(12) United States Patent
Feldstein et al.

(10) Patent No.: US 12,049,623 B2
(45) Date of Patent: Jul. 30, 2024

(54) COMPOSITIONS AND METHODS FOR IDENTIFYING POLYNUCLEOTIDES OF INTEREST

(71) Applicant: THE REGENTS OF THE UNIVERSITY OF CALIFORNIA, Oakland, CA (US)

(72) Inventors: Paul A. Feldstein, San Francisco, CA (US); James E. Lincoln, Woodland, CA (US)

(73) Assignee: THE REGENTS OF THE UNIVERSITY OF CALIFORNIA, Oakland, CA (US)

( * ) Notice: Subject to any disclaimer, the term of this patent is extended or adjusted under 35 U.S.C. 154(b) by 12 days.

(21) Appl. No.: 17/892,686

(22) Filed: Aug. 22, 2022

(65) Prior Publication Data

US 2023/0272374 A1 Aug. 31, 2023

Related U.S. Application Data

(60) Continuation of application No. 16/909,979, filed on Jun. 23, 2020, now Pat. No. 11,453,876, which is a division of application No. 15/737,297, filed as application No. PCT/US2016/039348 on Jun. 24, 2016, now Pat. No. 10,738,302.

(60) Provisional application No. 62/184,868, filed on Jun. 26, 2015.

(51) Int. Cl.
*C12N 15/10* (2006.01)
*C12Q 1/6869* (2018.01)
*C12Q 1/6874* (2018.01)

(52) U.S. Cl.
CPC ..... *C12N 15/1093* (2013.01); *C12N 15/1051* (2013.01); *C12N 15/1096* (2013.01); *C12Q 1/6869* (2013.01); *C12Q 1/6874* (2013.01)

(58) Field of Classification Search
None
See application file for complete search history.

(56) References Cited

U.S. PATENT DOCUMENTS

| | | |
|---|---|---|
| 8,158,595 B2 | 4/2012 | Galloway |
| 10,738,302 B2 | 8/2020 | Feldstein |
| 11,453,876 B2 | 9/2022 | Feldstein |
| 2004/0259079 A1 | 12/2004 | Barber |
| 2006/0029958 A1 | 2/2006 | Sakanyan |
| 2006/0074041 A1 | 4/2006 | Johnston |
| 2008/0207539 A1 | 8/2008 | Arbuthnot |
| 2014/0206546 A1 | 7/2014 | Chenchik |
| 2018/0155713 A1 | 6/2018 | Feldstein |

FOREIGN PATENT DOCUMENTS

| | | |
|---|---|---|
| WO | 2005021751 A | 3/2005 |
| WO | 2008058291 A2 | 5/2008 |
| WO | 2014022702 A2 | 2/2014 |
| WO | 2016210321 A2 | 12/2016 |

OTHER PUBLICATIONS

ISA/US, United States Patent and Trademark Office (USPTO), International Search Report and Written Opinion issued Jan. 10, 2017, related PCT international application No. PCT/US2016/039348, pp. 1-14, claims searched, pp. 15-29.
European Patent Office (EPO), extended European search report issued Dec. 12, 2018, related European patent application No. 16815419.3, pp. 1-9, claims searched, pp. 10-12.
Liang, Joe C., "A high-throughput, quantitative cell-based screen for efficient tailoring of RNA device activity", Nucleic Acids Research, 2012, vol. 40, No. 20, published online Jul. 18, 2012, pp. 1-14, supplementary data, 19 pages (33 pages total).
Shen, Shensi et al., "Dynamic signal processing by ribozyme-mediated RNA circuits to control gene expression", Nucleic Acids Research, 2015, vol. 43, No. 10, pubished online Apr. 27, 2015, pp. 5158-5170, Supplementary Information, 61 pages (74 pages total).

*Primary Examiner* — Sean McGarry
(74) *Attorney, Agent, or Firm* — O'BANION & RITCHEY LLP; John P. O'Banion

(57) ABSTRACT

Provided are constructs and methods useful for the screening and identification of polynucleotide sequences of interest, in particular promoters, RNA stability modifying sequences and transcriptional modifying sequences.

18 Claims, 36 Drawing Sheets

Specification includes a Sequence Listing.

```
       10         20         30         40         50         60         70         80         90        100
        *          *          *          *          *          *          *          *          *          *
  1 AGATCTGACCGTCCTGTCCGTATGACAGAGAAGTCAACCAGAGAGAAACACAGTTGTGTATATTACCTGGTGGCGCCGAATTCTGGAATTCTCGGGTG 100
    >>>>>                  >>>>>>>>>>>>>>>>>>>>>>>>>>>>>>>>>>>>>>>>>>>>>>>>>>>>>>>>>>>>>>>^^^^^^^^^^^
    P5                     E48                                                              Reverse transcriptase primer 1
         >>>>>>>                                                                            >>>>>>>>>>>
         D8                                                                                 Multiple cloning site (MCS)

110        120        130        140        150        160        170        180        190        200
          *          *          *          *          *          *          *          *          *          *
101 CCAAGGGTTCAGAGTTCTACAGTCCGACGATCGCGGCCGCGTCGACGCTTCCTGCAGGTGACCGTCCTGTCTCCTAGACGCGTTGCTGTGGCGTT 200
    >>>>>>>>>>>>>>>>>>>>>>>>>>>>>>>>>>>>>>>>>>>>>>>>>>>>>>>>>>>>>>>>>>>>>>>>>>>>>>>>>>>>> <<<<<<<<<<<
                                                                                           rep (pMB1)
                                                                                 >>>>>>>>
                                                                                 second D8
                                                                       >>>>>
                                                                       second P5
             >>>>>>>>>>>>>>>>>>>>>>>>>>>>>>>>>>>>>>>>>>>>>>>>>>>>>>>>>>>
             Multiple cloning site (MCS)

210        220        230        240        250        260        270        280        290        300
          *          *          *          *          *          *          *          *          *          *
201 TTTTCCATAGGCTCCGCCCCCCTGACGAGCATCACAAAAATCGACGCTCAAGTCAGAGGTGGCGAAACCCGACAGGACTATAAAGATACCAGGCGTTTCCC 300
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)
                                <<<<<<<<<<<<<<<<<<<<<<<<<<<<
                                seq2
    <<<<<<
    Reverse transcriptase primer 1
    <<<<<<<<<<<<<<<<<<<<<<<<<<<
    Primer 2
```

Fig. 2A

```
     310        320        330        340        350        360        370        380        390        400
301  CCTGGAAGCTCCCTGTGCGCTCTCCTGTTCCGATACCTGCCGCTTACCGGATACCTGTCCGCCTTTCTCCCTTCGGGAAGCGTGGCGCTTTCTCATAGCT  400
     rep (pMB1)

410        420        430        440        450        460        470        480        490        500
401  CACGCTGTAGGTATCTCAGTTCGGTGTAGGTCGTTCGCTCCAAGCTGGGCTGTGTGCACGAACCCCCCGTTCAGCCCGACCGCTGCGCCTTATCCGGTAA  500
     rep (pMB1)

510        520        530        540        550        560        570        580        590        600
501  CTATCGTCTTGAGTCCAACCCGGTAAGACACGACTTATCGCCACTGGCAGCAGCCACTGGTAACAGGATTAGCAGAGCGAGGTATGTAGGCGGTGCTACA  600
     rep (pMB1)

610        620        630        640        650        660        670        680        690        700
601  GAGTTCTTGAAGTGGTGGCCTAACTACGGCTACACTAGAAGAACAGTATTTGGTATCTGCGCTCTGCTGAAGCCAGTTACCTTCGGAAAAGAGTTGGTA  700
     rep (pMB1)

710        720        730        740        750        760        770        780        790        800
701  GCTCTTGATCCGGCAAACAAACCACCGCTGGTAGCGGTGGTTTTTTTGTTTGCAAGCAGCAGATTACGCGCAGAAAAAAGGATCTCAAGAAGATCCTTT  800
     rep (pMB1)
```

*Fig. 2B*

```
           810       820       830       840       850       860       870       880       890       900
             *         *         *         *         *         *         *         *         *         *
 801  GATCTTTTCTACGGGGTCTGACGCTCAGTGGAACGAAAACTCACGTTAAGGGATTTTGGTCATGAGATTATCAAAAAGGATCTTCACCTAGATCCTTTTA  900
             *         *         *         *         *         *         *         *         *         *
           910       920       930       940       950       960       970       980       990      1000
             *         *         *         *         *         *         *         *         *         *
 901  AATTAAAAATGAAGTTTTAAATCAATCTAAAGTATATATGAGTAAACTTGGTCTGACAGTTACCAATGCTTAATCAGTGAGGCACCTATCTCAGCGATCT 1000
      <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
                                                           ampR
          1010      1020      1030      1040      1050      1060      1070      1080      1090      1100
             *         *         *         *         *         *         *         *         *         *
1001  GTCTATTTCGTTCATCCATAGTTGCCTGACTCCCCGTCGTGTAGATAAACTACGATACGGGAGGGCTTACCATCTGGCCCCAGTGCTGCAATGATACCGCG 1100
      <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
      ampR
          1110      1120      1130      1140      1150      1160      1170      1180      1190      1200
             *         *         *         *         *         *         *         *         *         *
1101  AGACCCACGCTCACCGGCTCCAGATTTATCAGCAATAAACCAGCCAGCCGGAAGGGCCGAGAAGTGGTCCTGCAACTTTATCCGCCTCCATCCCATCCAG 1200
      <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
      ampR
          1210      1220      1230      1240      1250      1260      1270      1280      1290      1300
             *         *         *         *         *         *         *         *         *         *
1201  TCTATTAATTGTTGCGGGAAGCTAGAGTAAGTAGTTCGCCAGTTAATAGTTTGCGCAACGTTGTTGCCATTGCTACAGGCATCGTGGTGTCACGCTCGT 1300
      <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
      ampR
```

Fig. 2C

```
          1310      1320      1330      1340      1350      1360      1370      1380      1390      1400
            *         *         *         *         *         *         *         *         *         *
1301 CGTTTGGTATGGCTTCAGTTCATTCAGTTCCCGGTTCCCGGTTCCGGTTCCAACGATCAAGGCGAGTTACATGATCCCCCATGTTGTGCAAAAAGCGGTTAGCTCCTTCGGTCCTCC 1400
     vvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvv
     ampR 1410      1420      1430      1440      1450      1460      1470      1480      1490      1500
            *         *         *         *         *         *         *         *         *         *
1401 GATCGTTGTCAGAAGTAAGTTGGCCGCAGTGTTATCACTCATGGTTATGGCAGCACTGCATAATTCTCTTACTGTCATGCCATCCGTAAGATGCTTTTCT 1500
     vvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvv
     ampR 1510      1520      1530      1540      1550      1560      1570      1580      1590      1600
            *         *         *         *         *         *         *         *         *         *
1501 GTGACTGGTGAGTACTCAACCAAGTCATTCTGAGAATAGTGTATGCGGCGACCGAGTTGCTCTTGCCCGGCGTCAATACGGGATAATACCGCGCCACATA 1600
     vvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvv
     ampR 1610      1620      1630      1640      1650      1660      1670      1680      1690      1700
            *         *         *         *         *         *         *         *         *         *
1601 GCAGAACTTTAAAAGTGCTCATCATTGGAAAACGTTCTTCGGGGCGAAAACTCTCAAGGATCTTACCGCTGTTGAGATCGTTGAGATCCAGTTCGATGTAACCCACTCG 1700
     vvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvv
     ampR
```

*Fig. 2D*

```
            1710       1720       1730       1740       1750       1760       1770       1780       1790       1800
              *          *          *          *          *          *          *          *          *          *
1701 TGCACCCAACTGATCTTCAGCATCTTTTACTTTCACCAGCCGTTTCTGGGTGAGCAAACAGGAAGGCAAAATGCCGCAAAAAAGGGAATAAGGGCGACA 1800
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR 1810       1820       1830       1840       1850       1860       1870       1880       1890       1900
              *          *          *          *          *          *          *          *          *          *
1801 CGGAAATGTTGAATACTCATATACTCTTCCTTTTTCAATATTATTGAAGCATTTATCAGGGTTATTGTCTCATGAGCGGATACATATTTGAATGTATTTAGA 1900
                                            >>>>>>>>>>>>>>>>>>>>>>>>>>>>>>>>>>>>>>>>>>>>>>>>>>>>>>>>>>>>
                                            seq1
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR                                   <<<<<<<<<<<<<<<<<<<<<<<<<<<<<<<<<<<<<<<<<<<<<<<<<<<<<<<<<<<<
                                            ampr promoter 1910       1920
              *          *
1901 AAAATAAACAAATAGGGGTTCCGCG 1925
     <<<<<<<<<<<<<<<<<<<<<<<<<
     ampr promoter
1901 AAAATAAACAAATAGGGGTTCCGCG 1925
     <<<<<<<<<<<<<<<<<<<<<<<<<
     ampr promoter
```

*Fig. 2E*

```
          10         20         30         40         50         60         70         80         90        100
           *          *          *          *          *          *          *          *          *          *
  1 AGATCTGACAGTACTGTCCGTATGACAGCGAAGTCAAACGGCGAAACACACCTTGTGTGTATATTACCCGTTCCTAGGGTCTCGTGGGCTCGGTCGTCG 100
    >>>>>                 >>>>>>>>>>>>>>>>>>>>>>>>>>>>>>>>>>>>>>>>>>>>>>>>>>>>>>>>>>>>>>>>>>>>>>>>>>>>>
      P5                                 sArMV E50                                  Reverse transcriptase primer 3
         >>>>>>>>                                                                                        >>>>>>>
            D8                                                                                            Primer 4

110        120        130        140        150        160        170        180        190        200
           *          *          *          *          *          *          *          *          *          *
101 GCAGCGCTCGGTACCACTAGTTGACCGTCCTGTATGACAGAGAAGTCAACCAGAGAAACACACGTTGTGGTATATTACCTGGTGGCGCGCCGAATTC 200
    >>>>>                       >>>>>>>>>>>>>>>>>>>>>>>>>>>>>>>>>>>>>>>>>>>>>>>>>>>>>>>>>>>>>>>>>>>>>>>>>
    second P5                               sTRSV E48                               Multiple >>>>>>>>>>>>>
          >>>>>>>                                                                            cloning site (MCS)
            second D8
>>>>>>>   >>>>>>
Primer 4  Barcode insertion site 210        220        230        240        250        260        270        280        290        300
           *          *          *          *          *          *          *          *          *          *
201 TGGAATTCTCGGGTGCCAAGGGTTCAGAGTTCTACAGAGTTCCGACAGTCCGACAGTTCCTGCAGGTGACCGTCCTGTCTCTAGA 300
                                                                                  >>>>>>>>
                                                                                   third D8
                                                                              >>>>>
                                                                               third P5

>>>>>>>>>>>>>>>>>>>>>>>>>>>>>>>>>>>>>>>>>>>>>>>>>>>>>>>>>>>>>>
             Multiple cloning site (MCS)

>>>>>>>>>>>>>>>>>>>>
Reverse transcriptase primer 1
           >>>>>>>>>>>>>>>>>>>>>>>>>
                   Primer 2
```

Fig. 4A

```
       310        320        330        340        350        360        370        380        390        400
        *          *          *          *          *          *          *          *          *          *
301 CGCGTTGCTGGCGTTTTCCATAGGCTCCGCCCCCTGACGAGCATCACAAAAATCGACGCTCAAGTCAGAGGTGGCGAAACCCGACAGGACTATAAAGA 400
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

410        420        430        440        450        460        470        480        490        500
        *          *          *          *          *          *          *          *          *          *
401 TACCAGGCGTTTCCCCCTGGAAGCTCCCTCGTGCGCTCTCCTGTTCCGACCCTGTCCGCCTTACCGGATACCTGTCCGCCTTTCTCCCTTCGGGAAGCGTGG 500
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
                                              <<<<<<<<<<<<<
                                                seq2
    rep (pMB1)

510        520        530        540        550        560        570        580        590        600
        *          *          *          *          *          *          *          *          *          *
501 CGCTTTCTCATAGCTCACGCTGTAGGTATCTCAGTTCGGTGTAGTCGTTCGCTCCAAGCTGGGCTGTGTGCACGAACCCCCGTTCAGCCCGACCGCTG 600
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

610        620        630        640        650        660        670        680        690        700
        *          *          *          *          *          *          *          *          *          *
601 CGCCTTATCCGGTAACTATCGTCTTGAGTCCAACCCGGTAAGACACGACTTATCGCCACTGGCAGCAGCCACTGGTAACAGGATTAGCAGAGCGAGGTAT 700
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

710        720        730        740        750        760        770        780        790        800
        *          *          *          *          *          *          *          *          *          *
701 GTAGGCGGTGCTACAGAGTTCTTGAAGTGGTGGCCTAACTACGGCTACACTAGAAGAACAGTATTTGGTATCTGCGCTCTGCTGAAGCCAGTTACCTTCG 800
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)
```

*Fig. 4B*

```
       610        620        630        640        650        660        670        680        690        700
         *          *          *          *          *          *          *          *          *          *
601 CGCCTTATCCGGTAACTATGTCTTGAGTCTTGAGTCCAACCGGTAAGACACGACTTATCGCCACTGGCAGCAGCCACTGGTAACAGGATTAGCAGAGCGAGGTAT 700
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

710        720        730        740        750        760        770        780        790        800
         *          *          *          *          *          *          *          *          *          *
701 GTAGGCGGTGCTACAGAGTTCTTGAAGTGGTGGCCTAACTACGGCTACACTAGAAGAACAGTATTTGGTATCTGCGCTCTGCTGAAGCCAGTTACCTTCG 800
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

810        820        830        840        850        860        870        880        890        900
         *          *          *          *          *          *          *          *          *          *
801 GAAAAAGAGTTGGTAGCTCTTGATCCGGCAAACAAACCACCGCTGGTAGCGGTGGTTTTTTTGTTTGCAAGCAGCAGATTACGCGCAGAAAAAAAGGATC 900
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

910        920        930        940        950        960        970        980        990       1000
         *          *          *          *          *          *          *          *          *          *
901 TCAAGAAGATCCTTTGATCTTTTCTACGGGGTCTGACGCTCAGTGGAACGAAAACTCACGTTAAGGGATTTTGGTCATGAGATTATCAAAAAGGATCTTC 1000
    <<<<<<<<<<
    rep (pMB1)

1010       1020       1030       1040       1050       1060       1070       1080       1090       1100
         *          *          *          *          *          *          *          *          *          *
1001 ACCTAGATCCTTTTAAATTAAAAATGAAGTTTTAAATCAATCTAAAGTATATATGAGTAAACTTGGTCTGACAGTTACCAATGCTTAATCAGTGAGGCAC 1100
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR
```

*Fig. 4C*

```
       1110      1120      1130      1140      1150      1160      1170      1180      1190      1200
          *         *         *         *         *         *         *         *         *         *
1101 CTATCTCAGCGATCTGTCTATTTCGTTCATCCATAGTTGCCTGACTCCCCGTCGTGTAGATAACTACGATACGGGAGGCTTACCATCTGGCCCCAGTGC 1200
     vvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvv
     ampR 1210      1220      1230      1240      1250      1260      1270      1280      1290      1300
          *         *         *         *         *         *         *         *         *         *
1201 TGCAATGATACCGCGAGACCCACGCTCACCGGCTCCAGATTTATCAGCAATAAACCAGCCAGCCGGAAGGGCCGAGCGCAGAAGTGGTCCTGCAACTTTA 1300
     vvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvv
     ampR 1310      1320      1330      1340      1350      1360      1370      1380      1390      1400
          *         *         *         *         *         *         *         *         *         *
1301 TCCGGCCTCCATCCAGTCTATTAATTGTTGCCGGGAAGCTAGAGTAAGTAGTTCGCCAGTTAATAGTTTGCGCAACGTTGTTGCCATTGCTACAGGCATCG 1400
     vvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvv
     ampR 1410      1420      1430      1440      1450      1460      1470      1480      1490      1500
          *         *         *         *         *         *         *         *         *         *
1401 TGGTGTCACGCTCGTCGTTTGGTATGGCTTCATTCAGCTCCGGTTCCCAACGATCAAGGCGAGTTACATGATCCCCCATGTTGTGCAAAAAAGCGGTTAG 1500
     vvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvv
     ampR 1510      1520      1530      1540      1550      1560      1570      1580      1590      1600
          *         *         *         *         *         *         *         *         *         *
1501 CTCCCTTCGGTCCTCCGATCGTTGTCAGAAGTAAGTTGGCCGCAGTGTTATCACTCATGGTTATGCAGCACTGCATAATTCTTACTGTCATGCCATCC 1600
     vvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvv
     ampR
```

*Fig. 4D*

```
       1410       1420       1430       1440       1450       1460       1470       1480       1490       1500
         *          *          *          *          *          *          *          *          *          *
1401 TGGTGTCACGCTCGTCGTTTGGTATGGCTTCATTCAGCTCCGGTTCCCAACGATCAAGGCGAGTTACATGATCCCCATGTTGTGCAAAAAAGCGGTTAG
     vvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvv
     ampR 1510       1520       1530       1540       1550       1560       1570       1580       1590       1600
         *          *          *          *          *          *          *          *          *          *
1501 CTCCCTTCGGTCCTCCCCGATCGTTGTCAGAAGTAAGTTGGCCGCAGTGTTATCACTCATGGTTATGCAGCACTGCATAATTCTCTTACTGTCATGCCATCC
     vvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvv
     ampR 1610       1620       1630       1640       1650       1660       1670       1680       1690       1700
         *          *          *          *          *          *          *          *          *          *
1601 GTAAGATGCTTTTCTGTGACTGGTGAGTACTCAACCAAGTCATTCTGAGAATAGTGTATGCGGCGACCGAGTTGCTCTTGCCCGGCGTCAATACGGGATA
     vvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvv
     ampR 1710       1720       1730       1740       1750       1760       1770       1780       1790       1800
         *          *          *          *          *          *          *          *          *          *
1701 ATACCGCGCCACATAGCAGAACTTTAAAAGTGCTCATCATTGGAAAACGTTCTTCGGGGCGAAAACTCTCAAGGATCTTACCGCTGTTGAGATCCAGTTC
     vvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvv
     ampR 1810       1820       1830       1840       1850       1860       1870       1880       1890       1900
         *          *          *          *          *          *          *          *          *          *
1801 GATGTAACCCACTCGTGCACCCAACTGATCTTCAGCATCTTTTACTTTCACCAGCGTTTCTGGGTGAGCAAAAACAGGAAGGCAAAATGCCGCAAAAAAG
     vvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvvv
     ampR
```

*Fig. 4E*

```
           1910       1920       1930       1940       1950       1960       1970       1980       1990       2000
             *          *          *          *          *          *          *          *          *          *
1901 GGAATAAGGGCGACACGGAAATGTTGAATACTCATACTCTTCCTTTTTCAATATTATTGAAGCATTTATCAGGGTTATTGTCTCATGAGCGGATACATAT 2000
     <<<<<<<<<<<<<<<<<<<<<<<<<<<<<<<<<<<<<<<<<<<<<<<<<  >>>>>>>>>>>>>>>>>>>>>>>>>>>>>>>>>>>>>>>>>>>>>>>>>
     ampR                                                                    seq1
                                                     <<<<<<<<<<<<<<<<<<<<<<<<<<<<<<<<<<<<<<<<<<<<<<<<<
                                                      ampr promoter 2010       2020       2030       2040
             *          *          *          *
2001 TTTGAATGTATTTAGAAAAATAAACAAATAGGGGTTCCGCG 2040
     <<<<<<<<<<<<<<<<<<<<<<<<<<<<<<<<<<<<<<<<
     ampr promoter
```

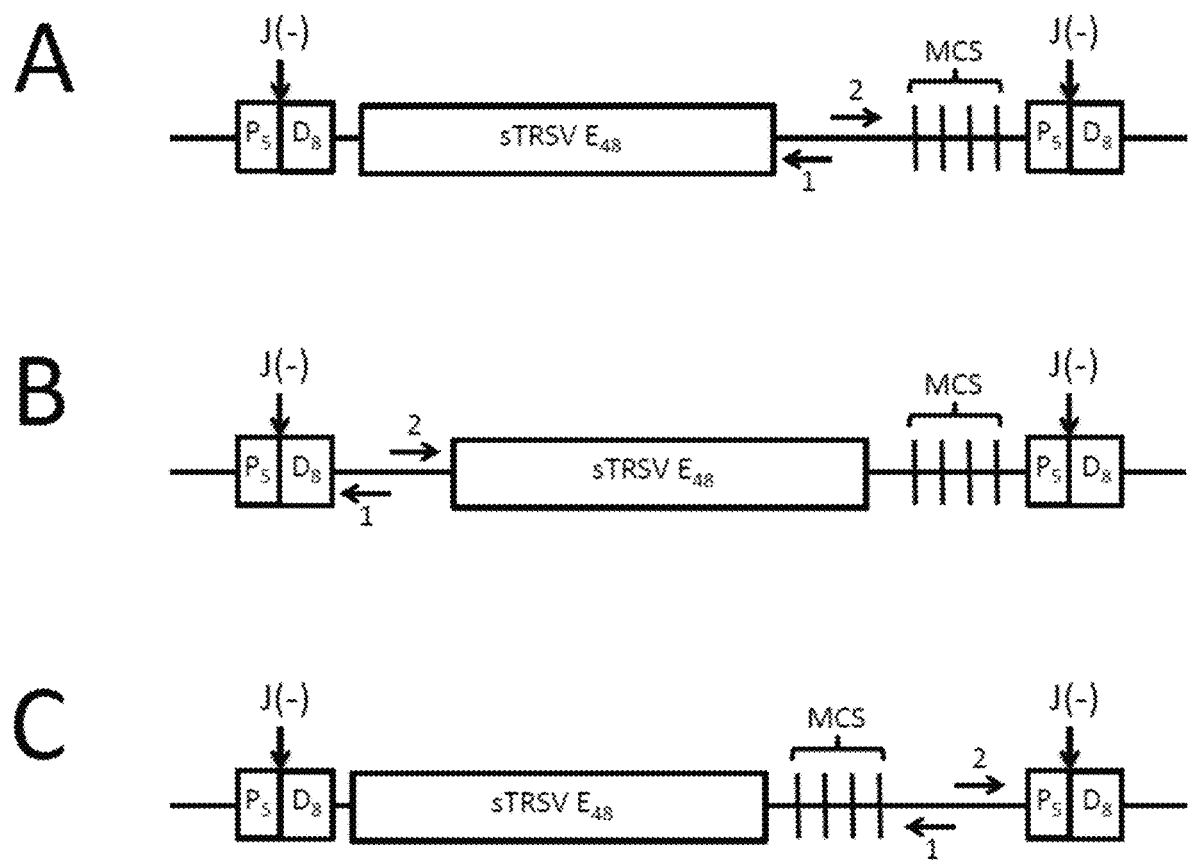
Fig. 16A-C

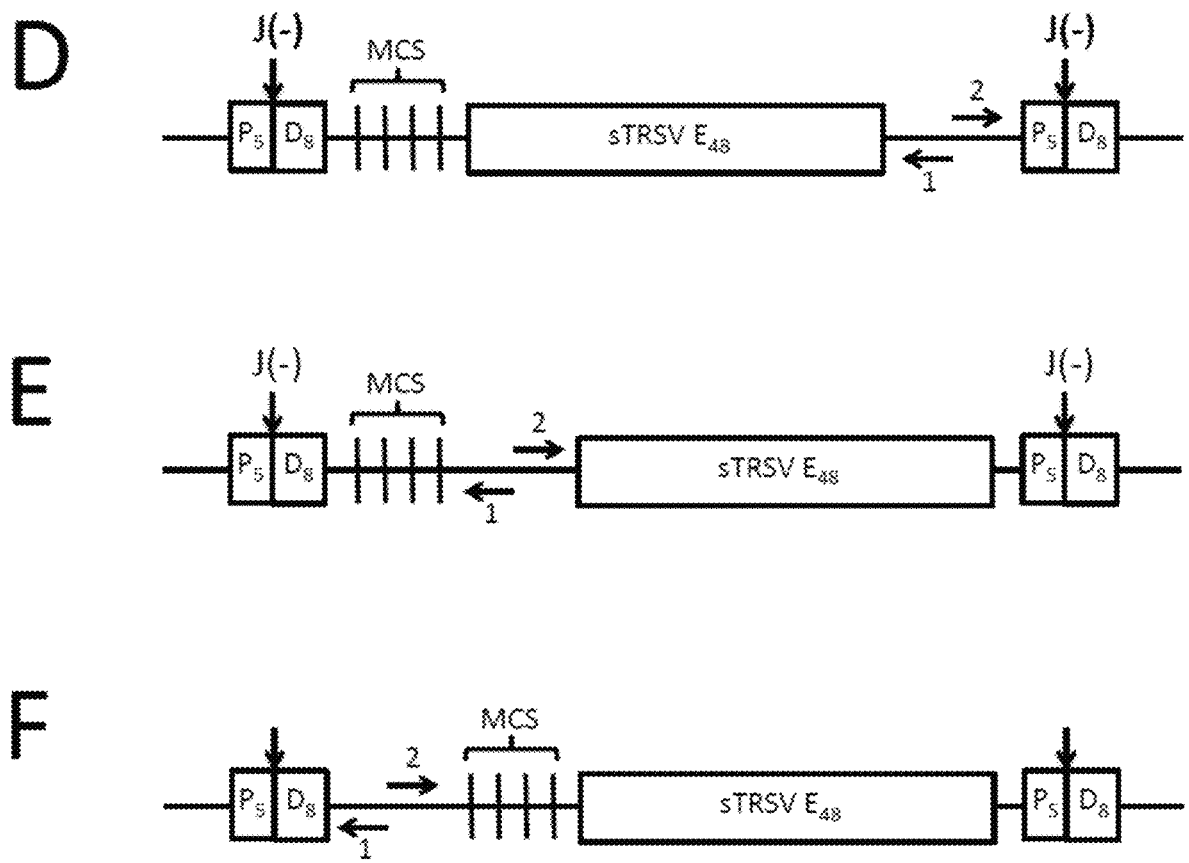
*Fig. 16D-F*

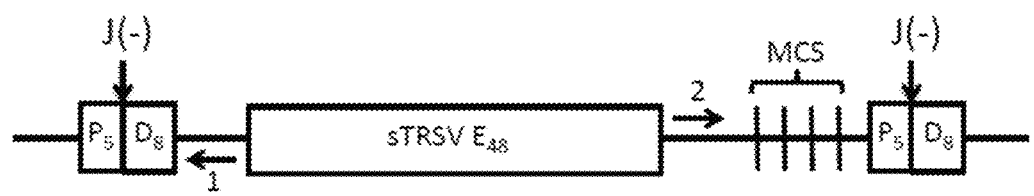
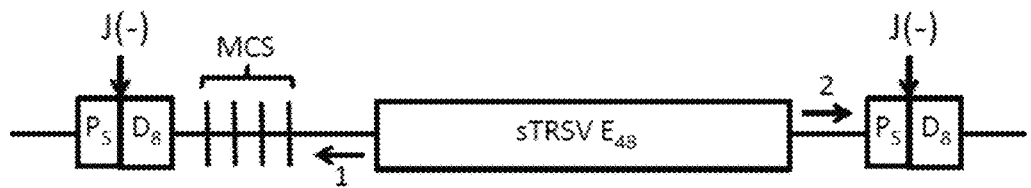
Fig. 17A-B

Fig. 18A-C

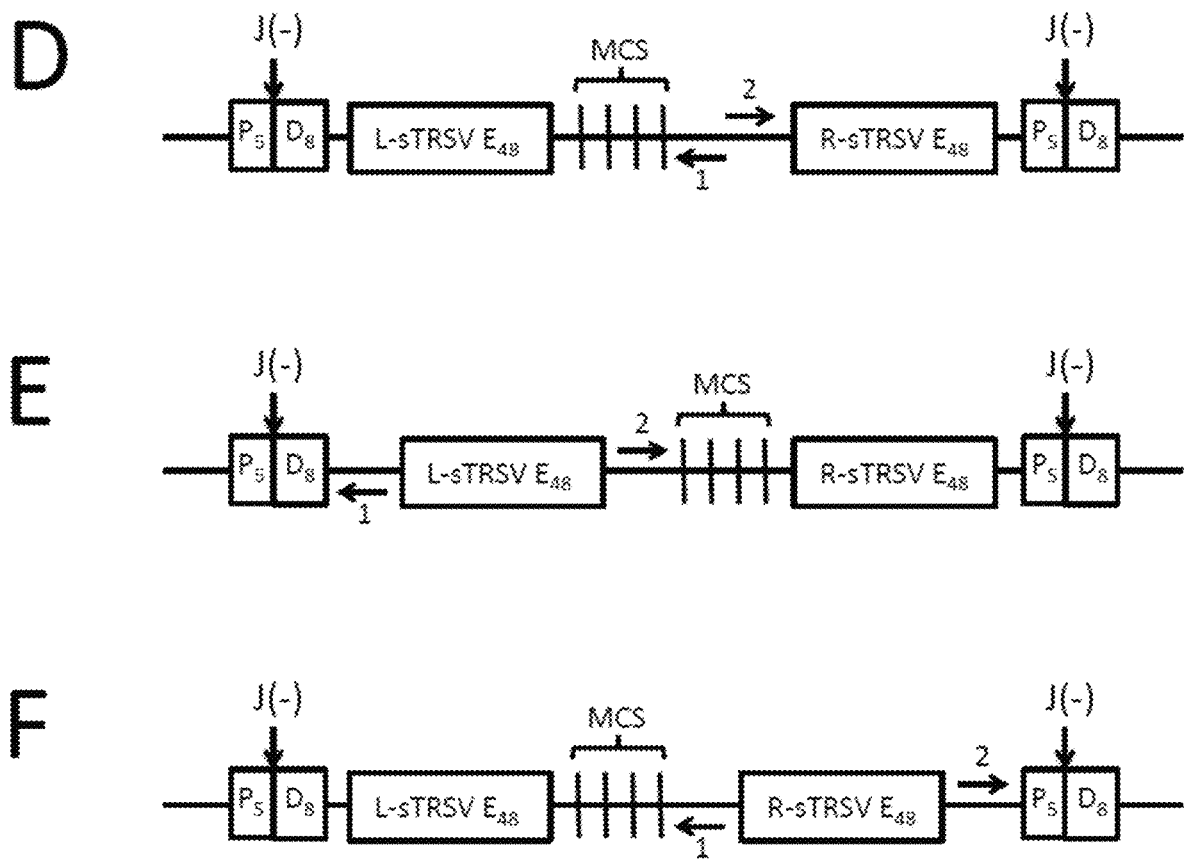
*Fig. 18D-F*

Fig. 24A-B

COMPOSITIONS AND METHODS FOR IDENTIFYING POLYNUCLEOTIDES OF INTEREST

CROSS-REFERENCE TO RELATED APPLICATIONS

This application is continuation of U.S. patent application Ser. No. 16/909,979 filed on Jun. 23, 2020, incorporated herein by reference in its entirety, which is a division of U.S. patent application Ser. No. 15/737,297 filed on Dec. 17, 2017, incorporated herein by reference in its entirety, which is the U.S. National Phase of Intl. Appl. No. PCT/US2016/039348, filed on Jun. 24, 2016, incorporated herein by reference in its entirety, which claims the benefit under 35 U.S.C. § 119(e) of U.S. Provisional Application No. 62/184,868, filed on Jun. 26, 2015, incorporated herein by reference in its entirety.

FIELD

Provided are constructs and methods useful for the screening and identification of polynucleotide sequences of interest, in particular promoters, RNA stability modifying sequences and transcriptional modifying sequences.

SEQUENCE LISTING

This application includes a sequence listing in a file entitled "CUB-00203_SL.xml" created on May 1, 2023 and having a 69,882,676 byte file size. The sequence listing is submitted through EFS-Web and is incorporated herein by reference in its entirety.

BACKGROUND

Currently available technologies for identifying sequences of interest, including promoters, transcriptional modifiers and RNA stability sequences, consist of computer annotation of sequenced genomes to find expressed regions. Generally, the sequence flanking the 5' end of an expressed sequence is "identified" as the promoter. This analysis is often paired with RNA sequencing which identifies the starts of the transcription. These methods do not yield the cloned promoter or allow promoter mutations to be evaluated.

SUMMARY

In one aspect, provided is a DNA plasmid useful for identifying a promoter. In some embodiments, the DNA plasmid comprises operably linked polynucleotides encoding: (a) a mini-monomer cassette, comprising a first ribozyme cleavage site and a second ribozyme cleavage site, and comprising between the first ribozyme cleavage site and the second ribozyme cleavage site: (i) a ribozyme catalytic core; (ii) a multiple cloning site polynucleotide comprising plurality of restriction endonuclease cleavage sites; and (iii) a reverse primer annealing polynucleotide located upstream or 5' to a forward primer annealing polynucleotide; and (b) a plasmid backbone, comprising an origin of replication. In some embodiments, the DNA plasmid comprises operably linked polynucleotides encoding: (a) a mini-monomer cassette, comprising in the 5' to 3' direction: (i) a first ribozyme cleavage site; (ii) a ribozyme catalytic core; (iii) a multiple cloning site polynucleotide comprising plurality of restriction endonuclease cleavage sites, a reverse primer annealing polynucleotide and a forward primer annealing polynucleotide; and (iv) a second ribozyme cleavage site; and (b) a plasmid backbone, comprising an origin of replication.

In a further aspect, provided is a DNA plasmid useful for identifying a promoter. In some embodiments, the DNA plasmid comprises operably linked polynucleotides encoding: (a) a mini-monomer cassette, comprising a first ribozyme cleavage site and a second ribozyme cleavage site, and comprising between the first ribozyme cleavage site and the second ribozyme cleavage site: (i) a ribozyme catalytic core; (ii) a reverse primer annealing polynucleotide; (iii) a forward primer annealing polynucleotide; and (iv) an inserted polynucleotide suspected of comprising a promoter; and (b) a plasmid backbone, comprising an origin of replication. In some embodiments, the DNA plasmid comprises operably linked polynucleotides encoding: (a) a mini-monomer cassette, comprising in the 5' to 3' direction: (i) a first ribozyme cleavage site; (ii) a ribozyme catalytic core; (iii) a reverse primer annealing polynucleotide; (iv) a forward primer annealing polynucleotide; (v) an inserted polynucleotide suspected of comprising a promoter; (vi) a second ribozyme cleavage site; (b) a plasmid backbone, comprising an origin of replication. In varying embodiments of the DNA plasmid, the polynucleotide suspected of comprising a promoter has from about 50 nucleotides or base pairs (bp) to about 2000 bp, e.g., from about 100 bp to about 1000 bp. In varying embodiments, the primer annealing polynucleotides are reverse transcriptase polymerase chain reaction (RT-PCR) primer annealing polynucleotides.

In varying embodiments of the DNA plasmid useful for identifying a promoter, the second ribozyme cleavage site is capable of being transcribed into RNA by a RNA polymerase when the inserted polynucleotide comprises a functional promoter. In varying embodiments, the promoter in the inserted polynucleotide suspected of comprising a promoter is functional in a eukaryotic cell. In varying embodiments, the promoter in the inserted polynucleotide suspected of comprising a promoter is functional in a prokaryotic cell. In varying embodiments, the inserted polynucleotide suspected of comprising a promoter is from a library of randomized chemically synthesized DNA sequences. In varying embodiments, the inserted polynucleotide suspected of comprising a promoter is from a genomic DNA library. In varying embodiments, the inserted polynucleotide suspected of comprising a promoter comprises a mutagenized promoter. In varying embodiments, the plasmid has from about 1800 bp to about 3800 bp, e.g., from about 1900 bp to about 2900 bp. In varying embodiments, the plasmid backbone does not comprise a promoter functional in a eukaryotic cell. In varying embodiments, the ribozyme catalytic core is derived from a hairpin ribozyme. In varying embodiments, the ribozyme catalytic core is derived from the negative strand self-cleavage domain (e.g., a hairpin ribozyme catalytic core) of a satellite RNA of a plant virus selected from the group consisting of the satellite RNA of tobacco ringspot virus (sTRSV), the satellite RNA of arabis mosaic virus (sArMV), and the satellite RNA of chicory yellow mottle virus (sCYMV). In varying embodiments, the ribozyme catalytic core is derived from the negative strand self-cleavage domain of the satellite RNA of tobacco ringspot virus (sTRSV). In varying embodiments, the ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 8. In varying embodiments, the ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 3. In varying embodiments, the ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 4. In varying embodiments, the ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 5. In varying embodiments, the first, second and/or third ribozyme cleavage sites are hairpin ribozyme cleavage sites or sites cleavable by a hairpin ribozyme catalytic core. In varying embodiments, the first, second and/or third ribozyme cleavage sites have a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 6. In varying embodiments, the plasmid does not comprise upstream of or 5' to the mini-monomer cassette, a promoter functional in a prokaryotic cell that promotes the transcription of the mini-monomer cassette in the sense orientation. In varying embodiments, the plasmid further comprises a control promoter. In varying embodiments, the control promoter is functional in a prokaryotic cell. In varying embodiments, the control promoter is positioned upstream of or 5' to the mini-monomer cassette. In varying embodiments, the promoter functional in a prokaryotic cell comprises a bacteriophage promoter, e.g., selected from the group consisting of T7, T3 and SP6. In varying embodiments, the plasmid or plasmid backbone comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 1. In varying embodiments, the plasmid backbone comprises an expression cassette encoding a selection marker. In varying embodiments, the expression cassette is in the antisense orientation from the ribozyme catalytic core. In varying embodiments, the expression cassette is in the sense orientation to the ribozyme catalytic core. In varying embodiments, the selection marker comprises a polynucleotide encoding a gene or protein conferring antibiotic resistance, heat tolerance, fluorescence, luminescence or rescue of auxotrophic growth for specific amino acids or nucleotides. In varying embodiments, the step of transcribing the population of plasmids into RNA is performed in the presence and absence of an adjusted external factor. In varying embodiments, the adjusted external factor is selected from the group consisting of temperature, pH, ion concentrations, ionic strength, salt concentration, calcium concentration, endoplasmic reticulum stress, hormones and ligands, heavy metals, toxins, glucose, the presence of virus, fungi, bacteria or other pathogens.

In a further aspect, provided are methods of identifying functional promoter sequences. In some embodiments, the methods comprise:
 a) providing a population of plasmids as described above and herein;
 b) transcribing the population of plasmids into RNA; wherein the second ribozyme cleavage site is transcribed by a RNA polymerase when the inserted polynucleotide comprises a functional promoter; wherein RNA transcripts comprising the mini-monomer cassette self-cleave from the transcript, thereby forming a population of circularized RNA transcripts of self-cleaved mini-monomer cassettes;
 c) reverse transcribing into cDNA the population of circularized RNA transcripts of self-cleaved mini-monomer cassettes, thereby forming a population of cDNA reverse-transcripts of self-cleaved mini-monomer cassettes; and
 d) sequencing the inserted polynucleotides comprising a functional promoter in the population of cDNA reverse-transcripts of self-cleaved mini-monomer cassettes, whereby functional promoter sequences are identified.

In varying embodiments, the step of transcribing the population of plasmids into RNA is performed in vitro. In varying embodiments, the step of transcribing the population of plasmids into RNA is performed in vivo. In varying embodiments, the functional promoter is functional in a eukaryotic cell. In varying embodiments, the functional promoter is functional in a prokaryotic cell. In varying embodiments, the methods further comprise, after step b), the step of purifying or isolating RNA from non-RNA. In varying embodiments, the methods further comprise, after step b), the step of purifying or isolating the population of circularized RNA transcripts of self-cleaved mini-monomer cassettes. In some embodiments, the reverse transcribing step comprises amplifying from the forward and reverse primer annealing polynucleotides. In some embodiments, the sequencing step comprises deep sequencing. In some embodiments, statistical analyses of a population of RT-PCR products are performed and the identified promoters are ordered by strength. In some embodiments, the sequencing step comprises amplifying from the forward and reverse primer annealing polynucleotides (e.g., for PCR or RT-PCR).

In a related aspect, provided is a DNA plasmid useful for identifying a RNA stability modifier or a transcription modifier. In some embodiments, the DNA plasmid comprises operably linked polynucleotides encoding in the 5' to 3' direction:
 (a) a test promoter, wherein the test promoter is functional in a eukaryotic cell or in a prokaryotic cell;
 (b) a mini-monomer cassette, comprising:
  (i) a first ribozyme cleavage site;
  (ii) a ribozyme catalytic core;
  (iii) a reverse primer annealing polynucleotide (e.g., for PCR or RT-PCR);
  (iv) a forward primer annealing polynucleotide (e.g., for PCR or RT-PCR);
  (v) an inserted polynucleotide suspected of comprising a RNA stability modifier or a transcription modifier;
  (vi) a second ribozyme cleavage site;
 (c) a plasmid backbone comprising an origin of replication.

In another aspect, provided is a DNA plasmid useful for identifying a RNA stability modifier or a transcription modifier. In some embodiments, the DNA plasmid comprises operably linked polynucleotides encoding in the 5' to 3' direction:
 (a) a test promoter, wherein the test promoter is functional in a eukaryotic cell or in a prokaryotic cell;
 (b) a first mini-monomer cassette, comprising:
  (i) a first ribozyme cleavage site;
  (ii) a first ribozyme catalytic core;
  (iii) a first reverse primer annealing polynucleotide;
  (iv) a first forward primer annealing polynucleotide;
  (v) a barcode polynucleotide
  (vi) a second ribozyme cleavage site;

(c) a second mini-monomer cassette, comprising:
   (i) the second ribozyme cleavage site;
   (ii) a second ribozyme catalytic core;
   (iii) a second reverse primer annealing polynucleotide;
   (iv) a second forward primer annealing polynucleotide;
   (v) an inserted polynucleotide suspected of comprising a RNA stability modifier or a transcription modifier;
   (vi) a third ribozyme cleavage site;
(d) a plasmid backbone comprising an origin of replication. In varying embodiments, the barcode polynucleotide comprises a random DNA sequence comprising from about 10 to about 20 N residues. In varying embodiments, the primer annealing polynucleotides are reverse transcriptase polymerase chain reaction (RT-PCR) primer annealing polynucleotides.

In varying embodiments of the DNA plasmid useful for identifying a RNA stability modifier or a transcription modifier, the polynucleotide suspected of comprising a RNA stability modifier or a transcription modifier has from about 50 bp to about 1000 bp. In varying embodiments, the polynucleotide suspected of comprising a RNA stability modifier or a transcription modifier comprises an enhancer. In varying embodiments, the inserted polynucleotide suspected of comprising a RNA stability modifier or a transcription modifier is located 5' of the first ribozyme cleavage site. In varying embodiments, the promoter functional in a eukaryotic cell comprises a promoter from the same species as the inserted polynucleotide suspected of comprising a RNA stability modifier or a transcription modifier. In some embodiments, the inserted polynucleotide suspected of comprising a RNA stability modifier or a transcription modifier is from a library of randomized chemically synthesized DNA sequences. In varying embodiments, the inserted polynucleotide suspected of comprising a RNA stability modifier or a transcription modifier is from a genomic DNA library. In varying embodiments, the inserted polynucleotide suspected of comprising a RNA stability modifier or a transcription modifier comprises a mutagenized RNA stability modifier or a transcription modifier. In varying embodiments, the first and second ribozyme catalytic cores are independently derived from first and second hairpin ribozymes. In varying embodiments, the first and second ribozyme catalytic cores are independently derived from the negative strand self-cleavage domain (e.g., a hairpin ribozyme catalytic core) of a plant virus satellite RNA selected from the group consisting of the satellite RNA of tobacco ringspot virus (sTRSV), the satellite RNA of arabis mosaic virus (sArMV), and the satellite RNA of chicory yellow mottle virus (sCYMV). In some embodiments, the first and second ribozyme catalytic cores are different. In varying embodiments, the first and second ribozyme catalytic cores are the same. In varying embodiments, the first or second ribozyme catalytic core is derived from the negative strand self-cleavage domain the satellite RNA of tobacco ringspot virus (sTRSV). In varying embodiments, the first and/or second ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 8. In varying embodiments, the first and/or second ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 3. In varying embodiments, the first and/or second ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 4. In varying embodiments, the first and/or second ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 5. In varying embodiments, the first, second and/or third ribozyme cleavage sites are hairpin ribozyme cleavage sites or sites cleavable by a hairpin ribozyme catalytic core. In varying embodiments, the first, second and/or third ribozyme cleavage sites comprise a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 7. In varying embodiments, the first, second and/or third ribozyme cleavage sites have a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 6. In varying embodiments, the plasmid or plasmid backbone comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 2. In varying embodiments, the plasmid does not comprise upstream of or 5' to the mini-monomer cassette, a promoter functional in a prokaryotic cell that promotes the transcription of the mini-monomer cassette in the sense orientation. In varying embodiments, the plasmid further comprises a control promoter. In varying embodiments, the control promoter is functional in a prokaryotic cell. In varying embodiments, the control promoter is positioned upstream of or 5' to the mini-monomer cassette. In varying embodiments, the promoter functional in a prokaryotic cell comprises a bacteriophage promoter, e.g., selected from the group consisting of T7, T3 and SP6. In varying embodiments, the plasmid backbone comprises an expression cassette encoding a selection marker. In varying embodiments, the expression cassette is in the antisense orientation from the ribozyme catalytic core. In varying embodiments, the expression cassette is in the sense orientation to the ribozyme catalytic core. In varying embodiments, the selection marker comprises a polynucleotide encoding a gene or protein conferring antibiotic resistance, heat tolerance, fluorescence, luminescence or rescue of auxotrophic growth for specific amino acids or nucleotides. In varying embodiments, the promoter functional in a eukaryotic cell is located 3' of the third ribozyme cleavage site. In such embodiments, the plasmid has from about 1800 bp to about 3800 bp, e.g., from about 1900 bp to about 2900 bp. In varying embodiments, the promoter functional in a eukaryotic cell is located 5' of the first ribozyme cleavage site. In such embodiments, the construct has no upper size limit, but the plasmid optionally can have from about 2100 bp to about 3100 bp, e.g., from about 2100 bp to about 2250 bp.

In a further aspect, provided are methods of identifying RNA stability modifying and/or transcription modifying sequences. In some embodiments, the method comprises:
   a) providing a population of plasmids useful for identifying a RNA stability modifier or a transcription modifier as described above and herein;
   b) sequencing the first and second mini-monomer cassettes; thereby linking the barcode polynucleotide to a unique inserted polynucleotide suspected of comprising a RNA stability modifier;

c) transcribing in vitro the population of plasmids into RNA from a control promoter (e.g., a promoter functional in a prokaryotic cell), wherein RNA transcripts comprising the first and second mini-monomer cassettes self-cleave from the transcript;

d) sequencing the self-cleaved first and second mini-monomer cassettes transcribed in vitro in step c); thereby controlling for cleavage and circularization efficiency;

e) transcribing either in vitro or in a population of host cells the population of plasmids into RNA from a test promoter, wherein the test promoter is functional in a eukaryotic cell or in a prokaryotic cell, wherein RNA transcripts comprising the first and second mini-monomer cassettes self-cleave from the transcript;

f) sequencing the self-cleaved first and second mini-monomer cassettes transcribed in step e);

g) comparing the relative abundance or frequency of the self-cleaved second mini-monomer cassettes transcribed in vitro in step c) with the self-cleaved second mini-monomer cassettes transcribed in step e), wherein a higher or increased relative abundance or frequency of the self-cleaved second mini-monomer cassettes transcribed in step e) identifies RNA stabilizing sequences or transcription enhancer sequences in the second mini-monomer cassette, and wherein a lower or decreased relative abundance or frequency of the self-cleaved second mini-monomer cassettes transcribed in step e) identifies RNA destabilizing sequences or transcription reduction sequences in the second mini-monomer cassette; and h) comparing the ratios of the relative abundance or frequency of the self-cleaved first mini-monomers to their linked self-cleaved second mini-monomers produced in vitro in step c) with those produced in step e), wherein a substantially unchanged and/or a substantially 1:1 ratio, and an increased relative abundance or frequency of the self-cleaved second mini-monomer cassettes transcribed in step e) identifies a transcriptional enhancer;

wherein a ratio showing a higher relative abundance of the self-cleaved second mini-monomer, and an increased relative abundance or frequency of the self-cleaved second mini-monomer cassettes transcribed in step e) identifies a RNA stabilizing sequence;

wherein a substantially unchanged and/or a substantially 1:1 ratio, and a decreased relative abundance or frequency of the self-cleaved second mini-monomer cassettes transcribed in step e) identifies a transcriptional reducing sequence; and wherein a ratio showing a lower relative abundance of the self-cleaved second mini-monomer, and a decreased relative abundance or frequency of the self-cleaved second mini-monomer cassettes transcribed in a host cell in step g) identifies a RNA destabilizing sequence.

In a further aspect, provided are methods of identifying a polynucleotide sequence bound by a transcription factor, comprising:

a) providing a population of plasmids as described above and herein for use in identifying RNA stability/transcription modifying sequences;

b) sequencing the first and second mini-monomer cassettes; thereby linking the barcode polynucleotide to a unique inserted polynucleotide suspected of comprising a RNA stability modifier;

c) transcribing in vitro the population of plasmids into RNA from the control promoter (e.g., a promoter functional in a prokaryotic cell), wherein RNA transcripts comprising the first and second mini-monomer cassettes self-cleave from the transcript;

d) sequencing the self-cleaved first and second mini-monomer cassettes transcribed in vitro; thereby controlling for cleavage and circularization efficiency;

e) transcribing the population of plasmids into RNA from the test promoter (e.g., a promoter functional in a eukaryotic or a prokaryotic cell), wherein the transcribing is performed in a population of host cells and in the presence and absence of an inhibitory nucleic acid that inhibits or reduces the expression of the transcription factor, wherein RNA transcripts comprising the first and second mini-monomer cassettes self-cleave from the transcript;

f) sequencing the self-cleaved first and second mini-monomer cassettes transcribed in a host cell;

g) comparing the relative abundance or frequency of the self-cleaved second mini-monomer cassettes transcribed in the host cell in the presence of the inhibitory nucleic acid with the self-cleaved second mini-monomer cassettes transcribed in a host cell in the absence of the inhibitory nucleic acid, wherein a higher or increased relative abundance or frequency of the self-cleaved second mini-monomer cassettes transcribed in a host cell in the absence of the inhibitory nucleic acid identifies the polynucleotide sequence bound by the transcription factor. In varying embodiments, the inhibitory nucleic acid is an interfering RNA polynucleotide (RNAi).

In varying embodiments of the methods, the step of transcribing the population of plasmids into RNA is performed in the presence and absence of an adjusted external factor. In varying embodiments, the adjusted external factor is selected from the group consisting of temperature, pH, ion concentrations, ionic strength, salt concentration, calcium concentration, endoplasmic reticulum stress, hormones and ligands, heavy metals, toxins, glucose, the presence of virus, fungi, bacteria or other pathogens. In varying embodiments, the methods further comprise, after step c), the step of purifying or isolating RNA from non-RNA. In varying embodiments, the methods further comprise, after step c), the step of purifying or isolating the population of circularized RNA transcripts of self-cleaved mini-monomer cassettes. In varying embodiments, the reverse-transcribing step comprises amplifying from the first forward and reverse primer annealing polynucleotides (e.g., for PCR or RT-PCR) and the second forward and reverse primer annealing polynucleotides (e.g., for PCR or RT-PCR), respectively. In varying embodiments, the sequencing step comprises deep sequencing. In varying embodiments, the sequencing step comprises amplifying from the first forward and reverse primer annealing polynucleotides (e.g., for PCR or RT-PCR) and the second forward and reverse primer annealing polynucleotides (e.g., for PCR or RT-PCR), respectively. In varying embodiments, statistical analyses of a population of RT-PCR products are performed and the identified RNA stability modifying and/or transcription modifying sequences are ordered by strength.

In a further aspect, provided is a host cell or a population of host cells comprising a DNA plasmid or a population of DNA plasmids, as described above and herein. In varying embodiments, the host cell or population of host cells is a prokaryotic cell or a eukaryotic cell. In varying embodiments, the host cell or population of host cells is selected from an archael cell, a bacterial cell, an animal cell (e.g., a mammalian cell or an insect cell), a plant cell, or a fungal cell.

In a further aspect, provided are kits comprising one or more plasmids or one or more populations of plasmids, as described above and herein.

In a further aspect, provided is a polynucleotides comprising one or more promoters selected from the group consisting of SEQ ID NOs: 10-73473. Also provided is an expression cassette comprising one or more promoters selected from the group consisting of SEQ ID NOs: 10-73473. Also provided is a plasmid comprising an expression cassette comprising one or more promoters selected from the group consisting of SEQ ID NOs: 10-73473. Also provided is a host cell or a population of host cells, each comprising an expression cassette comprising one or more promoters selected from the group consisting of SEQ ID NOs: 10-73473. In some embodiments, the expression cassette is in a plasmid. In some embodiments, the expression cassette is incorporated into the genome of the host cell. In some embodiments, the host cell is selected from an archael cell, a bacterial cell, an animal cell, a plant cell, or a fungal cell.

In a further aspect, provided are methods for producing an RNA polynucleotide of interest. In some embodiments, the methods comprise expressing an RNA molecule from a polynucleotide operably linked to one or more promoters selected from the group consisting of SEQ ID NOs: 10-73473. In varying embodiments, the RNA molecule encodes a protein. In varying embodiments, the RNA molecule is non-coding RNA. In varying embodiments, the RNA molecule is selected from the group consisting of mRNA, rRNA, tRNA, guide RNA and micro RNA. In varying embodiments, the method is performed in vivo (e.g., in a cell) or in vitro.

Definitions

The term "RNA stability modifier" refers to a DNA motif that modulates (e.g., increases or decreases) the rate of degradation of the RNA and thus change the half-life of the RNA. Mechanisms include binding of proteins or polynucleotides to the "RNA stability modifier" that create this change (e.g., in iron regulation or in cells exposed to hormones). See, e.g., Addess, et al., *J. Mol. Biol.* 274 (1): 72-83. Reference to "RNA stability modifier" includes polynucleotides that bind a polynucleotide involved in decreasing RNA stability thus increasing RNA turnover, double stranded polynucleotides that are cleaved by a RNAse (e.g., Dicer) and transcriptional terminators.

The term "transcription modifier" refers to a DNA motif that modulates (e.g., increases or decreases) promoter strength.

As used herein, "promoter strength" or "promoter efficiency" interchangeably refer to the number completed transcripts per unit time which is obtained by sequencing the RT-PCR product population.

The term "enhancer" refers to a DNA motif that increases promoter strength. Enhancers recruit transcription factors to bind in the vicinity of promoters, thus increasing effectiveness of the promoter or promoter specificity to certain external factors (light, hormones, etc.).

The term "repressor" refers to a DNA motif that decreases promoter strength. Repressors recruit transcription factors to bind in the vicinity of promoters, thus decreasing effectiveness of the promoter or promoter specificity to certain external factors (light, hormones, etc.).

The term "mini-monomer cassette" refers to a polynucleotide sequence comprising a ribozyme catalytic core and upstream and downstream ribozyme cleavage sites, such that when transcribed into RNA, the ribozyme catalytic core self-cleaves the mini-monomer cassette at the upstream and downstream ribozyme cleavage sites out of the context of a longer polynucleotide. The 5' and 3' ends of the excised polynucleotide ligate to form a circularized polynucleotide.

The term "ribozyme catalytic core" refers to the subsequence of a ribozyme capable of carrying out cleavage of a RNA molecule.

The term "ribozyme cleavage site" refers to the sequences recognized and cleaved by a ribozyme catalytic core.

The terms "identical" or percent "identity," and variants thereof in the context of two or more polynucleotide or two or more amino acid sequences, refer to two or more sequences or subsequences that are the same. Sequences are "substantially identical" if they have a specified percentage of nucleic acid residues or amino acid residues that are the same (i.e., at least 60% identity, optionally at least 65%, 70%, 75%, 80%, 85%, 90%, 95%, 96%, 97%, 98%, or 99% identity to a reference sequence (e.g., SEQ ID NOs: 1-73473) over a specified region (or the whole reference sequence when not specified)), when compared and aligned for maximum correspondence over a comparison window, or designated region as measured using any sequence comparison algorithm known in the art (GAP, BESTFIT, BLAST, Align, FASTA, and TFASTA in the Wisconsin Genetics Software Package, Genetics Computer Group (GCG), 575 Science Dr., Madison, WI), Karlin and Altschul Proc. Natl. Acad. Sci. (U.S.A.) 87:2264-2268 (1990) set to default settings, or by manual alignment and visual inspection (see, e.g., Ausubel et al., Current Protocols in Molecular Biology (1995-2014). Optionally, the identity exists over a region that is at least about 100, 200, 300, 400, 500, 600, 800, 1000, or more, nucleic acids in length, or over the full-length of the sequence.

BRIEF DESCRIPTION OF THE DRAWINGS

FIGS. 2A-E illustrate an annotated polynucleotide sequence of a vector map for a plasmid useful for screening for promoters.

FIG. 4A-F illustrate an annotated polynucleotide sequence of a vector map for a plasmid useful for screening for RNA stability modifiers and/or transcription modifiers.

FIGS. 16A-F illustrate six functional arrangements between the ribozyme cleavage sites of the ribozyme core, MCS that will contain the test promoter sequence, and the primer 1 and 2 sequences, where the primer 1 and 2 sequences are adjacent to each other. When these illustrative mini-monomer cassettes are transcribed, ribozyme cleaved and ligated, reverse-transcribed and PCR amplified the test promoter sequence is recovered.

FIGS. 17A-B illustrate two additional functional arrangements between the ribozyme cleavage sites of the ribozyme core, MCS that will contain the test promoter sequence, and the primer 1 and 2 sequences, where the primer 1 and 2 sequences are not adjacent to each other. When these illustrative mini-monomer cassettes are transcribed, ribozyme cleaved and ligated, reverse-transcribed and PCR amplified, the test promoter sequence is recovered.

FIGS. 18A-F illustrate six functional arrangements between the ribozyme cleavage sites in which the MCS (with or without comprising an insert comprising a test promoter sequence) is inserted into loop 2 of stem 4 (see, FIG. 5) of the ribozyme core and the primer 1 and 2 sequences, where the primer 1 and 2 sequences are either adjacent to each other (FIG. 18A-D) or are not adjacent to each other (FIG. 18E-F). L-sTRSV $E_{48}$ and R-sTRSV$E_{48}$ represent the left and right halves of the ribozyme catalytic core respectively. When these illustrative mini-monomer cassettes are transcribed, ribozyme cleaved and ligated, reverse-transcribed and PCR amplified, the test promoter sequence is recovered.

DETAILED DESCRIPTION

1. Introduction

Figure 1:
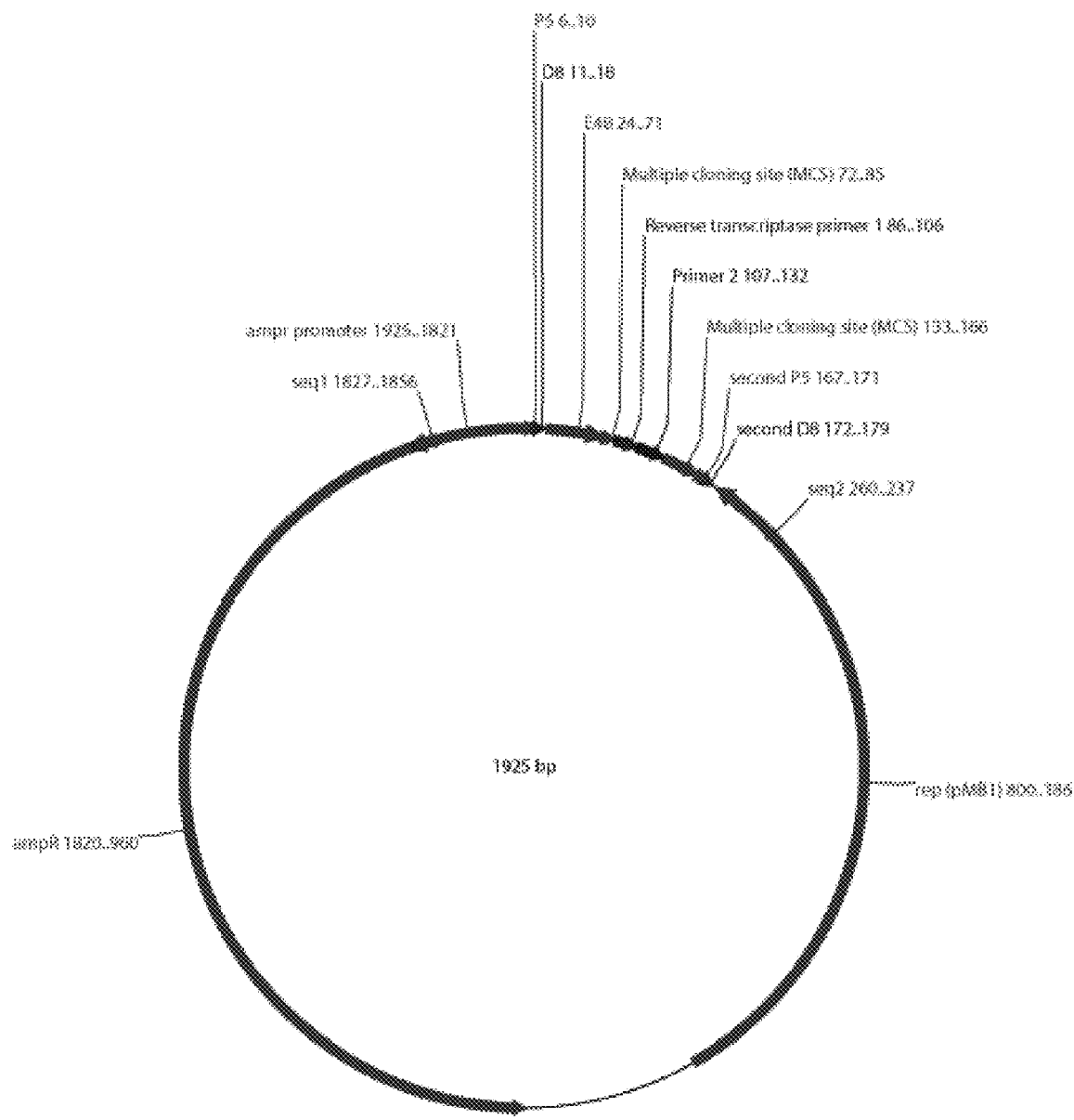
FIG. 1 illustrates a schematic of a vector map for a plasmid useful for screening for promoters.
Figure 3:
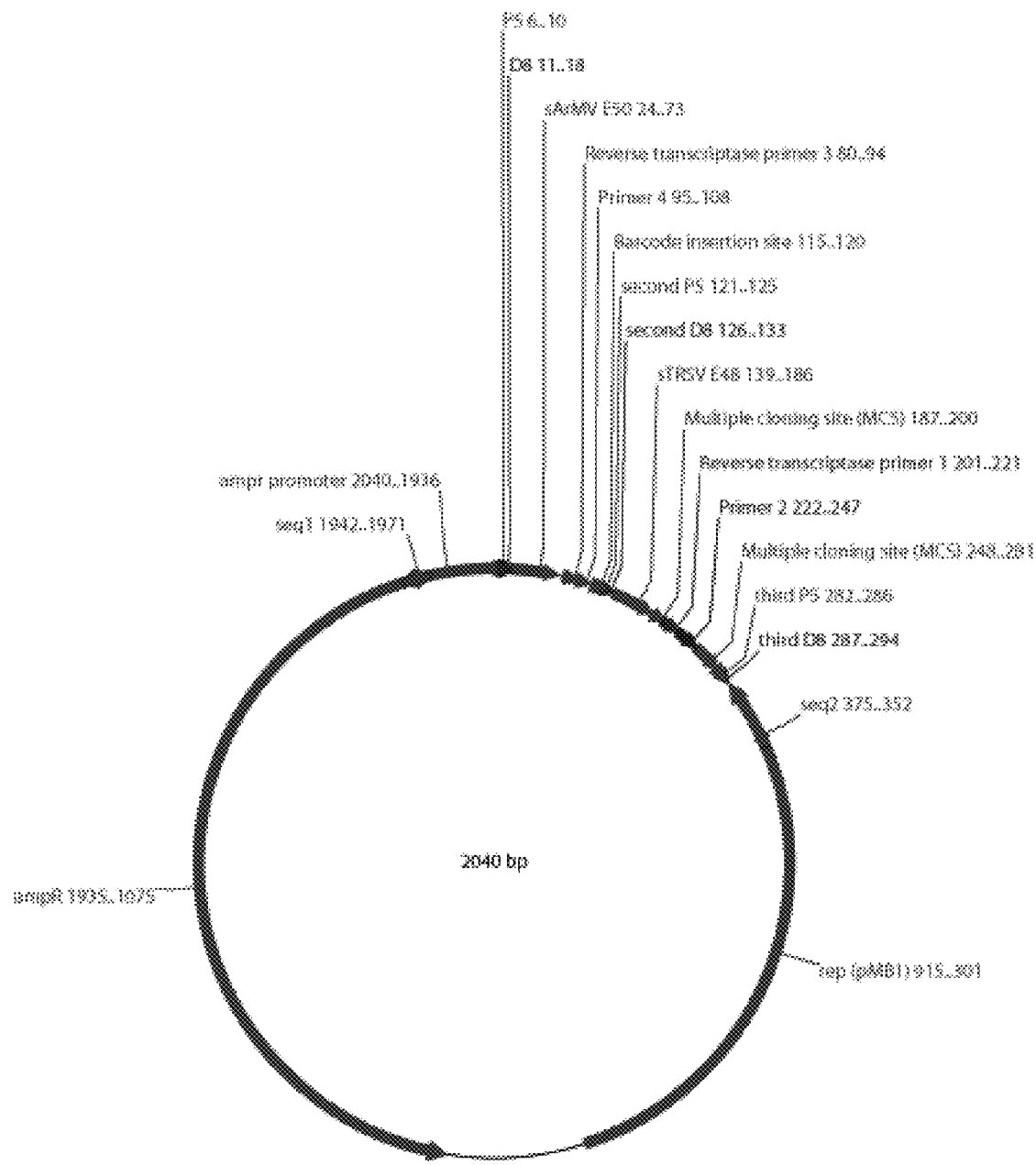
FIG. 3 illustrates a schematic of a vector map for a plasmid useful for screening for RNA stability modifiers and/or transcription modifiers.

Provided are constructs designed for cloning of either prokaryotic, eukaryotic or random nucleotide DNA fragments within a self-cleaving and circularizing derivative of a ribozyme catalytic core of the (−) strand of the satellite RNA (e.g., tobacco ringspot virus (sTRSV)) in a small circular DNA plasmid that allows production of longer than unit length RNAs when the cloned fragment contains a promoter sequence. Ribozyme cleavage and circularization of said longer than unit length RNAs allows for recovery of the promoter containing sequences by reverse transcriptase-polymerase chain reaction (RT-PCR) either before or after purification of the now smaller RNA circles. The constructs facilitate the easy selection of desired polynucleotides (e.g., functional promoters, RNA stability modifiers, transcriptional modifiers) within DNA fragments with a natural selection by the amount of circular RNA produced of promoters based on their respective abilities to produce RNA.

Employing straightforward methods, desired sequences can be identified and recovered in a short time period. As desired, functional promoters, RNA stability modifying sequences and transcriptional modifying sequences can be directly recovered without the need to have or determine upstream sequences as is the case where promoters are found indirectly by cloning expressed sequence tags (ESTs). Promoters, RNA stability modifying sequences and transcriptional modifying sequences can be found in the DNA from any eukaryotic organism or can be found among random DNA sequences thus obviating the need to use promoters from heterologous organisms. Promoters, RNA stability modifying sequences and transcriptional modifying sequences can be recovered either from in vivo expression or in vitro expression systems. Randomization of identified promoters, RNA stability modifying sequences and transcriptional modifying sequences can be easily done to increase or decrease promoter/modifier strength. Using deep sequencing of recovered reverse transcriptase-polymerase chain reaction (RT-PCR) products, the relative strength of the population of promoters/modifiers recovered is naturally related to the fraction of the total each sequence represents.

2. Constructs/DNA Plasmids

The constructs described herein are generally synthetic and/or recombinant. The constructs can be comprised wholly of naturally occurring nucleic acids, or in certain embodiments can contain one or more nucleic acid analogues or derivatives. The nucleic acid analogues can include backbone analogues and/or nucleic acid base analogues and/or utilize non-naturally occurring base pairs. Illustrative artificial nucleic acids that can be used in the present constructs include, without limitation, nucleic backbone analogs peptide nucleic acids (PNA), morpholino and locked nucleic acids (LNA), bridged nucleic acids (BNA), glycol nucleic acids (GNA) and threose nucleic acids (TNA). Nucleic acid base analogues that can be used in the present constructs include, without limitation, fluorescent analogs (e.g., 2-aminopurine (2-AP), 3-Methylindole (3-MI), 6-methyl isoxanthopterin (6-MI), 6-MAP, pyrrolo-dC and derivatives thereof, furan-modified bases, 1,3-Diaza-2-oxophenothiazine (tC), 1,3-diaza-2-oxophenoxazine); non-canonical bases (e.g.: inosine, thiouridine, pseudouridine, dihydrouridine, queuosine and wyosine), 2-aminoadenine, thymine analogue 2,4-difluorotoluene (F), adenine analogue 4-methylbenzimidazole (Z), isoguanine, isocytosine; diaminopyrimidine, xanthine, isoquinoline, pyrrolo[2,3-b]pyridine; 2-amino-6-(2-thienyl)purine, pyrrole-2-carbaldehyde, and universal bases (e.g., 2' deoxyinosine (hypoxanthine deoxynucleotide) derivatives, nitroazole analogues). Non-naturally occurring base pairs that can be used in the present constructs include, without limitation, isoguanine and isocytosine; diaminopyrimidine and xanthine; 2-aminoadenine and thymine; isoquinoline and pyrrolo[2,3-b]pyridine; 2-amino-6-(2-thienyl)purine and pyrrole-2-carbaldehyde; two 2,6-bis(ethylthiomethyl)pyridine (SPy) with a silver ion; pyridine-2,6-dicarboxamide (Dipam) and a monodentate pyridine (Py) with a copper ion.

a. For Identification of Functional Promoter Sequences

Generally, constructs useful for the screening and identification of functional promoter sequences comprise a mini-monomer cassette in a minimal DNA plasmid backbone having an origin of replication and, optionally, an expression cassette for a selection gene. A specific illustration and polynucleotide sequence of a DNA plasmid useful for the screening and identification of functional promoter sequences is provided in FIGS. 1 and 2A-E.

Components of the mini-monomer cassette within the ribozyme cleavage sites—e.g., the multiple cloning site (MCS) with or without insert, the reverse and forward primer annealing sites, the ribozyme catalytic core—can be arranged in any number of several possible ways, with the following considerations:

1. The mini-monomer cassette is flanked by two ribozyme cleavage sites;
2. Primer 1 (reverse primer) is positioned upstream or 5' to primer 2 (forward primer); and
3. The RT-PCR product made by reverse transcription with primer 1 followed by PCR with primers 1 and 2 of the circular RNA made after transcription, cleavage and ligation includes the MCS with insert.

Figure 5:
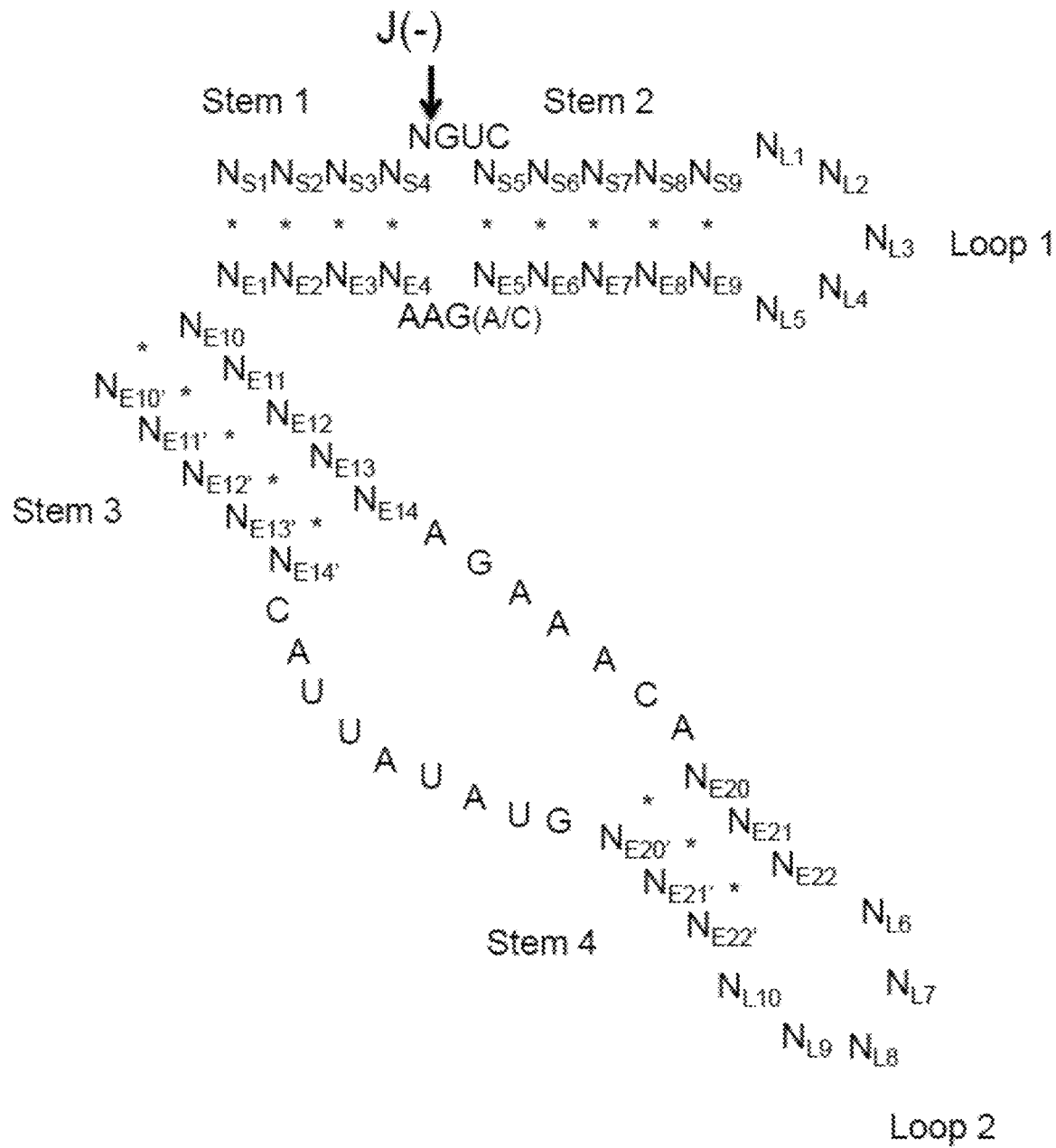
FIG. 5 illustrates a depiction of a generalized structure of the P-D regions and ribozyme core regions and their interactions.

Further, the ribozyme catalytic core can be separated at loop 2 (see, the bottom of stem 4 in FIG. 5). Several illustrative arrangements of the primers, ribozyme core and MCS with insert are depicted in FIGS. 16-18. In the arrangements depicted in FIGS. 16A-F, the reverse and forward primer annealing sites (e.g., primer 1 and primer 2) are adjacent to or abut each other. In the arrangements depicted in FIGS. 17A-B, the reverse and forward primers 1 and 2 are flanking the ribozyme core. A PCR product made with the constructs of FIGS. 17A-B would not recover or amplify the ribozyme core sequence.

Figure 18A:
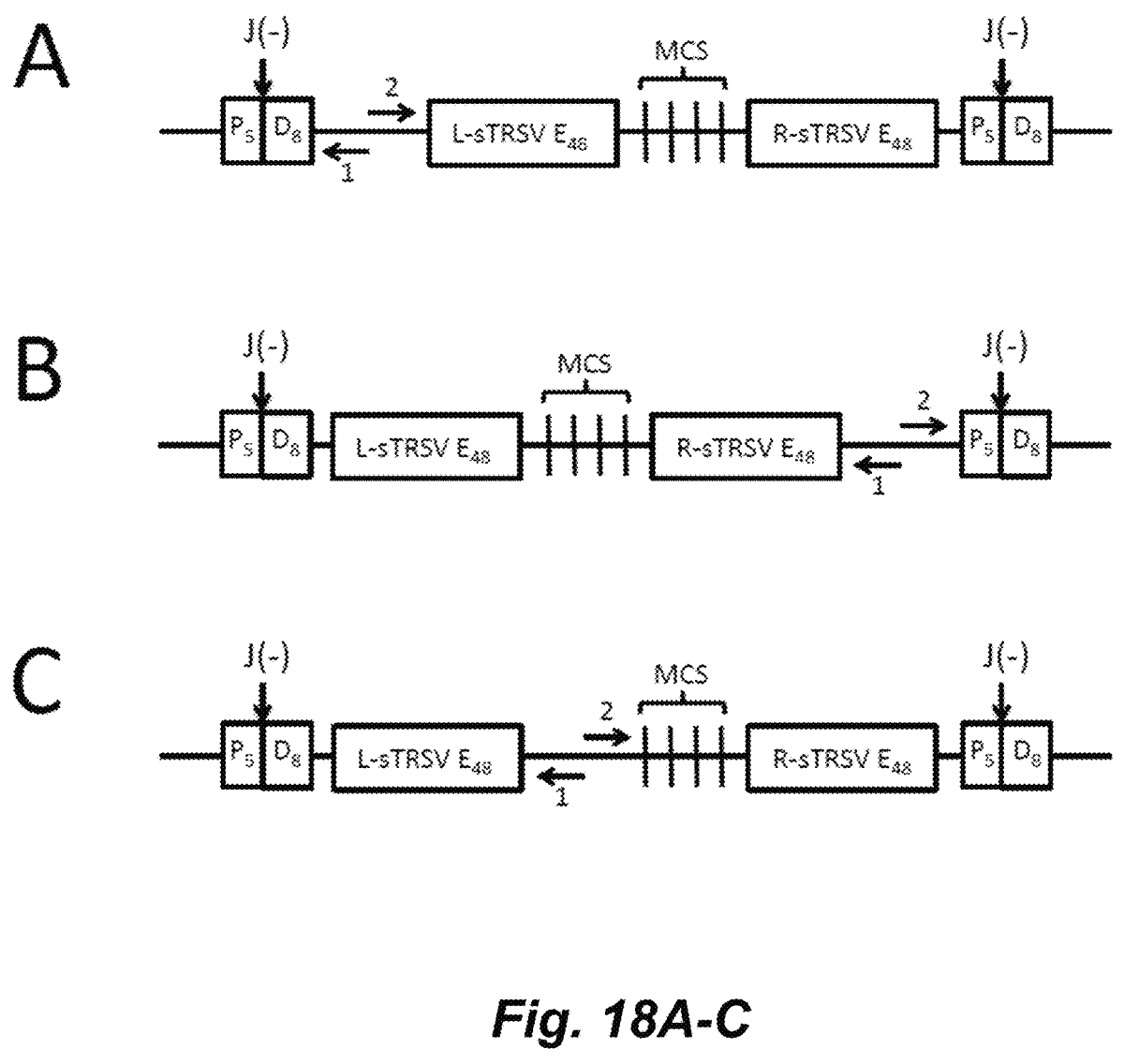

Further, the MCS with or without insert and/or the forward and/or reverse primer annealing sites can be inserted into loop 2 at the bottom of stem 4 of FIG. 5. The ribozyme can be opened and/or expanded at loop 2 and still retain activity. FIGS. 18A-F illustrates arrangements wherein the ribozyme core is split or expanded at loop 2 into a left half (L-sTRSV $E_{48}$) and a right half (R-sTRSV $E_{48}$). FIGS. 18E-F depicts the reverse and forward primer annealing sites separated by either the left half of the ribozyme core or the right half of the ribozyme core, respectively. Again, a PCR product made with primer annealing sites that straddle entirely or partially the ribozyme core will not recover or amplify either the entire or partial ribozyme core polynucleotide sequence, respectively.

In an embodiment prior to the insertion of a polynucleotide suspected of containing a functional promoter, the DNA plasmid comprises operably linked polynucleotides encoding: (a) a mini-monomer cassette, comprising a first ribozyme cleavage site and a second ribozyme cleavage site, and comprising between the first ribozyme cleavage site and the second ribozyme cleavage site: (i) a ribozyme catalytic core; (ii) a multiple cloning site polynucleotide comprising plurality of restriction endonuclease cleavage sites; and (iii) a reverse primer annealing polynucleotide (e.g., for PCR or RT-PCR) located upstream or 5' to a forward primer annealing polynucleotide (e.g., for PCR or RT-PCR); and (b) a plasmid backbone, comprising an origin of replication. Illustrative ordering or relative positioning of the ribozyme catalytic core; the multiple cloning site, the reverse primer annealing polynucleotide, and the forward primer annealing polynucleotide can be as depicted in FIGS. 6, 7, 16, 17 and/or 18. In some embodiments, the DNA plasmid comprises operably linked polynucleotides encoding: (a) a mini-monomer cassette, comprising in the 5' to 3' direction: (i) a first ribozyme cleavage site; (ii) a ribozyme catalytic core; (iii) a multiple cloning site polynucleotide comprising plurality of restriction endonuclease cleavage sites, a reverse primer annealing polynucleotide and a forward primer annealing polynucleotide (e.g., for PCR or RT-PCR); and (iv) a second ribozyme cleavage site; and (b) a plasmid backbone, comprising an origin of replication. In some embodiments, the plasmid backbone further comprises an expression cassette encoding a selection marker.

In an embodiment of the construct containing a polynucleotide suspected of containing a functional promoter, the DNA plasmid comprises operably linked polynucleotides encoding: (a) a mini-monomer cassette, comprising a first ribozyme cleavage site and a second ribozyme cleavage site, and comprising between the first ribozyme cleavage site and the second ribozyme cleavage site: (i) a ribozyme catalytic core; (ii) a reverse primer annealing polynucleotide; (iii) a forward primer annealing polynucleotide; and (iv) an inserted polynucleotide suspected of comprising a promoter; and (b) a plasmid backbone, comprising an origin of replication. Illustrative ordering or relative positioning of the ribozyme catalytic core; the multiple cloning site containing the insert, the reverse primer annealing polynucleotide, and the forward primer annealing polynucleotide can be as depicted in FIGS. 6, 7, 16, 17 and/or 18. In some embodiments, the DNA plasmid comprises operably linked polynucleotides encoding: (a) a mini-monomer cassette, comprising in the 5' to 3' direction: (i) a first ribozyme cleavage site; (ii) a ribozyme catalytic core; (iii) a reverse primer annealing polynucleotide; (iv) a forward primer annealing polynucleotide; (v) an inserted polynucleotide suspected of comprising a promoter; (vi) a second ribozyme cleavage site; (b) a plasmid backbone, comprising an origin of replication. In some embodiments, the plasmid backbone further comprises an expression cassette encoding a selection marker.

i. Ribozyme Catalytic Core

The constructs or DNA plasmids described herein can comprise any functional ribozyme catalytic core capable of being circularized by ribozyme or enzymatic function. Enzymatic circularization can also work in cases where the reverse transcription reaction bypasses the ligation site. Illustrative ribozyme catalytic cores of use include, e.g., the hammerhead ribozyme, the hepatitis delta positive strand ribozyme, the hepatitis delta negative strand ribozyme, the *Neurospora* Varkud Satellite ribozyme, or group I or group II self-processing intron-derived ribozymes.

In varying embodiments, the ribozyme catalytic core is a hairpin ribozyme catalytic core. The hairpin ribozyme catalytic core polynucleotides of use are capable of self-cleaving itself and flanking sequences within ribozyme cleavage sites out of the context of a longer polynucleotide sequence and then ligating the excised polynucleotide into a circularized polynucleotide. In varying embodiments, the hairpin ribozyme catalytic core can be derived from a naturally occurring source. For example, Rubino, et al, *J Gen Virol* (1990) 71:1897-1903 describes examples of naturally-derived and consensus sequences of ribozyme catalytic core polynucleotides. In varying embodiments, the ribozyme catalytic core is or is derived from the negative strand self-cleavage domain (e.g., a hairpin ribozyme catalytic core) of a plant virus satellite RNA, e.g., the satellite RNA of tobacco ringspot virus (sTRSV), the satellite RNA of arabis mosaic virus (sArMV), and the satellite RNA of chicory yellow mottle virus (sCYMV). In varying embodiments, the ribozyme catalytic core is or is derived from the negative strand self-cleavage domain of a satellite RNA of the plant virus tobacco ringspot virus (sTRSV). In some embodiments, the ribozyme catalytic core polynucleotide is a synthetic sequence, e.g., based on naturally occurring or consensus ribozyme catalytic core sequences. The general structure for a hairpin ribozyme catalytic core is provided in FIG. 5. The structure of hairpin ribozyme catalytic cores are well known in the art, and described, e.g., in Müller, et al., *IUBMB Life*. (2012) 64(1):36-47; Fedor, *J Mol Biol*. (2000) 297(2):269-91; and Ferré-D'Amaré, Biopolymers. (2004) 73(1):71-8.

A generalized or consensus negative strand self-cleavage domain (e.g., a hairpin ribozyme catalytic core) is provided in SEQ ID NO: 8. The polynucleotide sequences of illustrative ribozyme catalytic core molecules are provided herein as SEQ ID NOs: 3, 4 and 5. In varying embodiments, the ribozyme catalytic core comprises a polynucleotide sequence having at least about 60% sequence identity, e.g., at least about 65%, 70%, 75%, 80%, 85%, 90%, 91%, 92%, 93%, 94%, 95%, 96%, 97%, 98%, 99% or 100% sequence identity to any one of SEQ ID NOs: 3, 4 or 5.

In varying embodiments, the ribozyme catalytic core can be or can be derived from a circularizing ribozyme. Examples include the *Neurospora* Varkud Satellite ribozyme ("VS ribozyme") and circularizing group I intron ribozyme (e.g., circularizing introns from *Tetrahymena*. The structure and sequence of the VS ribozyme is known in the art, and described, e.g., in Bonneau, et al., *Biochemistry* (2014) 53(39):6264-75; Bouchard, et al., *RNA*. (2014) 20(9):1451-64; and Desjardins, et al, *Nucleic Acids Res*. (2011) 39(10): 4427-37. The structure and sequence of circularizing group I intron ribozymes, including circularizing introns from *Tetrahymena*, are known in the art and described, e.g., in Puttaraju and Been, *Nucl. Acid Res*. (1992), 20:5357-64; Puttaraju and Been, *J Biol Chem* (1996), 271:26081-7, Ford and Ares, *Proc Natl Acad Sci USA* (1994), 91:3117-21. Ribozyme structures and mechanisms are also reviewed in Doherty, et al., *Annu Rev Biochem*. (2000) 69:597-615.

In varying embodiments, ribozyme catalytic cores other than those that naturally have substantial ligation activity could be used to identify promoter and/or transcriptional modifying sequences. In such embodiments constructs can have two functional ribozymes to produce the equivalent of a hairpin ribozyme-derived "mini-monomer" and use enzymatic ligation for formation of circles (e.g., via rolling circle replication) that can then be recovered by RT-PCR. This is shown in FIG. 15.

Figure 15:
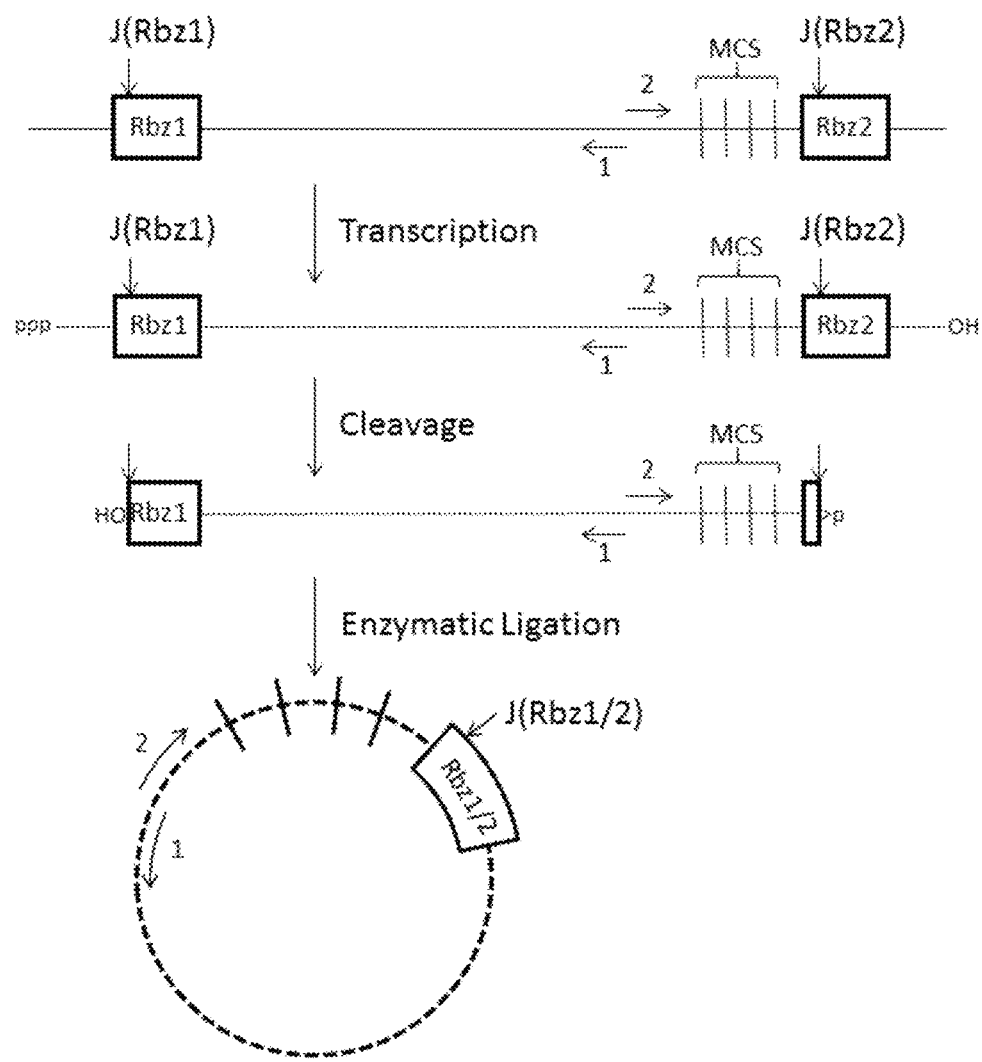
FIG. 15 illustrates an alternative scheme using generic cleaving ribozymes and enzymatic ligation to form circles containing promoter or other transcription/RNA stability modifying sequences. Note that this is just one possible form for circular RNA. The ribozyme catalytic core need not be present within the circular RNA.
Figure 19:
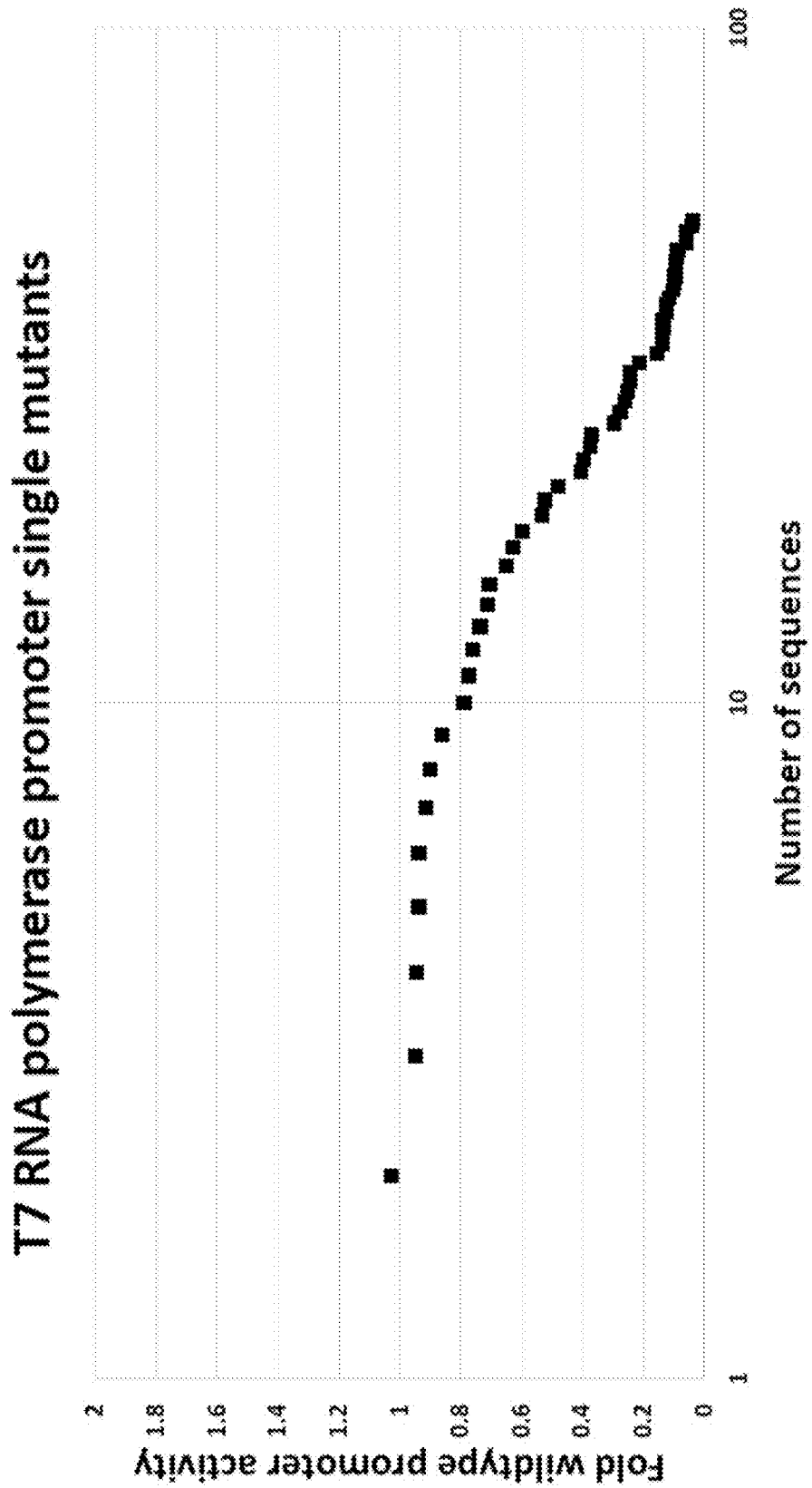
FIG. 19 illustrates the relative in vivo activity of 51 single mutants of the mutated T7 RNA polymerase promoter whose construction is described in Example 4. Mutant promoter activity is shown on the y-axis and is normalized to the wildtype promoter activity as described in Example 4. The single mutants were placed in activity order from highest to lowest relative to wildtype. The number of individual single mutants analyzed is shown on the x-axis. Due to the number of sequences shown, the y-axis is a log axis to compress its length. Of the unique single mutants possible, an analysis of 51 out of the possible 51 is shown (100%).
Figure 20:
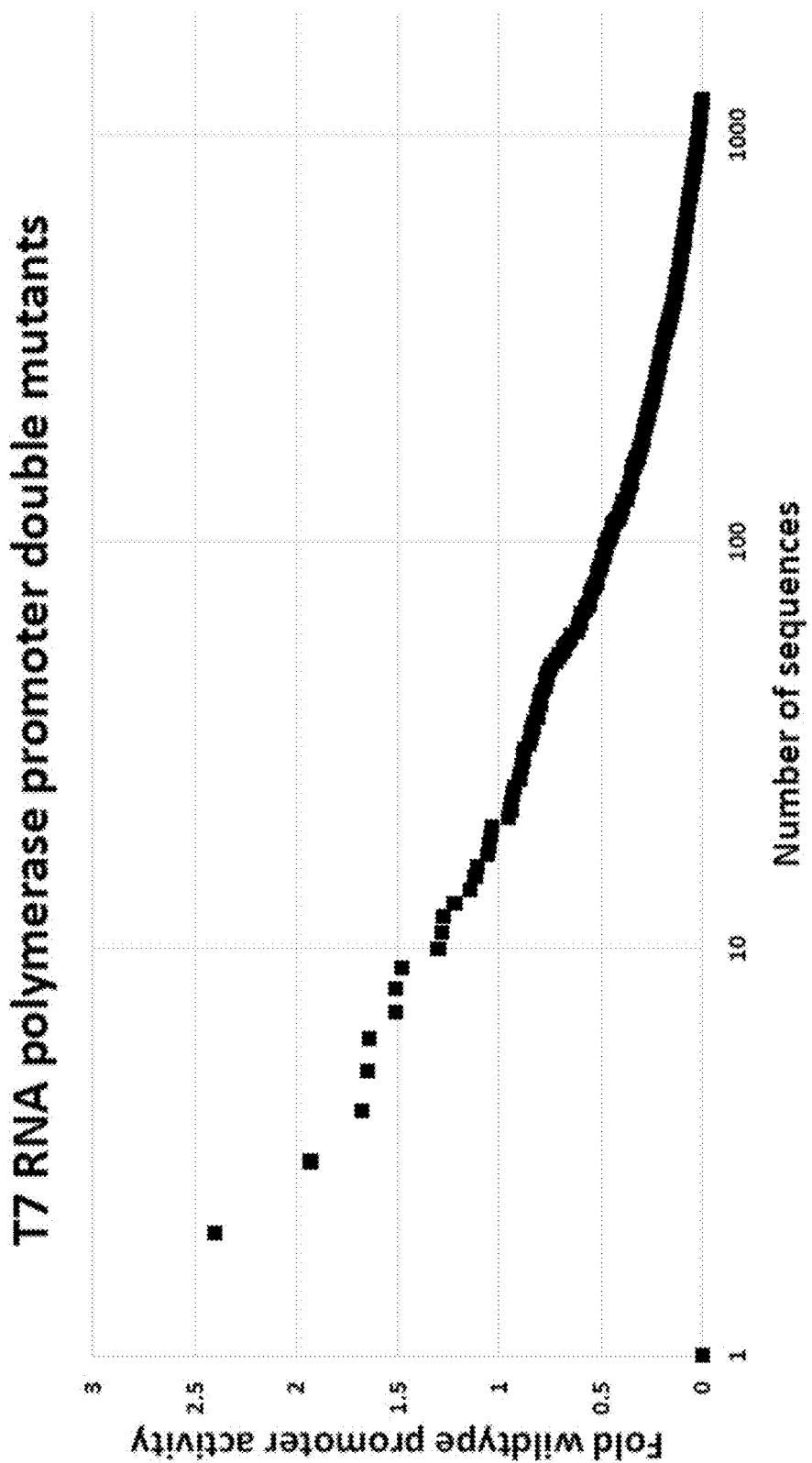
FIG. 20 illustrates the relative in vivo activity of 1223 double mutants of the mutated T7 RNA polymerase promoter whose construction is described in Example 4. Mutant promoter activity is shown on the y-axis and is normalized to the wildtype promoter activity as described in Example 4. The double mutants were placed in activity order from highest to lowest relative to wildtype. The number of individual double mutants analyzed is shown on the x-axis. Due to the number of sequences shown, the y-axis is a log axis to compress its length. Of the unique double mutants possible, an analysis of 1223 out of the possible 1224 is shown (99.9%).
Figure 21:
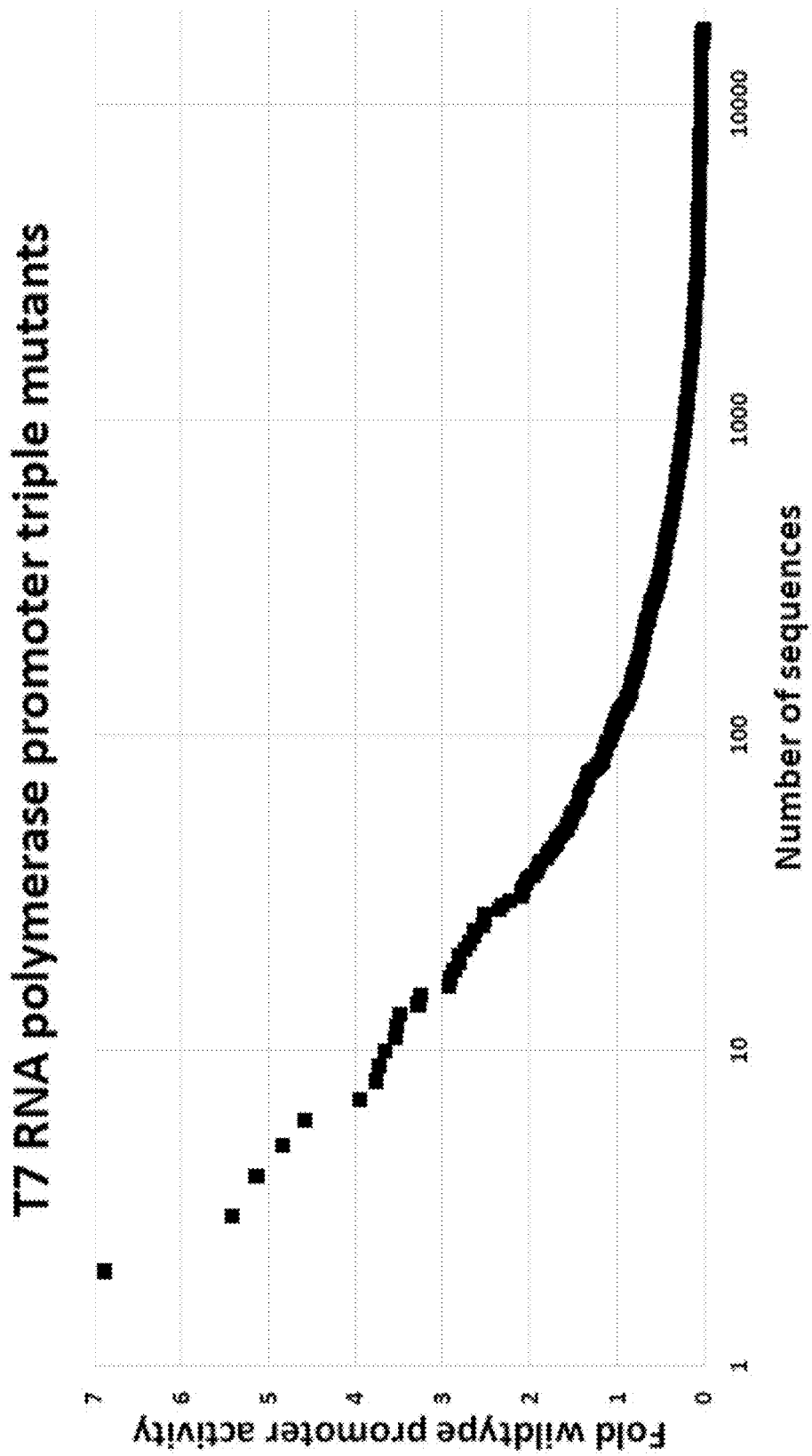
FIG. 21 illustrates the relative in vivo activity of 17281 triple mutants of the mutated T7 RNA polymerase promoter whose construction is described in Example 4. Mutant promoter activity is shown on the y-axis and is normalized to the wildtype promoter activity as described in Example 4. The triple mutants were placed in activity order from highest to lowest relative to wildtype. The number of individual triple mutants analyzed is shown on the x-axis. Due to the number of sequences shown, the y-axis is a log axis to compress its length. Of the unique triple mutants possible, an analysis of 17281 out of the possible 18340 is shown (94.1%).
Figure 22:
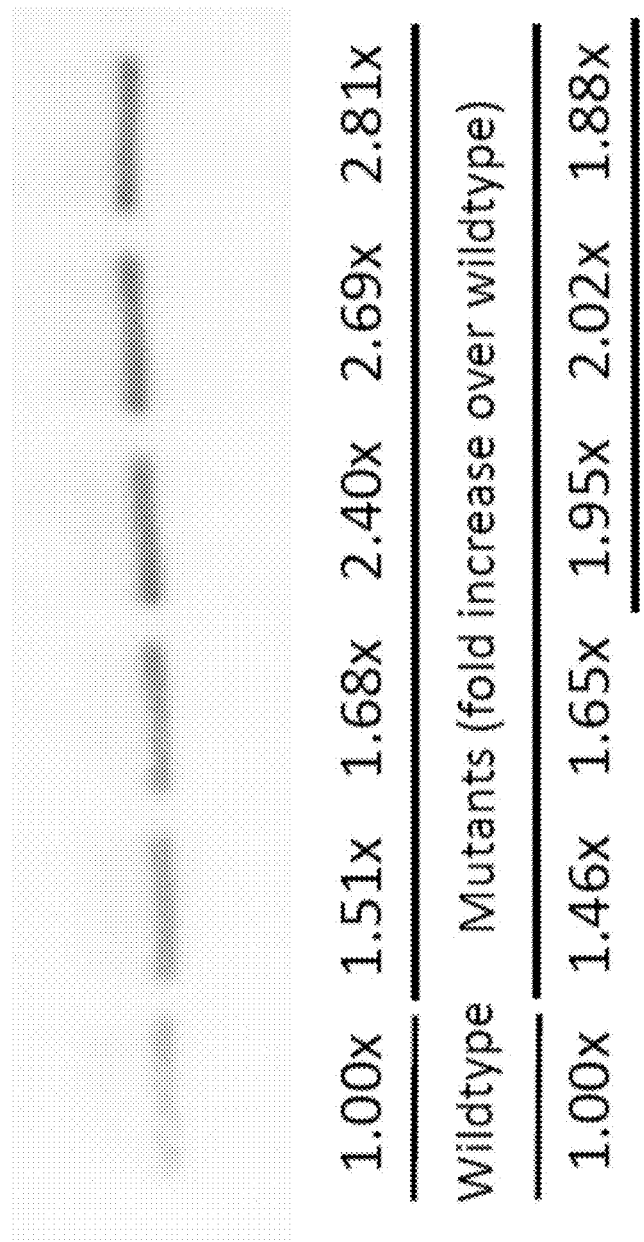
FIG. 22 illustrates the measured transcription ratios and their relationship to in vivo protein expression levels for 5 selected mutant T7 RNA polymerase promoters. Constructions containing the coding sequence for the green fluorescent protein (GFP) downstream of the selected mutant T7 RNA polymerase promoters were made and inserted into T7 RNA polymerase-expressing cells. Induction of T7 RNA polymerase activity was done in vivo for 2 hours, just as was done for the expression at the time of mini-monomer RNA production as part of the mutant promoter activity assay. Protein was extracted and run on a SDS-polyacrylamide gel, transferred to a PVDF membrane, and an immunoblot was done with anti-GFP antibodies. The gel was scanned and the area under the peak of detected protein was estimated with the image analysis software package, ImageJ. See, e.g., Rasband, W. S., ImageJ, U. S. National Institutes of Health, Bethesda, Maryland, USA, http://imagej.nih.gov/ij/, 1997-2016. A comparison of the ratio of transcription and the amount of protein produced by the mutant and wildtype T7 RNA polymerase promoters is shown. This comparison shows good agreement for the first two selected promoters, but deviates somewhat for the last three. It is likely that this is due to the narrow linear range of immunoblots.
Figure 23:
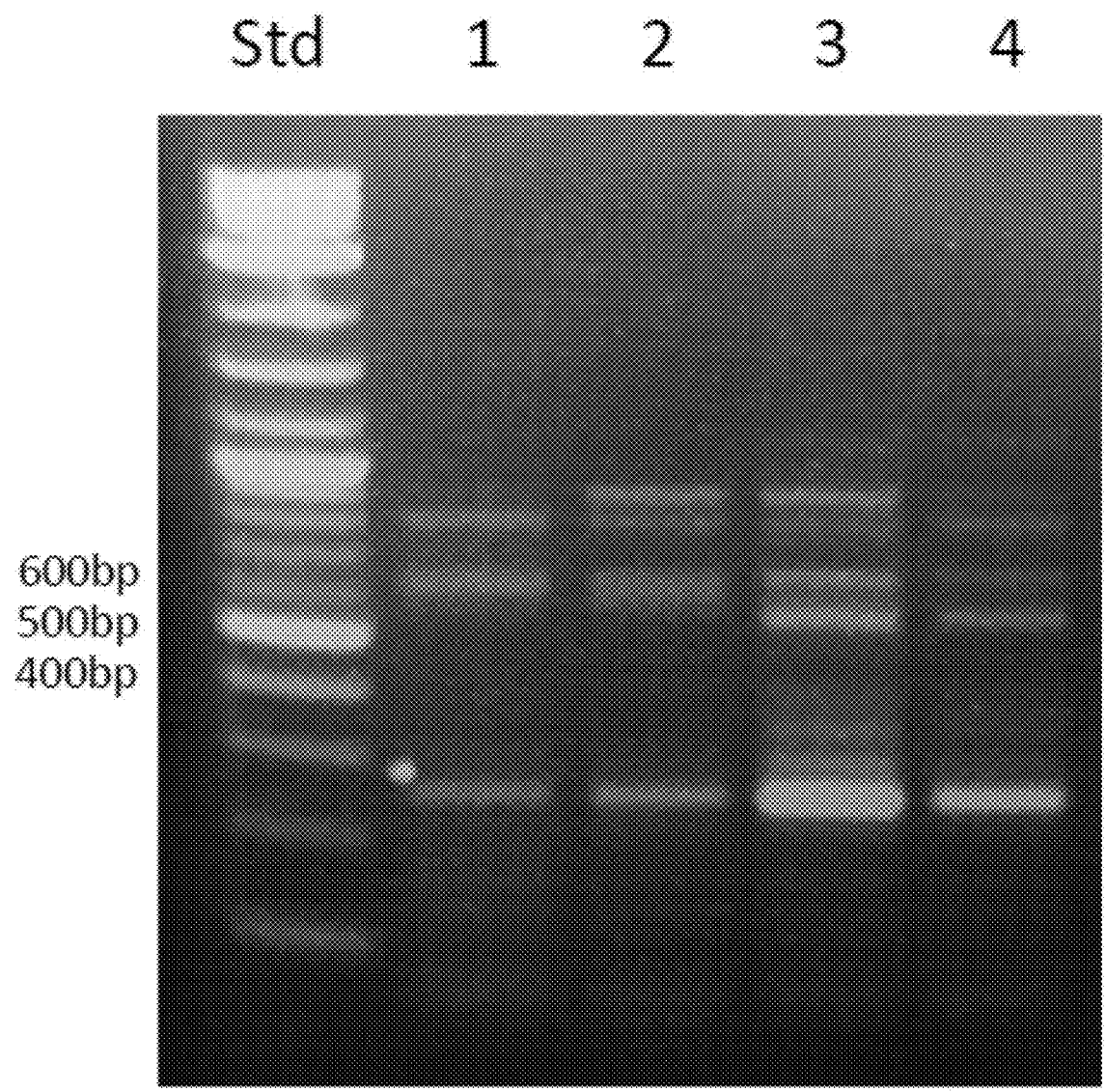
FIG. 23 illustrates RT-PCR of mini-monomer RNAs from yeast constructs containing either the known yeast (*Saccharomyces cerevisiae*) TEF promoter or a fragment of the GFP gene in a yeast 2 micron vector containing a mini-monomer cassette. Extracted yeast total RNA was extracted, reverse transcribed and subjected to 35 cycles of PCR with primers 1 and 2 (e.g., reverse and forward primer annealing polynucleotides, respectively). The appropriate sized fragment should be 595 base pairs long. This band is only seen in the RNA samples from the yeast containing the TEF promoter in the mini-monomer cassette. Lanes: (Std) 2-Log DNA ladder from New England Biolabs; (1) Total yeast RNA from mini-monomer construct containing the GFP coding sequence; (2) Duplicate total yeast RNA from mini-monomer construct containing the GFP coding sequence; (3) Total yeast RNA from mini-monomer construct containing the known yeast TEF promoter; (4) Duplicate total yeast RNA from mini-monomer construct containing the known yeast TEF promoter.
Figure 24:
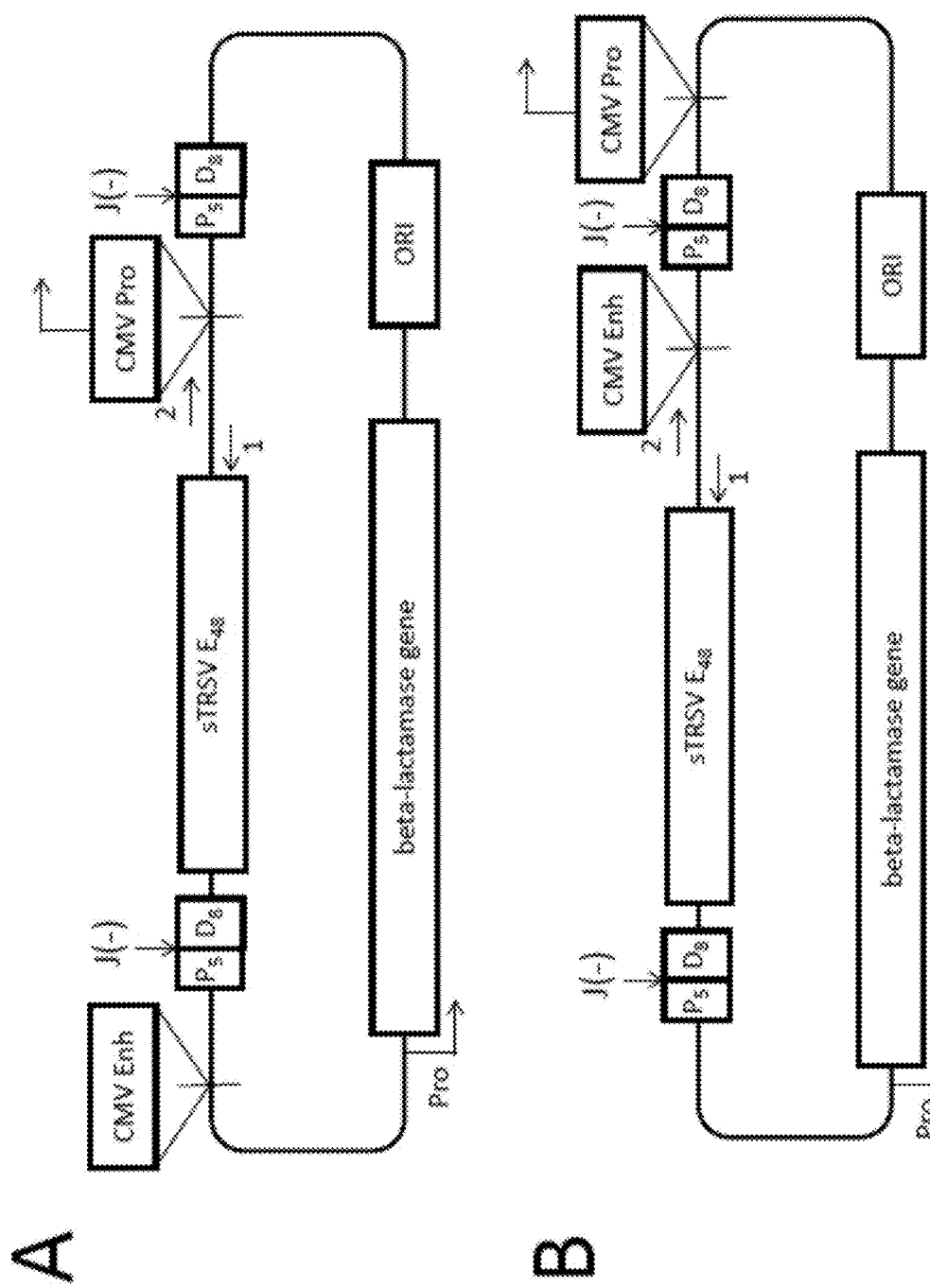
FIGS. 24A-B. (A) Construct for recovery of CMV Pro sequences after mini-monomer circularization. Enhancer function provided by upstream CMV Enh sequence. (B) Construct for recovery of CMV Enh sequences after mini-monomer circularization. Core promoter function provided by downstream CMV Pro sequence.
Figure 25:
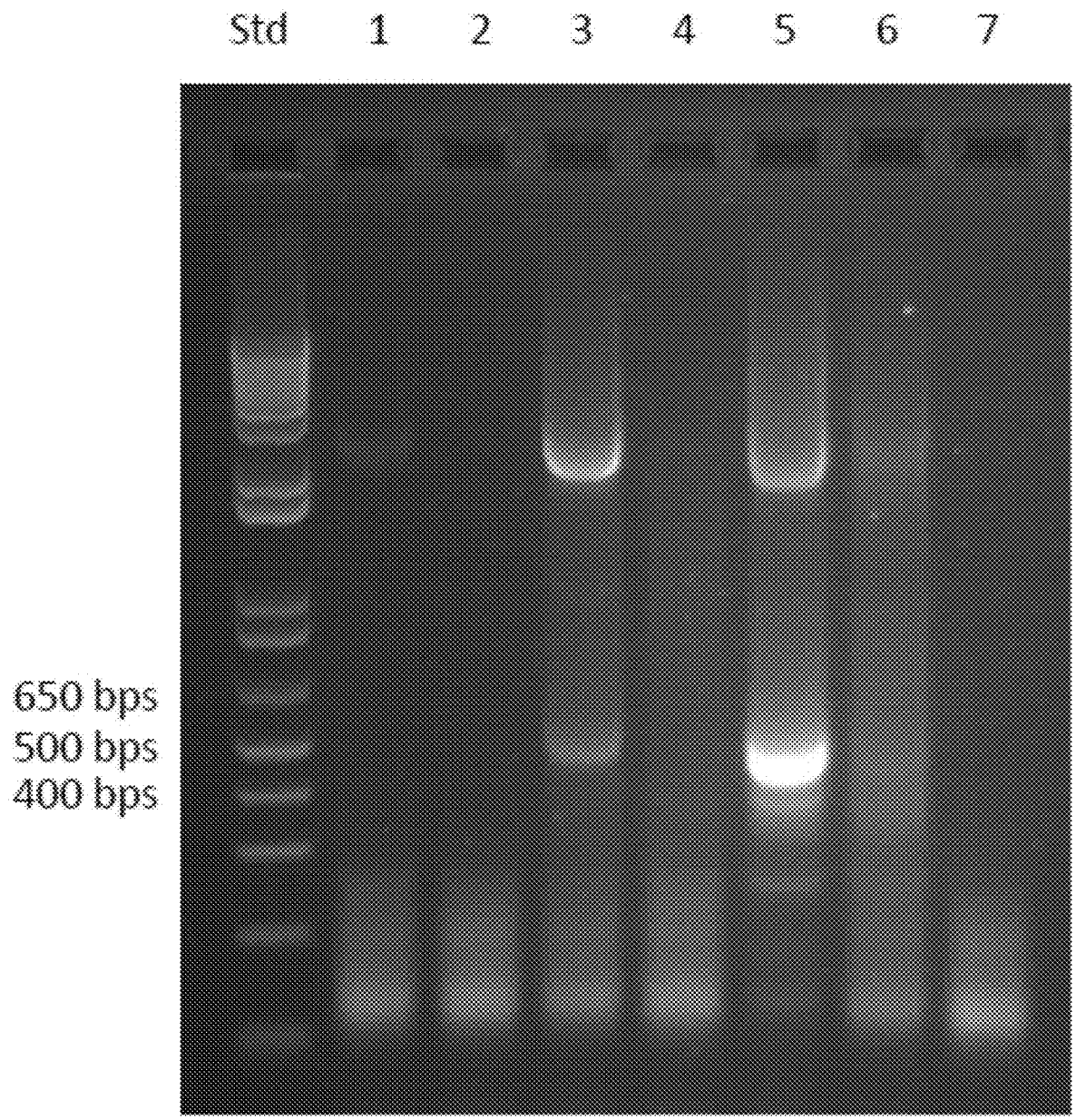
FIG. 25 illustrates RT-PCR of mini-monomer RNAs containing either the CMV core promoter or the CMV enhancer within a mini-monomer cassette transfected into Chinese Hamster Ovary (CHO) cells. Total RNA was extracted, reverse transcribed and subjected to 35 cycles of PCR with primers 1 and 2 (e.g., reverse and forward primer annealing polynucleotides, respectively). The appropriate sized fragments should be 432 and 560 base pairs long respectively. The bands are only seen in the RNA samples containing the appropriate construct Lanes: (Std) 1 Kb+DNA ladder from New England Biolabs; (1) Total CHO RNA from transfection reagent only without DNase treatment on the column; (2) Total CHO RNA from transfection reagent only with DNase treatment on the column; (3) Total CHO RNA from transfection reagent and CMV Enh mini-monomer construct without DNase treatment on the column; (4) Total CHO RNA from transfection reagent and CMV Enh mini-monomer construct with DNase treatment on the column; (5) Total CHO RNA from transfection reagent and CMV Pro mini-monomer construct without DNase treatment on the column; (6) Total CHO RNA from transfection reagent and CMV Pro mini-monomer construct with DNase treatment on the column; (7) PCR negative control (no added cDNA). Residual DNase seems to be present in treated samples as evidenced by the reduction in the expected band intensity.

In the circular RNA-producing system shown in FIG. 15, the first or upstream ribozyme catalytic core (Rbz 1) can be from any kind of ribozyme, including, e.g., a hairpin ribozyme, a hammerhead ribozyme (e.g., a type III, or a type I hammerhead ribozyme); a hepatitis delta virus (HDV) positive strand ribozyme; or a HDV negative strand ribozyme. In various embodiments, the construct is designed with the first or upstream ribozyme catalytic core positioned or located 5' relative to the first or upstream ribozyme cleavage site (depicted as J(Rbz1)). In the circular RNA-producing system depicted in FIG. 15, the second or downstream ribozyme catalytic core (Rbz 2) also can be from any kind of ribozyme including, e.g., a hairpin ribozyme, a hammerhead ribozyme (e.g., a type III, or a type I hammerhead ribozyme); a HDV positive strand ribozyme; or a HDV negative strand ribozyme. In varying embodiments, the construct is designed with the second or downstream ribozyme catalytic core positioned or located 3' relative to the second or downstream ribozyme cleavage site (depicted as J(Rbz2)). Any ribozyme that leaves a hydroxyl group at the 5'-end and/or a 2':3' cyclic phosphodiester bond at the 3'-end can be used. The requirements for these terminal structures for enzymatic ligation would make type I or type II self-splicing intron-derived ribozyme inappropriate. The secondary structure of the cleaved RNA that forms the circular RNA is circularized most efficiently if the 5' and 3' ends are juxtaposed such that they are within a short distance—e.g., less than 5 nucleotides apart at the 3' and 5' ends of stable stems—of each other in stable secondary structures.

Accordingly, in varying embodiments, the ribozyme catalytic core can be or can be derived from a hammerhead ribozyme. The minimal hammerhead sequence required for the self-cleavage reaction includes approximately 13 conserved or invariant "core" nucleotides, most of which are not involved in forming canonical Watson-Crick base-pairs. The core region is flanked by Stems I, II and III, which are in general made of canonical Watson-Crick base-pairs but are otherwise not constrained with respect to sequence. Functionally, a hammerhead ribozyme performs a chemical reaction that results in the breakage of the substrate strand of RNA, specifically at C17, the cleavage-site nucleotide. Structurally, the hammerhead ribozyme is composed of three base paired helices, separated by short linkers of conserved sequences. These helices are called I, II and III. Hammerhead ribozymes can be classified into three types based on which helix the 5' and 3' ends are found in. If the 5' and 3' ends of the sequence contribute to stem I then it is a type I hammerhead ribozyme, to stem II is a type II and to stem III then it is a type III hammerhead ribozyme. In varying embodiments, the first and 5'-most hammerhead ribozyme catalytic core can be a Type I, Type II, Type III, HH9 and HH10 hammerhead ribozyme catalytic core. The structure and function of hammerhead ribozymes is well-characterized in the art, and has been reviewed in, e.g., Scott, et al., Prog Mol Biol Transl Sci. (2013) 120:1-23; Lee, et al., Prog Mol Biol Transl Sci. (2013) 120:25-91; and Hammann, et al., RNA. (2012) 18(5):871-85.

In varying embodiments, the second ribozyme catalytic core can be or can be derived from a positive or negative strand hepatitis delta virus (HDV) ribozyme catalytic core or a ribozyme catalytic core from a member of the HDV family. The structure of hepatitis delta virus (HDV) and HDV family members are known in the art. See, e.g., Riccitelli, et al., Prog Mol Biol Transl Sci. (2013) 120:123-71; Kapral, et al., Nucleic Acids Res. (2014) 42(20):12833-46.

ii. Ribozyme Cleavage Sites

The ribozyme cleavage sites can be any polynucleotide sequence capable of being cleaved by a ribozyme. As depicted in FIG. 5, the sequence and structure of the ribozyme cleavage sites are guided by the polynucleotide sequence of the ribozyme catalytic core. Interactions between the ribozyme cleavage site and the negative strand self-cleavage domain (as generalized in SEQ ID NO: 8) are via hydrogen bonds forming two stems—1 and 2 (as depicted in FIG. 5).

Stem 1 is formed by hydrogen bonds between NS1 and NE1, NS2 and NE2, NS3 and NE3, NS4 and NE4

Stem 2 is formed by hydrogen bonds between NS5 and NE5, NS6 and NE6, NS7 and NE7, NS8 and NE8, NS9 and NE9

Interactions within the generalized negative strand self-cleavage and ligation domain form 2 stems—3 and 4

Stem 3 is formed by hydrogen bonds between NE10 and NE10', NE11 and NE11', NE12 and NE12', NE13 and NE13', NE14 and NE14'

Stem 4 is formed by hydrogen bonds between NE20 and NE20', NE21 and NE21', and NE22 and NE22'

Stem 1 is essentially universally 4 base pairs long

Stem 2 can be as short as 4 base pairs, but can be longer

Stem 3 is essentially universally 5 base pairs long

Stem 4 is from 2 to 4 base pairs long depending on the source

Loop 1 can be as small as 4 nucleotides, if it is a special sequence called a tetra-loop, but can be longer, e.g., 100's of nucleotides up to 1000 nucleotides Loop 2 varies from 4 to 6 bases long in natural sequences The polynucleotide sequences of an illustrative ribozyme cleavage site is provided herein as SEQ ID NO: 6. In varying embodiments, the ribozyme cleavage site a polynucleotide sequence having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 6.

Generally, the polynucleotide sequences of the first and second ribozyme cleavage sites are the same.

iii. Multiple Cloning Site (MCS)

Test polynucleotides (e.g., polynucleotides suspected of encoding a functional promoter, a RNA stability modifying sequence or a transcriptional modifying sequence) are cloned into a multiple cloning site (MCS), which comprises two or more sites or sequences subject to restriction endonuclease cleavage. The positioning of the MCS and the forward and reverse primer annealing sequences (e.g., for PCR or RT-PCR) can vary in the present constructs or DNA plasmids. In varying embodiments, both the forward and reverse primer annealing sequences (e.g., for PCR or RT-PCR) are positioned 5' to the MCS. In varying embodiments, one or both of the forward and reverse primer annealing sequences (e.g., for PCR or RT-PCR) are positioned within the MCS (e.g., as depicted in FIGS. 1 and 2A-E). The MCS is located within the first and second (or upstream and downstream) ribozyme cleavage sites, but can be positioned 5' or 3' to the ribozyme catalytic core, embedded within loop 2 of the ribozyme catalytic core, and/or 5' or 3' to one or both of the reverse and forward primer annealing sites. In varying embodiments, the MCS with the insert is not positioned or located between the reverse and forward primer annealing sites. Various illustrative configurations of the components in the mini-monomer cassette are depicted in FIGS. 6, 7, 16, 17 and 18. In varying embodiments, both the forward and reverse primer annealing sequences (e.g., for PCR or RT-PCR) are positioned 3' to the MCS. In varying embodiments, both the forward and reverse primer annealing sequences (e.g., for PCR or RT-PCR) are positioned 5' to the MCS. In varying embodiments, the MCS is positioned within the mini-monomer cassette, located 3' to the ribozyme catalytic core and 5' to the second ribozyme cleavage site. In varying embodiments, the MCS is positioned within the mini-monomer cassette, located 5' to the ribozyme catalytic core and 3' to the first ribozyme cleavage site. See, e.g., FIGS. 6, 7, 16, 17 and 18.

iv. Forward and Reverse Primer Annealing Polynucleotide (e.g., for PCR or RT-PCR)

The forward and reverse primer annealing polynucleotides (e.g., for PCR or RT-PCR) are each unique sequences in the constructs or DNA plasmids and can abut each other or can be located proximally to each other (e.g., within about 500, 400, 300, 200, or 100 nucleotides from one another) with the reverse primer annealing polynucleotide (e.g., for PCR or RT-PCR) positioned 5' to the forward primer annealing polynucleotide (e.g., for PCR or RT-PCR). The forward and reverse primer annealing polynucleotides (e.g., for PCR or RT-PCR) are positioned or located such that the reverse primer annealing nucleotide (e.g., primer 1) is upstream or 5' relative to the forward primer annealing nucleotide (e.g., primer 2) and both reverse and forward primer annealing nucleotides are between the two ribozyme cleavage sites (e.g., the P-D regions) so they are excised as part of the mini-monomer cassette, and they face each other across the P-D region formed from ribozyme cleavage at the first and second P-D regions (or second and third P-D regions) followed by ribozyme ligation. The PCR product they make contains the insert region. Depending on the positioning of the reverse and forward primer annealing polynucleotides relative to the ribozyme catalytic core, the PCR product may include all of the ribozyme catalytic core, a partial polynucleotide of the ribozyme catalytic core, or exclude all of the ribozyme catalytic core. In varying embodiments, the forward and reverse primer annealing polynucleotides (e.g., for PCR or RT-PCR) are positioned such that they abut or are within the MCS. In varying embodiments, the forward and reverse primer annealing polynucleotides (e.g., for PCR or RT-PCR) are positioned within the mini-monomer cassette, located 3' to the ribozyme catalytic core and 5' to or 3' to or within the MCS, and also 5' to the second ribozyme cleavage site. In varying embodiments, the forward and reverse primer annealing polynucleotides (e.g., for PCR or RT-PCR) are positioned within the mini-monomer cassette, located 5' to the ribozyme catalytic core and 3' to or 5' to or within the MCS, and also 3' to the first ribozyme cleavage site. In varying embodiments, one or both of the forward and reverse primer annealing polynucleotides (e.g., for PCR or RT-PCR) are positioned or embedded within loop 2 of the ribozyme catalytic core. See, e.g., FIGS. 6, 7, 16, 17 and 18.

v. Inserted Polynucleotide Suspected of Comprising a Promoter

The inserted polynucleotide suspected of comprising a promoter can be from any source, for example, a randomly generated library, a naturally occurring source (e.g., a genomic library), a chemically synthesized source, a mutagenized known promoter, random polynucleotides, restriction fragments of eukaryotic DNA or prokaryotic DNA, or randomized PCR fragments of eukaryotic DNA or prokaryotic DNA. The inserted polynucleotides suspected of containing a functional promoter within the mini-monomer cassette can be functional in eukaryotes or prokaryotes. This is distinguished from the in vitro control promoter located externally and 5' to the mini-monomer cassette, which is functional in prokaryotic cells, but not eukaryotic cells.

Generally, the polynucleotide suspected of comprising a promoter has from about 50 bp to about 2000 bp, e.g., from about 100 bp to about 1000 bp. In varying embodiments, the polynucleotide suspected of comprising a promoter contains an entire promoter or a partial promoter. Within the inserted or captured polynucleotide suspected of comprising a promoter, the promoter may be centered or located more proximal to the 3' or 5' end. The methods of employing the DNA constructs described herein identify functional promoters, e.g., promoters capable of inducing, directing or promoting transcription, regardless of whether the entire promoter or a partial promoter is captured, or the location of the promoter within the captured insert. In varying embodiments, inserted polynucleotide suspected of comprising a promoter is cloned into the MCS, so therefore is positioned within the mini-monomer cassette, located 3' to the ribozyme catalytic core and 5' to the second ribozyme cleavage site. See, e.g., FIGS. 6 and 7.

vi. Plasmid Backbone for Promoter-Screening Plasmid

In the constructs or DNA plasmids that are designed for screening and identifying functional promoter sequences, the plasmid backbone has minimal features to minimize or reduce the entire size of the plasmid. In varying embodiments, the entire size of the DNA plasmids that are designed for screening and identifying functional promoter sequences is from about 1800 bp to about 3800 bp, e.g., from about 1900 bp to about 2900 bp. Generally, the plasmid backbone comprises an origin of replication and, optionally, an expression cassette for expressing a selection gene. In varying embodiments, the expression cassette for expressing a selection gene is in the antisense orientation from the mini-monomer cassette. In varying embodiments, the expression cassette for expressing a selection gene is in the sense orientation to the mini-monomer cassette. The expression cassette for expressing a selection gene can be either in the antisense or sense orientation. If the selection is being done in eukaryotic cells, the selection gene can be any marker known in the art for selection of a host cell that has been transformed with a desired plasmid. In varying embodiments, the selection marker comprises a polynucleotide encoding a gene or protein conferring antibiotic resistance, heat tolerance, fluorescence, luminescence or rescue of auxotrophic growth for specific amino acids or nucleotides. Such selection markers are well known in the art.

vii. Optional Control Promoter

The constructs or DNA plasmids designed for the screening of promoter sequences can optionally further contain a control promoter. In varying embodiments, the control promoter is a promoter functional in a prokaryotic host cell. Such a promoter is useful as an internal control for in vitro transcription. In some embodiments, the control promoter can be added to the library by PCR. Illustrative promoters functional in a prokaryotic cell of use include without limitation bacteriophage promoters T7, T3 and SP6.

Accordingly, in varying embodiments of the constructs or DNA plasmids designed for screening of promoters a promoter functional in a prokaryotic host cell is positioned 5' of the first ribozyme cleavage site. See, e.g., FIG. 8, lower embodiment.

Transcription of the plasmid library in vitro with a RNA polymerase (e.g., a T7, T3 or SP6 RNA polymerase) followed by RT-PCR with forward and reverse RT-PCR primers and sequencing (e.g., deep sequencing) produces a processing and library bias-controlled sequenced data set for comparison with sequenced data sets derived from internal promoters (e.g., the functional promoter within the test insert polynucleotide).

b. For Identification of RNA Stability/Transcription Modifying Sequences

Generally, constructs useful for the screening and identification of RNA stability/transcription modifying sequences comprise a mini-monomer cassette in a DNA plasmid backbone having an origin of replication, and optionally, an expression cassette for a selection gene. Generally, the plasmid backbones of the constructs useful for RNA Stability/Transcription modifier screening do not have an upper size limit.

Any under or overrepresented sequence may be due to an effect at a distance on the promoter by the insert, which can be functioning as an enhancer or repressor of transcription. Enhancer and repressors can function up to 10 Kb away from a promoter either upstream or downstream. One construct design that takes the effect a potential transcription enhancer or repressor has on a promoter is illustrated in FIGS. 3, 4A-F and 11. A specific illustration and polynucleotide sequence of a DNA plasmid useful for the screening and identification of functional promoter sequences utilizes first and second mini-monomer cassettes. The first mini-monomer cassette comprises a randomized barcode polynucleotide and the second mini-monomer cassette comprises an inserted polynucleotide suspected of comprising a RNA stability/transcription modifying sequence.

In one embodiment, the construct or DNA plasmid containing a polynucleotide suspected of containing a RNA stability/transcription modifying sequence comprises:

(a) a promoter functional in a eukaryotic cell or in a prokaryotic cell;
(b) a mini-monomer cassette, comprising:
  (i) a first ribozyme cleavage site;
  (ii) a ribozyme catalytic core;
  (iii) a reverse primer annealing polynucleotide (e.g., for PCR or RT-PCR);
  (iv) a forward primer annealing polynucleotide (e.g., for PCR or RT-PCR);
  (v) an inserted polynucleotide suspected of comprising a RNA stability modifier or a transcription modifier;
  (vi) a second ribozyme cleavage site;
(c) a plasmid backbone, comprising an origin of replication. In some embodiments, the plasmid backbone further comprises an expression cassette encoding a selection marker.

In one embodiment, the construct or DNA plasmid containing a polynucleotide suspected of containing a RNA stability/transcription modifying sequence comprises:
(a) a test promoter, wherein the test promoter is functional in a eukaryotic cell or in a prokaryotic cell;
(b) a first mini-monomer cassette, comprising:
  (i) a first ribozyme cleavage site;
  (ii) a first ribozyme catalytic core;
  (iii) a first reverse primer annealing polynucleotide (e.g., for PCR or RT-PCR);
  (iv) a first forward primer annealing polynucleotide (e.g., for PCR or RT-PCR);
  (v) a barcode polynucleotide
  (vi) a second ribozyme cleavage site;
(c) a second mini-monomer cassette, comprising:
  (i) the second ribozyme cleavage site;
  (ii) a second ribozyme catalytic core;
  (iii) a second reverse primer annealing polynucleotide (e.g., for PCR or RT-PCR);
  (iv) a second forward primer annealing polynucleotide (e.g., for PCR or RT-PCR);
  (v) an inserted polynucleotide suspected of comprising a RNA stability modifier or a transcription modifier;
  (vi) a third ribozyme cleavage site;
(d) a plasmid backbone, comprising an origin of replication. In some embodiments, the plasmid backbone further comprises an expression cassette encoding a selection marker.

In the constructs or DNA plasmids designed to screen for RNA stability/transcription modifying sequences, the ribozyme catalytic cores, ribozyme cleavage sites, multiple cloning sites, and forward and reverse RT-PCT primer annealing polynucleotide sequences are as described above for the DNA plasmids designed to screen for functional promoter sequences. Distinguished from the promoter screening plasmid, constructs or DNA plasmids designed to screen for RNA stability/transcription modifying sequences have a first mini-monomer cassette containing a barcode polynucleotide, and a second mini-monomer cassette containing an inserted polynucleotide suspected of comprising a RNA stability modifier or a transcription modifier. Further, the plasmid backbone can be minimal, but need not be minimal. A schematic of the constructs or DNA plasmids designed to screen for RNA stability/transcription modifying sequences is provided in FIG. 11. Like the DNA plasmid designed for screening promoters, a 5'-RNA polymerase control promoter (e.g., a promoter functional in a prokaryotic host cell) can optionally be included in the construct to serve as an internal control for in vitro transcription.

The positioning or the ordering of the components in the first and second mini-monomer cassettes, including the MCS (with or without an inserted polynucleotide), the reverse and forward primer annealing sites and the ribozyme catalytic core, can be varied as described above for the mini-monomer cassette in the constructs used to identify promoter sequences. Illustrative variations in the arrangement or positioning of the components between the ribozyme cleavage sites in the first and second mini-monomer cassettes are depicted in FIGS. 16-18. The positioning or the ordering of the components in the first and second mini-monomer cassettes, including the MCS, the reverse and forward primer annealing sites and the ribozyme catalytic core, can be the same or different.

i. First Mini-Monomer Cassette Containing Barcode Polynucleotide

The first mini-monomer cassette is located 5' to the second mini-monomer cassette. The first mini-monomer cassette contains a barcode polynucleotide positioned 3' to a first ribozyme catalytic core and first forward and first reverse primer annealing polynucleotides and 5' to a second ribozyme cleavage site. The barcode polynucleotide comprises a random DNA sequence comprising from about 10 to about 20 N residues, e.g., 10, 11, 12, 13, 14, 15, 16, 17, 18, 19, or 20 N residues. The barcode polynucleotide serves as a unique identifier of a particular DNA plasmid comprising an inserted polynucleotide suspected of comprising a RNA stability modifier or a transcription modifier in the second mini-monomer cassette, and allows tracking of each inserted polynucleotide suspected of comprising a RNA stability modifier or a transcription modifier. The first ribozyme catalytic core in the first mini-monomer cassette is as described above, and can be the same or different as the second ribozyme catalytic core in the second mini-monomer cassette. See, e.g., FIG. 11.

To reduce the possibility of recombination between two identical ribozyme core sequences, however, two different ribozyme cores can be used. For example, in one embodiment, the first mini-monomer cassette comprises a ribozyme catalytic core from the satellite RNA of arabis mosaic virus (sArMV) and the second mini-monomer cassette comprises a ribozyme catalytic core from the satellite RNA of tobacco ringspot virus (sTRSV). Utilizing ribozyme catalytic cores having slightly different polynucleotide sequences should not only decrease recombination between the two, but will also serve as an internal control for the sequencing (e.g., deep sequencing).

ii. Second Mini-Monomer Cassette Containing Inserted Polynucleotide Suspected of Comprising a RNA Stability Modifier or a Transcription Modifier The second mini-monomer cassette is located 3' to the first mini-monomer cassette. In varying embodiments, inserted polynucleotide suspected of comprising a RNA stability modifier or a transcription modifier is cloned into the MCS of the second mini-monomer cassette, so therefore is positioned within the second mini-monomer cassette, located 3' to the second ribozyme catalytic core and 5' to the third ribozyme cleavage site. See, e.g., FIG. 11.

The inserted polynucleotide suspected of comprising a RNA stability modifier or a transcription modifier can be from any source, for example, a randomly generated library, a naturally occurring source (e.g., a genomic library), a chemically synthesized source, random nucleotides, restriction fragments of eukaryotic DNA, or randomized PCR fragments of eukaryotic DNA. Generally, the polynucleotide suspected of comprising a RNA stability modifier or a transcription modifier has from about 50 bp to about 1000 bp. In varying embodiments, the polynucleotide suspected of comprising a RNA stability modifier or a transcription modifier contains an entire modifying sequence or a partial modifying sequence. Within the inserted or captured polynucleotide suspected of comprising a modifying sequence, the modifier may be centered or located more proximal to the 3' or 5' end. The methods of employing the DNA constructs described herein identify functional modifiers, e.g., polynucleotides capable of modifying (e.g., increasing or decreasing) RNA stability and/or transcription, regardless of whether the entire modifying sequence or a partial modifying sequence is captured, or the location of the modifying sequence within the captured insert. In varying embodiments, inserted polynucleotide suspected of comprising a RNA stability modifier or a transcription modifier is cloned into the MCS, so therefore is positioned within the mini-monomer cassette, located 3' to the ribozyme catalytic core and 5' to the second ribozyme cleavage site. See, e.g., FIG. 11.

Generally, the first, second and third ribozyme cleavage sites are the same.

iii. Plasmid Backbone of Construct for RNA Stability/Transcription Modifier Screening The plasmid backbone for the constructs or DNA plasmids designed to screen for RNA stability/transcription modifying sequences can but need not be minimized. Like the plasmid backbone for the constructs or DNA plasmids designed to screen for promoters, the plasmid backbone for the constructs or DNA plasmids designed to screen for RNA stability/transcription modifying sequences have an origin of replication, and optionally, an expression cassette for expressing a selection marker, as described above. The entire size of the DNA plasmids that are designed for screening for RNA stability/transcription modifying sequences is guided by the location of the promoter functional in a eukaryotic cell in relationship to the first and third ribozyme cleavage sites. In the case where the eukaryotic promoter is 3' of the third ribozyme cleavage site, the overall plasmid size is minimized. In embodiments where the eukaryotic promoter is 5' of the first ribozyme cleavage site, there is no size limitation on the plasmid. In the case where the eukaryotic promoter is 5' of the first ribozyme cleavage site, the plasmid can also contain other features (e.g., sequences for entry into cells, e.g., left and right border sequences for *Agrobacterium*-mediated transfer). Viral replicating vectors can also be used. Accordingly, in varying embodiments, the promoter functional in a eukaryotic cell is located 3' of the third ribozyme cleavage site. In such embodiments, the plasmid has from about 1800 bp to about 3800 bp, e.g., from about 1900 bp to about 2900 bp. In varying embodiments, the promoter functional in a eukaryotic cell is located 5' of the first ribozyme cleavage site. In such embodiments, there is no fixed upper size limit, but the plasmid optionally can have from about 2100 bp to about 3100 bp, e.g., from about 2100 bp to about 2250 bp.

iv. Optional Control Promoter

The constructs or DNA plasmids designed for the screening of RNA stability and/or transcription modifying sequences can optionally further contain a control promoter. In varying embodiments, the control promoter is a promoter functional in a prokaryotic host cell. In some embodiments, the control promoter can be added to the library by PCR. As discussed above for the promoter screening plasmids, such a promoter is useful as an internal control for in vitro transcription. Illustrative promoters functional in a prokaryotic cell of use include without limitation bacteriophage promoters T7, T3 and SP6.

Accordingly, in varying embodiments of the constructs or DNA plasmids designed for screening of promoters a control promoter functional in a prokaryotic host cell is positioned 5' of the first ribozyme cleavage site. See, e.g., FIG. 11.

Transcription of the plasmid library in vitro with a RNA polymerase (e.g., a T7, T3 or SP6 RNA polymerase) followed by RT-PCR with forward and reverse RT-PCR primers and sequencing (e.g., deep sequencing) produces a processing and library bias-controlled sequenced data set for comparison with sequenced data sets derived from internal promoters (e.g., the functional promoter within the test insert polynucleotide).

3. Methods a. For Identification of Functional Promoter Sequences

In varying embodiments, methods for screening for promoters entail the steps of:
 a) providing a population of plasmids designed for screening promoters, the plasmids in the population containing an insert suspected of containing a functional promoter sequence, as described above and herein;
 b) transcribing the population of plasmids into RNA;
 c) reverse transcribing into cDNA the population of circularized RNA transcripts of self-cleaved mini-monomer cassettes; and
 d) sequencing the inserted polynucleotides comprising a functional promoter in the population of cDNA reverse-transcripts of self-cleaved mini-monomer cassettes.

i. Initial Transcriptional Control Step

In embodiments employing a plasmid further comprising a control promoter (e.g., a promoter functional in a prokaryotic host cell), positioned 5' to the mini-monomer cassette, in vitro transcription can additional and initially be performed from this promoter as an internal control for processing (e.g., self-cleaving) efficiency. In vitro transcription is performed using methodologies known in the art, as described below and herein.

ii. Transcribing the Population of Plasmids into RNA

The step of transcribing the population of plasmids into RNA can be performed using any methodologies known in the art. Such methodologies are described, e.g., in Green and Sambrook, Molecular Cloning, A Laboratory Manual, 4th Ed., Cold Spring Harbor Press, (2012).

Figure 7:
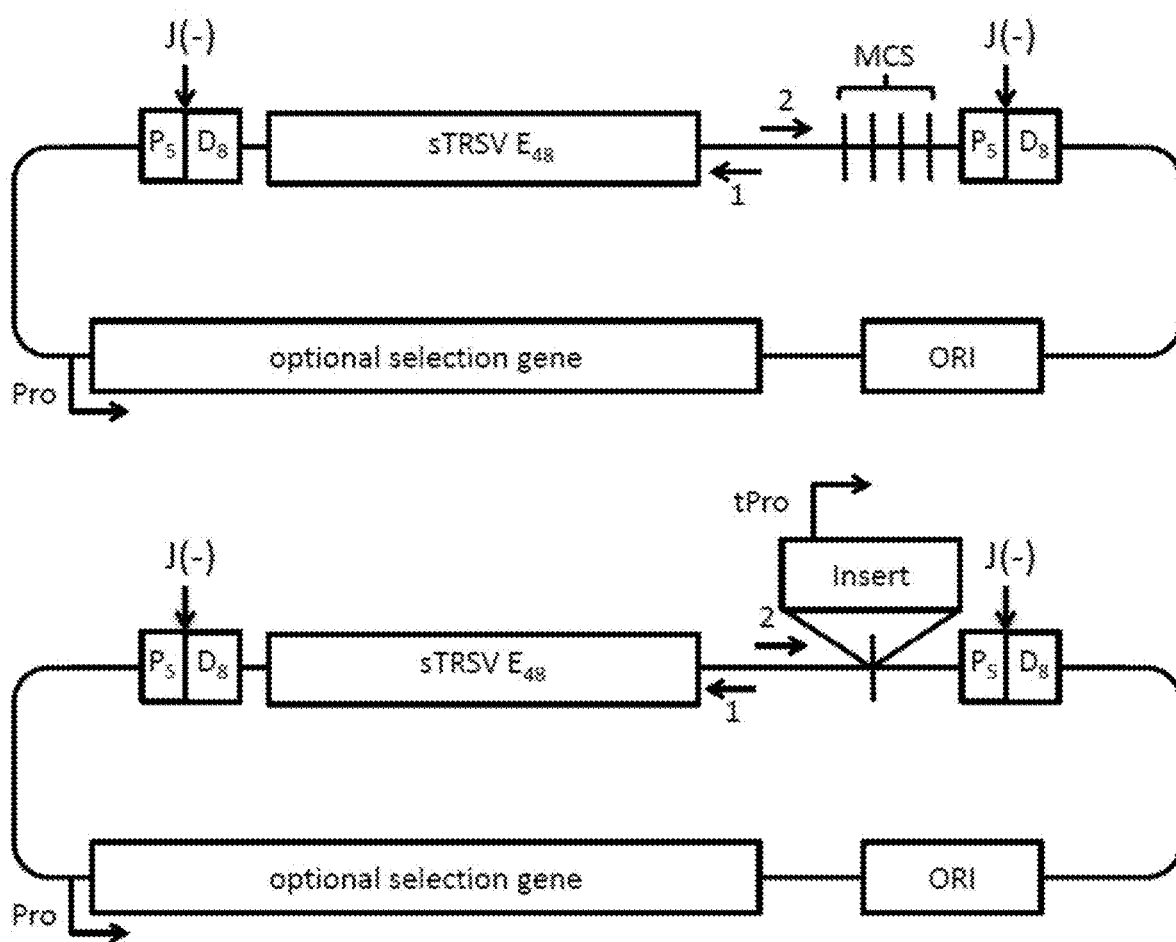
FIG. 7 illustrates cloning of the mini-monomer cassette into a plasmid backbone (e.g., pUN) followed by insertion of fragments into the mini-monomer cassette MCS. The upper construct is the plasmid backbone-ribozyme construct without potential test promoter-containing inserts (tPro). The lower construct is the same, but containing a polynucleotide suspected of encoding a test promoter-containing insert (tPro). In varying embodiments, the construct may further optionally contain an expression cassette for expression of a selection gene, in either the sense or antisense orientation in relation to the test promoter containing insert. In varying embodiments, the optional selection gene polynucleotide can be an antibiotic resistance gene (e.g., a beta-lactamase gene that confers resistance to carbenicillin or related antibiotics). The ORI refers to an origin of replication for plasmid replication.
Figure 8:
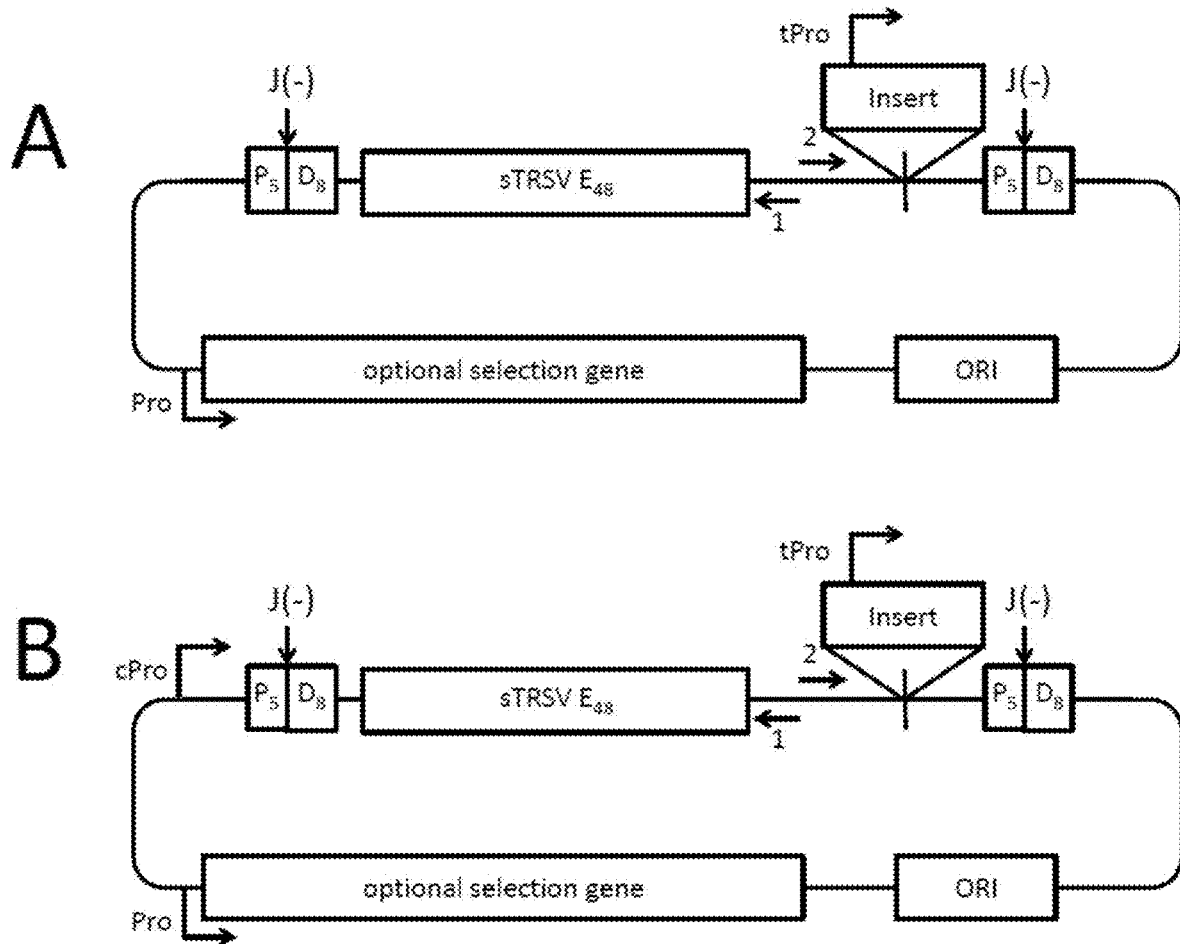
FIG. 8 illustrates a mini-monomer cassette into a plasmid backbone, with the optional addition of a control promoter (cPro), e.g., a promoter functional in a prokaryotic cell (e.g., a T7 polymerase promoter) as an internal control. Upper construct is the same as the lower construct in FIG. 7, above. Lower construct illustrates optional addition of a control promoter (cPro), e.g., a promoter functional in a prokaryotic cell (e.g., a T7 polymerase promoter). Here it is depicted 5' to the mini-monomer cassette.

As discussed above, constructs or DNA plasmids designed for screening for functional promoters have a ribozyme insert having two (−) strand ribozyme cleavage sites flanking a (−) strand ribozyme catalytic core and an inserted polynucleotide suspected of encoding a functional promoter (FIGS. 7 and 8). This ribozyme insert, inclusive of the ribozyme cleavage sites, the (−) strand ribozyme catalytic core, an inserted polynucleotide suspected of encoding a functional promoter, and forward and reverse primer annealing sequences, all between the two ribozyme cleavage sites, is referred to hereinafter as a "mini-monomer."

In varying embodiments, the step of transcribing the population of plasmids into RNA can be performed in vitro or in vivo. In vitro testing of DNA plasmids comprising a library of inserts suspected of comprising a functional promoter sequence can be achieved using nuclei preparations, nuclear extracts capable of giving in vitro transcription or purified RNA polymerases. In vivo methods entail the transformation of a suitable host cell of closed circular DNA plasmid using any method known in the art, e.g., by electroporation of protoplasts, fusion of liposomes to cell membranes, cell transfection methods using calcium ions or PEG, use of gold or tungsten microparticles coated with plasmid with the gene gun. The cells of all eukaryotic and prokaryotic organisms (plants, animals, fungi, bacteria, archaea etc.) can be used. Libraries of DNA inserts cloned into the mini-monomer cassette can be used to select promoter-containing fragments in a variety of ways. As one can only recover the PCR products after greater than full-length transcription which only occurs with the insertion of a polynucleotide encoding a functional promoter, functional promoter sequences can be readily identified from a mixed population of polynucleotide sequences with high specificity.

An insert containing a functional eukaryotic promoter is transcribed into RNA from its transcription start site. In varying embodiments, the functional promoter is functional in a eukaryotic cell or is functional in a prokaryotic cell. The primary transcript continues around the full length of the plasmid and produces the full-length mini-monomer RNA sequence containing the full insert on its second pass through that part of the plasmid backbone through to the second ribozyme cleavage site for a second time. See, e.g., FIG. 9. In the absence of a terminator, the primary transcript can be substantially longer than shown. When the inserted polynucleotide comprises a functional promoter, the first and second ribozyme cleavage site are transcribed into RNA by a RNA polymerase, and RNA transcripts comprising the mini-monomer cassette self-cleave from the transcript. A population of circularized RNA transcripts of self-cleaved mini-monomer cassettes is formed.

Figure 9:
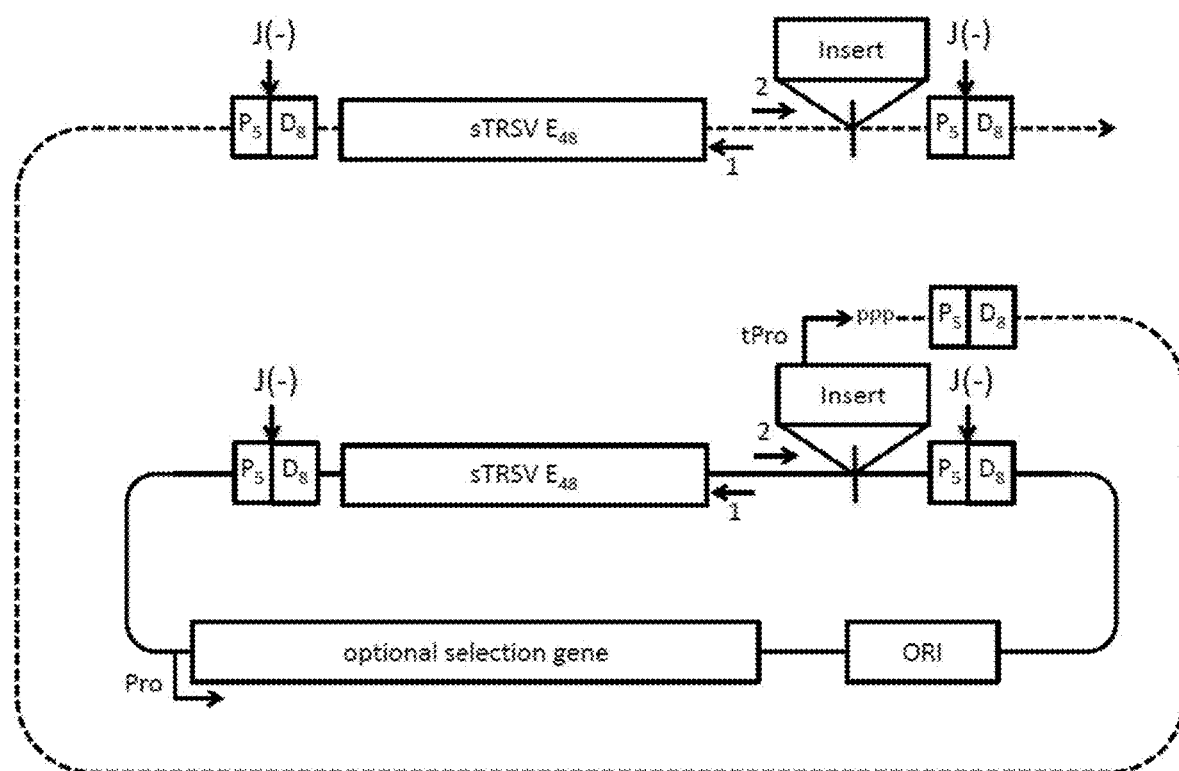
FIG. 9 illustrates a primary transcript from a plasmid comprising a mini-monomer cassette-DNA insert containing a test promoter (tPro). The dashed line represents the primary transcript. Orientation is shown by the 5' triphosphate (ppp) and the 3' hydroxyl (arrowhead at the right-hand end of the dashed line). Note that the transcript is not drawn to scale. In practice, the primary transcript is longer than depicted at the 3' end.
Figure 10:
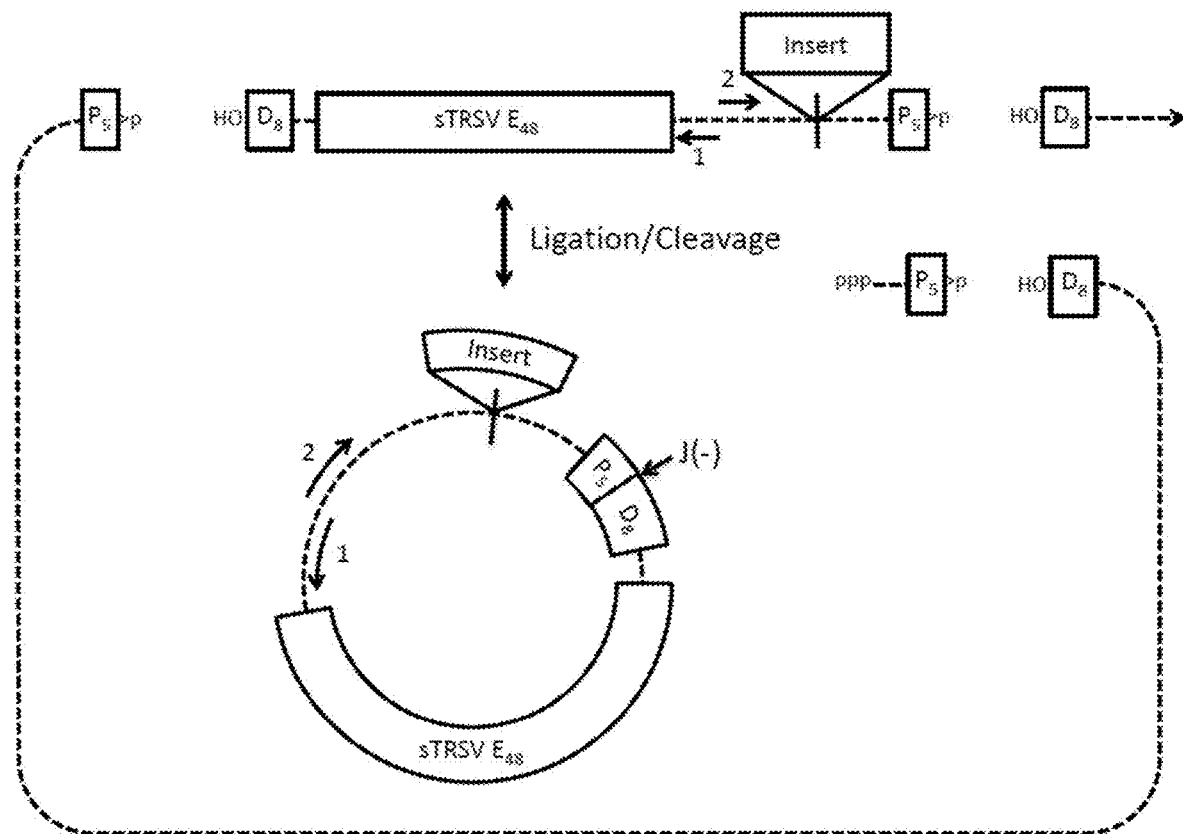
FIG. 10 illustrates complete processing products for greater than full-length RNA transcripts.

The primary transcript shown in FIG. 9 is processed (e.g., self-cleaved) to produce the excised and circularized mini-monomer cassette shown in FIG. 10. Partial processing products may also be present. Any transcript that is terminated after the ribozyme catalytic core ($E_{48}$), but before the second ribozyme cleavage site (e.g., $P_5$-$D_8$) immediately downstream of the catalytic core is processed, but is not able to form a circular mini-monomer containing the promoter-carrying insert. Any transcripts that terminate after the second ribozyme cleavage site (e.g., $P_5$-$D_8$) immediately downstream of the catalytic core is able to form a circular mini-monomer containing the promoter-carrying insert.

In varying embodiments, the methods further comprise the step of purifying or isolating the transcribed RNA from non-RNA. In varying embodiments, the methods further comprise the step of purifying or isolating the population of circularized RNA transcripts of self-cleaved mini-monomer cassettes. In varying embodiments, purifying or isolating circularized RNA transcripts of self-cleaved mini-monomer cassettes is performed by two-dimensional gel electrophoresis.

iii. Reverse-Transcribing into cDNA the Population of Circularized RNA Transcripts of Self-Cleaved Mini-Monomer Cassettes The step of reverse-transcribing the population of plasmids into cDNA can be performed using any methodologies known in the art. Such methodologies are described, e.g., in Green and Sambrook, Molecular Cloning, A Laboratory Manual, 4th Ed., Cold Spring Harbor Press, (2012). In varying embodiments, the reverse transcribing step comprises amplifying from the forward and reverse primer annealing polynucleotides (e.g., for PCR or RT-PCR).

cDNA can be synthesized from reverse transcription of the RNA of circularized and self-cleaved mini-monomer carrying a functional promoter (e.g., eukaryotic or prokaryotic) using a primer that binds at the reverse primer annealing sequence (e.g., for PCR or RT-PCR). Reverse transcription can be followed by PCR with the forward and reverse primers, thereby yielding a PCR product containing the mini-monomer sequence with the promoter-containing insert if the RNA template for reverse transcription is circular. If PCR product is amplified from residual circular plasmid DNA or on unprocessed transcripts, it will give a larger PCR product containing all of the plasmid backbone and mini-monomer cassette, which is substantially larger. Such oversized PCR product can be readily excluded, e.g., by adjusting PCR conditions or, in the case of residual DNA template, by treatment with DNase or the restriction endonuclease Dpn I. These RT PCR-derived DNAs can only be produced if a cloned DNA insert contains a functional eukaryotic promoter.

iv. Sequencing the Inserted Polynucleotides Comprising a Functional Promoter in the Population of cDNA Reverse-Transcripts of Self-Cleaved Mini-Monomer Cassettes The step of sequencing the inserted polynucleotides comprising a functional promoter in the population of cDNA reverse-transcripts of self-cleaved mini-monomer cassettes can be performed using any methodologies known in the art. Such methodologies are described, e.g., in Green and Sambrook, Molecular Cloning, A Laboratory Manual, 4th Ed., Cold Spring Harbor Press, (2012). In varying embodiments, next generation sequencing, deep sequencing or ultra deep sequencing methodologies are applied. Deep sequencing data analysis is described, e.g., in "Deep Sequencing Data Analysis (Methods in Molecular Biology)," Noam Shomron (Editor), Humana Press; 2013 edition. Next generation sequencing is described, e.g., in "Next-Generation DNA Sequencing Informatics," Stuart M. Brown (Editor), Cold Spring Harbor Laboratory Press; 1st edition (2013); "Next-generation Sequencing: Current Technologies and Applications," Jianping Xu (Editor), Caister Academic Press (2014); Wilhelm, et al., Nature. (2008) 453:1239-1243; Nagalakshmi, et al., Science. (2008) 320:1344-1349; and Mortazavi, et al., Nat. Methods. (2008) 5:621-628.

v. Exposure to External Influences

In varying embodiments, de novo selection and subsequent evolution of externally influenced promoters is performed. Using a library containing inserted polynucleotides suspected of comprising a functional promoter, as described above, insertion of this library into cells with or without some external factor (e.g., $Ca^{++}$ ions, salt, temperature stress, hormones, etc.), followed by analysis as described previously will allow detection of promoter sequences that are increased preferentially in the presence of the external factor. Analysis of these sequences allows determination of common features that can make the significant structural features more obvious. Reconstruction of a library of mutagenized sequences related to these initial sequences followed by reanalysis, again in the presence or absence of the external factor, will allow an evolutionary optimization of said sequences, ultimately leading to the selection of a de novo optimized promoter sequences that can be used in the construction of novel promoters or modified genes that are responsive to the external factor in question.

vi. Methods of Identifying Promoters Having Modulated Strengths or Transcription Efficiencies The methods described herein can be used to identify promoters derived from known promoters, but having increased or decreased transcription efficiencies. In varying embodiments, the insert suspected of comprising a functional promoter comprises a known promoter that has been mutated or mutagenized. The methods of promoter identification described above and herein allow one to take a known promoter sequence, mutagenize it, then run the mutagenized sequences through the promoter selection procedure, thereby generating a quasispecies of new promoters with a range of promoter strengths (ability to promote transcription). This procedure can be done iteratively or generationally (e.g., providing a population of polynucleotides comprising mutagenized promoters, selecting for promoters having increased or decreased transcription efficiency (as desired), recovering RT-PCR products, performing one or more further rounds of mutagenesis and then performing the steps of the methods again, as many iterations as necessary or desired).

In varying embodiments, methods for screening for promoters having modulated strength or transcription efficiencies entail the steps of:

a) providing a population of plasmids designed for screening promoters, the plasmids in the population containing an insert suspected of containing a functional promoter sequence, as described above and herein, wherein the promoter sequence comprises a polynucleotide from a known parent promoter that has been mutated;

b) transcribing the population of plasmids into RNA;

c) reverse transcribing into cDNA the population of circularized RNA transcripts of self-cleaved mini-monomer cassettes;

d) sequencing the inserted polynucleotides comprising a functional promoter in the population of cDNA reverse-transcripts of self-cleaved mini-monomer cassettes; and e) comparing the transcriptional strength or efficiency of the mutated promoter to the parent promoter.

Further embodiments of this method are the same as the methodologies described above and herein for identifying promoter polynucleotides.

vii. Methods of Identifying Natural Promoter Variants

The methods described herein can be used to identify genetic variation in the same promoter. Such variation may or may not correlate with a phenotypic difference (e.g., promoter strength and/or transcription efficiency). In varying embodiments, a library of inserts comprising the same known functional promoter from different individuals is created. The methods of promoter identification described above and herein allow one to take a known promoter sequence from a population of individuals to create a promoter library, and compare the promoter sequences of the different members of the library to identify sequence variation. For example, the promoter identification methods can be applied to the identification and comparison of the polynucleotide sequences of the same promoter from two or more different breeding line parents and the identification of variances in such promoter sequences, e.g., the identification of single nucleotide polymorphisms (SNPs). Natural variation can be found in regions of promoters that are not highly constrained and comparison of the polynucleotide sequences of the same promoter from two or more different individuals or a population of individuals can be used to identify SNPs and other longer regions within a promoter subject to variation. Genetic variation in a promoter may or may not correlate with variation in a phenotypic trait. This method applies the same methodologies described above for identifying promoter polynucleotides to two populations, e.g., one from each breeding line, and then comparing/aligning the promoter polynucleotide sequences found and looking for variation.

In varying embodiments, methods for identifying variation in a promoter sequence entail the steps of:

a) providing a population of plasmids designed for screening promoters, the plasmids in the population containing inserts suspected of containing functional promoter sequences, as described above and herein, wherein each population comprises the same potential promoter population from a different individual;

b) transcribing the population of plasmids into RNA;

c) reverse transcribing into cDNA the population of circularized RNA transcripts of self-cleaved mini-monomer cassettes;

d) sequencing the inserted polynucleotides comprising a functional promoter in the population of cDNA reverse-transcripts of self-cleaved mini-monomer cassettes; and e) comparing the polynucleotide sequences of the promoters from the different individuals, thereby identifying variation in the promoter sequence in the population.

Further embodiments of this method are the same as the methodologies described above and herein for identifying promoter polynucleotides.

b. For Identification of RNA Stability/Transcription Modifying Sequences

In varying embodiments, methods for screening for RNA stability/transcription modifying sequences entail the steps of:

a) providing a population of plasmids designed for screening for RNA stability/transcription modifying sequences, the plasmids in the population containing an insert suspected of having a RNA stability/transcription modifying sequence;

b) sequencing the first and second mini-monomer cassettes;

c) transcribing in vitro the population of plasmids into RNA from a control promoter (e.g., a promoter functional in a prokaryotic cell);

d) reverse transcribing into cDNA and sequencing the self-cleaved first and second mini-monomer cassettes transcribed in vitro in step c);

e) transcribing either in vitro or in a population of host cells the population of plasmids into RNA from a test promoter, wherein the test promoter is functional in a prokaryotic cell and/or in a eukaryotic cell;

f) reverse transcribing into cDNA and sequencing the self-cleaved first and second mini-monomer cassettes reverse transcribed in step e);

g) comparing the relative abundance or frequency of the self-cleaved second mini-monomer cassettes transcribed in vitro in step c) with the self-cleaved second mini-monomer cassettes transcribed in step e); and h) comparing the ratios of the relative abundance or frequency of the self-cleaved first mini-monomers to their linked self-cleaved second mini-monomers produced in step c) with those produced in step e).

Insertion of this library of DNA plasmids or constructs into cells or possibly transcriptionally active extracts and following the same basic protocol of RNA separation, isolation and/or purification, in vitro transcription, RT-PCR, and sequencing (e.g., deep sequencing) identifies RNA stabilizing or destabilizing inserts by screening for sequences that are increased or decreased in the deep sequencing population.

i. Sequencing the First and Second Mini-Monomer Cassettes

The first and second mini-monomer cassettes are sequenced using any methodologies known in the art. Such methodologies are described, e.g., in Green and Sambrook, Molecular Cloning, A Laboratory Manual, 4th Ed., Cold Spring Harbor Press, (2012). In varying embodiments, next generation sequencing, deep sequencing or ultra deep sequencing methodologies are applied, as described above.

A library of barcoded first mini-monomer/insert containing second mini-monomer is made. Construction of functional libraries begins with cloning of the barcodes into the first mini-monomer cassette, followed by sequencing (e.g., deep sequencing) to determine library extent. This first step barcoded library is then used to construct a library of inserts for functional testing. A subsequent round of sequencing (e.g., deep sequencing) of the barcode library and insert-containing library links any individual plasmid library member's barcode and insert sequence and shows the distribution of the sequences in the library (whether some more prevalent than others, for example).

ii. Transcribing In Vitro the Population of Plasmids into RNA

In vitro transcription of the first and second mini-monomers is performed, using methods known in the art, as discussed above. First and second mini-monomer cassettes that are fully transcribed into RNA, including downstream and then the upstream ribozyme cleavage sites, can self-cleave and circularize from the transcribed sequence.

Generally, transcription for this step is initiated from the control promoter (e.g., a promoter functional in a prokaryotic cell) positioned 5' to the first mini-monomer cassette as an internal control for processing efficiency. Mini-monomer cassettes that are transcribed into RNA over their full length, including the upstream and downstream ribozyme cleavage sites, self-cleave and circularize from the context of the DNA plasmid. The self-cleaved and circularized mini-monomer cassettes can be recovered.

Figure 11:
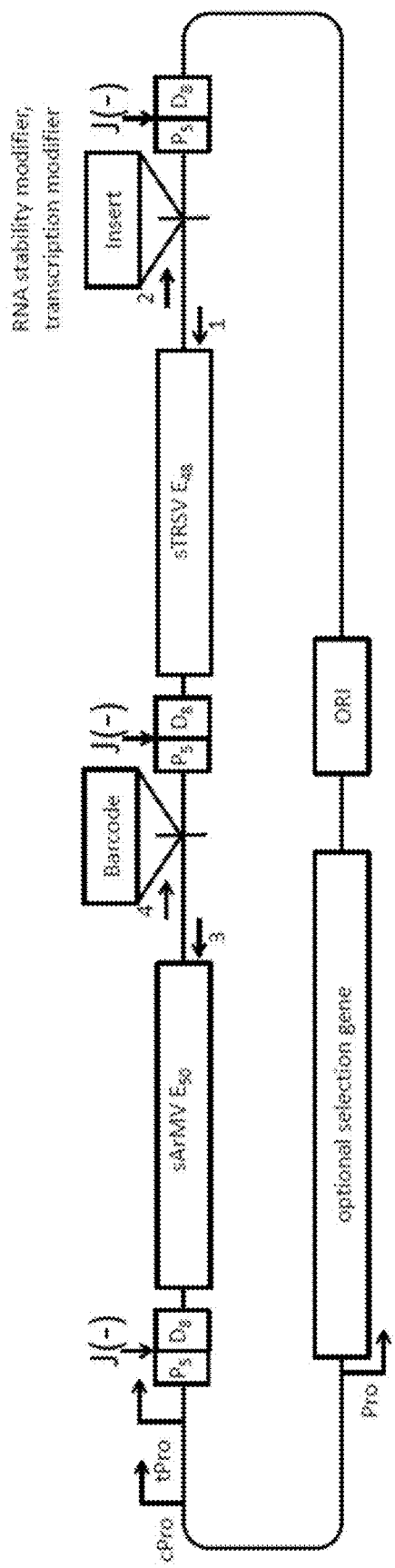
FIG. 11 illustrates an internally controlled, dimer mini-monomer construct. Notice the three P-D cleavage and ligation sites with two E ribozyme core sequences, in this embodiment, one from sArMV and one from sTRSV, between them. In some embodiments, the barcode sequence is a random DNA sequence with 15 N residues (approximately $1 \times 10^9$ different possible sequences).
Figure 12:
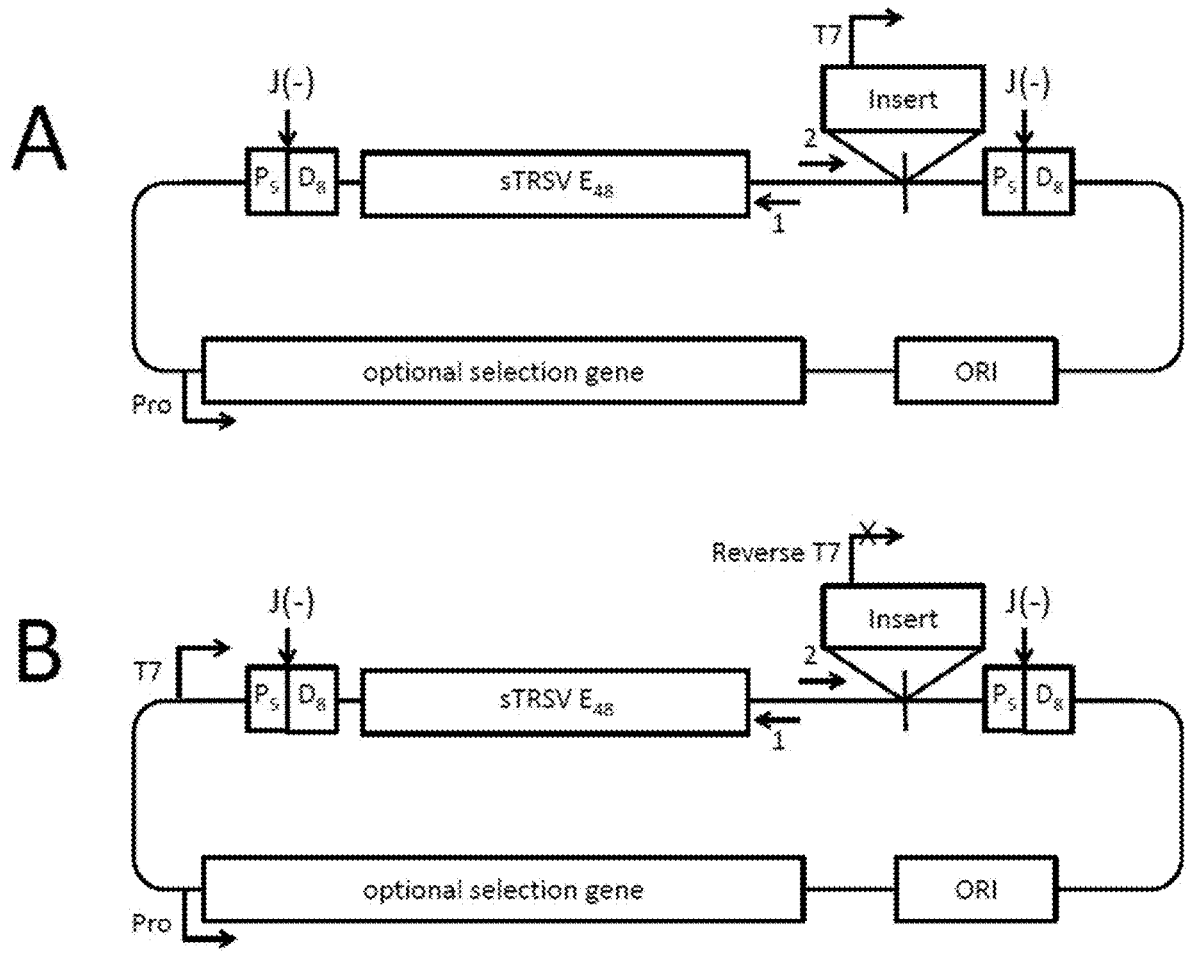
FIGS. 12A-B. (A) T7 construct containing a fully functional T7 RNA polymerase promoter as an insert. (B) reverse T7 ("7T") construct containing the reverse T7 RNA polymerase promoter (contains the T7 RNA polymerase promoter sequence written backwards) as a nonfunctional promoter as an insert.
Figure 13:
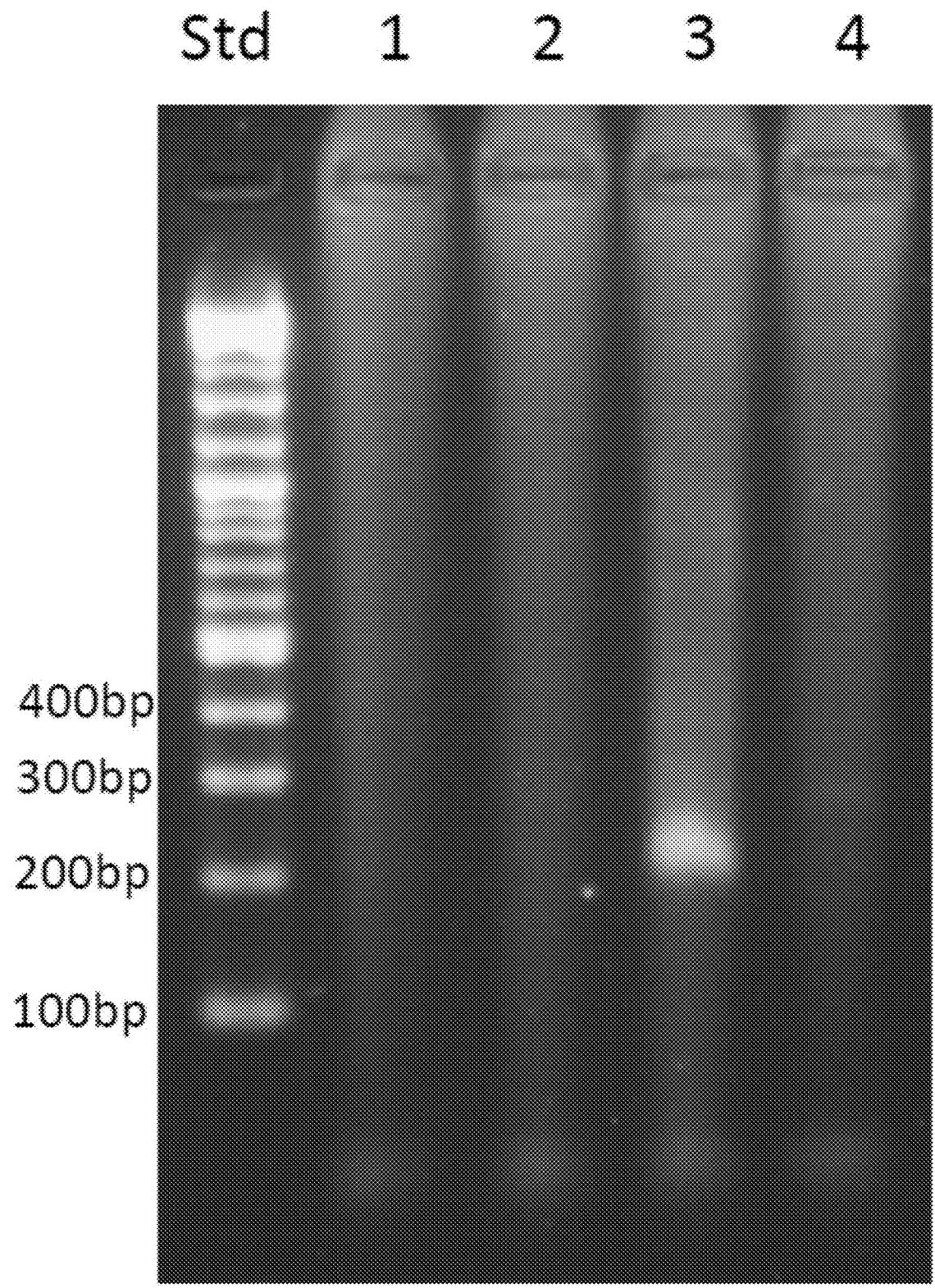
FIG. 13 illustrates T7 construct and reverse T7 construct incubated under transcription conditions with or without T7 RNA polymerase, phenol/chloroform/so-amyl alcohol extracted, ethanol precipitated, reverse transcribed, and then subjected to 20 cycles of PCR with primers 1 and 2 (e.g., reverse and forward primer annealing polynucleotides, respectively). The appropriate sized fragment should be 221 base pairs long. This band is only seen in the T7 promoter construct incubated with T7 RNA polymerase under transcription conditions. Notice the faint band in lane 4 just below 300 base pairs. Lanes: (Std) 2-Log DNA ladder from New England Biolabs; (1) T7 promoter construct incubated without T7 RNA polymerase; (2) Reverse T7 promoter construct without T7 RNA polymerase; (3) T7 promoter construct with T7 RNA polymerase; and (4) Reverse T7 promoter construct with T7 RNA polymerase.
Figure 14:
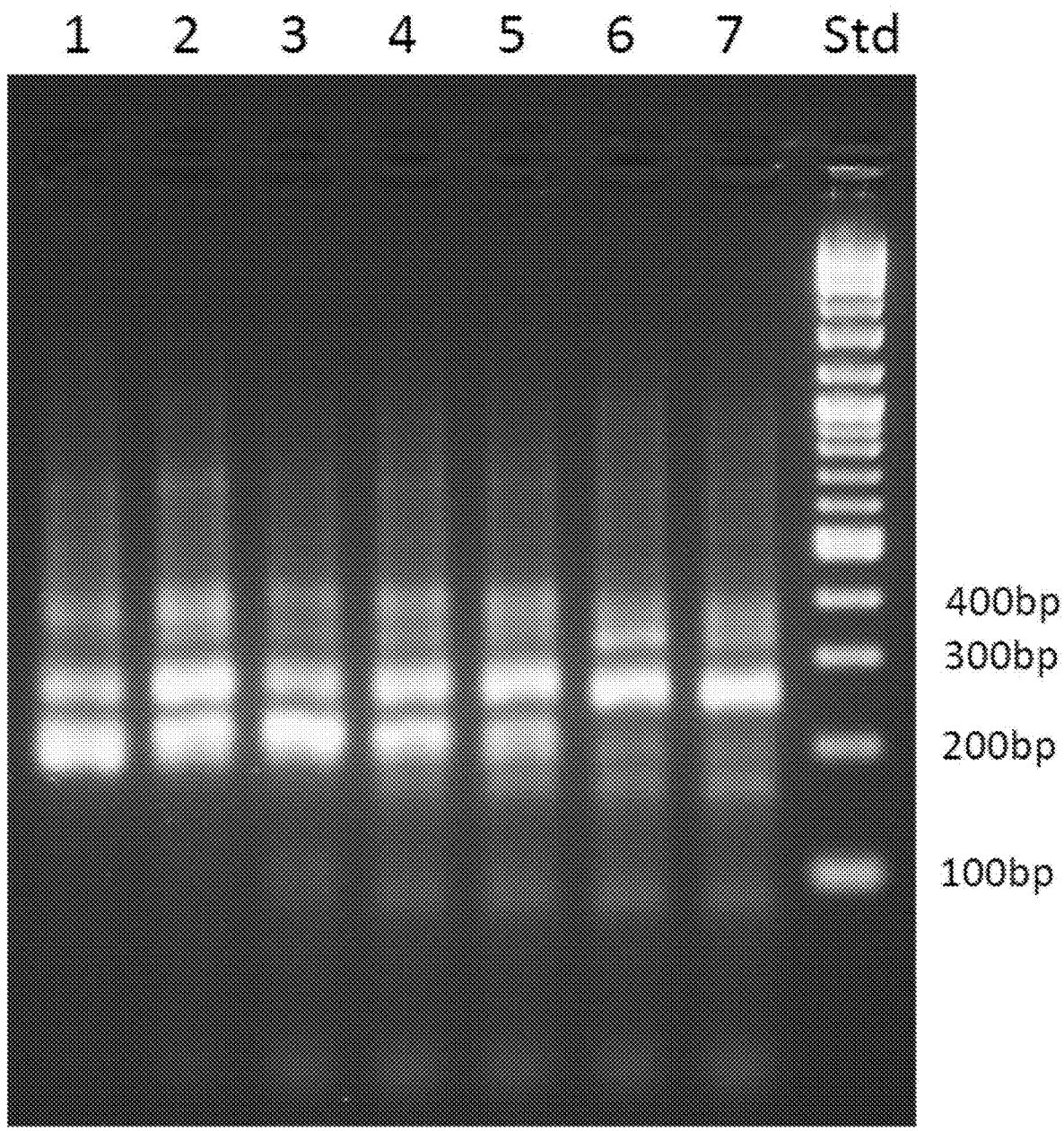
FIG. 14 illustrates a dilution series of the T7 construct mixed with a constant amount of the reverse T7 construct incubated under transcription conditions with T7 RNA polymerase, phenol/chloroform/so-amyl alcohol extracted, ethanol precipitated, reverse transcribed, and then subjected to 35 cycles of PCR with primers 1 and 2. The appropriate sized fragment should be 221 base pairs long. This band is seen in the lane with $1:10^{-4}$ reverse T7 promoter construct: T7 promoter construct incubated with T7 RNA polymerase. Lanes: (1) 1:1 reverse T7 promoter construct:T7 promoter construct; (2) $1:10^{-1}$ reverse T7 promoter construct:T7 promoter construct; (3) $1:10^{-2}$ reverse T7 promoter construct: T7 promoter construct; (4) $1:10^{-3}$ reverse T7 promoter construct:T7 promoter construct; (5) $1:10^{-4}$ reverse T7 promoter construct:T7 promoter construct; (6) $1:10_{-5}$ reverse T7 promoter construct:T7 promoter construct; (7) reverse T7 promoter construct only; and (Std) 2-Log DNA ladder from New England Biolabs.

In varying embodiments, the methods further comprise the step of purifying or isolating the transcribed RNA from non-RNA. In varying embodiments, the methods further comprise the step of purifying or isolating the population of circularized RNA transcripts of self-cleaved mini-monomer cassettes. In varying embodiments, purifying or isolating circularized RNA transcripts of self-cleaved mini-monomer cassettes is performed by two-dimensional gel electrophoresis.

iii. Reverse Transcribing into cDNA and Sequencing the Self-Cleaved First and Second Mini-Monomer Cassettes Transcribed into RNA In Vitro The self-cleaved first and second mini-monomers that were transcribed into RNA in vitro are reverse-transcribed into cDNA and then sequenced (e.g., deep sequenced) using methods known in the art, as discussed above. Reverse transcription and sequencing (e.g., deep sequencing can be performed using any methods known in the art, as described above. Generally, reverse transcription in this step can be initiated from the first reverse primer annealing polynucleotide (e.g., for PCR or RT-PCR) for the first mini-monomer cassette and from the second reverse primer annealing polynucleotide (e.g., for PCR or RT-PCR) for the second mini-monomer cassette, wherein the location or positioning of the first and second forward and reverse primer annealing polynucleotides (e.g., for PCR or RT-PCR) is as depicted in FIG. 11. PCR is performed using the first forward and reverse primer annealing polynucleotides (e.g., for PCR or RT-PCR) for amplifying the first self-cleaved and circularized mini-monomer cassettes comprising the barcode polynucleotides and second forward and reverse primer annealing polynucleotides (e.g., for PCR or RT-PCR) for amplifying the second self-cleaved and circularized mini-monomer cassettes, comprising the insert suspected of encoding a RNA stability and/or transcriptional modifying sequence.

This step functions as an internal control for circularization efficiency within the first and second mini-monomer cassettes (barcode and insert containing RNA and/or transcription stability modifier). It is possible that particular barcodes or inserts have increased or decreased circularization when transcribed into RNA in vitro.

iv. Transcribing In Vitro or in a Population of Host Cells the Population of Plasmids into RNA The DNA plasmid library can be transcribed, in vitro or in a host cell. In varying embodiments, the DNA plasmid library is transcribed in vitro. This can be done according to methods known in the art, and described herein. In varying embodiments, the DNA plasmid library is transformed into a population of host cells, where they are transcribed into RNA, and the transcribed mini-monomers circularize and self-cleave within the host cell. Whether transcribed in vitro or in a host cell, the self-cleaved and circularized mini-monomers are recovered, reverse-transcribed into cDNA and sequenced (e.g., deep sequenced).

As discussed above, in vivo transformation of a suitable host cell with a closed circular DNA plasmid using any method known in the art, e.g., by electroporation of protoplasts, fusion of liposomes to cell membranes, cell transfection methods using calcium ions or PEG, use of gold or tungsten microparticles coated with plasmid with the gene gun. Mini-monomer cassettes that are transcribed into RNA along their full length, including the upstream and downstream ribozyme cleavage sites, can self-cleave and circularize. The self-cleaved and circularized mini-monomer cassettes can be recovered.

Accordingly, in varying embodiments, the methods further comprise the step of purifying or isolating the transcribed RNA from non-RNA. In varying embodiments, the methods further comprise the step of purifying or isolating the population of circularized RNA transcripts of self-cleaved mini-monomer cassettes. In varying embodiments, purifying or isolating circularized RNA transcripts of self-cleaved mini-monomer cassettes is performed by two-dimensional gel electrophoresis.

v. Reverse Transcribing into cDNA and Sequencing the Self-Cleaved First and Second Mini-Monomer Cassettes The self-cleaved first and second mini-monomers that were functionally transcribed into RNA either in vitro or in vivo (e.g., in a host cell) are reverse-transcribed into cDNA and then sequenced (e.g., deep sequenced) using methods known in the art, as discussed above. Reverse transcription and sequencing (e.g., deep sequencing can be performed using any methods known in the art, as described above. Generally, reverse transcription in this step can be initiated from the first reverse primer annealing polynucleotide (e.g., for PCR or RT-PCR) for the first mini-monomer cassette and from the second reverse primer annealing polynucleotide (e.g., for PCR or RT-PCR) for the second mini-monomer cassette, wherein the location or positioning of the first and second forward and reverse primer annealing polynucleotides (e.g., for PCR or RT-PCR) is as depicted in FIG. 11. PCR is performed using the first forward and reverse primer annealing polynucleotides for amplifying the first self-cleaved and circularized mini-monomer cassettes comprising the barcode polynucleotides and second forward and reverse primer annealing polynucleotides for amplifying the second self-cleaved and circularized mini-monomer cassettes, comprising the insert suspected of encoding a RNA stability and/or transcriptional modifying sequence.

vi. Comparing the Relative Abundance or Frequency of the Self-Cleaved Second Mini-Monomer Cassettes Reverse-Transcribed into cDNA In Vitro with the Self-Cleaved Second Mini-Monomer Cassettes Reverse-Transcribed into cDNA The frequency and abundance of circularized self-cleaved inserted polynucleotide sequences functionally transcribed into RNA either in vitro or in a host cell are compared with the frequency and abundance of circularized self-cleaved inserted polynucleotide sequences transcribed into RNA in the in vitro control. Any that have increased in relation to their frequency in the DNA library contain either a transcription enhancer or a RNA stabilizing sequence. Both possibilities can cause an increase in the amount of mini-monomer RNA with that sequence. Any that have decreased in relation to their frequency in the DNA library contain either a transcription decreasing sequence or a RNA destabilizing sequence. Both possibilities can cause a decrease in the amount of mini-monomer RNA with that sequence.

vii. Comparing the Ratios of the Relative Abundance or Frequency of the Self-Cleaved First Mini-Monomers to their Linked Self-Cleaved Second Mini-Monomers The ratios of the barcoded mini-monomers to their linked insert mini-monomers are compared. Reverse transcription can be performed, e.g., with the first and second reverse primers, followed by PCR with the second forward and reverse primers to measure the presence of the insert-containing mini-monomer and first forward and reverse primers to measure the presence of the barcode-containing mini-monomer. See, e.g., FIG. 11. Comparison of the ratio of the appropriate barcoded mini-monomer to its linked insert mini-monomer allows discrimination between those inserts that actually affect RNA stability and those that affect transcription. Those that affect RNA stability increase or decrease the insert mini-monomer relative to the barcode mini-monomer if they increase or decrease the RNA stability, respectively. Those that affect transcription only do not affect the ratio, instead increasing or decreasing both mini-monomers coordinately.

In the case of an increase, if the ratio is unchanged, then the sequence is a transcriptional enhancer. It causes both mini-monomers to increase the same amount. If the ratio is changed with the insert being higher, then it is a RNA stabilizing sequence. It only increases the amount of the insert mini-monomer. In the case of a decrease, if the ratio is unchanged, then the sequence is a transcriptional reducing sequence. It causes both mini-monomers to decrease the same amount. If the ratio is changed with the insert being lower, then it is a RNA destabilizing sequence. It only decreases the amount of the insert mini-monomer.

In varying embodiments, the ratio of the first bar-coded mini-monomer to the second insert-containing mini-monomer produced inside host cells can be normalized by division by the ratio of the first bar-coded mini-monomer to the second insert-containing mini-monomer produced in vitro. To provide an example, the ratio of the bar-coded mini-monomer to insert-containing mini-monomer is 0.5, e.g., due to a lower circularization efficiency of the bar-coded mini-monomer (presumably due to sequence specific effects on circularization by the bar code sequence). In the case of a transcriptional enhancer, an increase in the relative abundance of the insert-containing mini-monomer produced in the host cell is observed relative to that produced in vitro, but the ratio of the bar-coded mini-monomer to insert-containing mini-monomer produced in the host cells remains at 0.5. Likewise, in the case of a transcriptional repressor, a decrease in the relative abundance of the insert-containing mini-monomer produced in the host cell is observed relative to that produced in vitro, but the ratio of the bar-coded mini-monomer to insert-containing mini-monomer produced in the host cells remains at 0.5. In the case of a RNA stabilizing sequence, an increase in the relative abundance of the insert-containing mini-monomer produced in the host cell is observed relative to that produced in vitro, but the ratio of the bar-coded mini-monomer to insert-containing mini-monomer produced in the host cells is lower than 0.5 (more insert-containing mini-monomer relative to bar-coded mini-monomer). The ratio between the bar-coded mini-monomer and the insert-containing mini-monomer could be greater or less than 1.

viii. Exposure to External Influences

In varying embodiments, de novo selection and subsequent evolution of externally influenced transcriptional or RNA stability sequences is performed. Using a library containing inserted polynucleotides suspected of comprising a RNA stability/transcription modifying sequence, as described above, insertion of this library into cells with or without some external factor (e.g., $Ca^{++}$ ions, salt, temperature stress, hormones, etc.), followed by analysis as described previously will allow detection of sequences that are increased preferentially in the presence of the external factor. Analysis of these sequences allows determination of common features that can make the significant structural features more obvious. Reconstruction of a library of mutagenized sequences related to these initial sequences followed by reanalysis, again in the presence or absence of the external factor, will allow an evolutionary optimization of said sequences, ultimately leading to the selection of a de novo optimized transcriptional or RNA stability sequence that can be used in the construction of novel promoters or modified genes that are responsive to the external factor in question.

ix. Methods of Identifying Modulated RNA Stability/Transcription Modifying Sequences The methods described herein can be used to identify RNA stability/transcription modifying sequences derived from known RNA stability/transcription modifying sequences, but having increased or decreased RNA stability/transcription modifying efficiencies or strengths. In varying embodiments, the insert suspected of comprising a RNA stability/transcription modifying sequence comprises a known RNA stability/transcription modifying sequence that has been mutated or mutagenized. The methods of RNA stability/transcription modifying sequence identification described above and herein allow one to take a known RNA stability/transcription modifying sequence, mutagenize it, then run the mutagenized sequences through the RNA stability/transcription modifying sequences selection procedure, thereby generating a quasispecies of new RNA stability/transcription modifying sequences with a range of RNA stability/transcription modifying sequences strengths (ability to increase or decrease RNA stability and/or transcription). This procedure can be done iteratively or generationally (e.g., providing a population of polynucleotides comprising mutagenized promoters, selecting for RNA stability/transcription modifying sequences having increased or decreased transcription efficiency (as desired), recovering RT-PCR products, performing one or more further rounds of mutagenesis and then performing the steps of the methods again, as many iterations as necessary or desired).

4. Method of Identifying a Polynucleotide Sequence Bound by a Transcription Factor Further provided are methods of identifying a polynucleotide sequence bound by a transcription factor. The methods are useful to identify the polynucleotide sequence or sequences bound by any transcription factor known in the art. Sequences identified to be bound by one or more transcription factors can be mutagenized, rerun through the steps of the methods as described herein, and then used to determine stronger or weaker binding site for the transcription factor, as desired. The method entails using a inhibitory nucleic acid, e.g., an RNAi, to reduce the expression and/or activity of the transcription factor being tested. In varying embodiments, the steps of the method comprise:

a) providing a population of plasmids as described above and herein for use in identifying RNA stability/transcription modifying sequences.

b) sequencing the first and second mini-monomer cassettes; thereby linking the barcode polynucleotide to a unique inserted polynucleotide suspected of comprising a RNA stability modifier;
c) transcribing in vitro the population of plasmids into RNA from a control promoter (e.g., a promoter functional in a prokaryotic cell), wherein RNA transcripts comprising the first and second mini-monomer cassettes self-cleave from the transcript;
d) sequencing the self-cleaved first and second mini-monomer cassettes transcribed in vitro; thereby controlling for cleavage and circularization efficiency;
e) transcribing the population of plasmids into RNA from the promoter functional in a eukaryotic cell, wherein the transcribing is performed in a population of host cells and in the presence and absence of an inhibitory nucleic acid that inhibits or reduces the expression of the transcription factor, wherein RNA transcripts comprising the first and second mini-monomer cassettes self-cleave from the transcript;
f) sequencing the self-cleaved first and second mini-monomer cassettes transcribed in a host cell;
g) comparing the relative abundance or frequency of the self-cleaved second mini-monomer cassettes transcribed in the host cell in the presence of the inhibitory nucleic acid with the self-cleaved second mini-monomer cassettes transcribed in a host cell in the absence of the inhibitory nucleic acid, wherein a higher or increased relative abundance or frequency of the self-cleaved second mini-monomer cassettes transcribed in a host cell in the absence of the inhibitory nucleic acid identifies the polynucleotide sequence bound by the transcription factor. In varying embodiments, the inhibitory nucleic acid is an interfering RNA polynucleotide (RNAi). The transcription and sequencing steps can be performed as described above. Further embodiments of the method are as described above for the methods of identifying RNA stability/transcription modifying sequences.

5. Kits

Further provided are kits containing one or more of the constructs or DNA plasmids for screening for promoters or for RNA or transcriptional modifying sequences, as described herein. In varying embodiments, the kits can further comprise in one or more containers or vessels buffers, reagents, nucleotides, enzymes, control polynucleotides, and instructions for use. In varying embodiments, the kits comprise a library of DNA plasmids for use in screening for RNA or transcriptional modifying sequences, wherein in each member of the library, the first mini-monomer cassette has already been preloaded with a unique barcode polynucleotide. Accordingly, each member of the library of DNA plasmids contains a first mini-monomer cassette comprising a different barcode polynucleotide.

EXAMPLES

The following examples are offered to illustrate, but not to limit the claimed invention.

Example 1

An Illustrative Protocol for Selection of Promoters
Materials
1. A plasmid containing
   a. a selectable marker for identifying *E. coli* bacteria containing said plasmid
   b. an origin of replication for maintenance of the plasmid within the *E. coli* bacteria
   c. a mini-monomer cassette containing
      i. a ribozyme catalytic core from the negative strand of the satellite RNA of tobacco ringspot virus (sTRSV)
      ii. two ribozyme cleavage/ligation sites capable of being cleaved and ligated by the ribozyme catalytic core
      iii. binding sites for primers appropriate for reverse transcriptase-polymerase chain reaction (RT-PCR)
      iv. a multiple cloning site (MCS) containing multiple sequentially arranged, adjacent restriction endonuclease cleavage sites for cloning. See, e.g., FIGS. 1-2A-E and 6-8.
2. Random DNA fragments inserted into the MCS from any of the following sources
   a. In vivo-derived DNAs from any biological organism including, but not limited to plants, animals, fungi, protists, bacteria, or Archaea
   b. In vitro-derived DNAs from chemical or enzymatic DNA synthesis
   c. Said random DNA fragments prepared by total or partial DNA degradation by restriction endonuclease cleavage, physical fragmentation followed by ligation of DNA linkers, PCR with random nonamers attached to specific primers followed by PCR with these specific primers, or other methods of DNA fragmentation appropriate for cloning into one or more MCS restriction endonuclease cleavage sites,
3. Reagents for preparation and ligation of random DNA fragments into plasmid to create plasmid libraries
   a. Restriction endonucleases
   b. T4 DNA ligase
   c. Deoxyribonucleotide triphosphates
   d. Klenow fragment of *E. coli* DNA polymerase
4. Reagents for introduction and amplification of plasmid libraries in *E. coli*
   a. Electroporation-quality competent *E. coli* cells
   b. Bacterial growth media, both as plates and liquid
   c. Plasmid DNA preparation materials
5. A source of RNA polymerase activity, such as:
   a. Living cells
   b. Isolated nuclei
   c. Transcriptionally-active cell extracts
   d. Purified RNA polymerases
6. Buffers, salts and ribonucleotide triphosphates appropriate for RNA synthesis if done outside living cells (in vitro)
7. Material for delivery of plasmid DNA to living cells (in vivo), including, but not limited to
   a. Liposomes
   b. Microparticles for particle bombardment made of
      i. Gold, tungsten or other material
8. Reagents for:
   a. Separation, isolation and/or purification of RNA
   b. Removal of any residual DNA
9. A primer (primer 1) complementary to any mini-monomer RNA synthesized
10. A primer (primer 2) with the same sequence as any mini-monomer RNA synthesized
11. Reverse transcriptase
12. Buffers, salts and deoxyribonucleotide triphosphates appropriate for cDNA synthesis in vitro
13. Thermo-stable DNA polymerase for PCR
14. Buffers, salts and deoxyribonucleotide triphosphates appropriate for PCR in vitro 15. Materials for cloning PCR products 16. Materials for direct sequencing Method An illustrative method for producing illustrative mini-monomer RNAs containing promoter sequences I. Construction of Plasmid Library (Listed in Materials)

Mini-monomer cassette-containing plasmid is digested at one of the restriction endonuclease cleavage sites within the MCS, an example of which would be the restriction endonuclease, Sal I, which leaves a four base palindromic 5' overhang of TCGA. Addition of dTTP, dCTP and the Klenow fragment of E. coli DNA polymerase will convert the four base, palindromic 5' overhang left after Sal I cleavage to a two base, non-palindromic 5' overhang. TC 5' extensions will no longer ligate to each other. This reduces the background of re-ligated plasmid during the cloning of the DNA library. The plasmid is now ready to receive the random DNA fragments.

The random DNA fragments can be produced in a variety of ways.

A desired organism's DNA must be purified by either a commercial DNA purification kit (DNAeasy) or other previously established non-commercial method (CTAB, etc.). The simplest method of producing the random DNA fragments from this purified DNA is complete digestion with a restriction endonuclease that will ultimately be compatible with the half-filled, Sal I digested mini-monomer cassette-containing plasmid, an example would be the restriction endonuclease, Sau3AI, which recognizes and cleaves the 4 base sequence GATC, leaves a 4 base palindromic 5' overhang, and should cut randomly approximately every 256 base pairs. Addition of dGTP, dATP and the Klenow fragment of E. coli DNA polymerase will convert the four base, palindromic 5' overhang left after Sau3AI cleavage to a two base, non-palindromic 5' overhang just as was done for the Sal I cleaved plasmid. The 2 base, non-palindromic 5' overhangs of the Sal I-cleaved plasmid and the Sau3AI-cleaved DNA are not compatible with themselves, but are compatible with each other. This should reduce the background of plasmid self-ligation, ligation of insert DNAs to each other and ensure that most plasmids recovered during library construction will have one and only one insert. The use of Sal I and Sau3AI is not exclusive (see Korch C. "Cross index for improving cloning selectivity by partially filling in 5'-extensions of DNA produced by type II restriction endonucleases." Nucleic Acids Res. 1987 Apr. 24; 15(8):3199-220). Many other restriction endonuclease pairs can be used in the same way and the restriction endonuclease cleavage sites in the MCS are chosen to maximize the number of possible cloning choices.

Alternative preparation methods for the purified organismal DNA include partial rather than complete digestion with the desired restriction endonuclease, PCR with primers ending with random nonamer sequences (Robi D. Mitra and George M. Church. (1999) "In situ localized amplification and contact replication of many individual DNA molecules" Nucl. Acids Res. 27 (24)) followed by size selection followed by restriction endonuclease cleavage and filling as described, or random fragmentation and size fractionation of the DNA followed by ligation of linkers with compatible overhangs for ligation to the half-filled, Sal I cleaved plasmid, (See, e.g., Zabarovsky E R, Allikmets R L. (1986) "An improved technique for the efficient construction of gene libraries by partial filling-in of cohesive ends." Gene 42(1): 119-23; Sambrook, J. and Russell, D. W. (2001) "Molecular Cloning: A Laboratory Manual." Cold Spring Harbor Laboratory Press, Cold Spring Harbor, NY.)

An alternative to the use of organismal DNA is the use of chemically-synthesized random DNA and selection of any functional promoters from that random DNA population. Ligation of the inserts into the mini-monomer vector makes a plasmid library.

II. Introduce the Plasmid Library (from 1 Listed in Materials) Using Materials (from 3 or 4) into an Environment Containing RNA Polymerase (from 2) Under Appropriate Conditions for RNA Synthesis Either In Vitro or In Vivo.

An in vitro example: Prepare a library of randomized chemically synthesized DNA sequences based on the existing bacteriophage T7 RNA polymerase promoter cloned into the mini-monomer vector. Incubate this library with purified bacteriophage T7 RNA polymerase.

An in vivo example: For tobacco promoters, use inserts from tobacco genomic DNA cloned into the mini-monomer vector to make a library. Prepare plasmid DNA from the complete library, coat gold or tungsten particles (from 7b) with the library plasmid DNA, then use a biolistic particle delivery system to transfer the library of plasmids into plant nuclei (Julie R. Kikkert, José R. Vidal, and Bruce I. Reisch "Stable Transformation of Plant Cells by Particle Bombardment/Biolistics" Methods in Molecular Biology, vol. 286: Transgenic Plants: Methods and Protocols Edited by: L. Pefia C Humana Press Inc., Totowa, NJ).

III. Purification of Total RNA and Removal of any Residual DNA Using Appropriate Reagents (from 5).

In vitro synthesized RNA is purified after removal of the plasmid DNA library by digestion with commercial RNase-free DNase (Qiagen), followed by phenol/chloroform/isoamyl alcohol (25:24:1) extraction, removal of the aqueous phase to a new tube, and ethanol precipitation of the RNA from the aqueous phase with or without glycogen or linear acrylamide carrier.

In vivo synthesized RNA is purified with either a commercial kit (Qiagen RNAeasy) or with a TRIzol extraction protocol (Chomczynski, P., and Sacchi, N. (1987) Single Step Method of RNA Isolation by Acid Guanidinium Thiocyanate-Phenol-Chloroform Extraction. Anal. Biochem. 162, 156-159) (alternative protocols are used as needed depending on the source of the RNA to be purified).

IV. cDNA Synthesis Using Reverse Transcriptase. Buffer and Primer (from 9-12)

cDNA synthesis from purified total RNA is done using SuperScript II using the manufacturer's protocol (Life Technologies). Alternatively SuperScript III or other reverse transcriptase can be used. Primer 1 (from 9) is added to the total RNA in water and deoxynucleotide triphosphates, heated to 65 degrees C. for 5 minutes followed by quick chilling on ice. The other components necessary for cDNA synthesis is added (first strand reverse transcriptase buffer, dithiothreitol (DTT), and the mixture incubated at 42 for 2 minutes. Reverse transcriptase is added and the entire mixture is incubated at 42 degrees C. for 50 minutes, followed by enzyme inactivation at 70 degrees C. for 15 minutes.

V. PCR Using the Primers, Buffers, and Thermo-Stable DNA Polymerase (from 9, 10, 13 and 14)

PCR reactions are done on the synthesized cDNA using Herculase II Fusion DNA polymerase (Agilent Genomics) using the manufacturer's protocol. Alternatively, other thermostable DNA polymerases can be substituted such as Phusion DNA polymerase (NewEnglandBiolabs).

Annealing conditions for the PCR are adjusted depending on the melting temperatures based on the specific sequences of primers 1 and 2 (from 9 and 10). Extension times should be minimized to amplify only the smaller products derived from cDNA derived from the total RNA containing the circular ribozyme-ligated RNA. The number of PCR cycles necessary should be determined empirically depending on the concentration of amplifiable cDNA present.

Newly synthesized PCR products are checked on either 1 to 2 percent TBE or TAE agarose gels or on 5% non-denaturing TBE polyacrylamide gels depending on the resolution desired for a given experiment. Purification of any individual strong bands can be achieved from either of these gel types, if desired.

VI. Cloning Newly Synthesized PCR Products (from 15) or Direct Sequencing of New Synthesized PCR Products (from 16)

Once synthesized, PCR products can either be cloned as blunt ended DNA fragments by TOPO cloning (Life Technologies) using the manufacturer's protocol, or by restriction endonuclease cleavage of the PCR products at restriction endonuclease cleavage sites incorporated into primers 1 and 2 back into the mini-monomer plasmid for subsequent analysis or further rounds of selection, or into any other plasmid containing compatible restriction endonuclease cleavage sites. These clones represent individual promoter sequences. General mutation, for example through mutagenic PCR, of these individual promoters followed by subsequent selection and analysis of the promoter strength in vitro or in vivo leads to potentially patentable material.

Direct sequencing is an essential aspect of this method and depends on the use of primer 1 and 2 (from 9 and 10) chosen to match existing deep sequencing primer sets, for example those for MiSeq or HiSeq (Illumina), including the ability to use "bar coding" to get sequences from multiple experiments in a single deep sequence run due to sequencing costs (Illumina). The selection of MiSeq, which produces fewer total sequences (10s of millions), or HiSeq, which produces more total sequences (100s of millions) are made based on the expectation of the complexity of the potential promoter population being examined and the need for getting sufficient numbers of sequences for statistical analysis.

Example 2

An Illustration of Promoter Selection

This example illustrates an embodiment of the methods for selection of polynucleotides encoding a promoter.

Figure 6:
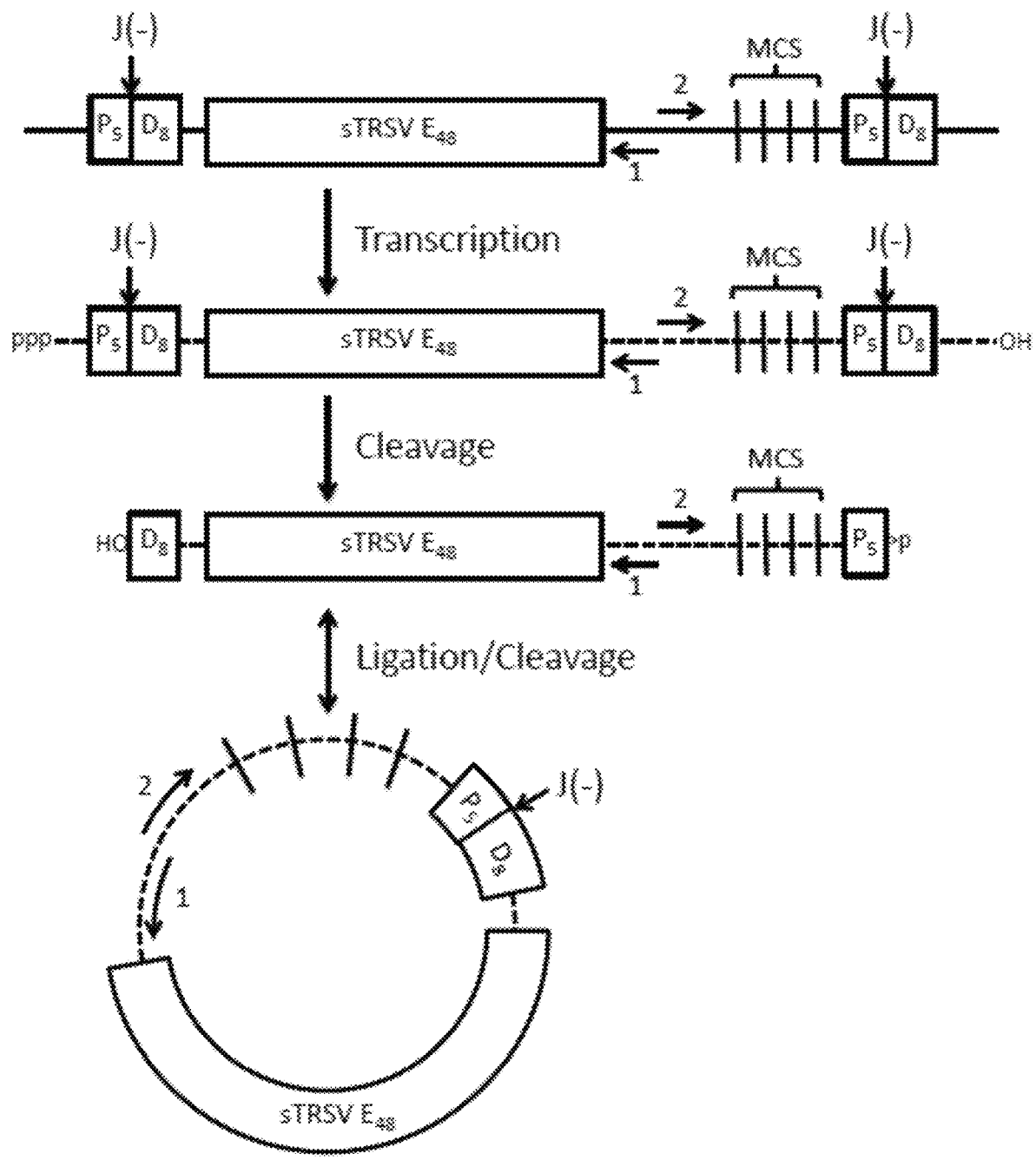
FIG. 6 illustrates a mini-monomer cassette. P and D represent the 5' and 3' sides of the (−) strand ribozyme cleavage size. E represents the (−) strand ribozyme catalytic core. The subscripted numbers represent the number of ribozyme catalytic core nucleotides present in each of these sections. The J(−) designated by the black down arrows represents the cleavage and ligation sites used by the ribozyme catalytic core. The multiple cloning site (MCS) has a number of unique restriction endonuclease cleavage sites. The black arrows labeled 1 and 2 represent primers for RT-PCR. The arrows represent the 3' end of the primers. Transcription produces a primary transcript beginning with a 5' triphosphate (ppp) and a 3' hydroxyl (OH). Ribozyme-mediated processing (e.g., self-cleaving) at the J(−) sites giving a linear mini-monomer RNA with a 5' hydroxyl (HO) and a 2':3' cyclic phosphodiester (>p). Intramolecular ligation and cleavage interconverts the linear mini-monomer RNA to a circular mini-monomer RNA.

The initial construct can have the following form. Two (−) strand ribozyme cleavage sites along with a (−) strand ribozyme catalytic core is cloned along with a multiple cloning site in the follow order (FIG. 6). This ribozyme insert is referred to as a mini-monomer.

Transcription of this insert by a promoter outside the mini-monomer insert produces a primary transcript shown in FIG. 6. Complete ribozyme-mediated cleavage of this primary transcript produces the linear mini-monomer RNA (FIG. 6). The other cleavage products as well as partial ribozyme-mediated cleavage products are not shown, but would be present. Intramolecular ligation and cleavage interconverts this product from a linear mini-monomer to a circular mini-monomer form and from a circular mini-monomer to a linear mini-monomer form respectively.

This mini-monomer cassette is cloned into a plasmid backbone. In this example pUN is used. pUN is a minimal plasmid derived from pUC18 by removal of all but the origin of replication and the selection gene (here, an antibiotic resistance gene, e.g., a beta-lactamase (bla) gene). In this example, the plasmid backbone contains two unique restriction sites, EcoRV and NotI. pUN was selected for its short length to maximize the chances of greater than full length transcripts being produced. The mini-monomer cassette is cloned directionally such that transcription from the bla gene promoter produces the anti-sense version of the ribozyme fragment (FIG. 7).

FIG. 7 shows the plasmid backbone with mini-monomer cassette construct (e.g, pUN1). Notice that the promoter for the beta-lactamase gene is oriented such that any transcription from it gives the antisense of the mini-monomer cassette. This lowers the possibility of accidental promoter discovery due to the beta-lactamase promoter, however it could be in either orientation. Inserts possibly containing eukaryotic promoters are cloned into the mini-monomer cassette MCS of the plasmid backbone (e.g, pUN1)-mini-monomer cassette plasmid. These inserts can have a large number of sources such as fragments containing random nucleotides, restriction fragments of eukaryotic DNA, or randomized PCR fragments of eukaryotic DNA, most likely size selected. This is not an exhaustive list of possible insert DNA sources.

An insert containing a functional eukaryotic promoter is transcribed into RNA from its transcription start site. Notice that while part of the insert is found at the 5' end of the primary transcript, most, if not all, of the promoter itself is not found until later. However, as the plasmid backbone (e.g., pUN) is small and is designed not to contain a functional eukaryotic terminator, the primary transcript continues around the full length of the plasmid and the full insert on its second pass through that part of the plasmid. In the absence of a terminator, the primary transcript can be substantially longer than shown, and will produce the full-length mini-monomer RNA sequence containing the functional promoter.

Optionally, a control promoter (cPro), e.g., a promoter functional in a prokaryotic cell (e.g., a T7 RNA polymerase promoter and can be placed immediately 5' of the initial ribozyme cleavage site as shown in the lower construct FIG. 8. Transcription of the plasmid library in vitro with T7 RNA polymerase followed by RT-PCR with primers 1 and 2 and deep sequencing gives a processing and library bias-controlled deep sequencing data set for comparison with deep sequencing data sets derived from internal promoters (tPro in the lower construct in FIG. 8). This is not absolutely necessary as there are other ways of dealing with this issue. For example, one can perform PCR of the plasmid library with primers where the upstream primer has a RNA polymerase promoter (e.g., bacteriophage T3, T7 or SP6) attached.

The primary transcript from a test polynucleotide suspected of containing a functional promoter is shown in FIG. 9 and the complete processing products are shown in FIG. 10. In reality, partial processing products can also be present. Any transcript that is terminated after the ribozyme catalytic core ($E_{48}$), but before the $P_5$-$D_8$ immediately downstream of the catalytic core is processed, but are not able to form a circular mini-monomer containing the promoter-carrying insert. Any transcripts that terminate after the $P_5$-$D_8$ immediately downstream of the catalytic core can form a circular mini-monomer containing the promoter-carrying insert.

Synthesized cDNA from reverse transcription of RNA expressed from any insert carrying a functional eukaryotic promoter using primer 1, followed by PCR with primer 1 and primer 2 gives a PCR product, containing the mini-monomer sequence with the promoter-containing insert if the RNA template for reverse transcription is circular. Unprocessed transcripts are not circular. If PCR product is made on residual circular plasmid DNA, it gives a larger PCR product containing all of pUN-mini-monomer-insert DNA sequence, which is substantially larger and can be excluded by adjusting PCR conditions or, in the case of residual DNA template, by treatment with DNase or the restriction endonuclease Dpn I. These RT-PCR-derived DNAs can only be produced if a cloned DNA insert contains a functional eukaryotic promoter.

An alternative method to using total RNA involves purification of circular RNAs from all other RNAs using a two-dimensional gel system. The first dimension consists of a denaturing 7M urea, 1×TBE polyacrylamide gel of 5 to 6.5% total acrylamide concentration with 39:1 acrylamide: bis-acrylamide ratio. The second dimension consists of a denaturing 7M urea, 1×TBE polyacrylamide gel of the same total acrylamide concentration with 38:2 acrylamide:bis-acrylamide ratio. The two dimensions are cast together, the extracted total RNA is run first in the first dimension, which is then removed from the gel apparatus, rotated 90 degrees then put back on the gel apparatus and run in the second dimension. In a typical two-dimensional gel, two diagonals are seen-one for the linear RNAs and one for the circular RNAs. The circular RNAs are well separated from the linear RNAs. Due to the greater electrophoretic mobility of the linear RNAs in both the first and second dimensions compared to the circular RNAs, which are preferentially retarded in the second dimension gel compared to the linear RNAs, one also sees that the linear RNAs are not only on the linear diagonal, but also are farther down the linear diagonal than the circular RNAs are down the circular diagonal. Circular RNA size standards can be made without the primer binding sites to more easily delineate the diagonal of circles.

Using purified circular RNAs should give a much cleaner result. It also allows for a different approach to the reverse transcription as well. The primer binding sites can be positioned or located on opposite sides of the DNA insert with primer 1 being moved towards the 3' side of the insert. This change is not required, but is possible.

Example 3

An Illustration of RNA Stability/Transcription Modifier Selection

This example illustrates an embodiment of the methods for selection of polynucleotides encoding a RNA stability modifier or a transcription modifier.

In one embodiment, a promoter functional in a prokaryotic cell (e.g., a T7 RNA polymerase promoter) is retained for generating the same control described in Example 1, above. Adjacent to the control promoter (cPro, e.g., T7 RNA polymerase promoter) is a test promoter (tPro in FIG. 11) from the organism whose RNA stability and transcription modifying sequences are being sought. One difference between this construct and the one above is that the plasmid backbone itself need not be a minimal plasmid as transcription all the way around is not necessary. The use of a larger plasmid has the advantage of minimizing the chance of generating any competing PCR products all the way around the plasmid DNA.

As before an in vitro transcription with a control promoter (e.g., T7 RNA polymerase promoter) serves as an internal control as described above. As before, the library can be derived from natural sequences from an organism's DNA or can be randomized DNA (25 or 50 N residues, for example). Insertion of this plasmid library into cells or possibly transcriptionally active extracts followed by the same basic protocol of RT-PCR then deep sequencing gives RNA stabilizing or destabilizing inserts by looking for sequences that are increased or decreased in the deep sequenced population.

One possibility that must be considered is that any under or overrepresented sequence is due to a distance effect on the promoter by the insert, which is functioning as an enhancer or repressor of transcription. These can function up to 10 kilobases away from a promoter either upstream or downstream. To overcome to this problem, a construct as depicted in FIG. 11 can be used.

To reduce the possibility of recombination between two identical ribozyme core sequences, two related ribozyme cores can be used—for example, one from the satellite RNA of tobacco ringspot virus (sTRSV) as in the constructs described in Examples 1 and 2, and one from the satellite RNA of arabis mosaic virus (sArMV). The slightly different sequences not only decrease recombination between the two ribozyme cores, but also serve as an internal control for the deep sequencing. Construction of functional libraries begins with cloning of the barcodes into the first (e.g., sArMV) mini-monomer construct, followed by deep sequencing to determine library extent. This first step barcoded library is then used to construct a library of inserts for functional testing. Deep sequencing of this insert-containing library links any individual plasmid library member's barcode and insert sequence. Experimentation is performed as described previously with the variation of reverse transcription with primers 1 and 3, followed by PCR with primer sets 1 and 2 to measure the presence of the insert-containing mini-monomer and 3 and 4 to measure the presence of the barcode-containing mini-monomer. Comparison of the ratio of the appropriate barcoded mini-monomer to its linked insert mini-monomer allows discrimination between those inserts that actually affect RNA stability and those that affect transcription. Those that affect RNA stability increase or decrease the insert mini-monomer relative to the barcode mini-monomer if they increase or decrease the RNA stability respectively. Those that affect transcription only do not affect the ratio, instead increasing or decreasing both mini-monomers coordinately.

One attractive application of this approach is the de novo selection and subsequent evolution of externally influenced transcriptional or RNA stability sequences. Using a library containing random DNA fragments as insert sequences, insertion of this library into cells with or without some external factor (e.g., $Ca^{2+}$ ions, salt, temperature stress, hormones, etc.), followed by analysis as described previously allows detection of sequences that are increased preferentially in the presence of the external factor. Analysis of these sequences allows determination of common features that can make the significant structural features more obvious. Reconstruction of a library of mutagenized sequences related to these initial sequences followed by reanalysis, again in the presence or absence of the external factor, allows an evolutionary optimization of said sequences, ultimately leading to the selection of a de novo optimized transcriptional or RNA stability sequence that can be used in the construction of novel promoters or modified genes that are responsive to the external factor in question.

Example 4

Illustrative Selection of Functional Mutant T7 RNA Polymerase Promoters

Randomized oligonucleotides with 75% correct T7 RNA polymerase nucleotides at each of 17 positions were cloned into a mini-monomer cassette-containing plasmid forming a library containing approximately 500,000 unique sequences. Transcription with T7 RNA polymerase, phenol/chloroform/so-amyl alcohol extraction, ethanol precipitation, and reverse transcription were performed as described for Examples 1 and 2, above. PCR was done of the resulting cDNA with primers that added appropriate indexed sequences for Illumina deep sequencing, as described above and herein. PCR was also done directly on the library plasmid, again adding the appropriate sequences for Illumina deep sequencing, but with a different index. The appropriately sized PCR products from the cDNA and from the plasmid library were gel purified. An equal mass amount of the two products were mixed and submitted for Illumina MiSeq deep sequencing. Approximately 5 million sequences were generated for each of the cDNA and plasmid library after separation based on the primer indices. For both cDNA and library PCR products, non-promoter sequences were trimmed, promoter sequences were separated based on the number of mutations present in each sequence, and the number of times any given sequence was present was determined. Comparing the ratio of the fraction of wildtype T7 RNA polymerase promoter present in the cDNA PCR products with the fraction of wildtype T7 RNA polymerase promoter present in the plasmid library PCR products with that for any given mutant provides an indication of the relative strength, defined as the promoter's ability to produce RNA, of the particular mutant promoter and the wildtype promoter. 73464 functional mutant T7 RNA polymerase promoters were selected in this manner. See, SEQ ID NOs: 10-73473 listed in the text-formatted computer readable sequence listing filed herewith, and incorporated herein by reference. They represent almost all possible double mutants, roughly half of the possible triple mutants and a smaller fraction of the possible quadruple and quintuple mutants. Sequences containing 6 or more mutations were not considered due to their low prevalence in the plasmid library. Only those mutants that were recovered as a cDNA and whose sequence was present in the initial plasmid library were included. Also, a few known double mutant promoters from an earlier T7 promoter paper were removed. The identified mutant T7 RNA polymerase promoters of SEQ ID NOs: 10-73473 find use to express coding and non-coding RNA molecules of interest, e.g., using methods well-known in the art.

Example 5

Illustrative Selection of Functional Mutant T7 RNA Polymerase Promoters In Vivo

The random library of approximately 500,000 unique T7 RNA polymerase promoters from Example 4 was inserted by electroporation into *E. coli* Shuffle T7 (New England Biolabs) cells, which contains an inducible T7 RNA polymerase gene. A small fraction of the cells was plated to determine that the entire library of 500,000 variants was represented. 2,000,000 transformants were made ensuring reasonable representation of the original library's complexity. The remaining cells were grown overnight at 37° C. to stationary phase. A fresh culture of the library was started and expression of the T7 RNA polymerase in vivo was induced by the addition of the inducer isopropyl β-D-1 thiogalactopyranoside (IPTG). After two hours, total RNA was purified from the cells (SigmaAldritch GenElute Universal Total RNA purification kit). Reverse transcription were performed as described for Examples 1 and 2, above. PCR was done of the resulting cDNA with primers that added appropriate indexed sequences for Illumina deep sequencing, as described above and herein. PCR was also done directly on the library plasmid prepared from a separate fraction of the same cells used for the total RNA purification at the same time point (2 hours after IPTG induction), again adding the appropriate sequences for Illumina deep sequencing, but with a different index. The appropriately sized PCR products from the cDNA and from the plasmid library were gel purified. An equal mass amount of the two products were mixed and submitted for Illumina MiSeq deep sequencing. Approximately 8 and 10 million sequences were generated respectively for the cDNA and plasmid library after separation based on the primer indices. For both cDNA and library PCR products, non-promoter sequences were trimmed, promoter sequences were separated based on the number of mutations present in each sequence, and the number of times any given sequence was present was determined. Comparing the ratio of the fraction of wildtype T7 RNA polymerase promoter present in the cDNA PCR products with the fraction of wildtype T7 RNA polymerase promoter present in the plasmid library PCR products with that for any given mutant provides an indication of the relative strength, defined as the promoter's ability to produce RNA, of the particular mutant promoter and the wildtype promoter. In this case, analysis was limited to single, double and triple mutants. We were able to analyze all possible single mutants, 99.9% of all possible double mutants, and 94.1% of all possible triple mutants. A smaller number of quadruple mutants were analyzed, but not beyond measuring their relative activity to wildtype. Five examples of mutant T7 RNA polymerase promoters with higher than wildtype activity were selected and inserted into plasmids with the coding sequence for the GFP protein. Increased in vivo expression of this gene was found after immunoblot with anti-GFP antibody.

Example 6

Illustrative Recovery of a Known Yeast Promoter Sequence after In Vivo Expression A yeast 2 micron plasmid containing a mini-monomer cassette was constructed beginning by doing PCR of the yeast 2 micron plasmid, pYES2 to delete gal promoters and leave a BglII, NotI and XbaI sites. The mini-monomer cassette was inserted into this as a BglII-XbaI fragment to give the desired construct. The TEF promoter construct was made by amplifying the TEF promoter by PCR as a BamHI-SalI fragment from the plasmid p427-TEF and cloned into the yeast 2 micron plasmid with the mini-monomer cassette as a BamHI-SalI fragment. The control construct (used the EGFP coding sequence in the antisense orientation) was made by moving the GFP coding sequence as a BglII-SalI fragment into the BamHI-SalI sites of the yeast 2 micron plasmid with the mini-monomer cassette. These plasmids were constructed and amplified using *E. coli* NEB5alpha. Plasmids were purified from carbenicillin resistant *E. coli* using Zymoresearch Zyppy™ Plasmid Miniprep Kit. The *Saccharomyces cerevisiae* yeast strain, INVSc1, was made competent and transformed using Zymoresearch Frozen-EZ Yeast Transformation II Kit™. Transformed yeast was selected and maintained on synthetic defined media lacking uracil. Selected yeast colonies were scraped from plates, crushed with sand in a morter and pestle in ice cold RLT Buffer and RNA isolated using a Qiagen RNeasy kit. Reverse transcription and PCR were as described in Example 1 and 2.

Example 7

Illustrative Recovery of Known Cytomegalovirus Core Promoter and Enhancer Sequences after In Vivo Expression The Cytomegalovirus (CMV) enhancer (Enh) was cloned upstream of a mini-monomer cassette. Into the multiple cloning site (MCS) was cloned the CMV core promoter (Pro). A second construction was made with the CMV Pro downstream of a mini-monomer cassette. Into the MCS of this second construct was cloned the CMV Enh. These plasmids were amplified in *E. coli* DH5alpha. Mirus CHO cell Transfection reagent was used to transfect CHO cells with each construct. A control with the transfection reagent but no plasmid DNA was done in parallel. Total RNA extracts were prepared after 24 hours using the SigmaAldrich GenElute Universal RNA extraction kit either with or without DNase treatment on the column. Reverse transcription and PCR were as described in Example 1 and 2.

It is understood that the examples and embodiments described herein are for illustrative purposes only and that various modifications or changes in light thereof will be suggested to persons skilled in the art and are to be included within the spirit and purview of this application and scope of the appended claims. All publications, patents, and patent applications cited herein are hereby incorporated by reference in their entirety for all purposes.

SEQUENCE LISTING (73473 sequences)

SEQ ID NO: 1 - DNA, 1925 bp, synthetic construct
  source 1..1925: mol_type = other DNA
  misc_feature 6..10: note = P5 sequence
  misc_feature 11..18: note = D8 sequence
  misc_feature 24..71: note = E48 sequence
  misc_feature 72..85: note = Multiple cloning site (MCS)
  primer_bind 86..106: note = Reverse transcriptase primer 1 binding site
  primer_bind 107..132: note = Primer 2 binding site
  misc_feature 133..166: note = Multiple cloning site (MCS)
  misc_feature 167..171: note = Second P5 sequence
  misc_feature 172..179: note = Second D8 sequence
  rep_origin 186..800: note = pMB1 origin of replication in the reverse orientation
  primer_bind 237..260: note = Seq2 primer binding site
  gene 960..1820: note = Beta-lactamase gene in the reverse orientation
  regulatory 1821..1925: note = beta-lactamase promoter in the reverse orientation; regulatory_class = promoter
  primer_bind 1827..1856: note = Seq1 primer binding site
agatctgaccgtcctgtccgtatgacagagaagtcaaccagagaaacacacgttgtggtatattacctggtggcgcgccgaattctggaattctcgggtgccaagggttcagagttctacagtccgacgatcgcggccgcgtcgacggatccaagcttcctgcaggtgaccgtcctgtctctagacgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcg

SEQ ID NO: 2 - DNA, 2040 bp, synthetic construct
  source 1..2040: mol_type = other DNA
  misc_feature 6..10: note = P5 sequence
  misc_feature 11..18: note = D8 sequence
  misc_feature 24..73: note = sArMV E50 sequence
  primer_bind 80..94: note = Reverse transcriptase primer 3 binding site
  primer_bind 95..108: note = Primer 4 binding site
  misc_feature 115..120: note = Barcode insertion site
  misc_feature 121..125: note = Second P5 sequence
  misc_feature 126..133: note = Second D8 sequence
  misc_feature 139..186: note = sTRSV E48 sequence
  misc_feature 187..200: note = Multiple cloning site (MCS)
  primer_bind 201..221: note = Reverse transcriptase primer 1 binding site
  primer_bind 222..247: note = Primer 2 binding site
  misc_feature 248..281: note = Multiple cloning site (MCS)
  misc_feature 282..286: note = Third P5 sequence
  misc_feature 287..294: note = Third D8 sequence
  rep_origin 301..915: note = pMB1 origin of replication in the reverse orientation
  primer_bind 352..375: note = Seq2 primer binding site
  gene 1075..1935: note = Beta-lactamase gene in the reverse orientation
  regulatory 1936..2040: note = beta-lactamase gene promoter in the reverse orientation; regulatory_class = promoter
  primer_bind 1942..1971: note = Seq 1 primer binding site
agatctgacagtactgtccgtatgacagcgaagtcaaacggcgaaacacaccttgtgtggtatattacccgttcctagggtctcgtgggctcggtcgtcggcagcgtcggtaccactagttgaccgtcctgtccgtatgacagagaagtcaaccagagaaacacacgttgtggtatattacctggtggcgcgccgaattctggaattctcgggtgccaagggttcagagttctacagtccgacgatcgcggccgcgtcgacggatccaagcttcctgcaggtgaccgtcctgtctctagacgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcg

SEQ ID NO: 3 - DNA, 48 bp, unidentified
  source 1..48: mol_type = unassigned DNA; note = Satellite tobacco ringspot virus
gacagagaagtcaaccagagaaacacacgttgtggtatattacctggt

SEQ ID NO: 4 - DNA, 50 bp, unidentified
  source 1..50: mol_type = unassigned DNA; note = Satellite arabis mosaic virus
gacagcgaagtcaaacggcgaaacacaccttgtgtggtatattacccgtt

SEQ ID NO: 5 - DNA, 50 bp, unidentified
  source 1..50: mol_type = unassigned DNA; note = Satellite chicory yellow mottle virus
gacagcgaagtcagccagggaaacacaccatgtgtggtatattatctggc

SEQ ID NO: 6 - DNA, 13 bp, synthetic construct
  source 1..13: mol_type = other DNA
tgaccgtcctgtc

SEQ ID NO: 7 - skipped

SEQ ID NO: 8 - RNA, 50 nt, synthetic construct
  source 1..50: mol_type = other RNA
  misc_difference 1..5: note = n is a, c, g, or u
  misc_difference 10..18: note = n is a, c, g, or u
  misc_difference 26..36: note = n is a, c, g, or u
  misc_difference 46..50: note = n is a, c, g, or u
nnnnnmgaannnnnnnnnagaaacannnnnnnnnnngtatattacnnnnn

SEQ ID NO: 9 - skipped

SEQ ID NO: 10 - DNA, 18 bp, synthetic construct
  source 1..18: mol_type = other DNA
taatacgactcgctatcg

SEQ ID NO: 11 - DNA, 18 bp, synthetic construct
  source 1..18: mol_type = other DNA
taattcgactcgctatag

SEQ ID NO: 12 - DNA, 18 bp, synthetic construct
  source 1..18: mol_type = other DNA
taatacgactcgctattg

SEQ ID NO: 13 - DNA, 18 bp, synthetic construct
  source 1..18: mol_type = other DNA
taattcgactcactatcg

SEQ ID NO: 14 - DNA, 18 bp, synthetic construct
  source 1..18: mol_type = other DNA
taatgcgcctcactatag

SEQ ID NO: 15 - DNA, 18 bp, synthetic construct
  source 1..18: mol_type = other DNA
taatgcgactcactaaag

SEQ ID NO: 16 - DNA, 18 bp, synthetic construct
  source 1..18: mol_type = other DNA
taatgcgactcactagag

SEQ ID NO: 17 - DNA, 18 bp, synthetic construct
  source 1..18: mol_type = other DNA
taatacgcctcactatat

SEQ ID NO: 18 - DNA, 18 bp, synthetic construct
  source 1..18: mol_type = other DNA
taatacgactcgctacag

SEQ ID NO: 19 - DNA, 18 bp, synthetic construct
  source 1..18: mol_type = other DNA
taatgcgactcactacag

SEQ ID NO: 20 - DNA, 18 bp, synthetic construct
  source 1..18: mol_type = other DNA
taatgcgactcactatcg

SEQ ID NO: 21 - DNA, 18 bp, synthetic construct
  source 1..18: mol_type = other DNA
taatgcgactcaccatag

SEQ ID NO: 22 - DNA, 18 bp, synthetic construct
  source 1..18: mol_type = other DNA
taatacgactcacgatat

SEQ ID NO: 23 - DNA, 18 bp, synthetic construct
  source 1..18: mol_type = other DNA
taatgcgactcactttag

SEQ ID NO: 24 - DNA, 18 bp, synthetic construct
  source 1..18: mol_type = other DNA
taatgcgactcactctag

SEQ ID NO: 25 - DNA, 18 bp, synthetic construct
  source 1..18: mol_type = other DNA
taataggactcactctag

SEQ ID NO: 26 - DNA, 18 bp, synthetic construct
  source 1..18: mol_type = other DNA
taatgcgtctcactatag

SEQ ID NO: 27 - DNA, 18 bp, synthetic construct
  source 1..18: mol_type = other DNA
taatacgactcactccag

SEQ ID NO: 28 - DNA, 18 bp, synthetic construct
  source 1..18: mol_type = other DNA
taatgcgactcactgtag

SEQ ID NO: 29 - DNA, 18 bp, synthetic construct
  source 1..18: mol_type = other DNA
taatacgcctcactaaag

SEQ ID NO: 30 - DNA, 18 bp, synthetic construct
  source 1..18: mol_type = other DNA
taaagcgactcactatag

SEQ ID NO: 31 - DNA, 18 bp, synthetic construct
  source 1..18: mol_type = other DNA
taacacgactcactatat

SEQ ID NO: 32 - DNA, 18 bp, synthetic construct
  source 1..18: mol_type = other DNA
taatgcgactcactattg

SEQ ID NO: 33 - DNA, 18 bp, synthetic construct
  source 1..18: mol_type = other DNA
taatacgcatcactatag

SEQ ID NO: 34 - DNA, 18 bp, synthetic construct
  source 1..18: mol_type = other DNA
taatgcgactcgctatag

SEQ ID NO: 35 - DNA, 18 bp, synthetic construct
  source 1..18: mol_type = other DNA
taatacgactcactaccg

SEQ ID NO: 36 - DNA, 18 bp, synthetic construct
  source 1..18: mol_type = other DNA
taatacgactcgccatag

SEQ ID NO: 37 - DNA, 18 bp, synthetic construct
  source 1..18: mol_type = other DNA
taataggactcactacag

SEQ ID NO: 38 - DNA, 18 bp, synthetic construct
  source 1..18: mol_type = other DNA
taattcggctcactatag

SEQ ID NO: 39 - DNA, 18 bp, synthetic construct
  source 1..18: mol_type = other DNA
taatacgcctcactacag

SEQ ID NO: 40 - DNA, 18 bp, synthetic construct
  source 1..18: mol_type = other DNA
taatacgcctcactctag

SEQ ID NO: 41 - DNA, 18 bp, synthetic construct
  source 1..18: mol_type = other DNA
taatatgactcactgtag

SEQ ID NO: 42 - DNA, 18 bp, synthetic construct
  source 1..18: mol_type = other DNA
ttatgcgactcactatag

SEQ ID NO: 43 - DNA, 18 bp, synthetic construct
  source 1..18: mol_type = other DNA
ttatacgcctcactatag

SEQ ID NO: 44 - DNA, 18 bp, synthetic construct
  source 1..18: mol_type = other DNA
tattgcgactcactatag

SEQ ID NO: 45 - DNA, 18 bp, synthetic construct
  source 1..18: mol_type = other DNA
taatacgacccactatac

SEQ ID NO: 46 - DNA, 18 bp, synthetic construct
  source 1..18: mol_type = other DNA
taatacgacgcactatac

SEQ ID NO: 47 - DNA, 18 bp, synthetic construct
  source 1..18: mol_type = other DNA
taatacgcctcactatcg

SEQ ID NO: 48 - DNA, 18 bp, synthetic construct
  source 1..18: mol_type = other DNA
taatacgcctcactattg

SEQ ID NO: 49 - DNA, 18 bp, synthetic construct
  source 1..18: mol_type = other DNA
taaaacgactcgctatag

SEQ ID NO: 50 - DNA, 18 bp, synthetic construct
  source 1..18: mol_type = other DNA
taataggactcagtatag

SEQ ID NO: 51 - DNA, 18 bp, synthetic construct
  source 1..18: mol_type = other DNA
taataggactcactttag

SEQ ID NO: 52 - DNA, 18 bp, synthetic construct
  source 1..18: mol_type = other DNA
taatacgactcacgagag

SEQ ID NO: 53 - DNA, 18 bp, synthetic construct
  source 1..18: mol_type = other DNA
taatacgactcgctctag

SEQ ID NO: 54 - DNA, 18 bp, synthetic construct
  source 1..18: mol_type = other DNA
taatgcgactcagtatag

SEQ ID NO: 55 - DNA, 18 bp, synthetic construct
  source 1..18: mol_type = other DNA
taatacgcctcactttag

SEQ ID NO: 56 - DNA, 18 bp, synthetic construct
  source 1..18: mol_type = other DNA
taattcgcctcactatag

SEQ ID NO: 57 - DNA, 18 bp, synthetic construct
  source 1..18: mol_type = other DNA
taaaacgcctcactatag

SEQ ID NO: 58 - DNA, 18 bp, synthetic construct
  source 1..18: mol_type = other DNA
taatacgactcgctagag

SEQ ID NO: 59 - DNA, 18 bp, synthetic construct
  source 1..18: mol_type = other DNA
taatacggctcactatcg

SEQ ID NO: 60 - DNA, 18 bp, synthetic construct
  source 1..18: mol_type = other DNA
taatacggctcactattg

SEQ ID NO: 61 - DNA, 18 bp, synthetic construct
  source 1..18: mol_type = other DNA
taatacgtctcactataa

SEQ ID NO: 62 - DNA, 18 bp, synthetic construct
  source 1..18: mol_type = other DNA
ttatacgactcgctatag

SEQ ID NO: 63 - DNA, 18 bp, synthetic construct
  source 1..18: mol_type = other DNA
taacgcgactcactatag

SEQ ID NO: 64 - DNA, 18 bp, synthetic construct
  source 1..18: mol_type = other DNA
taatacgacgcactattg

SEQ ID NO: 65 - DNA, 18 bp, synthetic construct
  source 1..18: mol_type = other DNA
taatccgcctcactatag

SEQ ID NO: 66 - DNA, 18 bp, synthetic construct
  source 1..18: mol_type = other DNA
tgatgcgactcactatag

SEQ ID NO: 67 - DNA, 18 bp, synthetic construct
  source 1..18: mol_type = other DNA
taataggactcgctatag

SEQ ID NO: 68 - DNA, 18 bp, synthetic construct
  source 1..18: mol_type = other DNA
gaatacgactcaccatag

SEQ ID NO: 69 - DNA, 18 bp, synthetic construct
  source 1..18: mol_type = other DNA
taattcgacgcactatag

SEQ ID NO: 70 - DNA, 18 bp, synthetic construct
  source 1..18: mol_type = other DNA
taatccgactcactctag

SEQ ID NO: 71 - DNA, 18 bp, synthetic construct
  source 1..18: mol_type = other DNA
taatacaactcactatcg

SEQ ID NO: 72 - DNA, 18 bp, synthetic construct
  source 1..18: mol_type = other DNA
caatgcgactcactatag

SEQ ID NO: 73 - DNA, 18 bp, synthetic construct
  source 1..18: mol_type = other DNA
taatacaactcactctag

SEQ ID NO: 74 - DNA, 18 bp, synthetic construct
  source 1..18: mol_type = other DNA
taaaacgactcactgtag

SEQ ID NO: 75 - DNA, 18 bp, synthetic construct
  source 1..18: mol_type = other DNA
taatacgtctcactatat

SEQ ID NO: 76 - DNA, 18 bp, synthetic construct
  source 1..18: mol_type = other DNA
taatacgtctcactaaag

SEQ ID NO: 77 - DNA, 18 bp, synthetic construct
  source 1..18: mol_type = other DNA
taatacgactcaccattg

SEQ ID NO: 78 - DNA, 18 bp, synthetic construct
  source 1..18: mol_type = other DNA
taatacgactcaccacag

SEQ ID NO: 79 - DNA, 18 bp, synthetic construct
  source 1..18: mol_type = other DNA
taatacgcctcactagag

SEQ ID NO: 80 - DNA, 18 bp, synthetic construct
  source 1..18: mol_type = other DNA
taaaacgactcactctag

SEQ ID NO: 81 - DNA, 18 bp, synthetic construct
  source 1..18: mol_type = other DNA
taataagactcactacag

SEQ ID NO: 82 - DNA, 18 bp, synthetic construct
  source 1..18: mol_type = other DNA
taatacgcctcagtatag

SEQ ID NO: 83 - DNA, 18 bp, synthetic construct
  source 1..18: mol_type = other DNA
taatacgactcactctgg

SEQ ID NO: 84 - DNA, 18 bp, synthetic construct
  source 1..18: mol_type = other DNA
taattcgtctcactatag

SEQ ID NO: 85 - DNA, 18 bp, synthetic construct
  source 1..18: mol_type = other DNA
taatacgactcactctat

SEQ ID NO: 86 - DNA, 18 bp, synthetic construct
  source 1..18: mol_type = other DNA
taatacgactcactgttg

SEQ ID NO: 87 - DNA, 18 bp, synthetic construct
  source 1..18: mol_type = other DNA
taatacgactcaccctag

SEQ ID NO: 88 - DNA, 18 bp, synthetic construct
  source 1..18: mol_type = other DNA
taataagactcactctag

SEQ ID NO: 89 - DNA, 18 bp, synthetic construct
  source 1..18: mol_type = other DNA
taatacgactcgctaaag

SEQ ID NO: 90 - DNA, 18 bp, synthetic construct
  source 1..18: mol_type = other DNA
taatccgactcactagag

SEQ ID NO: 91 - DNA, 18 bp, synthetic construct
  source 1..18: mol_type = other DNA
taatacgacgcactatcg

SEQ ID NO: 92 - DNA, 18 bp, synthetic construct
  source 1..18: mol_type = other DNA
ttatacgactcactctag

SEQ ID NO: 93 - DNA, 18 bp, synthetic construct
  source 1..18: mol_type = other DNA
taatgcgactcactatat

SEQ ID NO: 94 - DNA, 18 bp, synthetic construct
  source 1..18: mol_type = other DNA
taatacgactcacttttg

SEQ ID NO: 95 - DNA, 18 bp, synthetic construct
  source 1..18: mol_type = other DNA
taatccgactcactgtag

SEQ ID NO: 96 - DNA, 18 bp, synthetic construct
  source 1..18: mol_type = other DNA
ttatacgactcactatcg

SEQ ID NO: 97 - DNA, 18 bp, synthetic construct
  source 1..18: mol_type = other DNA
tattacgcctcactatag

SEQ ID NO: 98 - DNA, 18 bp, synthetic construct
  source 1..18: mol_type = other DNA
taatacaactcgctatag

SEQ ID NO: 99 - DNA, 18 bp, synthetic construct
  source 1..18: mol_type = other DNA
taataggactcactaaag

SEQ ID NO: 100 - DNA, 18 bp, synthetic construct
  source 1..18: mol_type = other DNA
taatacgactcactacat

SEQ ID NO: 101 - DNA, 18 bp, synthetic construct
  source 1..18: mol_type = other DNA
taatacgcctcactgtag

SEQ ID NO: 102 - DNA, 18 bp, synthetic construct
  source 1..18: mol_type = other DNA
taataggactcaccatag

SEQ ID NO: 103 - DNA, 18 bp, synthetic construct
  source 1..18: mol_type = other DNA
taatacgactcaatatat

SEQ ID NO: 104 - DNA, 18 bp, synthetic construct
  source 1..18: mol_type = other DNA
taatacgtctcgctatag

SEQ ID NO: 105 - DNA, 18 bp, synthetic construct
  source 1..18: mol_type = other DNA
taataggactcacgatag

SEQ ID NO: 106 - DNA, 18 bp, synthetic construct
  source 1..18: mol_type = other DNA
taattcgactcaccatag

SEQ ID NO: 107 - DNA, 18 bp, synthetic construct
  source 1..18: mol_type = other DNA
taatgcgactcactatgg

SEQ ID NO: 108 - DNA, 18 bp, synthetic construct
  source 1..18: mol_type = other DNA
taatacgactcaggatag

SEQ ID NO: 109 - DNA, 18 bp, synthetic construct
  source 1..18: mol_type = other DNA
ttatacgactcactgtag

SEQ ID NO: 110 - DNA, 18 bp, synthetic construct
  source 1..18: mol_type = other DNA
taatacgactcactcaag

SEQ ID NO: 111 - DNA, 18 bp, synthetic construct
  source 1..18: mol_type = other DNA
tgatacgactcactctag

SEQ ID NO: 112 - DNA, 18 bp, synthetic construct
  source 1..18: mol_type = other DNA
taatatgactcactagag

SEQ ID NO: 113 - DNA, 18 bp, synthetic construct
  source 1..18: mol_type = other DNA
taatacgtctcactctag

SEQ ID NO: 114 - DNA, 18 bp, synthetic construct
  source 1..18: mol_type = other DNA
taattcgactcactgtag

SEQ ID NO: 115 - DNA, 18 bp, synthetic construct
  source 1..18: mol_type = other DNA
taataggactcactatcg

SEQ ID NO: 116 - DNA, 18 bp, synthetic construct
  source 1..18: mol_type = other DNA
taatacgcgtcactatag

SEQ ID NO: 117 - DNA, 18 bp, synthetic construct
  source 1..18: mol_type = other DNA
taatacgactcgctatat

SEQ ID NO: 118 - DNA, 18 bp, synthetic construct
  source 1..18: mol_type = other DNA
taatacgactcagtacag

SEQ ID NO: 119 - DNA, 18 bp, synthetic construct
  source 1..18: mol_type = other DNA
gaatacgcctcactatag

SEQ ID NO: 120 - DNA, 18 bp, synthetic construct
  source 1..18: mol_type = other DNA
gaatgcgactcactatag

SEQ ID NO: 121 - DNA, 18 bp, synthetic construct
  source 1..18: mol_type = other DNA
taatacgactcagtctag

SEQ ID NO: 122 - DNA, 18 bp, synthetic construct
  source 1..18: mol_type = other DNA
taatacgtctcactacag

SEQ ID NO: 123 - DNA, 18 bp, synthetic construct
  source 1..18: mol_type = other DNA
taatgcgactcacgatag

SEQ ID NO: 124 - DNA, 18 bp, synthetic construct
  source 1..18: mol_type = other DNA
taatacgactcaccagag

SEQ ID NO: 125 - DNA, 18 bp, synthetic construct
  source 1..18: mol_type = other DNA
caatacgactcactctag

SEQ ID NO: 126 - DNA, 18 bp, synthetic construct
  source 1..18: mol_type = other DNA
taatacgactcattatat

SEQ ID NO: 127 - DNA, 18 bp, synthetic construct
  source 1..18: mol_type = other DNA
tgatacgactcactataa

SEQ ID NO: 128 - DNA, 18 bp, synthetic construct
  source 1..18: mol_type = other DNA
caatacgactcactatat

SEQ ID NO: 129 - DNA, 18 bp, synthetic construct
  source 1..18: mol_type = other DNA
taataggactcactagag

SEQ ID NO: 130 - DNA, 18 bp, synthetic construct
  source 1..18: mol_type = other DNA
taatacgactcactatct

SEQ ID NO: 131 - DNA, 18 bp, synthetic construct
  source 1..18: mol_type = other DNA
taatacgactcacttcag

SEQ ID NO: 132 - DNA, 18 bp, synthetic construct
  source 1..18: mol_type = other DNA
taattggactcactatag

SEQ ID NO: 133 - DNA, 18 bp, synthetic construct
  source 1..18: mol_type = other DNA
taatgcgacgcactatag

SEQ ID NO: 134 - DNA, 18 bp, synthetic construct
  source 1..18: mol_type = other DNA
taaaacgtctcactatag

SEQ ID NO: 135 - DNA, 18 bp, synthetic construct
  source 1..18: mol_type = other DNA
tattacgactcactctag

SEQ ID NO: 136 - DNA, 18 bp, synthetic construct
  source 1..18: mol_type = other DNA
taatacgactcacactag

SEQ ID NO: 137 - DNA, 18 bp, synthetic construct
  source 1..18: mol_type = other DNA
taatacgactcactactg

SEQ ID NO: 138 - DNA, 18 bp, synthetic construct
  source 1..18: mol_type = other DNA
taatacaactcactacag

SEQ ID NO: 139 - DNA, 18 bp, synthetic construct
  source 1..18: mol_type = other DNA
gaataggactcactatag

SEQ ID NO: 140 - DNA, 18 bp, synthetic construct
  source 1..18: mol_type = other DNA
taattcgactcactctag

SEQ ID NO: 141 - DNA, 18 bp, synthetic construct
  source 1..18: mol_type = other DNA
taatacgactcagtatcg

SEQ ID NO: 142 - DNA, 18 bp, synthetic construct
  source 1..18: mol_type = other DNA
taataggactcactgtag

SEQ ID NO: 143 - DNA, 18 bp, synthetic construct
  source 1..18: mol_type = other DNA
aaatgcgactcactatag

SEQ ID NO: 144 - DNA, 18 bp, synthetic construct
  source 1..18: mol_type = other DNA
taattcgactcactattg

SEQ ID NO: 145 - DNA, 18 bp, synthetic construct
  source 1..18: mol_type = other DNA
gaatacgtctcactatag

SEQ ID NO: 146 - DNA, 18 bp, synthetic construct
  source 1..18: mol_type = other DNA
ttatacgtctcactatag

SEQ ID NO: 147 - DNA, 18 bp, synthetic construct
  source 1..18: mol_type = other DNA
taatacgcctcaccatag

SEQ ID NO: 148 - DNA, 18 bp, synthetic construct
  source 1..18: mol_type = other DNA
taataagactcactagag

SEQ ID NO: 149 - DNA, 18 bp, synthetic construct
  source 1..18: mol_type = other DNA
taatacgactcagtttag

SEQ ID NO: 150 - DNA, 18 bp, synthetic construct
  source 1..18: mol_type = other DNA
taattcgactcactacag

SEQ ID NO: 151 - DNA, 18 bp, synthetic construct
  source 1..18: mol_type = other DNA
tattaggactcactatag

SEQ ID NO: 152 - DNA, 18 bp, synthetic construct
  source 1..18: mol_type = other DNA
taatacgactcagtaaag

SEQ ID NO: 153 - DNA, 18 bp, synthetic construct
  source 1..18: mol_type = other DNA
caaaacgactcactatag

SEQ ID NO: 154 - DNA, 18 bp, synthetic construct
  source 1..18: mol_type = other DNA
taatgggactcactatag

SEQ ID NO: 155 - DNA, 18 bp, synthetic construct
  source 1..18: mol_type = other DNA
taataagcctcactatag

SEQ ID NO: 156 - DNA, 18 bp, synthetic construct
  source 1..18: mol_type = other DNA
tgatacgcctcactatag

SEQ ID NO: 157 - DNA, 18 bp, synthetic construct
  source 1..18: mol_type = other DNA
taatacgactcactcttg

SEQ ID NO: 158 - DNA, 18 bp, synthetic construct
  source 1..18: mol_type = other DNA
taaaaggactcactatag

SEQ ID NO: 159 - DNA, 18 bp, synthetic construct
  source 1..18: mol_type = other DNA
taataagactcactgtag

SEQ ID NO: 160 - DNA, 18 bp, synthetic construct
  source 1..18: mol_type = other DNA
taataggactcactattg

SEQ ID NO: 161 - DNA, 18 bp, synthetic construct
  source 1..18: mol_type = other DNA
taatacgactcactttat

SEQ ID NO: 162 - DNA, 18 bp, synthetic construct
  source 1..18: mol_type = other DNA
taatacgactcactttaa

SEQ ID NO: 163 - DNA, 18 bp, synthetic construct
  source 1..18: mol_type = other DNA
taatacgcctcactataa

SEQ ID NO: 164 - DNA, 18 bp, synthetic construct
  source 1..18: mol_type = other DNA
taaaacgactcactatat

SEQ ID NO: 165 - DNA, 18 bp, synthetic construct
  source 1..18: mol_type = other DNA
taatccgactcactataa

SEQ ID NO: 166 - DNA, 18 bp, synthetic construct
  source 1..18: mol_type = other DNA
gaatacgactcactatat

SEQ ID NO: 167 - DNA, 18 bp, synthetic construct
  source 1..18: mol_type = other DNA
taatacgtctcactagag

SEQ ID NO: 168 - DNA, 18 bp, synthetic construct
  source 1..18: mol_type = other DNA
taatacgcctcactatgg

SEQ ID NO: 169 - DNA, 18 bp, synthetic construct
  source 1..18: mol_type = other DNA
taataagactcgctatag

SEQ ID NO: 170 - DNA, 18 bp, synthetic construct
  source 1..18: mol_type = other DNA
taatacgactcagtagag

SEQ ID NO: 171 - DNA, 18 bp, synthetic construct
  source 1..18: mol_type = other DNA
taatgcaactcactatag

SEQ ID NO: 172 - DNA, 18 bp, synthetic construct
  source 1..18: mol_type = other DNA
taatacgactcactgtgg

SEQ ID NO: 173 - DNA, 18 bp, synthetic construct
  source 1..18: mol_type = other DNA
taatacgactcactcgag

SEQ ID NO: 174 - DNA, 18 bp, synthetic construct
  source 1..18: mol_type = other DNA
taatacgactcactatca

SEQ ID NO: 175 - DNA, 18 bp, synthetic construct
  source 1..18: mol_type = other DNA
taatacgtctcactatac

SEQ ID NO: 176 - DNA, 18 bp, synthetic construct
  source 1..18: mol_type = other DNA
taatacgtctcactgtag

SEQ ID NO: 177 - DNA, 18 bp, synthetic construct
  source 1..18: mol_type = other DNA
taatagcactcactatag

SEQ ID NO: 178 - DNA, 18 bp, synthetic construct
  source 1..18: mol_type = other DNA
taatacgacgcgctatag

SEQ ID NO: 179 - DNA, 18 bp, synthetic construct
  source 1..18: mol_type = other DNA
taatacgactcacgctag

SEQ ID NO: 180 - DNA, 18 bp, synthetic construct
  source 1..18: mol_type = other DNA
taatacgactcacgaaag

SEQ ID NO: 181 - DNA, 18 bp, synthetic construct
  source 1..18: mol_type = other DNA
taatacgtctcactatcg

SEQ ID NO: 182 - DNA, 18 bp, synthetic construct
  source 1..18: mol_type = other DNA
ttatacgacgcactatag

SEQ ID NO: 183 - DNA, 18 bp, synthetic construct
  source 1..18: mol_type = other DNA
tgatacgactcactttag

SEQ ID NO: 184 - DNA, 18 bp, synthetic construct
  source 1..18: mol_type = other DNA
taatacgcctcacaatag

SEQ ID NO: 185 - DNA, 18 bp, synthetic construct
  source 1..18: mol_type = other DNA
taatccgactcactacag

SEQ ID NO: 186 - DNA, 18 bp, synthetic construct
  source 1..18: mol_type = other DNA
aaatacgactcactctag

SEQ ID NO: 187 - DNA, 18 bp, synthetic construct
  source 1..18: mol_type = other DNA
taataccactccctatag

SEQ ID NO: 188 - DNA, 18 bp, synthetic construct
  source 1..18: mol_type = other DNA
taaaacgactcactatcg

SEQ ID NO: 189 - DNA, 18 bp, synthetic construct
  source 1..18: mol_type = other DNA
tgatacgactcactgtag

SEQ ID NO: 190 - DNA, 18 bp, synthetic construct
  source 1..18: mol_type = other DNA
taatacggctcaccatag

SEQ ID NO: 191 - DNA, 18 bp, synthetic construct
  source 1..18: mol_type = other DNA
tattacgactcactgtag

SEQ ID NO: 192 - DNA, 18 bp, synthetic construct
  source 1..18: mol_type = other DNA
taatacgactcacgttag

SEQ ID NO: 193 - DNA, 18 bp, synthetic construct
  source 1..18: mol_type = other DNA
ttatacgactcactatac

SEQ ID NO: 194 - DNA, 18 bp, synthetic construct
  source 1..18: mol_type = other DNA
taatacgactcagtatat

SEQ ID NO: 195 - DNA, 18 bp, synthetic construct
  source 1..18: mol_type = other DNA
taatacgtctcactttag

SEQ ID NO: 196 - DNA, 18 bp, synthetic construct
  source 1..18: mol_type = other DNA
taaaacgactcactttag

SEQ ID NO: 197 - DNA, 18 bp, synthetic construct
  source 1..18: mol_type = other DNA
ttataggactcactatag

SEQ ID NO: 198 - DNA, 18 bp, synthetic construct
  source 1..18: mol_type = other DNA
taatccgagtcactatag

SEQ ID NO: 199 - DNA, 18 bp, synthetic construct
  source 1..18: mol_type = other DNA
taatacgacgcactctag

SEQ ID NO: 200 - DNA, 18 bp, synthetic construct
  source 1..18: mol_type = other DNA
tgatacgactcactacag

SEQ ID NO: 201 - DNA, 18 bp, synthetic construct
  source 1..18: mol_type = other DNA
aaataggactcactatag

SEQ ID NO: 202 - DNA, 18 bp, synthetic construct
  source 1..18: mol_type = other DNA
ttatacgactcactacag

SEQ ID NO: 203 - DNA, 18 bp, synthetic construct
  source 1..18: mol_type = other DNA
caatacgactcactgtag

SEQ ID NO: 204 - DNA, 18 bp, synthetic construct
  source 1..18: mol_type = other DNA
taatacgactcacgattg

SEQ ID NO: 205 - DNA, 18 bp, synthetic construct
  source 1..18: mol_type = other DNA
taatatgactcactctag

SEQ ID NO: 206 - DNA, 18 bp, synthetic construct
  source 1..18: mol_type = other DNA
taaaacgactcactagag

SEQ ID NO: 207 - DNA, 18 bp, synthetic construct
  source 1..18: mol_type = other DNA
caataggactcactatag

SEQ ID NO: 208 - DNA, 18 bp, synthetic construct
  source 1..18: mol_type = other DNA
taatacgactcaatatac

SEQ ID NO: 209 - DNA, 18 bp, synthetic construct
  source 1..18: mol_type = other DNA
taatacgactcgctataa

SEQ ID NO: 210 - DNA, 18 bp, synthetic construct
  source 1..18: mol_type = other DNA
taatccgactcgctatag

SEQ ID NO: 211 - DNA, 18 bp, synthetic construct
  source 1..18: mol_type = other DNA
tattacgactcactatat

SEQ ID NO: 212 - DNA, 18 bp, synthetic construct
  source 1..18: mol_type = other DNA
tattacgactcgctatag

SEQ ID NO: 213 - DNA, 18 bp, synthetic construct
  source 1..18: mol_type = other DNA
taatagaactcactatag

SEQ ID NO: 214 - DNA, 18 bp, synthetic construct
  source 1..18: mol_type = other DNA
ttatatgactcactatag

SEQ ID NO: 215 - DNA, 18 bp, synthetic construct
  source 1..18: mol_type = other DNA
taatccggctcactatag

SEQ ID NO: 216 - DNA, 18 bp, synthetic construct
  source 1..18: mol_type = other DNA
taatctgactcactatag

SEQ ID NO: 217 - DNA, 18 bp, synthetic construct
  source 1..18: mol_type = other DNA
taatacaactcactttag

SEQ ID NO: 218 - DNA, 18 bp, synthetic construct
  source 1..18: mol_type = other DNA
taacaggactcactatag

SEQ ID NO: 219 - DNA, 18 bp, synthetic construct
  source 1..18: mol_type = other DNA
ttatacgactcactagag

SEQ ID NO: 220 - DNA, 18 bp, synthetic construct
  source 1..18: mol_type = other DNA
taacacgactcactatac

SEQ ID NO: 221 - DNA, 18 bp, synthetic construct
  source 1..18: mol_type = other DNA
taatacgactcaccatat

SEQ ID NO: 222 - DNA, 18 bp, synthetic construct
  source 1..18: mol_type = other DNA
taatacggctcactatac

SEQ ID NO: 223 - DNA, 18 bp, synthetic construct
  source 1..18: mol_type = other DNA
taatacgactcaccaaag

SEQ ID NO: 224 - DNA, 18 bp, synthetic construct
  source 1..18: mol_type = other DNA
taatacaactcagtatag

SEQ ID NO: 225 - DNA, 18 bp, synthetic construct
  source 1..18: mol_type = other DNA
taatacgactcactttcg

SEQ ID NO: 226 - DNA, 18 bp, synthetic construct
  source 1..18: mol_type = other DNA
aaatacgactcactgtag

SEQ ID NO: 227 - DNA, 18 bp, synthetic construct
  source 1..18: mol_type = other DNA
taatgcgacttactatag

SEQ ID NO: 228 - DNA, 18 bp, synthetic construct
  source 1..18: mol_type = other DNA
taaaacgactcactacag

SEQ ID NO: 229 - DNA, 18 bp, synthetic construct
  source 1..18: mol_type = other DNA
taataagactcactttag

SEQ ID NO: 230 - DNA, 18 bp, synthetic construct
  source 1..18: mol_type = other DNA
taatgcgactcacaatag

SEQ ID NO: 231 - DNA, 18 bp, synthetic construct
  source 1..18: mol_type = other DNA
ttatacgactcaccatag

SEQ ID NO: 232 - DNA, 18 bp, synthetic construct
  source 1..18: mol_type = other DNA
taatacgactcacttgag

SEQ ID NO: 233 - DNA, 18 bp, synthetic construct
  source 1..18: mol_type = other DNA
taattcgactcactttag

SEQ ID NO: 234 - DNA, 18 bp, synthetic construct
  source 1..18: mol_type = other DNA
taatacaactcactatat

SEQ ID NO: 235 - DNA, 18 bp, synthetic construct
  source 1..18: mol_type = other DNA
taataagactcagtatag

SEQ ID NO: 236 - DNA, 18 bp, synthetic construct
  source 1..18: mol_type = other DNA
taaaccgactcactatag

SEQ ID NO: 237 - DNA, 18 bp, synthetic construct
  source 1..18: mol_type = other DNA
ttatacgactcagtatag

SEQ ID NO: 238 - DNA, 18 bp, synthetic construct
  source 1..18: mol_type = other DNA
taatacgcctcgctatag

SEQ ID NO: 239 - DNA, 18 bp, synthetic construct
  source 1..18: mol_type = other DNA
taataggtctcactatag

SEQ ID NO: 240 - DNA, 18 bp, synthetic construct
  source 1..18: mol_type = other DNA
taatacaacgcactatag

SEQ ID NO: 241 - DNA, 18 bp, synthetic construct
  source 1..18: mol_type = other DNA
taattcgactcactatat

SEQ ID NO: 242 - DNA, 18 bp, synthetic construct
  source 1..18: mol_type = other DNA
taatacgacgcactaaag

SEQ ID NO: 243 - DNA, 18 bp, synthetic construct
  source 1..18: mol_type = other DNA
taatacaactcactgtag

SEQ ID NO: 244 - DNA, 18 bp, synthetic construct
  source 1..18: mol_type = other DNA
caatatgactcactatag

SEQ ID NO: 245 - DNA, 18 bp, synthetic construct
  source 1..18: mol_type = other DNA
taataagactcactatcg

SEQ ID NO: 246 - DNA, 18 bp, synthetic construct
  source 1..18: mol_type = other DNA
taatacgactcagtgtag

SEQ ID NO: 247 - DNA, 18 bp, synthetic construct
  source 1..18: mol_type = other DNA
taatacgactcactagcg

SEQ ID NO: 248 - DNA, 18 bp, synthetic construct
  source 1..18: mol_type = other DNA
taatacgactcgctgtag

SEQ ID NO: 249 - DNA, 18 bp, synthetic construct
  source 1..18: mol_type = other DNA
ccatacgactcactatag

SEQ ID NO: 250 - DNA, 18 bp, synthetic construct
  source 1..18: mol_type = other DNA
taacacgactcactctag

SEQ ID NO: 251 - DNA, 18 bp, synthetic construct
  source 1..18: mol_type = other DNA
taataagactcactaaag

SEQ ID NO: 252 - DNA, 18 bp, synthetic construct
  source 1..18: mol_type = other DNA
aaatacgactcgctatag

SEQ ID NO: 253 - DNA, 18 bp, synthetic construct
  source 1..18: mol_type = other DNA
taatacgactctctctag

SEQ ID NO: 254 - DNA, 18 bp, synthetic construct
  source 1..18: mol_type = other DNA
taatacgcctcactatac

SEQ ID NO: 255 - DNA, 18 bp, synthetic construct
  source 1..18: mol_type = other DNA
taatgcgactcactatac

SEQ ID NO: 256 - DNA, 18 bp, synthetic construct
  source 1..18: mol_type = other DNA
taatacaactcactagag

SEQ ID NO: 257 - DNA, 18 bp, synthetic construct
  source 1..18: mol_type = other DNA
taatacgtctcactattg

SEQ ID NO: 258 - DNA, 18 bp, synthetic construct
  source 1..18: mol_type = other DNA
taatacgactctgtatag

SEQ ID NO: 259 - DNA, 18 bp, synthetic construct
  source 1..18: mol_type = other DNA
taatccgtctcactatag

SEQ ID NO: 260 - DNA, 18 bp, synthetic construct
  source 1..18: mol_type = other DNA
tattacgtctcactatag

SEQ ID NO: 261 - DNA, 18 bp, synthetic construct
  source 1..18: mol_type = other DNA
caatacgactcactacag

SEQ ID NO: 262 - DNA, 18 bp, synthetic construct
  source 1..18: mol_type = other DNA
taataaaactcactatag

SEQ ID NO: 263 - DNA, 18 bp, synthetic construct
  source 1..18: mol_type = other DNA
taattcgactcactaaag

SEQ ID NO: 264 - DNA, 18 bp, synthetic construct
  source 1..18: mol_type = other DNA
taatacgactcgcgatag

SEQ ID NO: 265 - DNA, 18 bp, synthetic construct
  source 1..18: mol_type = other DNA
taatacggctcacgatag

SEQ ID NO: 266 - DNA, 18 bp, synthetic construct
  source 1..18: mol_type = other DNA
taataagactcaccatag

SEQ ID NO: 267 - DNA, 18 bp, synthetic construct
  source 1..18: mol_type = other DNA
tagtgcgactcactatag

SEQ ID NO: 268 - DNA, 18 bp, synthetic construct
  source 1..18: mol_type = other DNA
taatacgtgtcactatag

SEQ ID NO: 269 - DNA, 18 bp, synthetic construct
  source 1..18: mol_type = other DNA
caatacgcctcactatag

SEQ ID NO: 270 - DNA, 18 bp, synthetic construct
  source 1..18: mol_type = other DNA
taatacggcgcactatag

SEQ ID NO: 271 - DNA, 18 bp, synthetic construct
  source 1..18: mol_type = other DNA
taatacgactctctagag

SEQ ID NO: 272 - DNA, 18 bp, synthetic construct
  source 1..18: mol_type = other DNA
taatacgactcagaatag

SEQ ID NO: 273 - DNA, 18 bp, synthetic construct
  source 1..18: mol_type = other DNA
tgttacgactcactatag

SEQ ID NO: 274 - DNA, 18 bp, synthetic construct
  source 1..18: mol_type = other DNA
tattacgactcactttag

SEQ ID NO: 275 - DNA, 18 bp, synthetic construct
  source 1..18: mol_type = other DNA
taatacgactcacgatcg

SEQ ID NO: 276 - DNA, 18 bp, synthetic construct
  source 1..18: mol_type = other DNA
caatacgactcaccatag

SEQ ID NO: 277 - DNA, 18 bp, synthetic construct
  source 1..18: mol_type = other DNA
gaataagactcactatag

SEQ ID NO: 278 - DNA, 18 bp, synthetic construct
  source 1..18: mol_type = other DNA
taatacgactcgctatgg

SEQ ID NO: 279 - DNA, 18 bp, synthetic construct
  source 1..18: mol_type = other DNA
taatacgactcactgaag

SEQ ID NO: 280 - DNA, 18 bp, synthetic construct
  source 1..18: mol_type = other DNA
taatgagactcactatag

SEQ ID NO: 281 - DNA, 18 bp, synthetic construct
  source 1..18: mol_type = other DNA
taatacaactcactaaag

SEQ ID NO: 282 - DNA, 18 bp, synthetic construct
  source 1..18: mol_type = other DNA
ttatacgactcactaaag

SEQ ID NO: 283 - DNA, 18 bp, synthetic construct
  source 1..18: mol_type = other DNA
tgattcgactcactatag

SEQ ID NO: 284 - DNA, 18 bp, synthetic construct
  source 1..18: mol_type = other DNA
taatacggctcgctatag

SEQ ID NO: 285 - DNA, 18 bp, synthetic construct
  source 1..18: mol_type = other DNA
tattacgactcactacag

SEQ ID NO: 286 - DNA, 18 bp, synthetic construct
  source 1..18: mol_type = other DNA
ttttacgactcactatag

SEQ ID NO: 287 - DNA, 18 bp, synthetic construct
  source 1..18: mol_type = other DNA
taattcgactcactataa

SEQ ID NO: 288 - DNA, 18 bp, synthetic construct
  source 1..18: mol_type = other DNA
taatccgactcactttag

SEQ ID NO: 289 - DNA, 18 bp, synthetic construct
  source 1..18: mol_type = other DNA
taattcgactcacgatag

SEQ ID NO: 290 - DNA, 18 bp, synthetic construct
  source 1..18: mol_type = other DNA
taaaaagactcactatag

SEQ ID NO: 291 - DNA, 18 bp, synthetic construct
  source 1..18: mol_type = other DNA
tagtacgactcactagag

SEQ ID NO: 292 - DNA, 18 bp, synthetic construct
  source 1..18: mol_type = other DNA
taacacgcctcactatag

SEQ ID NO: 293 - DNA, 18 bp, synthetic construct
  source 1..18: mol_type = other DNA
ttatacgactcactttag

SEQ ID NO: 294 - DNA, 18 bp, synthetic construct
  source 1..18: mol_type = other DNA
caatacgactcactagag

SEQ ID NO: 295 - DNA, 18 bp, synthetic construct
  source 1..18: mol_type = other DNA
ttatacgactcactattg

SEQ ID NO: 296 - DNA, 18 bp, synthetic construct
  source 1..18: mol_type = other DNA
tattacgactcactatcg

SEQ ID NO: 297 - DNA, 18 bp, synthetic construct
  source 1..18: mol_type = other DNA
taatacgacggactatag

SEQ ID NO: 298 - DNA, 18 bp, synthetic construct
  source 1..18: mol_type = other DNA
taataggactcacaatag

SEQ ID NO: 299 - DNA, 18 bp, synthetic construct
  source 1..18: mol_type = other DNA
taattcgactcactatac

SEQ ID NO: 300 - DNA, 18 bp, synthetic construct
  source 1..18: mol_type = other DNA
taatacgcctcacgatag

SEQ ID NO: 301 - DNA, 18 bp, synthetic construct
  source 1..18: mol_type = other DNA
tagtacgactcaccatag

SEQ ID NO: 302 - DNA, 18 bp, synthetic construct
  source 1..18: mol_type = other DNA
taatccaactcactatag

SEQ ID NO: 303 - DNA, 18 bp, synthetic construct
  source 1..18: mol_type = other DNA
caatccgactcactatag

SEQ ID NO: 304 - DNA, 18 bp, synthetic construct
  source 1..18: mol_type = other DNA
taatacgcttcactatag

SEQ ID NO: 305 - DNA, 18 bp, synthetic construct
  source 1..18: mol_type = other DNA
caatacgactcactaaag

SEQ ID NO: 306 - DNA, 18 bp, synthetic construct
  source 1..18: mol_type = other DNA
caattcgactcactatag

SEQ ID NO: 307 - DNA, 18 bp, synthetic construct
  source 1..18: mol_type = other DNA
taatccgactcactatcg

SEQ ID NO: 308 - DNA, 18 bp, synthetic construct
  source 1..18: mol_type = other DNA
tgatacgtctcactatag

SEQ ID NO: 309 - DNA, 18 bp, synthetic construct
  source 1..18: mol_type = other DNA
taatacgactcactacac

SEQ ID NO: 310 - DNA, 18 bp, synthetic construct
  source 1..18: mol_type = other DNA
taatacgacgcaccatag

SEQ ID NO: 311 - DNA, 18 bp, synthetic construct
  source 1..18: mol_type = other DNA
taatttgactcactatag

SEQ ID NO: 312 - DNA, 18 bp, synthetic construct
  source 1..18: mol_type = other DNA
taatacgactcacaatgg

SEQ ID NO: 313 - DNA, 18 bp, synthetic construct
  source 1..18: mol_type = other DNA
taatacgactcacttaag

SEQ ID NO: 314 - DNA, 18 bp, synthetic construct
  source 1..18: mol_type = other DNA
aaatacgactcactagag

SEQ ID NO: 315 - DNA, 18 bp, synthetic construct
  source 1..18: mol_type = other DNA
taatacgactctctatat

SEQ ID NO: 316 - DNA, 18 bp, synthetic construct
  source 1..18: mol_type = other DNA
tagtacgactcactgtag

SEQ ID NO: 317 - DNA, 18 bp, synthetic construct
  source 1..18: mol_type = other DNA
tactacgacgcactatag

SEQ ID NO: 318 - DNA, 18 bp, synthetic construct
  source 1..18: mol_type = other DNA
taatccgactcaccatag

SEQ ID NO: 319 - DNA, 18 bp, synthetic construct
  source 1..18: mol_type = other DNA
taatacgactcactgcag

SEQ ID NO: 320 - DNA, 18 bp, synthetic construct
  source 1..18: mol_type = other DNA
taatacgactcactagtg

SEQ ID NO: 321 - DNA, 18 bp, synthetic construct
  source 1..18: mol_type = other DNA
taatacgactcacaataa

SEQ ID NO: 322 - DNA, 18 bp, synthetic construct
  source 1..18: mol_type = other DNA
taatacagctcactatag

SEQ ID NO: 323 - DNA, 18 bp, synthetic construct
  source 1..18: mol_type = other DNA
taatacgactctctgtag

SEQ ID NO: 324 - DNA, 18 bp, synthetic construct
  source 1..18: mol_type = other DNA
taatatgactcactaaag

SEQ ID NO: 325 - DNA, 18 bp, synthetic construct
  source 1..18: mol_type = other DNA
taatacgactcactgtaa

SEQ ID NO: 326 - DNA, 18 bp, synthetic construct
  source 1..18: mol_type = other DNA
taatatgcctcactatag

SEQ ID NO: 327 - DNA, 18 bp, synthetic construct
  source 1..18: mol_type = other DNA
taattagactcactatag

SEQ ID NO: 328 - DNA, 18 bp, synthetic construct
  source 1..18: mol_type = other DNA
tattaagactcactatag

SEQ ID NO: 329 - DNA, 18 bp, synthetic construct
  source 1..18: mol_type = other DNA
tgatacgactcactaaag

SEQ ID NO: 330 - DNA, 18 bp, synthetic construct
  source 1..18: mol_type = other DNA
taatacgactcactaatg

SEQ ID NO: 331 - DNA, 18 bp, synthetic construct
  source 1..18: mol_type = other DNA
taattcgactcactagag

SEQ ID NO: 332 - DNA, 18 bp, synthetic construct
  source 1..18: mol_type = other DNA
ttatacaactcactatag

SEQ ID NO: 333 - DNA, 18 bp, synthetic construct
  source 1..18: mol_type = other DNA
aaatacgactcacgatag

SEQ ID NO: 334 - DNA, 18 bp, synthetic construct
  source 1..18: mol_type = other DNA
tattacgactcaccatag

SEQ ID NO: 335 - DNA, 18 bp, synthetic construct
  source 1..18: mol_type = other DNA
gagtacgactcactatag

SEQ ID NO: 336 - DNA, 18 bp, synthetic construct
  source 1..18: mol_type = other DNA
taatacgactcacggtag

SEQ ID NO: 337 - DNA, 18 bp, synthetic construct
  source 1..18: mol_type = other DNA
taatcggactcactatag

SEQ ID NO: 338 - DNA, 18 bp, synthetic construct
  source 1..18: mol_type = other DNA
taatacgactcactaggg

SEQ ID NO: 339 - DNA, 18 bp, synthetic construct
  source 1..18: mol_type = other DNA
tgatacgactcactagag

SEQ ID NO: 340 - DNA, 18 bp, synthetic construct
  source 1..18: mol_type = other DNA
aaatacgcctcactatag

SEQ ID NO: 341 - DNA, 18 bp, synthetic construct
  source 1..18: mol_type = other DNA
taataccactcactataa

SEQ ID NO: 342 - DNA, 18 bp, synthetic construct
  source 1..18: mol_type = other DNA
taaatcgactcactatag

SEQ ID NO: 343 - DNA, 18 bp, synthetic construct
  source 1..18: mol_type = other DNA
ggatacgactcactatag

SEQ ID NO: 344 - DNA, 18 bp, synthetic construct
  source 1..18: mol_type = other DNA
taatatgactcactataa

SEQ ID NO: 345 - DNA, 18 bp, synthetic construct
  source 1..18: mol_type = other DNA
taatacgactcactaagg

SEQ ID NO: 346 - DNA, 18 bp, synthetic construct
  source 1..18: mol_type = other DNA
taatacgactcactgtcg

SEQ ID NO: 347 - DNA, 18 bp, synthetic construct
  source 1..18: mol_type = other DNA
taatacgactcaccttag

SEQ ID NO: 348 - DNA, 18 bp, synthetic construct
  source 1..18: mol_type = other DNA
tattccgactcactatag

SEQ ID NO: 349 - DNA, 18 bp, synthetic construct
  source 1..18: mol_type = other DNA
taatacaactcaccatag

SEQ ID NO: 350 - DNA, 18 bp, synthetic construct
  source 1..18: mol_type = other DNA
gaatacgactcactatgg

SEQ ID NO: 351 - DNA, 18 bp, synthetic construct
  source 1..18: mol_type = other DNA
taataggactctctatag

SEQ ID NO: 352 - DNA, 18 bp, synthetic construct
  source 1..18: mol_type = other DNA
taaaacgactcactaaag

SEQ ID NO: 353 - DNA, 18 bp, synthetic construct
  source 1..18: mol_type = other DNA
tattacgactcacgatag

SEQ ID NO: 354 - DNA, 18 bp, synthetic construct
  source 1..18: mol_type = other DNA
aaatatgactcactatag

SEQ ID NO: 355 - DNA, 18 bp, synthetic construct
  source 1..18: mol_type = other DNA
taaaacgactcactataa

SEQ ID NO: 356 - DNA, 18 bp, synthetic construct
  source 1..18: mol_type = other DNA
ctatacgactcactatag

SEQ ID NO: 357 - DNA, 18 bp, synthetic construct
  source 1..18: mol_type = other DNA
tgatacgactcactatgg

SEQ ID NO: 358 - DNA, 18 bp, synthetic construct
  source 1..18: mol_type = other DNA
ttatacgactcacgatag

SEQ ID NO: 359 - DNA, 18 bp, synthetic construct
  source 1..18: mol_type = other DNA
taatacaactcacaatag

SEQ ID NO: 360 - DNA, 18 bp, synthetic construct
  source 1..18: mol_type = other DNA
caataagactcactatag

SEQ ID NO: 361 - DNA, 18 bp, synthetic construct
  source 1..18: mol_type = other DNA
taatacgacttactatcg

SEQ ID NO: 362 - DNA, 18 bp, synthetic construct
  source 1..18: mol_type = other DNA
taatccgactcacgatag

SEQ ID NO: 363 - DNA, 18 bp, synthetic construct
  source 1..18: mol_type = other DNA
tgaaacgactcactatag

SEQ ID NO: 364 - DNA, 18 bp, synthetic construct
  source 1..18: mol_type = other DNA
tgatacgactcgctatag

SEQ ID NO: 365 - DNA, 18 bp, synthetic construct
  source 1..18: mol_type = other DNA
taatacgactcaccataa

SEQ ID NO: 366 - DNA, 18 bp, synthetic construct
  source 1..18: mol_type = other DNA
taatacgtctcaccatag

SEQ ID NO: 367 - DNA, 18 bp, synthetic construct
  source 1..18: mol_type = other DNA
taataagactcactataa

SEQ ID NO: 368 - DNA, 18 bp, synthetic construct
  source 1..18: mol_type = other DNA
taatacgactcgctttag

SEQ ID NO: 369 - DNA, 18 bp, synthetic construct
  source 1..18: mol_type = other DNA
aaatacgactcactttag

SEQ ID NO: 370 - DNA, 18 bp, synthetic construct
  source 1..18: mol_type = other DNA
tatttcgactcactatag

SEQ ID NO: 371 - DNA, 18 bp, synthetic construct
  source 1..18: mol_type = other DNA
tattatgactcactatag

SEQ ID NO: 372 - DNA, 18 bp, synthetic construct
  source 1..18: mol_type = other DNA
taatacaactcactattg

SEQ ID NO: 373 - DNA, 18 bp, synthetic construct
  source 1..18: mol_type = other DNA
taatacgccgcactatag

SEQ ID NO: 374 - DNA, 18 bp, synthetic construct
  source 1..18: mol_type = other DNA
taatacgactcactatgc

SEQ ID NO: 375 - DNA, 18 bp, synthetic construct
  source 1..18: mol_type = other DNA
taatacgactcacaatat

SEQ ID NO: 376 - DNA, 18 bp, synthetic construct
  source 1..18: mol_type = other DNA
taatacgacgcactatat

SEQ ID NO: 377 - DNA, 18 bp, synthetic construct
  source 1..18: mol_type = other DNA
taatacgactcactatgt

SEQ ID NO: 378 - DNA, 18 bp, synthetic construct
  source 1..18: mol_type = other DNA
taataggactcactatat

SEQ ID NO: 379 - DNA, 18 bp, synthetic construct
  source 1..18: mol_type = other DNA
taataagactcactatgg

SEQ ID NO: 380 - DNA, 18 bp, synthetic construct
  source 1..18: mol_type = other DNA
taaaacgactcactattg

SEQ ID NO: 381 - DNA, 18 bp, synthetic construct
  source 1..18: mol_type = other DNA
tattacgactcactagag

SEQ ID NO: 382 - DNA, 18 bp, synthetic construct
  source 1..18: mol_type = other DNA
tactgcgactcactatag

SEQ ID NO: 383 - DNA, 18 bp, synthetic construct
  source 1..18: mol_type = other DNA
taataagactcactattg

SEQ ID NO: 384 - DNA, 18 bp, synthetic construct
  source 1..18: mol_type = other DNA
taatacgactcagtattg

SEQ ID NO: 385 - DNA, 18 bp, synthetic construct
  source 1..18: mol_type = other DNA
gaatacgactcactctag

SEQ ID NO: 386 - DNA, 18 bp, synthetic construct
  source 1..18: mol_type = other DNA
cattacgactcactatag

SEQ ID NO: 387 - DNA, 18 bp, synthetic construct
  source 1..18: mol_type = other DNA
taatacgtctcagtatag

SEQ ID NO: 388 - DNA, 18 bp, synthetic construct
  source 1..18: mol_type = other DNA
taatacaactcactataa

SEQ ID NO: 389 - DNA, 18 bp, synthetic construct
  source 1..18: mol_type = other DNA
taatacgactcggtatag

SEQ ID NO: 390 - DNA, 18 bp, synthetic construct
  source 1..18: mol_type = other DNA
taataggactcactatgg

SEQ ID NO: 391 - DNA, 18 bp, synthetic construct
  source 1..18: mol_type = other DNA
taatacgactcacaattg

SEQ ID NO: 392 - DNA, 18 bp, synthetic construct
  source 1..18: mol_type = other DNA
tagtacgactcactacag

SEQ ID NO: 393 - DNA, 18 bp, synthetic construct
  source 1..18: mol_type = other DNA
taatgcgagtcactatag

SEQ ID NO: 394 - DNA, 18 bp, synthetic construct
  source 1..18: mol_type = other DNA
tattacaactcactatag

SEQ ID NO: 395 - DNA, 18 bp, synthetic construct
  source 1..18: mol_type = other DNA
taatacgactctctaaag

SEQ ID NO: 396 - DNA, 18 bp, synthetic construct
  source 1..18: mol_type = other DNA
taattcaactcactatag

SEQ ID NO: 397 - DNA, 18 bp, synthetic construct
  source 1..18: mol_type = other DNA
taataagactcacgatag

SEQ ID NO: 398 - DNA, 18 bp, synthetic construct
  source 1..18: mol_type = other DNA
taattcgactcagtatag

SEQ ID NO: 399 - DNA, 18 bp, synthetic construct
  source 1..18: mol_type = other DNA
taatacgacgcactacag

SEQ ID NO: 400 - DNA, 18 bp, synthetic construct
  source 1..18: mol_type = other DNA
tgatacggctcactatag

SEQ ID NO: 401 - DNA, 18 bp, synthetic construct
  source 1..18: mol_type = other DNA
taatacgaccgactatag

SEQ ID NO: 402 - DNA, 18 bp, synthetic construct
  source 1..18: mol_type = other DNA
ttaaacgactcactatag

SEQ ID NO: 403 - DNA, 18 bp, synthetic construct
  source 1..18: mol_type = other DNA
tgatacgactcacgatag

SEQ ID NO: 404 - DNA, 18 bp, synthetic construct
  source 1..18: mol_type = other DNA
taatccgactcactaaag

SEQ ID NO: 405 - DNA, 18 bp, synthetic construct
  source 1..18: mol_type = other DNA
tattacgactcactaaag

SEQ ID NO: 406 - DNA, 18 bp, synthetic construct
  source 1..18: mol_type = other DNA
gaatacgactcactagag

SEQ ID NO: 407 - DNA, 18 bp, synthetic construct
  source 1..18: mol_type = other DNA
aaatacgactcactacag

SEQ ID NO: 408 - DNA, 18 bp, synthetic construct
  source 1..18: mol_type = other DNA
gattacgactcactatag

SEQ ID NO: 409 - DNA, 18 bp, synthetic construct
  source 1..18: mol_type = other DNA
ttataagactcactatag

SEQ ID NO: 410 - DNA, 18 bp, synthetic construct
  source 1..18: mol_type = other DNA
taatacggctcactctag

SEQ ID NO: 411 - DNA, 18 bp, synthetic construct
  source 1..18: mol_type = other DNA
taatcagactcactatag

SEQ ID NO: 412 - DNA, 18 bp, synthetic construct
  source 1..18: mol_type = other DNA
taatacgactcactacgg

SEQ ID NO: 413 - DNA, 18 bp, synthetic construct
  source 1..18: mol_type = other DNA
tgatacgactcactatcg

SEQ ID NO: 414 - DNA, 18 bp, synthetic construct
  source 1..18: mol_type = other DNA
taatacgactcactaacg

SEQ ID NO: 415 - DNA, 18 bp, synthetic construct
  source 1..18: mol_type = other DNA
taataggactcaatatag

SEQ ID NO: 416 - DNA, 18 bp, synthetic construct
  source 1..18: mol_type = other DNA
taataagtctcactatag

SEQ ID NO: 417 - DNA, 18 bp, synthetic construct
  source 1..18: mol_type = other DNA
caatacgactcactattg

SEQ ID NO: 418 - DNA, 18 bp, synthetic construct
  source 1..18: mol_type = other DNA
taatacgactcactctac

SEQ ID NO: 419 - DNA, 18 bp, synthetic construct
  source 1..18: mol_type = other DNA
aaatacgactcactatat

SEQ ID NO: 420 - DNA, 18 bp, synthetic construct
  source 1..18: mol_type = other DNA
caatacgactcactttag

SEQ ID NO: 421 - DNA, 18 bp, synthetic construct
  source 1..18: mol_type = other DNA
aattacgactcactatag

SEQ ID NO: 422 - DNA, 18 bp, synthetic construct
  source 1..18: mol_type = other DNA
tcatacgactcaccatag

SEQ ID NO: 423 - DNA, 18 bp, synthetic construct
  source 1..18: mol_type = other DNA
ttgtacgactcactatag

SEQ ID NO: 424 - DNA, 18 bp, synthetic construct
  source 1..18: mol_type = other DNA
taatataactcactatag

SEQ ID NO: 425 - DNA, 18 bp, synthetic construct
  source 1..18: mol_type = other DNA
taaaacgactcagtatag

SEQ ID NO: 426 - DNA, 18 bp, synthetic construct
  source 1..18: mol_type = other DNA
tcaaacgactcactatag

SEQ ID NO: 427 - DNA, 18 bp, synthetic construct
  source 1..18: mol_type = other DNA
taatacgactctctacag

SEQ ID NO: 428 - DNA, 18 bp, synthetic construct
  source 1..18: mol_type = other DNA
taatacgactcactttac

SEQ ID NO: 429 - DNA, 18 bp, synthetic construct
  source 1..18: mol_type = other DNA
taaaacaactcactatag

SEQ ID NO: 430 - DNA, 18 bp, synthetic construct
  source 1..18: mol_type = other DNA
tattacgactcagtatag

SEQ ID NO: 431 - DNA, 18 bp, synthetic construct
  source 1..18: mol_type = other DNA
taatacgactcacgacag

SEQ ID NO: 432 - DNA, 18 bp, synthetic construct
  source 1..18: mol_type = other DNA
tcatgcgactcactatag

SEQ ID NO: 433 - DNA, 18 bp, synthetic construct
  source 1..18: mol_type = other DNA
taatatgactcactatgg

SEQ ID NO: 434 - DNA, 18 bp, synthetic construct
  source 1..18: mol_type = other DNA
tcatacgactcactataa

SEQ ID NO: 435 - DNA, 18 bp, synthetic construct
  source 1..18: mol_type = other DNA
taagacgactcgctatag

SEQ ID NO: 436 - DNA, 18 bp, synthetic construct
  source 1..18: mol_type = other DNA
taaaacgactcactatgg

SEQ ID NO: 437 - DNA, 18 bp, synthetic construct
  source 1..18: mol_type = other DNA
taatacggctcagtatag

SEQ ID NO: 438 - DNA, 18 bp, synthetic construct
  source 1..18: mol_type = other DNA
aaatacgactcactaaag

SEQ ID NO: 439 - DNA, 18 bp, synthetic construct
  source 1..18: mol_type = other DNA
taatatgactcacgatag

SEQ ID NO: 440 - DNA, 18 bp, synthetic construct
  source 1..18: mol_type = other DNA
taatgtgactcactatag

SEQ ID NO: 441 - DNA, 18 bp, synthetic construct
  source 1..18: mol_type = other DNA
taatatgacgcactatag

SEQ ID NO: 442 - DNA, 18 bp, synthetic construct
  source 1..18: mol_type = other DNA
taatacgactcaccgtag

SEQ ID NO: 443 - DNA, 18 bp, synthetic construct
  source 1..18: mol_type = other DNA
taatacgactcactacaa

SEQ ID NO: 444 - DNA, 18 bp, synthetic construct
  source 1..18: mol_type = other DNA
gtatacgactcactatag

SEQ ID NO: 445 - DNA, 18 bp, synthetic construct
  source 1..18: mol_type = other DNA
taatacgactctctatcg

SEQ ID NO: 446 - DNA, 18 bp, synthetic construct
  source 1..18: mol_type = other DNA
aaatacgactcagtatag

SEQ ID NO: 447 - DNA, 18 bp, synthetic construct
  source 1..18: mol_type = other DNA
gaatacgactcgctatag

SEQ ID NO: 448 - DNA, 18 bp, synthetic construct
  source 1..18: mol_type = other DNA
tcatacgactcactctag

SEQ ID NO: 449 - DNA, 18 bp, synthetic construct
  source 1..18: mol_type = other DNA
aaatacgactcactataa

SEQ ID NO: 450 - DNA, 18 bp, synthetic construct
  source 1..18: mol_type = other DNA
taatacgactcactaaat

SEQ ID NO: 451 - DNA, 18 bp, synthetic construct
  source 1..18: mol_type = other DNA
taatacgagtcgctatag

SEQ ID NO: 452 - DNA, 18 bp, synthetic construct
  source 1..18: mol_type = other DNA
taaaatgactcactatag

SEQ ID NO: 453 - DNA, 18 bp, synthetic construct
  source 1..18: mol_type = other DNA
tagtacgactcactattg

SEQ ID NO: 454 - DNA, 18 bp, synthetic construct
  source 1..18: mol_type = other DNA
taatacgactcactaaaa

SEQ ID NO: 455 - DNA, 18 bp, synthetic construct
  source 1..18: mol_type = other DNA
ttatacggctcactatag

SEQ ID NO: 456 - DNA, 18 bp, synthetic construct
  source 1..18: mol_type = other DNA
taatacgcctaactatag

SEQ ID NO: 457 - DNA, 18 bp, synthetic construct
  source 1..18: mol_type = other DNA
taatatgtctcactatag

SEQ ID NO: 458 - DNA, 18 bp, synthetic construct
  source 1..18: mol_type = other DNA
tgataagactcactatag

SEQ ID NO: 459 - DNA, 18 bp, synthetic construct
  source 1..18: mol_type = other DNA
tattacgactcactattg

SEQ ID NO: 460 - DNA, 18 bp, synthetic construct
  source 1..18: mol_type = other DNA
taatacgagccactatag

SEQ ID NO: 461 - DNA, 18 bp, synthetic construct
  source 1..18: mol_type = other DNA
taaaacgactcacaatag

SEQ ID NO: 462 - DNA, 18 bp, synthetic construct
  source 1..18: mol_type = other DNA
caatacgtctcactatag

SEQ ID NO: 463 - DNA, 18 bp, synthetic construct
  source 1..18: mol_type = other DNA
taatacgactcaccatgg

SEQ ID NO: 464 - DNA, 18 bp, synthetic construct
  source 1..18: mol_type = other DNA
taatacggctccctatag

SEQ ID NO: 465 - DNA, 18 bp, synthetic construct
  source 1..18: mol_type = other DNA
taatacgaatcgctatag

SEQ ID NO: 466 - DNA, 18 bp, synthetic construct
  source 1..18: mol_type = other DNA
taatacgactctctttag

SEQ ID NO: 467 - DNA, 18 bp, synthetic construct
  source 1..18: mol_type = other DNA
taatgcggctcactatag

SEQ ID NO: 468 - DNA, 18 bp, synthetic construct
  source 1..18: mol_type = other DNA
ttatacgactcactataa

SEQ ID NO: 469 - DNA, 18 bp, synthetic construct
  source 1..18: mol_type = other DNA
taatacgactcactattt

SEQ ID NO: 470 - DNA, 18 bp, synthetic construct
  source 1..18: mol_type = other DNA
taatacgacttactatac

SEQ ID NO: 471 - DNA, 18 bp, synthetic construct
  source 1..18: mol_type = other DNA
taatatgactcactatat

SEQ ID NO: 472 - DNA, 18 bp, synthetic construct
  source 1..18: mol_type = other DNA
tgatacgactcaccatag

SEQ ID NO: 473 - DNA, 18 bp, synthetic construct
  source 1..18: mol_type = other DNA
gaatacgactcacaatag

SEQ ID NO: 474 - DNA, 18 bp, synthetic construct
  source 1..18: mol_type = other DNA
taatacgactctcgatag

SEQ ID NO: 475 - DNA, 18 bp, synthetic construct
  source 1..18: mol_type = other DNA
cgatacgactcactatag

SEQ ID NO: 476 - DNA, 18 bp, synthetic construct
  source 1..18: mol_type = other DNA
taataaggctcactatag

SEQ ID NO: 477 - DNA, 18 bp, synthetic construct
  source 1..18: mol_type = other DNA
caatacgactcagtatag

SEQ ID NO: 478 - DNA, 18 bp, synthetic construct
  source 1..18: mol_type = other DNA
tcatacgactcactgtag

SEQ ID NO: 479 - DNA, 18 bp, synthetic construct
  source 1..18: mol_type = other DNA
taatacgactctctattg

SEQ ID NO: 480 - DNA, 18 bp, synthetic construct
  source 1..18: mol_type = other DNA
aaacacgactcactatag

SEQ ID NO: 481 - DNA, 18 bp, synthetic construct
  source 1..18: mol_type = other DNA
caatacaactcactatag

SEQ ID NO: 482 - DNA, 18 bp, synthetic construct
  source 1..18: mol_type = other DNA
taacacgactcactacag

SEQ ID NO: 483 - DNA, 18 bp, synthetic construct
  source 1..18: mol_type = other DNA
taatacgactctctatac

SEQ ID NO: 484 - DNA, 18 bp, synthetic construct
  source 1..18: mol_type = other DNA
tagtacgactcactttag

SEQ ID NO: 485 - DNA, 18 bp, synthetic construct
  source 1..18: mol_type = other DNA
taatacgactcacagtag

SEQ ID NO: 486 - DNA, 18 bp, synthetic construct
  source 1..18: mol_type = other DNA
taatacgagtcactaaag

SEQ ID NO: 487 - DNA, 18 bp, synthetic construct
  source 1..18: mol_type = other DNA
taacacgactcactattg

SEQ ID NO: 488 - DNA, 18 bp, synthetic construct
  source 1..18: mol_type = other DNA
gaaaacgactcactatag

SEQ ID NO: 489 - DNA, 18 bp, synthetic construct
  source 1..18: mol_type = other DNA
taataccgctcactatag

SEQ ID NO: 490 - DNA, 18 bp, synthetic construct
  source 1..18: mol_type = other DNA
taaaacgagtcactatag

SEQ ID NO: 491 - DNA, 18 bp, synthetic construct
  source 1..18: mol_type = other DNA
taatacgagtcagtatag

SEQ ID NO: 492 - DNA, 18 bp, synthetic construct
  source 1..18: mol_type = other DNA
taatacgactaactatac

SEQ ID NO: 493 - DNA, 18 bp, synthetic construct
  source 1..18: mol_type = other DNA
tgatacgactcactatat

SEQ ID NO: 494 - DNA, 18 bp, synthetic construct
  source 1..18: mol_type = other DNA
agatacgactcactatag

SEQ ID NO: 495 - DNA, 18 bp, synthetic construct
  source 1..18: mol_type = other DNA
tagcacgactcactatag

SEQ ID NO: 496 - DNA, 18 bp, synthetic construct
  source 1..18: mol_type = other DNA
tataacgactcactatag

SEQ ID NO: 497 - DNA, 18 bp, synthetic construct
  source 1..18: mol_type = other DNA
aaatacgtctcactatag

SEQ ID NO: 498 - DNA, 18 bp, synthetic construct
  source 1..18: mol_type = other DNA
tatcacgactcactatag

SEQ ID NO: 499 - DNA, 18 bp, synthetic construct
  source 1..18: mol_type = other DNA
aaataagactcactatag

SEQ ID NO: 500 - DNA, 18 bp, synthetic construct
  source 1..18: mol_type = other DNA
taatacgactcaatataa

SEQ ID NO: 501 - DNA, 18 bp, synthetic construct
  source 1..18: mol_type = other DNA
tcatacgactcactacag

SEQ ID NO: 502 - DNA, 18 bp, synthetic construct
  source 1..18: mol_type = other DNA
taataggcctcactatag

SEQ ID NO: 503 - DNA, 18 bp, synthetic construct
  source 1..18: mol_type = other DNA
taatacaactcactatgg

SEQ ID NO: 504 - DNA, 18 bp, synthetic construct
  source 1..18: mol_type = other DNA
tgatacgactcactattg

SEQ ID NO: 505 - DNA, 18 bp, synthetic construct
  source 1..18: mol_type = other DNA
tactacgactcactaaag

SEQ ID NO: 506 - DNA, 18 bp, synthetic construct
  source 1..18: mol_type = other DNA
tagtacgactcactctag

SEQ ID NO: 507 - DNA, 18 bp, synthetic construct
  source 1..18: mol_type = other DNA
taatacgactcattataa

SEQ ID NO: 508 - DNA, 18 bp, synthetic construct
  source 1..18: mol_type = other DNA
taatacgactaactctag

SEQ ID NO: 509 - DNA, 18 bp, synthetic construct
  source 1..18: mol_type = other DNA
taattcgactctctatag

SEQ ID NO: 510 - DNA, 18 bp, synthetic construct
  source 1..18: mol_type = other DNA
tagtacgacttactatag

SEQ ID NO: 511 - DNA, 18 bp, synthetic construct
  source 1..18: mol_type = other DNA
aaattcgactcactatag

SEQ ID NO: 512 - DNA, 18 bp, synthetic construct
  source 1..18: mol_type = other DNA
tagtacaactcactatag

SEQ ID NO: 513 - DNA, 18 bp, synthetic construct
  source 1..18: mol_type = other DNA
gaatacgactcactaaag

SEQ ID NO: 514 - DNA, 18 bp, synthetic construct
  source 1..18: mol_type = other DNA
taatacgtcttactatag

SEQ ID NO: 515 - DNA, 18 bp, synthetic construct
  source 1..18: mol_type = other DNA
taatatgactcactacag

SEQ ID NO: 516 - DNA, 18 bp, synthetic construct
  source 1..18: mol_type = other DNA
aaatacgactcactatac

SEQ ID NO: 517 - DNA, 18 bp, synthetic construct
  source 1..18: mol_type = other DNA
taatacgacacactatat

SEQ ID NO: 518 - DNA, 18 bp, synthetic construct
  source 1..18: mol_type = other DNA
taatacgactcactagac

SEQ ID NO: 519 - DNA, 18 bp, synthetic construct
  source 1..18: mol_type = other DNA
ttatccgactcactatag

SEQ ID NO: 520 - DNA, 18 bp, synthetic construct
  source 1..18: mol_type = other DNA
taatacgacgcactttag

SEQ ID NO: 521 - DNA, 18 bp, synthetic construct
  source 1..18: mol_type = other DNA
caatacgactcactatcg

SEQ ID NO: 522 - DNA, 18 bp, synthetic construct
  source 1..18: mol_type = other DNA
taatgcgaatcactatag

SEQ ID NO: 523 - DNA, 18 bp, synthetic construct
  source 1..18: mol_type = other DNA
tattacgactcactatgg

SEQ ID NO: 524 - DNA, 18 bp, synthetic construct
  source 1..18: mol_type = other DNA
taatacgactcaatctag

SEQ ID NO: 525 - DNA, 18 bp, synthetic construct
  source 1..18: mol_type = other DNA
tgatccgactcactatag

SEQ ID NO: 526 - DNA, 18 bp, synthetic construct
  source 1..18: mol_type = other DNA
taatacgaatccctatag

SEQ ID NO: 527 - DNA, 18 bp, synthetic construct
  source 1..18: mol_type = other DNA
tattacgactcacaatag

SEQ ID NO: 528 - DNA, 18 bp, synthetic construct
  source 1..18: mol_type = other DNA
taatacgactgactttag

SEQ ID NO: 529 - DNA, 18 bp, synthetic construct
  source 1..18: mol_type = other DNA
taatgcgactcaatatag

SEQ ID NO: 530 - DNA, 18 bp, synthetic construct
  source 1..18: mol_type = other DNA
taatacgactcagtatgg

SEQ ID NO: 531 - DNA, 18 bp, synthetic construct
  source 1..18: mol_type = other DNA
gaatacgactcactattg

SEQ ID NO: 532 - DNA, 18 bp, synthetic construct
  source 1..18: mol_type = other DNA
taatactactcactataa

SEQ ID NO: 533 - DNA, 18 bp, synthetic construct
  source 1..18: mol_type = other DNA
taatacgacgctctatag

SEQ ID NO: 534 - DNA, 18 bp, synthetic construct
  source 1..18: mol_type = other DNA
taatacgcctcaatatag

SEQ ID NO: 535 - DNA, 18 bp, synthetic construct
  source 1..18: mol_type = other DNA
aaatacaactcactatag

SEQ ID NO: 536 - DNA, 18 bp, synthetic construct
  source 1..18: mol_type = other DNA
taatgcgactctctatag

SEQ ID NO: 537 - DNA, 18 bp, synthetic construct
  source 1..18: mol_type = other DNA
taatacgactcacgatgg

SEQ ID NO: 538 - DNA, 18 bp, synthetic construct
  source 1..18: mol_type = other DNA
caatacgactcacgatag

SEQ ID NO: 539 - DNA, 18 bp, synthetic construct
  source 1..18: mol_type = other DNA
taatacgactcacaaaag

SEQ ID NO: 540 - DNA, 18 bp, synthetic construct
  source 1..18: mol_type = other DNA
caagacgactcactatag

SEQ ID NO: 541 - DNA, 18 bp, synthetic construct
  source 1..18: mol_type = other DNA
taatactgctcactatag

SEQ ID NO: 542 - DNA, 18 bp, synthetic construct
  source 1..18: mol_type = other DNA
ttatacgactctctatag

SEQ ID NO: 543 - DNA, 18 bp, synthetic construct
  source 1..18: mol_type = other DNA
tagtacgactcactaaag

SEQ ID NO: 544 - DNA, 18 bp, synthetic construct
  source 1..18: mol_type = other DNA
ttatacgactcactatgg

SEQ ID NO: 545 - DNA, 18 bp, synthetic construct
  source 1..18: mol_type = other DNA
tagtacgactcgctatag

SEQ ID NO: 546 - DNA, 18 bp, synthetic construct
  source 1..18: mol_type = other DNA
tagtacgactcagtatag

SEQ ID NO: 547 - DNA, 18 bp, synthetic construct
  source 1..18: mol_type = other DNA
aaagacgactcactatag

SEQ ID NO: 548 - DNA, 18 bp, synthetic construct
  source 1..18: mol_type = other DNA
taataagactccctatag

SEQ ID NO: 549 - DNA, 18 bp, synthetic construct
  source 1..18: mol_type = other DNA
taatacgcctccctatag

SEQ ID NO: 550 - DNA, 18 bp, synthetic construct
  source 1..18: mol_type = other DNA
tcatacgactcgctatag

SEQ ID NO: 551 - DNA, 18 bp, synthetic construct
  source 1..18: mol_type = other DNA
taatacgactcgcaatag

SEQ ID NO: 552 - DNA, 18 bp, synthetic construct
  source 1..18: mol_type = other DNA
taatacgactcaatagag

SEQ ID NO: 553 - DNA, 18 bp, synthetic construct
  source 1..18: mol_type = other DNA
taacaagactcactatag

SEQ ID NO: 554 - DNA, 18 bp, synthetic construct
  source 1..18: mol_type = other DNA
ttattcgactcactatag

SEQ ID NO: 555 - DNA, 18 bp, synthetic construct
  source 1..18: mol_type = other DNA
taatactcctcactatag

SEQ ID NO: 556 - DNA, 18 bp, synthetic construct
  source 1..18: mol_type = other DNA
taacacaactcactatag

SEQ ID NO: 557 - DNA, 18 bp, synthetic construct
  source 1..18: mol_type = other DNA
tactaggactcactatag

SEQ ID NO: 558 - DNA, 18 bp, synthetic construct
  source 1..18: mol_type = other DNA
taatacgtctcactatgg

SEQ ID NO: 559 - DNA, 18 bp, synthetic construct
  source 1..18: mol_type = other DNA
taatccgacttactatag

SEQ ID NO: 560 - DNA, 18 bp, synthetic construct
  source 1..18: mol_type = other DNA
taaggcgactcactatag

SEQ ID NO: 561 - DNA, 18 bp, synthetic construct
  source 1..18: mol_type = other DNA
taatccgactcactattg

SEQ ID NO: 562 - DNA, 18 bp, synthetic construct
  source 1..18: mol_type = other DNA
taatatgactcactttag

SEQ ID NO: 563 - DNA, 18 bp, synthetic construct
  source 1..18: mol_type = other DNA
tgctacgactcactatag

SEQ ID NO: 564 - DNA, 18 bp, synthetic construct
  source 1..18: mol_type = other DNA
taacccgactcactatag

SEQ ID NO: 565 - DNA, 18 bp, synthetic construct
  source 1..18: mol_type = other DNA
ttagacgactcactatag

SEQ ID NO: 566 - DNA, 18 bp, synthetic construct
  source 1..18: mol_type = other DNA
taatacgaatcactttag

SEQ ID NO: 567 - DNA, 18 bp, synthetic construct
  source 1..18: mol_type = other DNA
aaatacgacacactatag

SEQ ID NO: 568 - DNA, 18 bp, synthetic construct
  source 1..18: mol_type = other DNA
taacacgactcgctatag

SEQ ID NO: 569 - DNA, 18 bp, synthetic construct
  source 1..18: mol_type = other DNA
aaatacgactcacaatag

SEQ ID NO: 570 - DNA, 18 bp, synthetic construct
  source 1..18: mol_type = other DNA
taatacgagtcactttag

SEQ ID NO: 571 - DNA, 18 bp, synthetic construct
  source 1..18: mol_type = other DNA
taataagaatcactatag

SEQ ID NO: 572 - DNA, 18 bp, synthetic construct
  source 1..18: mol_type = other DNA
taatacgactaactatcg

SEQ ID NO: 573 - DNA, 18 bp, synthetic construct
  source 1..18: mol_type = other DNA
taatccgactcactatgg

SEQ ID NO: 574 - DNA, 18 bp, synthetic construct
  source 1..18: mol_type = other DNA
tagtacgagtcactatag

SEQ ID NO: 575 - DNA, 18 bp, synthetic construct
  source 1..18: mol_type = other DNA
tgatacgacgcactatag

SEQ ID NO: 576 - DNA, 18 bp, synthetic construct
  source 1..18: mol_type = other DNA
taatacgactcactagaa

SEQ ID NO: 577 - DNA, 18 bp, synthetic construct
  source 1..18: mol_type = other DNA
taatacaactctctatag

SEQ ID NO: 578 - DNA, 18 bp, synthetic construct
  source 1..18: mol_type = other DNA
taatacggctcactaaag

SEQ ID NO: 579 - DNA, 18 bp, synthetic construct
  source 1..18: mol_type = other DNA
taatacggctcactacag

SEQ ID NO: 580 - DNA, 18 bp, synthetic construct
  source 1..18: mol_type = other DNA
tagtacgactgactatag

SEQ ID NO: 581 - DNA, 18 bp, synthetic construct
  source 1..18: mol_type = other DNA
aaatacgactcactattg

SEQ ID NO: 582 - DNA, 18 bp, synthetic construct
  source 1..18: mol_type = other DNA
tgatacgactaactatag

SEQ ID NO: 583 - DNA, 18 bp, synthetic construct
  source 1..18: mol_type = other DNA
caatacgactccctatag

SEQ ID NO: 584 - DNA, 18 bp, synthetic construct
  source 1..18: mol_type = other DNA
taagacgcctcactatag

SEQ ID NO: 585 - DNA, 18 bp, synthetic construct
  source 1..18: mol_type = other DNA
taatacgattcactataa

SEQ ID NO: 586 - DNA, 18 bp, synthetic construct
  source 1..18: mol_type = other DNA
taatacgaatcactctag

SEQ ID NO: 587 - DNA, 18 bp, synthetic construct
  source 1..18: mol_type = other DNA
taacacgactcactgtag

SEQ ID NO: 588 - DNA, 18 bp, synthetic construct
  source 1..18: mol_type = other DNA
aagtacgactcactatag

SEQ ID NO: 589 - DNA, 18 bp, synthetic construct
  source 1..18: mol_type = other DNA
taaaacgactcacgatag

SEQ ID NO: 590 - DNA, 18 bp, synthetic construct
  source 1..18: mol_type = other DNA
aaaaacgactcactatag

SEQ ID NO: 591 - DNA, 18 bp, synthetic construct
  source 1..18: mol_type = other DNA
taataccactcactagag

SEQ ID NO: 592 - DNA, 18 bp, synthetic construct
  source 1..18: mol_type = other DNA
ttctacgactcactatag

SEQ ID NO: 593 - DNA, 18 bp, synthetic construct
  source 1..18: mol_type = other DNA
taatgctactcactatag

SEQ ID NO: 594 - DNA, 18 bp, synthetic construct
  source 1..18: mol_type = other DNA
taataggagtcactatag

SEQ ID NO: 595 - DNA, 18 bp, synthetic construct
  source 1..18: mol_type = other DNA
taatacgactccctgtag

SEQ ID NO: 596 - DNA, 18 bp, synthetic construct
  source 1..18: mol_type = other DNA
taacacgtctcactatag

SEQ ID NO: 597 - DNA, 18 bp, synthetic construct
  source 1..18: mol_type = other DNA
taatacgactgactatcg

SEQ ID NO: 598 - DNA, 18 bp, synthetic construct
  source 1..18: mol_type = other DNA
taatacgactgaccatag

SEQ ID NO: 599 - DNA, 18 bp, synthetic construct
  source 1..18: mol_type = other DNA
taatacgacccactatgg

SEQ ID NO: 600 - DNA, 18 bp, synthetic construct
  source 1..18: mol_type = other DNA
taatacgaatcactagag

SEQ ID NO: 601 - DNA, 18 bp, synthetic construct
  source 1..18: mol_type = other DNA
tattacggctcactatag

SEQ ID NO: 602 - DNA, 18 bp, synthetic construct
  source 1..18: mol_type = other DNA
taatacgactcaatacag

SEQ ID NO: 603 - DNA, 18 bp, synthetic construct
  source 1..18: mol_type = other DNA
taatacgactctctatgg

SEQ ID NO: 604 - DNA, 18 bp, synthetic construct
  source 1..18: mol_type = other DNA
tagtacgactcactatgg

SEQ ID NO: 605 - DNA, 18 bp, synthetic construct
  source 1..18: mol_type = other DNA
taataagactcactatac

SEQ ID NO: 606 - DNA, 18 bp, synthetic construct
  source 1..18: mol_type = other DNA
taatacgactcgctatac

SEQ ID NO: 607 - DNA, 18 bp, synthetic construct
  source 1..18: mol_type = other DNA
taatacgacttactttag

SEQ ID NO: 608 - DNA, 18 bp, synthetic construct
  source 1..18: mol_type = other DNA
ttatacgactcacaatag

SEQ ID NO: 609 - DNA, 18 bp, synthetic construct
  source 1..18: mol_type = other DNA
taatacgactcacaacag

SEQ ID NO: 610 - DNA, 18 bp, synthetic construct
  source 1..18: mol_type = other DNA
taaaacgactcaatatag

SEQ ID NO: 611 - DNA, 18 bp, synthetic construct
  source 1..18: mol_type = other DNA
taatacgactcacaatac

SEQ ID NO: 612 - DNA, 18 bp, synthetic construct
  source 1..18: mol_type = other DNA
taacacgactcactatcg

SEQ ID NO: 613 - DNA, 18 bp, synthetic construct
  source 1..18: mol_type = other DNA
taatacgactcactggag

SEQ ID NO: 614 - DNA, 18 bp, synthetic construct
  source 1..18: mol_type = other DNA
tcatacgacacactatag

SEQ ID NO: 615 - DNA, 18 bp, synthetic construct
  source 1..18: mol_type = other DNA
taatacgacacactttag

SEQ ID NO: 616 - DNA, 18 bp, synthetic construct
  source 1..18: mol_type = other DNA
taatacgtcgcactatag

SEQ ID NO: 617 - DNA, 18 bp, synthetic construct
  source 1..18: mol_type = other DNA
taataccactcacgatag

SEQ ID NO: 618 - DNA, 18 bp, synthetic construct
  source 1..18: mol_type = other DNA
gaatacgactcactgtag

SEQ ID NO: 619 - DNA, 18 bp, synthetic construct
  source 1..18: mol_type = other DNA
taatacgacgcattatag

SEQ ID NO: 620 - DNA, 18 bp, synthetic construct
  source 1..18: mol_type = other DNA
taatccgacccactatag

SEQ ID NO: 621 - DNA, 18 bp, synthetic construct
  source 1..18: mol_type = other DNA
taatatgactcagtatag

SEQ ID NO: 622 - DNA, 18 bp, synthetic construct
  source 1..18: mol_type = other DNA
tcatacgactgactatag

SEQ ID NO: 623 - DNA, 18 bp, synthetic construct
  source 1..18: mol_type = other DNA
caatacgactcgctatag

SEQ ID NO: 624 - DNA, 18 bp, synthetic construct
  source 1..18: mol_type = other DNA
taatatgactcactatcg

SEQ ID NO: 625 - DNA, 18 bp, synthetic construct
  source 1..18: mol_type = other DNA
gaatacgactctctatag

SEQ ID NO: 626 - DNA, 18 bp, synthetic construct
  source 1..18: mol_type = other DNA
taatacgactcacgataa

SEQ ID NO: 627 - DNA, 18 bp, synthetic construct
  source 1..18: mol_type = other DNA
taatacgactccctatcg

SEQ ID NO: 628 - DNA, 18 bp, synthetic construct
  source 1..18: mol_type = other DNA
taaaacgacgcactatag

SEQ ID NO: 629 - DNA, 18 bp, synthetic construct
  source 1..18: mol_type = other DNA
tagtacgactcattatag

SEQ ID NO: 630 - DNA, 18 bp, synthetic construct
  source 1..18: mol_type = other DNA
cagtacgactcactatag

SEQ ID NO: 631 - DNA, 18 bp, synthetic construct
  source 1..18: mol_type = other DNA
taataggaatcactatag

SEQ ID NO: 632 - DNA, 18 bp, synthetic construct
  source 1..18: mol_type = other DNA
taatacgacgcactatgg

SEQ ID NO: 633 - DNA, 18 bp, synthetic construct
  source 1..18: mol_type = other DNA
taacacgactcacgatag

SEQ ID NO: 634 - DNA, 18 bp, synthetic construct
  source 1..18: mol_type = other DNA
taattcgactcactatgg

SEQ ID NO: 635 - DNA, 18 bp, synthetic construct
  source 1..18: mol_type = other DNA
tactacgtctcactatag

SEQ ID NO: 636 - DNA, 18 bp, synthetic construct
  source 1..18: mol_type = other DNA
taataggactgactatag

SEQ ID NO: 637 - DNA, 18 bp, synthetic construct
  source 1..18: mol_type = other DNA
tattacgacgcactatag

SEQ ID NO: 638 - DNA, 18 bp, synthetic construct
  source 1..18: mol_type = other DNA
taacacgagtcactatag

SEQ ID NO: 639 - DNA, 18 bp, synthetic construct
  source 1..18: mol_type = other DNA
tattacgactcactataa

SEQ ID NO: 640 - DNA, 18 bp, synthetic construct
  source 1..18: mol_type = other DNA
tgatacaactcactatag

SEQ ID NO: 641 - DNA, 18 bp, synthetic construct
  source 1..18: mol_type = other DNA
taatacgactcacattag

SEQ ID NO: 642 - DNA, 18 bp, synthetic construct
  source 1..18: mol_type = other DNA
taagacaactcactatag

SEQ ID NO: 643 - DNA, 18 bp, synthetic construct
  source 1..18: mol_type = other DNA
tagtacgacgcactatag

SEQ ID NO: 644 - DNA, 18 bp, synthetic construct
  source 1..18: mol_type = other DNA
gaatacgactcactatcg

SEQ ID NO: 645 - DNA, 18 bp, synthetic construct
  source 1..18: mol_type = other DNA
taatacgactaactataa

SEQ ID NO: 646 - DNA, 18 bp, synthetic construct
  source 1..18: mol_type = other DNA
taatgcgactcactataa

SEQ ID NO: 647 - DNA, 18 bp, synthetic construct
  source 1..18: mol_type = other DNA
taatacgacacactatac

SEQ ID NO: 648 - DNA, 18 bp, synthetic construct
  source 1..18: mol_type = other DNA
taatactactcactatac

SEQ ID NO: 649 - DNA, 18 bp, synthetic construct
  source 1..18: mol_type = other DNA
taatacgacttactaaag

SEQ ID NO: 650 - DNA, 18 bp, synthetic construct
  source 1..18: mol_type = other DNA
taatacgtttcactatag

SEQ ID NO: 651 - DNA, 18 bp, synthetic construct
  source 1..18: mol_type = other DNA
taatacgacccaatatag

SEQ ID NO: 652 - DNA, 18 bp, synthetic construct
  source 1..18: mol_type = other DNA
tagaacgactcactatag

SEQ ID NO: 653 - DNA, 18 bp, synthetic construct
  source 1..18: mol_type = other DNA
taatacgactaactatgg

SEQ ID NO: 654 - DNA, 18 bp, synthetic construct
  source 1..18: mol_type = other DNA
taatacgtatcactatag

SEQ ID NO: 655 - DNA, 18 bp, synthetic construct
  source 1..18: mol_type = other DNA
gaatacaactcactatag

SEQ ID NO: 656 - DNA, 18 bp, synthetic construct
  source 1..18: mol_type = other DNA
tactacgcctcactatag

SEQ ID NO: 657 - DNA, 18 bp, synthetic construct
  source 1..18: mol_type = other DNA
taataccactcactaaag

SEQ ID NO: 658 - DNA, 18 bp, synthetic construct
  source 1..18: mol_type = other DNA
taatacgacccactattg

SEQ ID NO: 659 - DNA, 18 bp, synthetic construct
  source 1..18: mol_type = other DNA
tcataggactcactatag

SEQ ID NO: 660 - DNA, 18 bp, synthetic construct
  source 1..18: mol_type = other DNA
taaaacgactctctatag

SEQ ID NO: 661 - DNA, 18 bp, synthetic construct
  source 1..18: mol_type = other DNA
tcatacgattcactatag

SEQ ID NO: 662 - DNA, 18 bp, synthetic construct
  source 1..18: mol_type = other DNA
taatacgagtctctatag

SEQ ID NO: 663 - DNA, 18 bp, synthetic construct
  source 1..18: mol_type = other DNA
taatgcgactgactatag

SEQ ID NO: 664 - DNA, 18 bp, synthetic construct
  source 1..18: mol_type = other DNA
taatacgacacactgtag

SEQ ID NO: 665 - DNA, 18 bp, synthetic construct
  source 1..18: mol_type = other DNA
tgatatgactcactatag

SEQ ID NO: 666 - DNA, 18 bp, synthetic construct
  source 1..18: mol_type = other DNA
taatacgactcattctag

SEQ ID NO: 667 - DNA, 18 bp, synthetic construct
  source 1..18: mol_type = other DNA
gaatatgactcactatag

SEQ ID NO: 668 - DNA, 18 bp, synthetic construct
  source 1..18: mol_type = other DNA
taatacgaatcactatcg

SEQ ID NO: 669 - DNA, 18 bp, synthetic construct
  source 1..18: mol_type = other DNA
tattacgactcactatac

SEQ ID NO: 670 - DNA, 18 bp, synthetic construct
  source 1..18: mol_type = other DNA
tattacgactctctatag

SEQ ID NO: 671 - DNA, 18 bp, synthetic construct
  source 1..18: mol_type = other DNA
taatacgactcaatttag

SEQ ID NO: 672 - DNA, 18 bp, synthetic construct
  source 1..18: mol_type = other DNA
tcatacgacccactatag

SEQ ID NO: 673 - DNA, 18 bp, synthetic construct
  source 1..18: mol_type = other DNA
taatactactcactatcg

SEQ ID NO: 674 - DNA, 18 bp, synthetic construct
  source 1..18: mol_type = other DNA
tagtacgtctcactatag

SEQ ID NO: 675 - DNA, 18 bp, synthetic construct
  source 1..18: mol_type = other DNA
taatacgacgaactatag

SEQ ID NO: 676 - DNA, 18 bp, synthetic construct
  source 1..18: mol_type = other DNA
taatacgactcaatgtag

SEQ ID NO: 677 - DNA, 18 bp, synthetic construct
  source 1..18: mol_type = other DNA
gaatacgactccctatag

SEQ ID NO: 678 - DNA, 18 bp, synthetic construct
  source 1..18: mol_type = other DNA
taataagactctctatag

SEQ ID NO: 679 - DNA, 18 bp, synthetic construct
  source 1..18: mol_type = other DNA
taataagactcaatatag

SEQ ID NO: 680 - DNA, 18 bp, synthetic construct
  source 1..18: mol_type = other DNA
taatacgccccactatag

SEQ ID NO: 681 - DNA, 18 bp, synthetic construct
  source 1..18: mol_type = other DNA
tactacgactcactttag

SEQ ID NO: 682 - DNA, 18 bp, synthetic construct
  source 1..18: mol_type = other DNA
taatacgaatcactattg

SEQ ID NO: 683 - DNA, 18 bp, synthetic construct
  source 1..18: mol_type = other DNA
taatacgattcaatatag

SEQ ID NO: 684 - DNA, 18 bp, synthetic construct
  source 1..18: mol_type = other DNA
taatacgatccactatag

SEQ ID NO: 685 - DNA, 18 bp, synthetic construct
  source 1..18: mol_type = other DNA
taatacgactcactattc

SEQ ID NO: 686 - DNA, 18 bp, synthetic construct
  source 1..18: mol_type = other DNA
taatacgaggcactatag

SEQ ID NO: 687 - DNA, 18 bp, synthetic construct
  source 1..18: mol_type = other DNA
taataggacgcactatag

SEQ ID NO: 688 - DNA, 18 bp, synthetic construct
  source 1..18: mol_type = other DNA
aaatacgactcaccatag

SEQ ID NO: 689 - DNA, 18 bp, synthetic construct
  source 1..18: mol_type = other DNA
taatacgaatcactaaag

SEQ ID NO: 690 - DNA, 18 bp, synthetic construct
  source 1..18: mol_type = other DNA
ttatacgaatcactatag

SEQ ID NO: 691 - DNA, 18 bp, synthetic construct
  source 1..18: mol_type = other DNA
tgatacgactgactatag

SEQ ID NO: 692 - DNA, 18 bp, synthetic construct
  source 1..18: mol_type = other DNA
tacttcgactcactatag

SEQ ID NO: 693 - DNA, 18 bp, synthetic construct
  source 1..18: mol_type = other DNA
tactacgactcagtatag

SEQ ID NO: 694 - DNA, 18 bp, synthetic construct
  source 1..18: mol_type = other DNA
taatacgactcaacatag

SEQ ID NO: 695 - DNA, 18 bp, synthetic construct
  source 1..18: mol_type = other DNA
taatacgacccagtatag

SEQ ID NO: 696 - DNA, 18 bp, synthetic construct
  source 1..18: mol_type = other DNA
taacacgactcactaaag

SEQ ID NO: 697 - DNA, 18 bp, synthetic construct
  source 1..18: mol_type = other DNA
taataccactcattatag

SEQ ID NO: 698 - DNA, 18 bp, synthetic construct
  source 1..18: mol_type = other DNA
taattcgactccctatag

SEQ ID NO: 699 - DNA, 18 bp, synthetic construct
  source 1..18: mol_type = other DNA
taatacgactaactagag

SEQ ID NO: 700 - DNA, 18 bp, synthetic construct
  source 1..18: mol_type = other DNA
taatacgactgacaatag

SEQ ID NO: 701 - DNA, 18 bp, synthetic construct
  source 1..18: mol_type = other DNA
gaatacgattcactatag

SEQ ID NO: 702 - DNA, 18 bp, synthetic construct
  source 1..18: mol_type = other DNA
taatactactcaccatag

SEQ ID NO: 703 - DNA, 18 bp, synthetic construct
  source 1..18: mol_type = other DNA
taatactactcgctatag

SEQ ID NO: 704 - DNA, 18 bp, synthetic construct
  source 1..18: mol_type = other DNA
taatacgtctcaatatag

SEQ ID NO: 705 - DNA, 18 bp, synthetic construct
  source 1..18: mol_type = other DNA
taatacgactgactgtag

SEQ ID NO: 706 - DNA, 18 bp, synthetic construct
  source 1..18: mol_type = other DNA
taatacgactggctatag

SEQ ID NO: 707 - DNA, 18 bp, synthetic construct
  source 1..18: mol_type = other DNA
taatacgacactctatag

SEQ ID NO: 708 - DNA, 18 bp, synthetic construct
  source 1..18: mol_type = other DNA
taatacccctcactatag

SEQ ID NO: 709 - DNA, 18 bp, synthetic construct
  source 1..18: mol_type = other DNA
taatacgactcacaatcg

SEQ ID NO: 710 - DNA, 18 bp, synthetic construct
  source 1..18: mol_type = other DNA
aaatacgactcactatcg

SEQ ID NO: 711 - DNA, 18 bp, synthetic construct
  source 1..18: mol_type = other DNA
taatacgagtcactctag

SEQ ID NO: 712 - DNA, 18 bp, synthetic construct
  source 1..18: mol_type = other DNA
ttatacgactcaatatag

SEQ ID NO: 713 - DNA, 18 bp, synthetic construct
  source 1..18: mol_type = other DNA
taatacggctcactttag

SEQ ID NO: 714 - DNA, 18 bp, synthetic construct
  source 1..18: mol_type = other DNA
taaaacgactgactatag

SEQ ID NO: 715 - DNA, 18 bp, synthetic construct
  source 1..18: mol_type = other DNA
caataccactcactatag

SEQ ID NO: 716 - DNA, 18 bp, synthetic construct
  source 1..18: mol_type = other DNA
caatacgactctctatag

SEQ ID NO: 717 - DNA, 18 bp, synthetic construct
  source 1..18: mol_type = other DNA
atatacgactcactatag

SEQ ID NO: 718 - DNA, 18 bp, synthetic construct
  source 1..18: mol_type = other DNA
taatccgactcagtatag

SEQ ID NO: 719 - DNA, 18 bp, synthetic construct
  source 1..18: mol_type = other DNA
gaatccgactcactatag

SEQ ID NO: 720 - DNA, 18 bp, synthetic construct
  source 1..18: mol_type = other DNA
taatacgacgcactgtag

SEQ ID NO: 721 - DNA, 18 bp, synthetic construct
  source 1..18: mol_type = other DNA
taatacaactcactatac

SEQ ID NO: 722 - DNA, 18 bp, synthetic construct
  source 1..18: mol_type = other DNA
taatacgacttactctag

SEQ ID NO: 723 - DNA, 18 bp, synthetic construct
  source 1..18: mol_type = other DNA
tcatacaactcactatag

SEQ ID NO: 724 - DNA, 18 bp, synthetic construct
  source 1..18: mol_type = other DNA
taatacgacccactgtag

SEQ ID NO: 725 - DNA, 18 bp, synthetic construct
  source 1..18: mol_type = other DNA
taatacgcctgactatag

SEQ ID NO: 726 - DNA, 18 bp, synthetic construct
  source 1..18: mol_type = other DNA
taatacgactctccatag

SEQ ID NO: 727 - DNA, 18 bp, synthetic construct
  source 1..18: mol_type = other DNA
tagtacggctcactatag

SEQ ID NO: 728 - DNA, 18 bp, synthetic construct
  source 1..18: mol_type = other DNA
taacacgacgcactatag

SEQ ID NO: 729 - DNA, 18 bp, synthetic construct
  source 1..18: mol_type = other DNA
caatacgagtcactatag

SEQ ID NO: 730 - DNA, 18 bp, synthetic construct
  source 1..18: mol_type = other DNA
tactacgactcaccatag

SEQ ID NO: 731 - DNA, 18 bp, synthetic construct
  source 1..18: mol_type = other DNA
taagacgactcactatcg

SEQ ID NO: 732 - DNA, 18 bp, synthetic construct
  source 1..18: mol_type = other DNA
taatacgacccgctatag

SEQ ID NO: 733 - DNA, 18 bp, synthetic construct
  source 1..18: mol_type = other DNA
tactacgactcactctag

SEQ ID NO: 734 - DNA, 18 bp, synthetic construct
  source 1..18: mol_type = other DNA
taaaacgacccactatag

SEQ ID NO: 735 - DNA, 18 bp, synthetic construct
  source 1..18: mol_type = other DNA
taatacgactccctatgg

SEQ ID NO: 736 - DNA, 18 bp, synthetic construct
  source 1..18: mol_type = other DNA
taattcgactcacaatag

SEQ ID NO: 737 - DNA, 18 bp, synthetic construct
  source 1..18: mol_type = other DNA
taatacgactagctatag

SEQ ID NO: 738 - DNA, 18 bp, synthetic construct
  source 1..18: mol_type = other DNA
tcatacgactcactattg

SEQ ID NO: 739 - DNA, 18 bp, synthetic construct
  source 1..18: mol_type = other DNA
tactacgactcactattg

SEQ ID NO: 740 - DNA, 18 bp, synthetic construct
  source 1..18: mol_type = other DNA
taatacgagtcacgatag

SEQ ID NO: 741 - DNA, 18 bp, synthetic construct
  source 1..18: mol_type = other DNA
taatacgaatcactataa

SEQ ID NO: 742 - DNA, 18 bp, synthetic construct
  source 1..18: mol_type = other DNA
ttatacgactcactatat

SEQ ID NO: 743 - DNA, 18 bp, synthetic construct
  source 1..18: mol_type = other DNA
taatacgagtcaccatag

SEQ ID NO: 744 - DNA, 18 bp, synthetic construct
  source 1..18: mol_type = other DNA
taatacgactaactacag

SEQ ID NO: 745 - DNA, 18 bp, synthetic construct
  source 1..18: mol_type = other DNA
tactacgactccctatag

SEQ ID NO: 746 - DNA, 18 bp, synthetic construct
  source 1..18: mol_type = other DNA
taataagactcacaatag

SEQ ID NO: 747 - DNA, 18 bp, synthetic construct
  source 1..18: mol_type = other DNA
taatacgacttactagag

SEQ ID NO: 748 - DNA, 18 bp, synthetic construct
  source 1..18: mol_type = other DNA
taatacgacacactatcg

SEQ ID NO: 749 - DNA, 18 bp, synthetic construct
  source 1..18: mol_type = other DNA
taagacgacacactatag

SEQ ID NO: 750 - DNA, 18 bp, synthetic construct
  source 1..18: mol_type = other DNA
taagacgactcaatatag

SEQ ID NO: 751 - DNA, 18 bp, synthetic construct
  source 1..18: mol_type = other DNA
taatacgactcaataaag

SEQ ID NO: 752 - DNA, 18 bp, synthetic construct
  source 1..18: mol_type = other DNA
taatacgacccactatcg

SEQ ID NO: 753 - DNA, 18 bp, synthetic construct
  source 1..18: mol_type = other DNA
taatccgattcactatag

SEQ ID NO: 754 - DNA, 18 bp, synthetic construct
  source 1..18: mol_type = other DNA
taagacgtctcactatag

SEQ ID NO: 755 - DNA, 18 bp, synthetic construct
  source 1..18: mol_type = other DNA
taattcgacttactatag

SEQ ID NO: 756 - DNA, 18 bp, synthetic construct
  source 1..18: mol_type = other DNA
tactacgactcactgtag

SEQ ID NO: 757 - DNA, 18 bp, synthetic construct
  source 1..18: mol_type = other DNA
taatacgacaaactatag

SEQ ID NO: 758 - DNA, 18 bp, synthetic construct
  source 1..18: mol_type = other DNA
taatatgagtcactatag

SEQ ID NO: 759 - DNA, 18 bp, synthetic construct
  source 1..18: mol_type = other DNA
gcatacgactcactatag

SEQ ID NO: 760 - DNA, 18 bp, synthetic construct
  source 1..18: mol_type = other DNA
taatacgactcgatatag

SEQ ID NO: 761 - DNA, 18 bp, synthetic construct
  source 1..18: mol_type = other DNA
taatccgaatcactatag

SEQ ID NO: 762 - DNA, 18 bp, synthetic construct
  source 1..18: mol_type = other DNA
taatacgacttactattg

SEQ ID NO: 763 - DNA, 18 bp, synthetic construct
  source 1..18: mol_type = other DNA
taataggattcactatag

SEQ ID NO: 764 - DNA, 18 bp, synthetic construct
  source 1..18: mol_type = other DNA
taataccactcgctatag

SEQ ID NO: 765 - DNA, 18 bp, synthetic construct
  source 1..18: mol_type = other DNA
taactcgactcactatag

SEQ ID NO: 766 - DNA, 18 bp, synthetic construct
  source 1..18: mol_type = other DNA
taatacgaatcactacag

SEQ ID NO: 767 - DNA, 18 bp, synthetic construct
  source 1..18: mol_type = other DNA
taatacgattcactgtag

SEQ ID NO: 768 - DNA, 18 bp, synthetic construct
  source 1..18: mol_type = other DNA
taatacgactctcaatag

SEQ ID NO: 769 - DNA, 18 bp, synthetic construct
  source 1..18: mol_type = other DNA
tcatacgactcactaaag

SEQ ID NO: 770 - DNA, 18 bp, synthetic construct
  source 1..18: mol_type = other DNA
taaaacgaatcactatag

SEQ ID NO: 771 - DNA, 18 bp, synthetic construct
  source 1..18: mol_type = other DNA
tcatacgactcactatcg

SEQ ID NO: 772 - DNA, 18 bp, synthetic construct
  source 1..18: mol_type = other DNA
tagtccgactcactatag

SEQ ID NO: 773 - DNA, 18 bp, synthetic construct
  source 1..18: mol_type = other DNA
taatacaaatcactatag

SEQ ID NO: 774 - DNA, 18 bp, synthetic construct
  source 1..18: mol_type = other DNA
taatacgactcataatag

SEQ ID NO: 775 - DNA, 18 bp, synthetic construct
  source 1..18: mol_type = other DNA
taatacgattcagtatag

SEQ ID NO: 776 - DNA, 18 bp, synthetic construct
  source 1..18: mol_type = other DNA
aaatacgactcactatgg

SEQ ID NO: 777 - DNA, 18 bp, synthetic construct
  source 1..18: mol_type = other DNA
taatacgcctctctatag

SEQ ID NO: 778 - DNA, 18 bp, synthetic construct
  source 1..18: mol_type = other DNA
taagacgactcactaaag

SEQ ID NO: 779 - DNA, 18 bp, synthetic construct
  source 1..18: mol_type = other DNA
taatacgactgactattg

SEQ ID NO: 780 - DNA, 18 bp, synthetic construct
  source 1..18: mol_type = other DNA
taatacgaccccctatag

SEQ ID NO: 781 - DNA, 18 bp, synthetic construct
  source 1..18: mol_type = other DNA
taatacgactcactatga

SEQ ID NO: 782 - DNA, 18 bp, synthetic construct
  source 1..18: mol_type = other DNA
taacacgactcactataa

SEQ ID NO: 783 - DNA, 18 bp, synthetic construct
  source 1..18: mol_type = other DNA
taatacgacagactatag

SEQ ID NO: 784 - DNA, 18 bp, synthetic construct
  source 1..18: mol_type = other DNA
ttatacgactaactatag

SEQ ID NO: 785 - DNA, 18 bp, synthetic construct
  source 1..18: mol_type = other DNA
taatacgtctctctatag

SEQ ID NO: 786 - DNA, 18 bp, synthetic construct
  source 1..18: mol_type = other DNA
taatacgacacactctag

SEQ ID NO: 787 - DNA, 18 bp, synthetic construct
  source 1..18: mol_type = other DNA
tactaagactcactatag

SEQ ID NO: 788 - DNA, 18 bp, synthetic construct
  source 1..18: mol_type = other DNA
taatacgtctccctatag

SEQ ID NO: 789 - DNA, 18 bp, synthetic construct
  source 1..18: mol_type = other DNA
taatacaactccctatag

SEQ ID NO: 790 - DNA, 18 bp, synthetic construct
  source 1..18: mol_type = other DNA
taatacgactcaatatcg

SEQ ID NO: 791 - DNA, 18 bp, synthetic construct
  source 1..18: mol_type = other DNA
taatacgagtcaatatag

SEQ ID NO: 792 - DNA, 18 bp, synthetic construct
  source 1..18: mol_type = other DNA
tcataagactcactatag

SEQ ID NO: 793 - DNA, 18 bp, synthetic construct
  source 1..18: mol_type = other DNA
taatacgactccctattg

SEQ ID NO: 794 - DNA, 18 bp, synthetic construct
  source 1..18: mol_type = other DNA
aaatccgactcactatag

SEQ ID NO: 795 - DNA, 18 bp, synthetic construct
  source 1..18: mol_type = other DNA
taatacgaatcacaatag

SEQ ID NO: 796 - DNA, 18 bp, synthetic construct
  source 1..18: mol_type = other DNA
taacacgactctctatag

SEQ ID NO: 797 - DNA, 18 bp, synthetic construct
  source 1..18: mol_type = other DNA
taatacgaataactatag

SEQ ID NO: 798 - DNA, 18 bp, synthetic construct
  source 1..18: mol_type = other DNA
taagacgactcactctag

SEQ ID NO: 799 - DNA, 18 bp, synthetic construct
  source 1..18: mol_type = other DNA
tcatacgcctcactatag

SEQ ID NO: 800 - DNA, 18 bp, synthetic construct
  source 1..18: mol_type = other DNA
taatacgacacgctatag

SEQ ID NO: 801 - DNA, 18 bp, synthetic construct
  source 1..18: mol_type = other DNA
taatacgactcattatcg

SEQ ID NO: 802 - DNA, 18 bp, synthetic construct
  source 1..18: mol_type = other DNA
taatactactgactatag

SEQ ID NO: 803 - DNA, 18 bp, synthetic construct
  source 1..18: mol_type = other DNA
taatacgactcattagag

SEQ ID NO: 804 - DNA, 18 bp, synthetic construct
  source 1..18: mol_type = other DNA
tagtacgaatcactatag

SEQ ID NO: 805 - DNA, 18 bp, synthetic construct
  source 1..18: mol_type = other DNA
taatacgaatcaccatag

SEQ ID NO: 806 - DNA, 18 bp, synthetic construct
  source 1..18: mol_type = other DNA
caacacgactcactatag

SEQ ID NO: 807 - DNA, 18 bp, synthetic construct
  source 1..18: mol_type = other DNA
tatgacgactcactatag

SEQ ID NO: 808 - DNA, 18 bp, synthetic construct
  source 1..18: mol_type = other DNA
taatacgagtcactatcg

SEQ ID NO: 809 - DNA, 18 bp, synthetic construct
  source 1..18: mol_type = other DNA
tgatacgactcacaatag

SEQ ID NO: 810 - DNA, 18 bp, synthetic construct
  source 1..18: mol_type = other DNA
taataccactcactacag

SEQ ID NO: 811 - DNA, 18 bp, synthetic construct
  source 1..18: mol_type = other DNA
tcatacgtctcactatag

SEQ ID NO: 812 - DNA, 18 bp, synthetic construct
  source 1..18: mol_type = other DNA
taatacggctcattatag

SEQ ID NO: 813 - DNA, 18 bp, synthetic construct
  source 1..18: mol_type = other DNA
taatacgaatcagtatag

SEQ ID NO: 814 - DNA, 18 bp, synthetic construct
  source 1..18: mol_type = other DNA
taattcgactcaatatag

SEQ ID NO: 815 - DNA, 18 bp, synthetic construct
  source 1..18: mol_type = other DNA
taatacgactgactagag

SEQ ID NO: 816 - DNA, 18 bp, synthetic construct
  source 1..18: mol_type = other DNA
tagtacgactcactatcg

SEQ ID NO: 817 - DNA, 18 bp, synthetic construct
  source 1..18: mol_type = other DNA
taatacgactcactctaa

SEQ ID NO: 818 - DNA, 18 bp, synthetic construct
  source 1..18: mol_type = other DNA
tagtacgactctctatag

SEQ ID NO: 819 - DNA, 18 bp, synthetic construct
  source 1..18: mol_type = other DNA
tactaccactcactatag

SEQ ID NO: 820 - DNA, 18 bp, synthetic construct
  source 1..18: mol_type = other DNA
taattcgacacactatag

SEQ ID NO: 821 - DNA, 18 bp, synthetic construct
  source 1..18: mol_type = other DNA
aaatacgactccctatag

SEQ ID NO: 822 - DNA, 18 bp, synthetic construct
  source 1..18: mol_type = other DNA
taatacgactcaatattg

SEQ ID NO: 823 - DNA, 18 bp, synthetic construct
  source 1..18: mol_type = other DNA
caatacgattcactatag

SEQ ID NO: 824 - DNA, 18 bp, synthetic construct
  source 1..18: mol_type = other DNA
gaatacgacttactatag

SEQ ID NO: 825 - DNA, 18 bp, synthetic construct
  source 1..18: mol_type = other DNA
tattacgagtcactatag

SEQ ID NO: 826 - DNA, 18 bp, synthetic construct
  source 1..18: mol_type = other DNA
tactacgactcattatag

SEQ ID NO: 827 - DNA, 18 bp, synthetic construct
  source 1..18: mol_type = other DNA
taatacgactcattgtag

SEQ ID NO: 828 - DNA, 18 bp, synthetic construct
  source 1..18: mol_type = other DNA
taatactacgcactatag

SEQ ID NO: 829 - DNA, 18 bp, synthetic construct
  source 1..18: mol_type = other DNA
taatacgacacactataa

SEQ ID NO: 830 - DNA, 18 bp, synthetic construct
  source 1..18: mol_type = other DNA
taaaacgattcactatag

SEQ ID NO: 831 - DNA, 18 bp, synthetic construct
  source 1..18: mol_type = other DNA
taacacgactcactttag

SEQ ID NO: 832 - DNA, 18 bp, synthetic construct
  source 1..18: mol_type = other DNA
taatacaactcaatatag

SEQ ID NO: 833 - DNA, 18 bp, synthetic construct
  source 1..18: mol_type = other DNA
taataccacccactatag

SEQ ID NO: 834 - DNA, 18 bp, synthetic construct
  source 1..18: mol_type = other DNA
taatacgactaactattg

SEQ ID NO: 835 - DNA, 18 bp, synthetic construct
  source 1..18: mol_type = other DNA
taatacgacccactaaag

SEQ ID NO: 836 - DNA, 18 bp, synthetic construct
  source 1..18: mol_type = other DNA
tattaccactcactatag

SEQ ID NO: 837 - DNA, 18 bp, synthetic construct
  source 1..18: mol_type = other DNA
taatacgactaactgtag

SEQ ID NO: 838 - DNA, 18 bp, synthetic construct
  source 1..18: mol_type = other DNA
tagtatgactcactatag

SEQ ID NO: 839 - DNA, 18 bp, synthetic construct
  source 1..18: mol_type = other DNA
tcatacgactcactttag

SEQ ID NO: 840 - DNA, 18 bp, synthetic construct
  source 1..18: mol_type = other DNA
tactacgactcactacag

SEQ ID NO: 841 - DNA, 18 bp, synthetic construct
  source 1..18: mol_type = other DNA
tattacgactcaatatag

SEQ ID NO: 842 - DNA, 18 bp, synthetic construct
  source 1..18: mol_type = other DNA
taatacgactaaccatag

SEQ ID NO: 843 - DNA, 18 bp, synthetic construct
  source 1..18: mol_type = other DNA
aaatacgactgactatag

SEQ ID NO: 844 - DNA, 18 bp, synthetic construct
  source 1..18: mol_type = other DNA
taatacgacccactagag

SEQ ID NO: 845 - DNA, 18 bp, synthetic construct
  source 1..18: mol_type = other DNA
taatactactcactattg

SEQ ID NO: 846 - DNA, 18 bp, synthetic construct
  source 1..18: mol_type = other DNA
taatacgattcactaaag

SEQ ID NO: 847 - DNA, 18 bp, synthetic construct
  source 1..18: mol_type = other DNA
taatgcgactaactatag

SEQ ID NO: 848 - DNA, 18 bp, synthetic construct
  source 1..18: mol_type = other DNA
tagttcgactcactatag

SEQ ID NO: 849 - DNA, 18 bp, synthetic construct
  source 1..18: mol_type = other DNA
tagtaggactcactatag

SEQ ID NO: 850 - DNA, 18 bp, synthetic construct
  source 1..18: mol_type = other DNA
taatacgactccctctag

SEQ ID NO: 851 - DNA, 18 bp, synthetic construct
  source 1..18: mol_type = other DNA
cactacgactcactatag

SEQ ID NO: 852 - DNA, 18 bp, synthetic construct
  source 1..18: mol_type = other DNA
taatacgaatcacgatag

SEQ ID NO: 853 - DNA, 18 bp, synthetic construct
  source 1..18: mol_type = other DNA
taatacgtcccactatag

SEQ ID NO: 854 - DNA, 18 bp, synthetic construct
  source 1..18: mol_type = other DNA
taatacgagtgactatag

SEQ ID NO: 855 - DNA, 18 bp, synthetic construct
  source 1..18: mol_type = other DNA
taacaccactcactatag

SEQ ID NO: 856 - DNA, 18 bp, synthetic construct
  source 1..18: mol_type = other DNA
taatatgactcactattg

SEQ ID NO: 857 - DNA, 18 bp, synthetic construct
  source 1..18: mol_type = other DNA
taatacgactcattttag

SEQ ID NO: 858 - DNA, 18 bp, synthetic construct
  source 1..18: mol_type = other DNA
taatacgactcatcatag

SEQ ID NO: 859 - DNA, 18 bp, synthetic construct
  source 1..18: mol_type = other DNA
taatactacccactatag

SEQ ID NO: 860 - DNA, 18 bp, synthetic construct
  source 1..18: mol_type = other DNA
taatacgactcaagatag

SEQ ID NO: 861 - DNA, 18 bp, synthetic construct
  source 1..18: mol_type = other DNA
gaatacgactcattatag

SEQ ID NO: 862 - DNA, 18 bp, synthetic construct
  source 1..18: mol_type = other DNA
taatacgacgcagtatag

SEQ ID NO: 863 - DNA, 18 bp, synthetic construct
  source 1..18: mol_type = other DNA
taatatgaatcactatag

SEQ ID NO: 864 - DNA, 18 bp, synthetic construct
  source 1..18: mol_type = other DNA
taatcctactcactatag

SEQ ID NO: 865 - DNA, 18 bp, synthetic construct
  source 1..18: mol_type = other DNA
taatgcgattcactatag

SEQ ID NO: 866 - DNA, 18 bp, synthetic construct
  source 1..18: mol_type = other DNA
taatgcgactcattatag

SEQ ID NO: 867 - DNA, 18 bp, synthetic construct
  source 1..18: mol_type = other DNA
tgatacgactcagtatag

SEQ ID NO: 868 - DNA, 18 bp, synthetic construct
  source 1..18: mol_type = other DNA
taatacgacacactagag

SEQ ID NO: 869 - DNA, 18 bp, synthetic construct
  source 1..18: mol_type = other DNA
taatacgactaagtatag

SEQ ID NO: 870 - DNA, 18 bp, synthetic construct
  source 1..18: mol_type = other DNA
taatacgactcatgatag

SEQ ID NO: 871 - DNA, 18 bp, synthetic construct
  source 1..18: mol_type = other DNA
aaatacgaatcactatag

SEQ ID NO: 872 - DNA, 18 bp, synthetic construct
  source 1..18: mol_type = other DNA
aaataccactcactatag

SEQ ID NO: 873 - DNA, 18 bp, synthetic construct
  source 1..18: mol_type = other DNA
taataggactccctatag

SEQ ID NO: 874 - DNA, 18 bp, synthetic construct
  source 1..18: mol_type = other DNA
taatacgagacactatag

SEQ ID NO: 875 - DNA, 18 bp, synthetic construct
  source 1..18: mol_type = other DNA
taataagacttactatag

SEQ ID NO: 876 - DNA, 18 bp, synthetic construct
  source 1..18: mol_type = other DNA
taatacgattcactatcg

SEQ ID NO: 877 - DNA, 18 bp, synthetic construct
  source 1..18: mol_type = other DNA
taatacgagtcactgtag

SEQ ID NO: 878 - DNA, 18 bp, synthetic construct
  source 1..18: mol_type = other DNA
aaatacgactcattatag

SEQ ID NO: 879 - DNA, 18 bp, synthetic construct
  source 1..18: mol_type = other DNA
taatactacacactatag

SEQ ID NO: 880 - DNA, 18 bp, synthetic construct
  source 1..18: mol_type = other DNA
taatatcactcactatag

SEQ ID NO: 881 - DNA, 18 bp, synthetic construct
  source 1..18: mol_type = other DNA
tagtaccactcactatag

SEQ ID NO: 882 - DNA, 18 bp, synthetic construct
  source 1..18: mol_type = other DNA
taatacgactcattaaag

SEQ ID NO: 883 - DNA, 18 bp, synthetic construct
  source 1..18: mol_type = other DNA
ttatacgactgactatag

SEQ ID NO: 884 - DNA, 18 bp, synthetic construct
  source 1..18: mol_type = other DNA
taatatgacttactatag

SEQ ID NO: 885 - DNA, 18 bp, synthetic construct
  source 1..18: mol_type = other DNA
tcatacgacttactatag

SEQ ID NO: 886 - DNA, 18 bp, synthetic construct
  source 1..18: mol_type = other DNA
taataccactcactgtag

SEQ ID NO: 887 - DNA, 18 bp, synthetic construct
  source 1..18: mol_type = other DNA
tcgtacgactcactatag

SEQ ID NO: 888 - DNA, 18 bp, synthetic construct
  source 1..18: mol_type = other DNA
taacacgattcactatag

SEQ ID NO: 889 - DNA, 18 bp, synthetic construct
  source 1..18: mol_type = other DNA
taatacgactccctacag

SEQ ID NO: 890 - DNA, 18 bp, synthetic construct
  source 1..18: mol_type = other DNA
taataccactcactctag

SEQ ID NO: 891 - DNA, 18 bp, synthetic construct
  source 1..18: mol_type = other DNA
taatacgagtcattatag

SEQ ID NO: 892 - DNA, 18 bp, synthetic construct
  source 1..18: mol_type = other DNA
taatacgcctcattatag

SEQ ID NO: 893 - DNA, 18 bp, synthetic construct
  source 1..18: mol_type = other DNA
taattcgaatcactatag

SEQ ID NO: 894 - DNA, 18 bp, synthetic construct
  source 1..18: mol_type = other DNA
taataccacttactatag

SEQ ID NO: 895 - DNA, 18 bp, synthetic construct
  source 1..18: mol_type = other DNA
taatacgactaactttag

SEQ ID NO: 896 - DNA, 18 bp, synthetic construct
  source 1..18: mol_type = other DNA
taatacggcacactatag

SEQ ID NO: 897 - DNA, 18 bp, synthetic construct
  source 1..18: mol_type = other DNA
taatacgaatcactgtag

SEQ ID NO: 898 - DNA, 18 bp, synthetic construct
  source 1..18: mol_type = other DNA
taatatgacccactatag

SEQ ID NO: 899 - DNA, 18 bp, synthetic construct
  source 1..18: mol_type = other DNA
gactacgactcactatag

SEQ ID NO: 900 - DNA, 18 bp, synthetic construct
  source 1..18: mol_type = other DNA
taatacgacacactacag

SEQ ID NO: 901 - DNA, 18 bp, synthetic construct
  source 1..18: mol_type = other DNA
tactacgacacactatag

SEQ ID NO: 902 - DNA, 18 bp, synthetic construct
  source 1..18: mol_type = other DNA
taaaactactcactatag

SEQ ID NO: 903 - DNA, 18 bp, synthetic construct
  source 1..18: mol_type = other DNA
taaaacgactccctatag

SEQ ID NO: 904 - DNA, 18 bp, synthetic construct
  source 1..18: mol_type = other DNA
ttacacgactcactatag

SEQ ID NO: 905 - DNA, 18 bp, synthetic construct
  source 1..18: mol_type = other DNA
ttatacgattcactatag

SEQ ID NO: 906 - DNA, 18 bp, synthetic construct
  source 1..18: mol_type = other DNA
taacacgactcacaatag

SEQ ID NO: 907 - DNA, 18 bp, synthetic construct
  source 1..18: mol_type = other DNA
tcatacgactcactagag

SEQ ID NO: 908 - DNA, 18 bp, synthetic construct
  source 1..18: mol_type = other DNA
taatacgattcacaatag

SEQ ID NO: 909 - DNA, 18 bp, synthetic construct
  source 1..18: mol_type = other DNA
taaaacgactcattatag

SEQ ID NO: 910 - DNA, 18 bp, synthetic construct
  source 1..18: mol_type = other DNA
taatacgactccttatag

SEQ ID NO: 911 - DNA, 18 bp, synthetic construct
  source 1..18: mol_type = other DNA
tgatacgactcaatatag

SEQ ID NO: 912 - DNA, 18 bp, synthetic construct
  source 1..18: mol_type = other DNA
caatactactcactatag

SEQ ID NO: 913 - DNA, 18 bp, synthetic construct
  source 1..18: mol_type = other DNA
taatacggatcactatag

SEQ ID NO: 914 - DNA, 18 bp, synthetic construct
  source 1..18: mol_type = other DNA
taatactaatcactatag

SEQ ID NO: 915 - DNA, 18 bp, synthetic construct
  source 1..18: mol_type = other DNA
taagacgactcactttag

SEQ ID NO: 916 - DNA, 18 bp, synthetic construct
  source 1..18: mol_type = other DNA
taatacgacttacgatag

SEQ ID NO: 917 - DNA, 18 bp, synthetic construct
  source 1..18: mol_type = other DNA
tcatacgactccctatag

SEQ ID NO: 918 - DNA, 18 bp, synthetic construct
  source 1..18: mol_type = other DNA
taatagtactcactatag

SEQ ID NO: 919 - DNA, 18 bp, synthetic construct
  source 1..18: mol_type = other DNA
taatacgactgaatatag

SEQ ID NO: 920 - DNA, 18 bp, synthetic construct
  source 1..18: mol_type = other DNA
tgatacgaatcactatag

SEQ ID NO: 921 - DNA, 18 bp, synthetic construct
  source 1..18: mol_type = other DNA
taatacgacacattatag

SEQ ID NO: 922 - DNA, 18 bp, synthetic construct
  source 1..18: mol_type = other DNA
taatacgagttactatag

SEQ ID NO: 923 - DNA, 18 bp, synthetic construct
  source 1..18: mol_type = other DNA
taatacgactgacgatag

SEQ ID NO: 924 - DNA, 18 bp, synthetic construct
  source 1..18: mol_type = other DNA
gaacacgactcactatag

SEQ ID NO: 925 - DNA, 18 bp, synthetic construct
  source 1..18: mol_type = other DNA
gaagacgactcactatag

SEQ ID NO: 926 - DNA, 18 bp, synthetic construct
  source 1..18: mol_type = other DNA
taatgccactcactatag

SEQ ID NO: 927 - DNA, 18 bp, synthetic construct
  source 1..18: mol_type = other DNA
taatacgattcactattg

SEQ ID NO: 928 - DNA, 18 bp, synthetic construct
  source 1..18: mol_type = other DNA
taataccacacactatag

SEQ ID NO: 929 - DNA, 18 bp, synthetic construct
  source 1..18: mol_type = other DNA
tacaacgactcactatag

SEQ ID NO: 930 - DNA, 18 bp, synthetic construct
  source 1..18: mol_type = other DNA
taatacatctcactatag

SEQ ID NO: 931 - DNA, 18 bp, synthetic construct
  source 1..18: mol_type = other DNA
taatatgactcaccatag

SEQ ID NO: 932 - DNA, 18 bp, synthetic construct
  source 1..18: mol_type = other DNA
ttatacgactccctatag

SEQ ID NO: 933 - DNA, 18 bp, synthetic construct
  source 1..18: mol_type = other DNA
taatacgactctatatag

SEQ ID NO: 934 - DNA, 18 bp, synthetic construct
  source 1..18: mol_type = other DNA
taatccgactcaatatag

SEQ ID NO: 935 - DNA, 18 bp, synthetic construct
  source 1..18: mol_type = other DNA
taatacgacttactacag

SEQ ID NO: 936 - DNA, 18 bp, synthetic construct
  source 1..18: mol_type = other DNA
taatacgattcactagag

SEQ ID NO: 937 - DNA, 18 bp, synthetic construct
  source 1..18: mol_type = other DNA
taattcgactgactatag

SEQ ID NO: 938 - DNA, 18 bp, synthetic construct
  source 1..18: mol_type = other DNA
taatacgactcaatatgg

SEQ ID NO: 939 - DNA, 18 bp, synthetic construct
  source 1..18: mol_type = other DNA
taattcgagtcactatag

SEQ ID NO: 940 - DNA, 18 bp, synthetic construct
  source 1..18: mol_type = other DNA
tcatactactcactatag

SEQ ID NO: 941 - DNA, 18 bp, synthetic construct
  source 1..18: mol_type = other DNA
ttatacgagtcactatag

SEQ ID NO: 942 - DNA, 18 bp, synthetic construct
  source 1..18: mol_type = other DNA
taatatgactaactatag

SEQ ID NO: 943 - DNA, 18 bp, synthetic construct
  source 1..18: mol_type = other DNA
aaatacgactctctatag

SEQ ID NO: 944 - DNA, 18 bp, synthetic construct
  source 1..18: mol_type = other DNA
taatacgactcattacag

SEQ ID NO: 945 - DNA, 18 bp, synthetic construct
  source 1..18: mol_type = other DNA
taatacggctgactatag

SEQ ID NO: 946 - DNA, 18 bp, synthetic construct
  source 1..18: mol_type = other DNA
aaatacgactcaatatag

SEQ ID NO: 947 - DNA, 18 bp, synthetic construct
  source 1..18: mol_type = other DNA
taatacgactcccaatag

SEQ ID NO: 948 - DNA, 18 bp, synthetic construct
  source 1..18: mol_type = other DNA
taatacggctaactatag

SEQ ID NO: 949 - DNA, 18 bp, synthetic construct
  source 1..18: mol_type = other DNA
taatactactcactaaag

SEQ ID NO: 950 - DNA, 18 bp, synthetic construct
  source 1..18: mol_type = other DNA
taatacgacccacgatag

SEQ ID NO: 951 - DNA, 18 bp, synthetic construct
  source 1..18: mol_type = other DNA
taatacgagtcactatgg

SEQ ID NO: 952 - DNA, 18 bp, synthetic construct
  source 1..18: mol_type = other DNA
gaatacgagtcactatag

SEQ ID NO: 953 - DNA, 18 bp, synthetic construct
  source 1..18: mol_type = other DNA
tcatacgactcacaatag

SEQ ID NO: 954 - DNA, 18 bp, synthetic construct
  source 1..18: mol_type = other DNA
taatacggttcactatag

SEQ ID NO: 955 - DNA, 18 bp, synthetic construct
  source 1..18: mol_type = other DNA
taatacgtctaactatag

SEQ ID NO: 956 - DNA, 18 bp, synthetic construct
  source 1..18: mol_type = other DNA
taatacgattcaccatag

SEQ ID NO: 957 - DNA, 18 bp, synthetic construct
  source 1..18: mol_type = other DNA
taatacgactatctatag

SEQ ID NO: 958 - DNA, 18 bp, synthetic construct
  source 1..18: mol_type = other DNA
taatacaactaactatag

SEQ ID NO: 959 - DNA, 18 bp, synthetic construct
  source 1..18: mol_type = other DNA
taatacgaccaactatag

SEQ ID NO: 960 - DNA, 18 bp, synthetic construct
  source 1..18: mol_type = other DNA
tattacgaatcactatag

SEQ ID NO: 961 - DNA, 18 bp, synthetic construct
  source 1..18: mol_type = other DNA
tattacgacacactatag

SEQ ID NO: 962 - DNA, 18 bp, synthetic construct
  source 1..18: mol_type = other DNA
taatacgagtaactatag

SEQ ID NO: 963 - DNA, 18 bp, synthetic construct
  source 1..18: mol_type = other DNA
taatacgacacaccatag

SEQ ID NO: 964 - DNA, 18 bp, synthetic construct
  source 1..18: mol_type = other DNA
tcatacgactcactatgg

SEQ ID NO: 965 - DNA, 18 bp, synthetic construct
  source 1..18: mol_type = other DNA
taatactactcactctag

SEQ ID NO: 966 - DNA, 18 bp, synthetic construct
  source 1..18: mol_type = other DNA
taatacgtctcattatag

SEQ ID NO: 967 - DNA, 18 bp, synthetic construct
  source 1..18: mol_type = other DNA
taatacgactaacgatag

SEQ ID NO: 968 - DNA, 18 bp, synthetic construct
  source 1..18: mol_type = other DNA
taataggacccactatag

SEQ ID NO: 969 - DNA, 18 bp, synthetic construct
  source 1..18: mol_type = other DNA
taatacgacacacgatag

SEQ ID NO: 970 - DNA, 18 bp, synthetic construct
  source 1..18: mol_type = other DNA
taataagattcactatag

SEQ ID NO: 971 - DNA, 18 bp, synthetic construct
  source 1..18: mol_type = other DNA
taatacgattaactatag

SEQ ID NO: 972 - DNA, 18 bp, synthetic construct
  source 1..18: mol_type = other DNA
taatacgaatcactatgg

SEQ ID NO: 973 - DNA, 18 bp, synthetic construct
  source 1..18: mol_type = other DNA
taatacgactttctatag

SEQ ID NO: 974 - DNA, 18 bp, synthetic construct
  source 1..18: mol_type = other DNA
taatacgacccactacag

SEQ ID NO: 975 - DNA, 18 bp, synthetic construct
  source 1..18: mol_type = other DNA
taatgcgactccctatag

SEQ ID NO: 976 - DNA, 18 bp, synthetic construct
  source 1..18: mol_type = other DNA
tgatacgactccctatag

SEQ ID NO: 977 - DNA, 18 bp, synthetic construct
  source 1..18: mol_type = other DNA
taattcgacccactatag

SEQ ID NO: 978 - DNA, 18 bp, synthetic construct
  source 1..18: mol_type = other DNA
taatccgactgactatag

SEQ ID NO: 979 - DNA, 18 bp, synthetic construct
  source 1..18: mol_type = other DNA
taacacgactcactatgg

SEQ ID NO: 980 - DNA, 18 bp, synthetic construct
  source 1..18: mol_type = other DNA
taagacggctcactatag

SEQ ID NO: 981 - DNA, 18 bp, synthetic construct
  source 1..18: mol_type = other DNA
taatatgactcattatag

SEQ ID NO: 982 - DNA, 18 bp, synthetic construct
  source 1..18: mol_type = other DNA
tactacgactcactatcg

SEQ ID NO: 983 - DNA, 18 bp, synthetic construct
  source 1..18: mol_type = other DNA
tcttacgactcactatag

SEQ ID NO: 984 - DNA, 18 bp, synthetic construct
  source 1..18: mol_type = other DNA
taatacgactacctatag

SEQ ID NO: 985 - DNA, 18 bp, synthetic construct
  source 1..18: mol_type = other DNA
taatactactctctatag

SEQ ID NO: 986 - DNA, 18 bp, synthetic construct
  source 1..18: mol_type = other DNA
tgataccactcactatag

SEQ ID NO: 987 - DNA, 18 bp, synthetic construct
  source 1..18: mol_type = other DNA
taatacttctcactatag

SEQ ID NO: 988 - DNA, 18 bp, synthetic construct
  source 1..18: mol_type = other DNA
tactacaactcactatag

SEQ ID NO: 989 - DNA, 18 bp, synthetic construct
  source 1..18: mol_type = other DNA
tactacgattcactatag

SEQ ID NO: 990 - DNA, 18 bp, synthetic construct
  source 1..18: mol_type = other DNA
taagaggactcactatag

SEQ ID NO: 991 - DNA, 18 bp, synthetic construct
  source 1..18: mol_type = other DNA
taataagactgactatag

SEQ ID NO: 992 - DNA, 18 bp, synthetic construct
  source 1..18: mol_type = other DNA
taatacgactcacaagag

SEQ ID NO: 993 - DNA, 18 bp, synthetic construct
  source 1..18: mol_type = other DNA
taattcgactaactatag

SEQ ID NO: 994 - DNA, 18 bp, synthetic construct
  source 1..18: mol_type = other DNA
aaatacgacgcactatag

SEQ ID NO: 995 - DNA, 18 bp, synthetic construct
  source 1..18: mol_type = other DNA
taatacgacgcacaatag

SEQ ID NO: 996 - DNA, 18 bp, synthetic construct
  source 1..18: mol_type = other DNA
taagccgactcactatag

SEQ ID NO: 997 - DNA, 18 bp, synthetic construct
  source 1..18: mol_type = other DNA
taatacgacttaccatag

SEQ ID NO: 998 - DNA, 18 bp, synthetic construct
  source 1..18: mol_type = other DNA
taacacgaatcactatag

SEQ ID NO: 999 - DNA, 18 bp, synthetic construct
  source 1..18: mol_type = other DNA
taatacgactgagtatag

SEQ ID NO: 1000 - DNA, 18 bp, synthetic construct
  source 1..18: mol_type = other DNA
tattacgacccactatag

SEQ ID NO: 1001 - DNA, 18 bp, synthetic construct
  source 1..18: mol_type = other DNA
taatactactcactgtag

SEQ ID NO: 1002 - DNA, 18 bp, synthetic construct
  source 1..18: mol_type = other DNA
tagtacgacacactatag

SEQ ID NO: 1003 - DNA, 18 bp, synthetic construct
  source 1..18: mol_type = other DNA
taagacgactcactacag

SEQ ID NO: 1004 - DNA, 18 bp, synthetic construct
  source 1..18: mol_type = other DNA
taatatgactcaatatag

SEQ ID NO: 1005 - DNA, 18 bp, synthetic construct
  source 1..18: mol_type = other DNA
tactccgactcactatag

SEQ ID NO: 1006 - DNA, 18 bp, synthetic construct
  source 1..18: mol_type = other DNA
taatatgactctctatag

SEQ ID NO: 1007 - DNA, 18 bp, synthetic construct
  source 1..18: mol_type = other DNA
tcatacgactaactatag

SEQ ID NO: 1008 - DNA, 18 bp, synthetic construct
  source 1..18: mol_type = other DNA
gaatacgactcactttag

SEQ ID NO: 1009 - DNA, 18 bp, synthetic construct
  source 1..18: mol_type = other DNA
taatacgaccctctatag

SEQ ID NO: 1010 - DNA, 18 bp, synthetic construct
  source 1..18: mol_type = other DNA
tactactactcactatag

SEQ ID NO: 1011 - DNA, 18 bp, synthetic construct
  source 1..18: mol_type = other DNA
taatactacttactatag

SEQ ID NO: 1012 - DNA, 18 bp, synthetic construct
  source 1..18: mol_type = other DNA
taattcgactcattatag

SEQ ID NO: 1013 - DNA, 18 bp, synthetic construct
  source 1..18: mol_type = other DNA
tgagacgactcactatag

SEQ ID NO: 1014 - DNA, 18 bp, synthetic construct
  source 1..18: mol_type = other DNA
tagtacgattcactatag

SEQ ID NO: 1015 - DNA, 18 bp, synthetic construct
  source 1..18: mol_type = other DNA
taatacgacttactgtag

SEQ ID NO: 1016 - DNA, 18 bp, synthetic construct
  source 1..18: mol_type = other DNA
taatacgacttattatag

SEQ ID NO: 1017 - DNA, 18 bp, synthetic construct
  source 1..18: mol_type = other DNA
taacacgactcattatag

SEQ ID NO: 1018 - DNA, 18 bp, synthetic construct
  source 1..18: mol_type = other DNA
tagtacgcctcactatag

SEQ ID NO: 1019 - DNA, 18 bp, synthetic construct
  source 1..18: mol_type = other DNA
taatacgactaaatatag

SEQ ID NO: 1020 - DNA, 18 bp, synthetic construct
  source 1..18: mol_type = other DNA
taatacgactccctttag

SEQ ID NO: 1021 - DNA, 18 bp, synthetic construct
  source 1..18: mol_type = other DNA
taatacgatacactatag

SEQ ID NO: 1022 - DNA, 18 bp, synthetic construct
  source 1..18: mol_type = other DNA
taatacgactctttatag

SEQ ID NO: 1023 - DNA, 18 bp, synthetic construct
  source 1..18: mol_type = other DNA
tcatacgaatcactatag

SEQ ID NO: 1024 - DNA, 18 bp, synthetic construct
  source 1..18: mol_type = other DNA
taatacgactcactgtac

SEQ ID NO: 1025 - DNA, 18 bp, synthetic construct
  source 1..18: mol_type = other DNA
taatacctctcactatag

SEQ ID NO: 1026 - DNA, 18 bp, synthetic construct
  source 1..18: mol_type = other DNA
caatacgactcaatatag

SEQ ID NO: 1027 - DNA, 18 bp, synthetic construct
  source 1..18: mol_type = other DNA
taatacgacttcctatag

SEQ ID NO: 1028 - DNA, 18 bp, synthetic construct
  source 1..18: mol_type = other DNA
taatacgaatctctatag

SEQ ID NO: 1029 - DNA, 18 bp, synthetic construct
  source 1..18: mol_type = other DNA
tattacgactgactatag

SEQ ID NO: 1030 - DNA, 18 bp, synthetic construct
  source 1..18: mol_type = other DNA
taatactactcactagag

SEQ ID NO: 1031 - DNA, 18 bp, synthetic construct
  source 1..18: mol_type = other DNA
caatacgacacactatag

SEQ ID NO: 1032 - DNA, 18 bp, synthetic construct
  source 1..18: mol_type = other DNA
taatacgattccctatag

SEQ ID NO: 1033 - DNA, 18 bp, synthetic construct
  source 1..18: mol_type = other DNA
tactacgactcacaatag

SEQ ID NO: 1034 - DNA, 18 bp, synthetic construct
  source 1..18: mol_type = other DNA
taatattactcactatag

SEQ ID NO: 1035 - DNA, 18 bp, synthetic construct
  source 1..18: mol_type = other DNA
taatactattcactatag

SEQ ID NO: 1036 - DNA, 18 bp, synthetic construct
  source 1..18: mol_type = other DNA
taatccgactcacaatag

SEQ ID NO: 1037 - DNA, 18 bp, synthetic construct
  source 1..18: mol_type = other DNA
taataacactcactatag

SEQ ID NO: 1038 - DNA, 18 bp, synthetic construct
  source 1..18: mol_type = other DNA
taattccactcactatag

SEQ ID NO: 1039 - DNA, 18 bp, synthetic construct
  source 1..18: mol_type = other DNA
tagtactactcactatag

SEQ ID NO: 1040 - DNA, 18 bp, synthetic construct
  source 1..18: mol_type = other DNA
tactacgactaactatag

SEQ ID NO: 1041 - DNA, 18 bp, synthetic construct
  source 1..18: mol_type = other DNA
taatactactcactacag

SEQ ID NO: 1042 - DNA, 18 bp, synthetic construct
  source 1..18: mol_type = other DNA
taatacgccacactatag

SEQ ID NO: 1043 - DNA, 18 bp, synthetic construct
  source 1..18: mol_type = other DNA
caatacgactcactatgg

SEQ ID NO: 1044 - DNA, 18 bp, synthetic construct
  source 1..18: mol_type = other DNA
taataccactcactatcg

SEQ ID NO: 1045 - DNA, 18 bp, synthetic construct
  source 1..18: mol_type = other DNA
aaatacgactaactatag

SEQ ID NO: 1046 - DNA, 18 bp, synthetic construct
  source 1..18: mol_type = other DNA
aaatacgacccactatag

SEQ ID NO: 1047 - DNA, 18 bp, synthetic construct
  source 1..18: mol_type = other DNA
taatatgacacactatag

SEQ ID NO: 1048 - DNA, 18 bp, synthetic construct
  source 1..18: mol_type = other DNA
taatacgactgtctatag

SEQ ID NO: 1049 - DNA, 18 bp, synthetic construct
  source 1..18: mol_type = other DNA
taatacgattcactttag

SEQ ID NO: 1050 - DNA, 18 bp, synthetic construct
  source 1..18: mol_type = other DNA
tattacgattcactatag

SEQ ID NO: 1051 - DNA, 18 bp, synthetic construct
  source 1..18: mol_type = other DNA
taatgcgacccactatag

SEQ ID NO: 1052 - DNA, 18 bp, synthetic construct
  source 1..18: mol_type = other DNA
tactacgactgactatag

SEQ ID NO: 1053 - DNA, 18 bp, synthetic construct
  source 1..18: mol_type = other DNA
tgatacgacccactatag

SEQ ID NO: 1054 - DNA, 18 bp, synthetic construct
  source 1..18: mol_type = other DNA
caatacgacgcactatag

SEQ ID NO: 1055 - DNA, 18 bp, synthetic construct
  source 1..18: mol_type = other DNA
tattactactcactatag

SEQ ID NO: 1056 - DNA, 18 bp, synthetic construct
  source 1..18: mol_type = other DNA
taatacaacacactatag

SEQ ID NO: 1057 - DNA, 18 bp, synthetic construct
  source 1..18: mol_type = other DNA
tcctacgactcactatag

SEQ ID NO: 1058 - DNA, 18 bp, synthetic construct
  source 1..18: mol_type = other DNA
taatactactcagtatag

SEQ ID NO: 1059 - DNA, 18 bp, synthetic construct
  source 1..18: mol_type = other DNA
taataccactctctatag

SEQ ID NO: 1060 - DNA, 18 bp, synthetic construct
  source 1..18: mol_type = other DNA
caatacgacttactatag

SEQ ID NO: 1061 - DNA, 18 bp, synthetic construct
  source 1..18: mol_type = other DNA
ttataccactcactatag

SEQ ID NO: 1062 - DNA, 18 bp, synthetic construct
  source 1..18: mol_type = other DNA
taatacgattcactctag

SEQ ID NO: 1063 - DNA, 18 bp, synthetic construct
  source 1..18: mol_type = other DNA
taatactactcactttag

SEQ ID NO: 1064 - DNA, 18 bp, synthetic construct
  source 1..18: mol_type = other DNA
taataccactcactattg

SEQ ID NO: 1065 - DNA, 18 bp, synthetic construct
  source 1..18: mol_type = other DNA
taatacgacacagtatag

SEQ ID NO: 1066 - DNA, 18 bp, synthetic construct
  source 1..18: mol_type = other DNA
taatacgagtcacaatag

SEQ ID NO: 1067 - DNA, 18 bp, synthetic construct
  source 1..18: mol_type = other DNA
taatacgacgcacgatag

SEQ ID NO: 1068 - DNA, 18 bp, synthetic construct
  source 1..18: mol_type = other DNA
taatactagtcactatag

SEQ ID NO: 1069 - DNA, 18 bp, synthetic construct
  source 1..18: mol_type = other DNA
taatacgactccccatag

SEQ ID NO: 1070 - DNA, 18 bp, synthetic construct
  source 1..18: mol_type = other DNA
taatacgactcattatgg

SEQ ID NO: 1071 - DNA, 18 bp, synthetic construct
  source 1..18: mol_type = other DNA
taatacgtcacactatag

SEQ ID NO: 1072 - DNA, 18 bp, synthetic construct
  source 1..18: mol_type = other DNA
taatacgactcaaaatag

SEQ ID NO: 1073 - DNA, 18 bp, synthetic construct
  source 1..18: mol_type = other DNA
tcatacgactctctatag

SEQ ID NO: 1074 - DNA, 18 bp, synthetic construct
  source 1..18: mol_type = other DNA
taataccactcacaatag

SEQ ID NO: 1075 - DNA, 18 bp, synthetic construct
  source 1..18: mol_type = other DNA
tgacacgactcactatag

SEQ ID NO: 1076 - DNA, 18 bp, synthetic construct
  source 1..18: mol_type = other DNA
tattacgacttactatag

SEQ ID NO: 1077 - DNA, 18 bp, synthetic construct
  source 1..18: mol_type = other DNA
taatactactccctatag

SEQ ID NO: 1078 - DNA, 18 bp, synthetic construct
  source 1..18: mol_type = other DNA
taatacgaatgactatag

SEQ ID NO: 1079 - DNA, 18 bp, synthetic construct
  source 1..18: mol_type = other DNA
taagacgactcattatag

SEQ ID NO: 1080 - DNA, 18 bp, synthetic construct
  source 1..18: mol_type = other DNA
taatacgattctctatag

SEQ ID NO: 1081 - DNA, 18 bp, synthetic construct
  source 1..18: mol_type = other DNA
aactacgactcactatag

SEQ ID NO: 1082 - DNA, 18 bp, synthetic construct
  source 1..18: mol_type = other DNA
taataggactaactatag

SEQ ID NO: 1083 - DNA, 18 bp, synthetic construct
  source 1..18: mol_type = other DNA
taatacgactccctagag

SEQ ID NO: 1084 - DNA, 18 bp, synthetic construct
  source 1..18: mol_type = other DNA
taatacgacccactttag

SEQ ID NO: 1085 - DNA, 18 bp, synthetic construct
  source 1..18: mol_type = other DNA
taatacgattgactatag

SEQ ID NO: 1086 - DNA, 18 bp, synthetic construct
  source 1..18: mol_type = other DNA
tagtaagactcactatag

SEQ ID NO: 1087 - DNA, 18 bp, synthetic construct
  source 1..18: mol_type = other DNA
taatatgactcgctatag

SEQ ID NO: 1088 - DNA, 18 bp, synthetic construct
  source 1..18: mol_type = other DNA
tcatacgactcacgatag

SEQ ID NO: 1089 - DNA, 18 bp, synthetic construct
  source 1..18: mol_type = other DNA
taatacgactgcctatag

SEQ ID NO: 1090 - DNA, 18 bp, synthetic construct
  source 1..18: mol_type = other DNA
taattctactcactatag

SEQ ID NO: 1091 - DNA, 18 bp, synthetic construct
  source 1..18: mol_type = other DNA
caatacgactcacaatag

SEQ ID NO: 1092 - DNA, 18 bp, synthetic construct
  source 1..18: mol_type = other DNA
taatacgacgtactatag

SEQ ID NO: 1093 - DNA, 18 bp, synthetic construct
  source 1..18: mol_type = other DNA
taatacgacacactaaag

SEQ ID NO: 1094 - DNA, 18 bp, synthetic construct
  source 1..18: mol_type = other DNA
taatacgattcgctatag

SEQ ID NO: 1095 - DNA, 18 bp, synthetic construct
  source 1..18: mol_type = other DNA
tattacgactccctatag

SEQ ID NO: 1096 - DNA, 18 bp, synthetic construct
  source 1..18: mol_type = other DNA
taatacgaatcaatatag

SEQ ID NO: 1097 - DNA, 18 bp, synthetic construct
  source 1..18: mol_type = other DNA
taataatactcactatag

SEQ ID NO: 1098 - DNA, 18 bp, synthetic construct
  source 1..18: mol_type = other DNA
taatacggcccactatag

SEQ ID NO: 1099 - DNA, 18 bp, synthetic construct
  source 1..18: mol_type = other DNA
taaaacgactaactatag

SEQ ID NO: 1100 - DNA, 18 bp, synthetic construct
  source 1..18: mol_type = other DNA
taatacggctcactatgg

SEQ ID NO: 1101 - DNA, 18 bp, synthetic construct
  source 1..18: mol_type = other DNA
gaatactactcactatag

SEQ ID NO: 1102 - DNA, 18 bp, synthetic construct
  source 1..18: mol_type = other DNA
tattacgactaactatag

SEQ ID NO: 1103 - DNA, 18 bp, synthetic construct
  source 1..18: mol_type = other DNA
tgatacgacttactatag

SEQ ID NO: 1104 - DNA, 18 bp, synthetic construct
  source 1..18: mol_type = other DNA
taatacgaagcactatag

SEQ ID NO: 1105 - DNA, 18 bp, synthetic construct
  source 1..18: mol_type = other DNA
taatacaattcactatag

SEQ ID NO: 1106 - DNA, 18 bp, synthetic construct
  source 1..18: mol_type = other DNA
tattacgactcattatag

SEQ ID NO: 1107 - DNA, 18 bp, synthetic construct
  source 1..18: mol_type = other DNA
tgatacgattcactatag

SEQ ID NO: 1108 - DNA, 18 bp, synthetic construct
  source 1..18: mol_type = other DNA
tactacgaatcactatag

SEQ ID NO: 1109 - DNA, 18 bp, synthetic construct
  source 1..18: mol_type = other DNA
taatagggctcactatag

SEQ ID NO: 1110 - DNA, 18 bp, synthetic construct
  source 1..18: mol_type = other DNA
tactacgactcactagag

SEQ ID NO: 1111 - DNA, 18 bp, synthetic construct
  source 1..18: mol_type = other DNA
taatacgatttactatag

SEQ ID NO: 1112 - DNA, 18 bp, synthetic construct
  source 1..18: mol_type = other DNA
taatacgaaacactatag

SEQ ID NO: 1113 - DNA, 18 bp, synthetic construct
  source 1..18: mol_type = other DNA
caatacgaatcactatag

SEQ ID NO: 1114 - DNA, 18 bp, synthetic construct
  source 1..18: mol_type = other DNA
taatacgattcattatag

SEQ ID NO: 1115 - DNA, 18 bp, synthetic construct
  source 1..18: mol_type = other DNA
taatacgactccctaaag

SEQ ID NO: 1116 - DNA, 18 bp, synthetic construct
  source 1..18: mol_type = other DNA
ttatactactcactatag

SEQ ID NO: 1117 - DNA, 18 bp, synthetic construct
  source 1..18: mol_type = other DNA
taaaacggctcactatag

SEQ ID NO: 1118 - DNA, 18 bp, synthetic construct
  source 1..18: mol_type = other DNA
taaaaccactcactatag

SEQ ID NO: 1119 - DNA, 18 bp, synthetic construct
  source 1..18: mol_type = other DNA
taatccgactctctatag

SEQ ID NO: 1120 - DNA, 18 bp, synthetic construct
  source 1..18: mol_type = other DNA
taatacgacttactatgg

SEQ ID NO: 1121 - DNA, 18 bp, synthetic construct
  source 1..18: mol_type = other DNA
taatacgacccactctag

SEQ ID NO: 1122 - DNA, 18 bp, synthetic construct
  source 1..18: mol_type = other DNA
taatacgtctcacgatag

SEQ ID NO: 1123 - DNA, 18 bp, synthetic construct
  source 1..18: mol_type = other DNA
taaaacgacttactatag

SEQ ID NO: 1124 - DNA, 18 bp, synthetic construct
  source 1..18: mol_type = other DNA
ttatacgacacactatag

SEQ ID NO: 1125 - DNA, 18 bp, synthetic construct
  source 1..18: mol_type = other DNA
tactacgactctctatag

SEQ ID NO: 1126 - DNA, 18 bp, synthetic construct
  source 1..18: mol_type = other DNA
tgataggactcactatag

SEQ ID NO: 1127 - DNA, 18 bp, synthetic construct
  source 1..18: mol_type = other DNA
caatacggctcactatag

SEQ ID NO: 1128 - DNA, 18 bp, synthetic construct
  source 1..18: mol_type = other DNA
taatacgactcattattg

SEQ ID NO: 1129 - DNA, 18 bp, synthetic construct
  source 1..18: mol_type = other DNA
taataccactcactttag

SEQ ID NO: 1130 - DNA, 18 bp, synthetic construct
  source 1..18: mol_type = other DNA
taaaacgacacactatag

SEQ ID NO: 1131 - DNA, 18 bp, synthetic construct
  source 1..18: mol_type = other DNA
taatactactcacgatag

SEQ ID NO: 1132 - DNA, 18 bp, synthetic construct
  source 1..18: mol_type = other DNA
taatacaagtcactatag

SEQ ID NO: 1133 - DNA, 18 bp, synthetic construct
  source 1..18: mol_type = other DNA
aaatactactcactatag

SEQ ID NO: 1134 - DNA, 18 bp, synthetic construct
  source 1..18: mol_type = other DNA
taagacgactcaccatag

SEQ ID NO: 1135 - DNA, 18 bp, synthetic construct
  source 1..18: mol_type = other DNA
taatacgactaacaatag

SEQ ID NO: 1136 - DNA, 18 bp, synthetic construct
  source 1..18: mol_type = other DNA
tactacgactcgctatag

SEQ ID NO: 1137 - DNA, 18 bp, synthetic construct
  source 1..18: mol_type = other DNA
tagtacgacccactatag

SEQ ID NO: 1138 - DNA, 18 bp, synthetic construct
  source 1..18: mol_type = other DNA
ttatacgacccactatag

SEQ ID NO: 1139 - DNA, 18 bp, synthetic construct
  source 1..18: mol_type = other DNA
tcatacggctcactatag

SEQ ID NO: 1140 - DNA, 18 bp, synthetic construct
  source 1..18: mol_type = other DNA
taatacggctctctatag

SEQ ID NO: 1141 - DNA, 18 bp, synthetic construct
  source 1..18: mol_type = other DNA
taataagactaactatag

SEQ ID NO: 1142 - DNA, 18 bp, synthetic construct
  source 1..18: mol_type = other DNA
taacacgacacactatag

SEQ ID NO: 1143 - DNA, 18 bp, synthetic construct
  source 1..18: mol_type = other DNA
taatacgactgactatgg

SEQ ID NO: 1144 - DNA, 18 bp, synthetic construct
  source 1..18: mol_type = other DNA
taatacgactgactaaag

SEQ ID NO: 1145 - DNA, 18 bp, synthetic construct
  source 1..18: mol_type = other DNA
taatatgactccctatag

SEQ ID NO: 1146 - DNA, 18 bp, synthetic construct
  source 1..18: mol_type = other DNA
taatacgacacacaatag

SEQ ID NO: 1147 - DNA, 18 bp, synthetic construct
  source 1..18: mol_type = other DNA
aaatacggctcactatag

SEQ ID NO: 1148 - DNA, 18 bp, synthetic construct
  source 1..18: mol_type = other DNA
taataagagtcactatag

SEQ ID NO: 1149 - DNA, 18 bp, synthetic construct
  source 1..18: mol_type = other DNA
taatactactaactatag

SEQ ID NO: 1150 - DNA, 18 bp, synthetic construct
  source 1..18: mol_type = other DNA
aaatacgattcactatag

SEQ ID NO: 1151 - DNA, 18 bp, synthetic construct
  source 1..18: mol_type = other DNA
tagtacgactaactatag

SEQ ID NO: 1152 - DNA, 18 bp, synthetic construct
  source 1..18: mol_type = other DNA
acatacgactcactatag

SEQ ID NO: 1153 - DNA, 18 bp, synthetic construct
  source 1..18: mol_type = other DNA
tgatacgactctctatag

SEQ ID NO: 1154 - DNA, 18 bp, synthetic construct
  source 1..18: mol_type = other DNA
taatacgactaattatag

SEQ ID NO: 1155 - DNA, 18 bp, synthetic construct
  source 1..18: mol_type = other DNA
tactacgacttactatag

SEQ ID NO: 1156 - DNA, 18 bp, synthetic construct
  source 1..18: mol_type = other DNA
taagacgactcacaatag

SEQ ID NO: 1157 - DNA, 18 bp, synthetic construct
  source 1..18: mol_type = other DNA
gaatacgactaactatag

SEQ ID NO: 1158 - DNA, 18 bp, synthetic construct
  source 1..18: mol_type = other DNA
caatacgactcattatag

SEQ ID NO: 1159 - DNA, 18 bp, synthetic construct
  source 1..18: mol_type = other DNA
ttatacgactcattatag

SEQ ID NO: 1160 - DNA, 18 bp, synthetic construct
  source 1..18: mol_type = other DNA
taatacgacttacaatag

SEQ ID NO: 1161 - DNA, 18 bp, synthetic construct
  source 1..18: mol_type = other DNA
taataccactcaccatag

SEQ ID NO: 1162 - DNA, 18 bp, synthetic construct
  source 1..18: mol_type = other DNA
taatacgacacaatatag

SEQ ID NO: 1163 - DNA, 18 bp, synthetic construct
  source 1..18: mol_type = other DNA
tgatactactcactatag

SEQ ID NO: 1164 - DNA, 18 bp, synthetic construct
  source 1..18: mol_type = other DNA
taatacgatgcactatag

SEQ ID NO: 1165 - DNA, 18 bp, synthetic construct
  source 1..18: mol_type = other DNA
taatacgactcagcatag

SEQ ID NO: 1166 - DNA, 18 bp, synthetic construct
  source 1..18: mol_type = other DNA
taatacgacccaccatag

SEQ ID NO: 1167 - DNA, 18 bp, synthetic construct
  source 1..18: mol_type = other DNA
taataggacttactatag

SEQ ID NO: 1168 - DNA, 18 bp, synthetic construct
  source 1..18: mol_type = other DNA
taacacgacttactatag

SEQ ID NO: 1169 - DNA, 18 bp, synthetic construct
  source 1..18: mol_type = other DNA
taatacgagtcactattg

SEQ ID NO: 1170 - DNA, 18 bp, synthetic construct
  source 1..18: mol_type = other DNA
taacacgactcaccatag

SEQ ID NO: 1171 - DNA, 18 bp, synthetic construct
  source 1..18: mol_type = other DNA
taatacggctcactgtag

SEQ ID NO: 1172 - DNA, 18 bp, synthetic construct
  source 1..18: mol_type = other DNA
taattcgattcactatag

SEQ ID NO: 1173 - DNA, 18 bp, synthetic construct
  source 1..18: mol_type = other DNA
taatatgactcacaatag

SEQ ID NO: 1174 - DNA, 18 bp, synthetic construct
  source 1..18: mol_type = other DNA
taatacgactaactaaag

SEQ ID NO: 1175 - DNA, 18 bp, synthetic construct
  source 1..18: mol_type = other DNA
tcatacgactcaatatag

SEQ ID NO: 1176 - DNA, 18 bp, synthetic construct
  source 1..18: mol_type = other DNA
taataccagtcactatag

SEQ ID NO: 1177 - DNA, 18 bp, synthetic construct
  source 1..18: mol_type = other DNA
taacatgactcactatag

SEQ ID NO: 1178 - DNA, 18 bp, synthetic construct
  source 1..18: mol_type = other DNA
taagactactcactatag

SEQ ID NO: 1179 - DNA, 18 bp, synthetic construct
  source 1..18: mol_type = other DNA
taatactactcaatatag

SEQ ID NO: 1180 - DNA, 18 bp, synthetic construct
  source 1..18: mol_type = other DNA
taatactactcacaatag

SEQ ID NO: 1181 - DNA, 18 bp, synthetic construct
  source 1..18: mol_type = other DNA
taatatgattcactatag

SEQ ID NO: 1182 - DNA, 18 bp, synthetic construct
  source 1..18: mol_type = other DNA
tcatacgactcagtatag

SEQ ID NO: 1183 - DNA, 18 bp, synthetic construct
  source 1..18: mol_type = other DNA
tagtacgactcacaatag

SEQ ID NO: 1184 - DNA, 18 bp, synthetic construct
  source 1..18: mol_type = other DNA
taatacgacatactatag

SEQ ID NO: 1185 - DNA, 18 bp, synthetic construct
  source 1..18: mol_type = other DNA
taataggacacactatag

SEQ ID NO: 1186 - DNA, 18 bp, synthetic construct
  source 1..18: mol_type = other DNA
taatacgccttactatag

SEQ ID NO: 1187 - DNA, 18 bp, synthetic construct
  source 1..18: mol_type = other DNA
tcacacgactcactatag

SEQ ID NO: 1188 - DNA, 18 bp, synthetic construct
  source 1..18: mol_type = other DNA
taacacggctcactatag

SEQ ID NO: 1189 - DNA, 18 bp, synthetic construct
  source 1..18: mol_type = other DNA
tcatacgacgcactatag

SEQ ID NO: 1190 - DNA, 18 bp, synthetic construct
  source 1..18: mol_type = other DNA
taatactactcattatag

SEQ ID NO: 1191 - DNA, 18 bp, synthetic construct
  source 1..18: mol_type = other DNA
tgatacgagtcactatag

SEQ ID NO: 1192 - DNA, 18 bp, synthetic construct
  source 1..18: mol_type = other DNA
taatacgactgattatag

SEQ ID NO: 1193 - DNA, 18 bp, synthetic construct
  source 1..18: mol_type = other DNA
taatacgacccattatag

SEQ ID NO: 1194 - DNA, 18 bp, synthetic construct
  source 1..18: mol_type = other DNA
tcattcgactcactatag

SEQ ID NO: 1195 - DNA, 18 bp, synthetic construct
  source 1..18: mol_type = other DNA
taatacgaaccactatag

SEQ ID NO: 1196 - DNA, 18 bp, synthetic construct
  source 1..18: mol_type = other DNA
taataccactcaatatag

SEQ ID NO: 1197 - DNA, 18 bp, synthetic construct
  source 1..18: mol_type = other DNA
taatccgacgcactatag

SEQ ID NO: 1198 - DNA, 18 bp, synthetic construct
  source 1..18: mol_type = other DNA
taatgcgacacactatag

SEQ ID NO: 1199 - DNA, 18 bp, synthetic construct
  source 1..18: mol_type = other DNA
taacacgactccctatag

SEQ ID NO: 1200 - DNA, 18 bp, synthetic construct
  source 1..18: mol_type = other DNA
taatacgattcactacag

SEQ ID NO: 1201 - DNA, 18 bp, synthetic construct
  source 1..18: mol_type = other DNA
tcataccactcactatag

SEQ ID NO: 1202 - DNA, 18 bp, synthetic construct
  source 1..18: mol_type = other DNA
taatacgacaccctatag

SEQ ID NO: 1203 - DNA, 18 bp, synthetic construct
  source 1..18: mol_type = other DNA
taacacgactcaatatag

SEQ ID NO: 1204 - DNA, 18 bp, synthetic construct
  source 1..18: mol_type = other DNA
taatccgactaactatag

SEQ ID NO: 1205 - DNA, 18 bp, synthetic construct
  source 1..18: mol_type = other DNA
taatacgacctactatag

SEQ ID NO: 1206 - DNA, 18 bp, synthetic construct
  source 1..18: mol_type = other DNA
taatacgacttgctatag

SEQ ID NO: 1207 - DNA, 18 bp, synthetic construct
  source 1..18: mol_type = other DNA
caatacgacccactatag

SEQ ID NO: 1208 - DNA, 18 bp, synthetic construct
  source 1..18: mol_type = other DNA
taatacgacccacaatag

SEQ ID NO: 1209 - DNA, 18 bp, synthetic construct
  source 1..18: mol_type = other DNA
taatccgactcattatag

SEQ ID NO: 1210 - DNA, 18 bp, synthetic construct
  source 1..18: mol_type = other DNA
taagacgactctctatag

SEQ ID NO: 1211 - DNA, 18 bp, synthetic construct
  source 1..18: mol_type = other DNA
taagacgattcactatag

SEQ ID NO: 1212 - DNA, 18 bp, synthetic construct
  source 1..18: mol_type = other DNA
taatccgactccctatag

SEQ ID NO: 1213 - DNA, 18 bp, synthetic construct
  source 1..18: mol_type = other DNA
taataccactcagtatag

SEQ ID NO: 1214 - DNA, 18 bp, synthetic construct
  source 1..18: mol_type = other DNA
taataagacccactatag

SEQ ID NO: 1215 - DNA, 18 bp, synthetic construct
  source 1..18: mol_type = other DNA
taatacgaattactatag

SEQ ID NO: 1216 - DNA, 18 bp, synthetic construct
  source 1..18: mol_type = other DNA
gaatacgacccactatag

SEQ ID NO: 1217 - DNA, 18 bp, synthetic construct
  source 1..18: mol_type = other DNA
taatacaacttactatag

SEQ ID NO: 1218 - DNA, 18 bp, synthetic construct
  source 1..18: mol_type = other DNA
taatacgactccgtatag

SEQ ID NO: 1219 - DNA, 18 bp, synthetic construct
  source 1..18: mol_type = other DNA
taataagacgcactatag

SEQ ID NO: 1220 - DNA, 18 bp, synthetic construct
  source 1..18: mol_type = other DNA
taataccaatcactatag

SEQ ID NO: 1221 - DNA, 18 bp, synthetic construct
  source 1..18: mol_type = other DNA
taacacgactaactatag

SEQ ID NO: 1222 - DNA, 18 bp, synthetic construct
  source 1..18: mol_type = other DNA
taatccgacacactatag

SEQ ID NO: 1223 - DNA, 18 bp, synthetic construct
  source 1..18: mol_type = other DNA
taccacgactcactatag

SEQ ID NO: 1224 - DNA, 18 bp, synthetic construct
  source 1..18: mol_type = other DNA
aaatacgacttactatag

SEQ ID NO: 1225 - DNA, 18 bp, synthetic construct
  source 1..18: mol_type = other DNA
taatactactcactatgg

SEQ ID NO: 1226 - DNA, 18 bp, synthetic construct
  source 1..18: mol_type = other DNA
taataccactaactatag

SEQ ID NO: 1227 - DNA, 18 bp, synthetic construct
  source 1..18: mol_type = other DNA
gaataccactcactatag

SEQ ID NO: 1228 - DNA, 18 bp, synthetic construct
  source 1..18: mol_type = other DNA
taatacgagtcactagag

SEQ ID NO: 1229 - DNA, 18 bp, synthetic construct
  source 1..18: mol_type = other DNA
tcatatgactcactatag

SEQ ID NO: 1230 - DNA, 18 bp, synthetic construct
  source 1..18: mol_type = other DNA
taacactactcactatag

SEQ ID NO: 1231 - DNA, 18 bp, synthetic construct
  source 1..18: mol_type = other DNA
tggtacgactcactatag

SEQ ID NO: 1232 - DNA, 18 bp, synthetic construct
  source 1..18: mol_type = other DNA
gaatacgacacactatag

SEQ ID NO: 1233 - DNA, 18 bp, synthetic construct
  source 1..18: mol_type = other DNA
taatacgactcactatcc

SEQ ID NO: 1234 - DNA, 18 bp, synthetic construct
  source 1..18: mol_type = other DNA
caatacgactaactatag

SEQ ID NO: 1235 - DNA, 18 bp, synthetic construct
  source 1..18: mol_type = other DNA
tagtacgactccctatag

SEQ ID NO: 1236 - DNA, 18 bp, synthetic construct
  source 1..18: mol_type = other DNA
taatacggctcaatatag

SEQ ID NO: 1237 - DNA, 18 bp, synthetic construct
  source 1..18: mol_type = other DNA
taatacgacttaatatag

SEQ ID NO: 1238 - DNA, 18 bp, synthetic construct
  source 1..18: mol_type = other DNA
taatacgacacactatgg

SEQ ID NO: 1239 - DNA, 18 bp, synthetic construct
  source 1..18: mol_type = other DNA
taacacgactgactatag

SEQ ID NO: 1240 - DNA, 18 bp, synthetic construct
  source 1..18: mol_type = other DNA
taataagacacactatag

SEQ ID NO: 1241 - DNA, 18 bp, synthetic construct
  source 1..18: mol_type = other DNA
taatacggctcacaatag

SEQ ID NO: 1242 - DNA, 18 bp, synthetic construct
  source 1..18: mol_type = other DNA
tacgacgactcactatag

SEQ ID NO: 1243 - DNA, 18 bp, synthetic construct
  source 1..18: mol_type = other DNA
taatacaactcattatag

SEQ ID NO: 1244 - DNA, 18 bp, synthetic construct
  source 1..18: mol_type = other DNA
taatacacctcactatag

SEQ ID NO: 1245 - DNA, 18 bp, synthetic construct
  source 1..18: mol_type = other DNA
taatacaacccactatag

SEQ ID NO: 1246 - DNA, 18 bp, synthetic construct
  source 1..18: mol_type = other DNA
taatacaactgactatag

SEQ ID NO: 1247 - DNA, 18 bp, synthetic construct
  source 1..18: mol_type = other DNA
taatacgactcactatta

SEQ ID NO: 1248 - DNA, 18 bp, synthetic construct
  source 1..18: mol_type = other DNA
taatatgactgactatag

SEQ ID NO: 1249 - DNA, 18 bp, synthetic construct
  source 1..18: mol_type = other DNA
taatacgtctgactatag

SEQ ID NO: 1250 - DNA, 18 bp, synthetic construct
  source 1..18: mol_type = other DNA
aaatacgagtcactatag

SEQ ID NO: 1251 - DNA, 18 bp, synthetic construct
  source 1..18: mol_type = other DNA
taatacgattcactatgg

SEQ ID NO: 1252 - DNA, 18 bp, synthetic construct
  source 1..18: mol_type = other DNA
taacacgactcagtatag

SEQ ID NO: 1253 - DNA, 18 bp, synthetic construct
  source 1..18: mol_type = other DNA
taatacgactgactctag

SEQ ID NO: 1254 - DNA, 18 bp, synthetic construct
  source 1..18: mol_type = other DNA
tgatacgacacactatag

SEQ ID NO: 1255 - DNA, 18 bp, synthetic construct
  source 1..18: mol_type = other DNA
gaatacgactcactacag

SEQ ID NO: 1256 - DNA, 18 bp, synthetic construct
  source 1..18: mol_type = other DNA
taagacgactcagtatag

SEQ ID NO: 1257 - DNA, 18 bp, synthetic construct
  source 1..18: mol_type = other DNA
taagacgacttactatag

SEQ ID NO: 1258 - DNA, 18 bp, synthetic construct
  source 1..18: mol_type = other DNA
tcatacgactcattatag

SEQ ID NO: 1259 - DNA, 18 bp, synthetic construct
  source 1..18: mol_type = other DNA
taagacgacgcactatag

SEQ ID NO: 1260 - DNA, 18 bp, synthetic construct
  source 1..18: mol_type = other DNA
taatacgaatcattatag

SEQ ID NO: 1261 - DNA, 18 bp, synthetic construct
  source 1..18: mol_type = other DNA
tactacgactcactatgg

SEQ ID NO: 1262 - DNA, 18 bp, synthetic construct
  source 1..18: mol_type = other DNA
taatacggctcactagag

SEQ ID NO: 1263 - DNA, 18 bp, synthetic construct
  source 1..18: mol_type = other DNA
tactacggctcactatag

SEQ ID NO: 1264 - DNA, 18 bp, synthetic construct
  source 1..18: mol_type = other DNA
taatacgagtcactacag

SEQ ID NO: 1265 - DNA, 18 bp, synthetic construct
  source 1..18: mol_type = other DNA
tactatgactcactatag

SEQ ID NO: 1266 - DNA, 18 bp, synthetic construct
  source 1..18: mol_type = other DNA
taatacgactcgttatag

SEQ ID NO: 1267 - DNA, 18 bp, synthetic construct
  source 1..18: mol_type = other DNA
ttatacgacttactatag

SEQ ID NO: 1268 - DNA, 18 bp, synthetic construct
  source 1..18: mol_type = other DNA
taagacgacccactatag

SEQ ID NO: 1269 - DNA, 18 bp, synthetic construct
  source 1..18: mol_type = other DNA
taagacgactgactatag

SEQ ID NO: 1270 - DNA, 18 bp, synthetic construct
  source 1..18: mol_type = other DNA
taataccattcactatag

SEQ ID NO: 1271 - DNA, 18 bp, synthetic construct
  source 1..18: mol_type = other DNA
caatacgactgactatag

SEQ ID NO: 1272 - DNA, 18 bp, synthetic construct
  source 1..18: mol_type = other DNA
gaatacgactcaatatag

SEQ ID NO: 1273 - DNA, 18 bp, synthetic construct
  source 1..18: mol_type = other DNA
taacacgacccactatag

SEQ ID NO: 1274 - DNA, 18 bp, synthetic construct
  source 1..18: mol_type = other DNA
tactacgactcaatatag

SEQ ID NO: 1275 - DNA, 18 bp, synthetic construct
  source 1..18: mol_type = other DNA
tactacgacccactatag

SEQ ID NO: 1276 - DNA, 18 bp, synthetic construct
  source 1..18: mol_type = other DNA
taagaagactcactatag

SEQ ID NO: 1277 - DNA, 18 bp, synthetic construct
  source 1..18: mol_type = other DNA
tagtacgactcacgatag

SEQ ID NO: 1278 - DNA, 18 bp, synthetic construct
  source 1..18: mol_type = other DNA
tgatacgactcattatag

SEQ ID NO: 1279 - DNA, 18 bp, synthetic construct
  source 1..18: mol_type = other DNA
taatcccactcactatag

SEQ ID NO: 1280 - DNA, 18 bp, synthetic construct
  source 1..18: mol_type = other DNA
taatacggcttactatag

SEQ ID NO: 1281 - DNA, 18 bp, synthetic construct
  source 1..18: mol_type = other DNA
taataggactcattatag

SEQ ID NO: 1282 - DNA, 18 bp, synthetic construct
  source 1..18: mol_type = other DNA
tcatacgagtcactatag

SEQ ID NO: 1283 - DNA, 18 bp, synthetic construct
  source 1..18: mol_type = other DNA
taagacgactcactattg

SEQ ID NO: 1284 - DNA, 18 bp, synthetic construct
  source 1..18: mol_type = other DNA
taacacgactcactagag

SEQ ID NO: 1285 - DNA, 18 bp, synthetic construct
  source 1..18: mol_type = other DNA
taataccacgcactatag

SEQ ID NO: 1286 - DNA, 18 bp, synthetic construct
  source 1..18: mol_type = other DNA
taatacgacgcaatatag

SEQ ID NO: 1287 - DNA, 18 bp, synthetic construct
  source 1..18: mol_type = other DNA
taatacgactccatatag

SEQ ID NO: 1288 - DNA, 18 bp, synthetic construct
  source 1..18: mol_type = other DNA
gaatacgaatcactatag

SEQ ID NO: 1289 - DNA, 18 bp, synthetic construct
  source 1..18: mol_type = other DNA
taagatgactcactatag

SEQ ID NO: 1290 - DNA, 18 bp, synthetic construct
  source 1..18: mol_type = other DNA
tagtacgactcaatatag

SEQ ID NO: 1291 - DNA, 18 bp, synthetic construct
  source 1..18: mol_type = other DNA
taataccactgactatag

SEQ ID NO: 1292 - DNA, 18 bp, synthetic construct
  source 1..18: mol_type = other DNA
taatacgagtccctatag

SEQ ID NO: 1293 - DNA, 18 bp, synthetic construct
  source 1..18: mol_type = other DNA
taatacgactgactacag

SEQ ID NO: 1294 - DNA, 18 bp, synthetic construct
  source 1..18: mol_type = other DNA
taatacgattcacgatag

SEQ ID NO: 1295 - DNA, 18 bp, synthetic construct
  source 1..18: mol_type = other DNA
tactacgagtcactatag

SEQ ID NO: 1296 - DNA, 18 bp, synthetic construct
  source 1..18: mol_type = other DNA
taatatggctcactatag

SEQ ID NO: 1297 - DNA, 18 bp, synthetic construct
  source 1..18: mol_type = other DNA
taatacgagccactacag

SEQ ID NO: 1298 - DNA, 18 bp, synthetic construct
  source 1..18: mol_type = other DNA
taatgcgactcgctatcg

SEQ ID NO: 1299 - DNA, 18 bp, synthetic construct
  source 1..18: mol_type = other DNA
ttatacgactcactatca

SEQ ID NO: 1300 - DNA, 18 bp, synthetic construct
  source 1..18: mol_type = other DNA
taatacgactcgctatct

SEQ ID NO: 1301 - DNA, 18 bp, synthetic construct
  source 1..18: mol_type = other DNA
taattcgactcgctattg

SEQ ID NO: 1302 - DNA, 18 bp, synthetic construct
  source 1..18: mol_type = other DNA
taattcgactcactatct

SEQ ID NO: 1303 - DNA, 18 bp, synthetic construct
  source 1..18: mol_type = other DNA
taattcgactcgctatcg

SEQ ID NO: 1304 - DNA, 18 bp, synthetic construct
  source 1..18: mol_type = other DNA
taataggactcgctagag

SEQ ID NO: 1305 - DNA, 18 bp, synthetic construct
  source 1..18: mol_type = other DNA
taatacgactcgctactg

SEQ ID NO: 1306 - DNA, 18 bp, synthetic construct
  source 1..18: mol_type = other DNA
gaatgcgactcactgtag

SEQ ID NO: 1307 - DNA, 18 bp, synthetic construct
  source 1..18: mol_type = other DNA
ttatacgactcgctatcg

SEQ ID NO: 1308 - DNA, 18 bp, synthetic construct
  source 1..18: mol_type = other DNA
caaaacgactcactatat

SEQ ID NO: 1309 - DNA, 18 bp, synthetic construct
  source 1..18: mol_type = other DNA
taatacgactcgctatcc

SEQ ID NO: 1310 - DNA, 18 bp, synthetic construct
  source 1..18: mol_type = other DNA
taattcgactcgctacag

SEQ ID NO: 1311 - DNA, 18 bp, synthetic construct
  source 1..18: mol_type = other DNA
taattcgactcactactg

SEQ ID NO: 1312 - DNA, 18 bp, synthetic construct
  source 1..18: mol_type = other DNA
taattcgactcgctaaag

SEQ ID NO: 1313 - DNA, 18 bp, synthetic construct
  source 1..18: mol_type = other DNA
taatccgactcgctatcg

SEQ ID NO: 1314 - DNA, 18 bp, synthetic construct
  source 1..18: mol_type = other DNA
ttatacgactcgctattg

SEQ ID NO: 1315 - DNA, 18 bp, synthetic construct
  source 1..18: mol_type = other DNA
tagtacgcttcactatag

SEQ ID NO: 1316 - DNA, 18 bp, synthetic construct
  source 1..18: mol_type = other DNA
taaaacgactcgctatat

SEQ ID NO: 1317 - DNA, 18 bp, synthetic construct
  source 1..18: mol_type = other DNA
caatacggcgcactatag

SEQ ID NO: 1318 - DNA, 18 bp, synthetic construct
  source 1..18: mol_type = other DNA
taatgcgcctcactgtag

SEQ ID NO: 1319 - DNA, 18 bp, synthetic construct
  source 1..18: mol_type = other DNA
taattcgacgcactattg

SEQ ID NO: 1320 - DNA, 18 bp, synthetic construct
  source 1..18: mol_type = other DNA
taatgcgactcgctattg

SEQ ID NO: 1321 - DNA, 18 bp, synthetic construct
  source 1..18: mol_type = other DNA
taatacgacgcactaccg

SEQ ID NO: 1322 - DNA, 18 bp, synthetic construct
  source 1..18: mol_type = other DNA
taaaacgactcgctattg

SEQ ID NO: 1323 - DNA, 18 bp, synthetic construct
  source 1..18: mol_type = other DNA
taatacgactcacgccag

SEQ ID NO: 1324 - DNA, 18 bp, synthetic construct
  source 1..18: mol_type = other DNA
taatagaactcactgtag

SEQ ID NO: 1325 - DNA, 18 bp, synthetic construct
  source 1..18: mol_type = other DNA
tgattcgactcactatcg

SEQ ID NO: 1326 - DNA, 18 bp, synthetic construct
  source 1..18: mol_type = other DNA
taattcggctcactatcg

SEQ ID NO: 1327 - DNA, 18 bp, synthetic construct
  source 1..18: mol_type = other DNA
taattcgactcactaccg

SEQ ID NO: 1328 - DNA, 18 bp, synthetic construct
  source 1..18: mol_type = other DNA
ttatgcgactcactgtag

SEQ ID NO: 1329 - DNA, 18 bp, synthetic construct
  source 1..18: mol_type = other DNA
taataggactcactttgg

SEQ ID NO: 1330 - DNA, 18 bp, synthetic construct
  source 1..18: mol_type = other DNA
taatgcgactcactgttg

SEQ ID NO: 1331 - DNA, 18 bp, synthetic construct
  source 1..18: mol_type = other DNA
taatgcgactcactactg

SEQ ID NO: 1332 - DNA, 18 bp, synthetic construct
  source 1..18: mol_type = other DNA
taatgcgactcactaccg

SEQ ID NO: 1333 - DNA, 18 bp, synthetic construct
  source 1..18: mol_type = other DNA
taatgcgactcactgaag

SEQ ID NO: 1334 - DNA, 18 bp, synthetic construct
  source 1..18: mol_type = other DNA
taatgcgcctcactaaag

SEQ ID NO: 1335 - DNA, 18 bp, synthetic construct
  source 1..18: mol_type = other DNA
aaataggactcactagag

SEQ ID NO: 1336 - DNA, 18 bp, synthetic construct
  source 1..18: mol_type = other DNA
taacgcgactcactgtag

SEQ ID NO: 1337 - DNA, 18 bp, synthetic construct
  source 1..18: mol_type = other DNA
taattggactcactagag

SEQ ID NO: 1338 - DNA, 18 bp, synthetic construct
  source 1..18: mol_type = other DNA
tagtgcaactcactatag

SEQ ID NO: 1339 - DNA, 18 bp, synthetic construct
  source 1..18: mol_type = other DNA
taataggactcgctatgg

SEQ ID NO: 1340 - DNA, 18 bp, synthetic construct
  source 1..18: mol_type = other DNA
gaattcgactcaccatag

SEQ ID NO: 1341 - DNA, 18 bp, synthetic construct
  source 1..18: mol_type = other DNA
taatacgcctcactatct

SEQ ID NO: 1342 - DNA, 18 bp, synthetic construct
  source 1..18: mol_type = other DNA
taataggactcactttac

SEQ ID NO: 1343 - DNA, 18 bp, synthetic construct
  source 1..18: mol_type = other DNA
tagtacgacgcactaaag

SEQ ID NO: 1344 - DNA, 18 bp, synthetic construct
  source 1..18: mol_type = other DNA
tattgcgactcactataa

SEQ ID NO: 1345 - DNA, 18 bp, synthetic construct
  source 1..18: mol_type = other DNA
tgatacgactcgctatcg

SEQ ID NO: 1346 - DNA, 18 bp, synthetic construct
  source 1..18: mol_type = other DNA
taattcgactcaccacag

SEQ ID NO: 1347 - DNA, 18 bp, synthetic construct
  source 1..18: mol_type = other DNA
taatgcgactcaccattg

SEQ ID NO: 1348 - DNA, 18 bp, synthetic construct
  source 1..18: mol_type = other DNA
taattcgactcaccattg

SEQ ID NO: 1349 - DNA, 18 bp, synthetic construct
  source 1..18: mol_type = other DNA
taatacaactcgctatcg

SEQ ID NO: 1350 - DNA, 18 bp, synthetic construct
  source 1..18: mol_type = other DNA
taattcggctcaccatag

SEQ ID NO: 1351 - DNA, 18 bp, synthetic construct
  source 1..18: mol_type = other DNA
taattcgactcgccatag

SEQ ID NO: 1352 - DNA, 18 bp, synthetic construct
  source 1..18: mol_type = other DNA
tattacgactcgctatcg

SEQ ID NO: 1353 - DNA, 18 bp, synthetic construct
  source 1..18: mol_type = other DNA
taattcgactcacactag

SEQ ID NO: 1354 - DNA, 18 bp, synthetic construct
  source 1..18: mol_type = other DNA
taattcggctcactattg

SEQ ID NO: 1355 - DNA, 18 bp, synthetic construct
  source 1..18: mol_type = other DNA
taatgcgtctcactaaag

SEQ ID NO: 1356 - DNA, 18 bp, synthetic construct
  source 1..18: mol_type = other DNA
taattcgacgcactatcg

SEQ ID NO: 1357 - DNA, 18 bp, synthetic construct
  source 1..18: mol_type = other DNA
gattacgactcagtatag

SEQ ID NO: 1358 - DNA, 18 bp, synthetic construct
  source 1..18: mol_type = other DNA
taatacgaatcgctatcg

SEQ ID NO: 1359 - DNA, 18 bp, synthetic construct
  source 1..18: mol_type = other DNA
taatacgactcagtctgg

SEQ ID NO: 1360 - DNA, 18 bp, synthetic construct
  source 1..18: mol_type = other DNA
taatgcgactcactaaat

SEQ ID NO: 1361 - DNA, 18 bp, synthetic construct
  source 1..18: mol_type = other DNA
tagtacgacgcactattg

SEQ ID NO: 1362 - DNA, 18 bp, synthetic construct
  source 1..18: mol_type = other DNA
ttatgcgcctcactatag

SEQ ID NO: 1363 - DNA, 18 bp, synthetic construct
  source 1..18: mol_type = other DNA
taatccaactcacgatag

SEQ ID NO: 1364 - DNA, 18 bp, synthetic construct
  source 1..18: mol_type = other DNA
taatacggctcacttcag

SEQ ID NO: 1365 - DNA, 18 bp, synthetic construct
  source 1..18: mol_type = other DNA
ttatgcgactcactaaag

SEQ ID NO: 1366 - DNA, 18 bp, synthetic construct
  source 1..18: mol_type = other DNA
taaaacggcccactatag

SEQ ID NO: 1367 - DNA, 18 bp, synthetic construct
  source 1..18: mol_type = other DNA
taataagactcgctattg

SEQ ID NO: 1368 - DNA, 18 bp, synthetic construct
  source 1..18: mol_type = other DNA
taattagactcactaaag

SEQ ID NO: 1369 - DNA, 18 bp, synthetic construct
  source 1..18: mol_type = other DNA
gaataagactcactacag

SEQ ID NO: 1370 - DNA, 18 bp, synthetic construct
  source 1..18: mol_type = other DNA
taatacgactcgctaccg

SEQ ID NO: 1371 - DNA, 18 bp, synthetic construct
  source 1..18: mol_type = other DNA
taattcgtctcgctatag

SEQ ID NO: 1372 - DNA, 18 bp, synthetic construct
  source 1..18: mol_type = other DNA
taataggactcactctcg

SEQ ID NO: 1373 - DNA, 18 bp, synthetic construct
  source 1..18: mol_type = other DNA
taaagcgactcactacag

SEQ ID NO: 1374 - DNA, 18 bp, synthetic construct
  source 1..18: mol_type = other DNA
taatgcgactcgctacag

SEQ ID NO: 1375 - DNA, 18 bp, synthetic construct
  source 1..18: mol_type = other DNA
taataggactcactctgg

SEQ ID NO: 1376 - DNA, 18 bp, synthetic construct
  source 1..18: mol_type = other DNA
caatccgactcactgtag

SEQ ID NO: 1377 - DNA, 18 bp, synthetic construct
  source 1..18: mol_type = other DNA
ttatgcgactcactatcg

SEQ ID NO: 1378 - DNA, 18 bp, synthetic construct
  source 1..18: mol_type = other DNA
taaaacgactcgctatcg

SEQ ID NO: 1379 - DNA, 18 bp, synthetic construct
  source 1..18: mol_type = other DNA
taatacgcctcaccaaag

SEQ ID NO: 1380 - DNA, 18 bp, synthetic construct
  source 1..18: mol_type = other DNA
taatcaggctcactatag

SEQ ID NO: 1381 - DNA, 18 bp, synthetic construct
  source 1..18: mol_type = other DNA
ttatgcgactcaccatag

SEQ ID NO: 1382 - DNA, 18 bp, synthetic construct
  source 1..18: mol_type = other DNA
ttattcgactcgctatag

SEQ ID NO: 1383 - DNA, 18 bp, synthetic construct
  source 1..18: mol_type = other DNA
taatgcgactcactttcg

SEQ ID NO: 1384 - DNA, 18 bp, synthetic construct
  source 1..18: mol_type = other DNA
gaatacgactcgctattg

SEQ ID NO: 1385 - DNA, 18 bp, synthetic construct
  source 1..18: mol_type = other DNA
taatgcgactcactccag

SEQ ID NO: 1386 - DNA, 18 bp, synthetic construct
  source 1..18: mol_type = other DNA
taatgcgactcactagtg

SEQ ID NO: 1387 - DNA, 18 bp, synthetic construct
  source 1..18: mol_type = other DNA
taattcgcatcactatag

SEQ ID NO: 1388 - DNA, 18 bp, synthetic construct
  source 1..18: mol_type = other DNA
tattacgcctcactacag

SEQ ID NO: 1389 - DNA, 18 bp, synthetic construct
  source 1..18: mol_type = other DNA
tgatacgactcactgtgg

SEQ ID NO: 1390 - DNA, 18 bp, synthetic construct
  source 1..18: mol_type = other DNA
aaatccgactcactagag

SEQ ID NO: 1391 - DNA, 18 bp, synthetic construct
  source 1..18: mol_type = other DNA
tagtacgaccgactatag

SEQ ID NO: 1392 - DNA, 18 bp, synthetic construct
  source 1..18: mol_type = other DNA
caatgcgactcactgtag

SEQ ID NO: 1393 - DNA, 18 bp, synthetic construct
  source 1..18: mol_type = other DNA
taatatgagtcactagag

SEQ ID NO: 1394 - DNA, 18 bp, synthetic construct
  source 1..18: mol_type = other DNA
taatgcgactcactagcg

SEQ ID NO: 1395 - DNA, 18 bp, synthetic construct
  source 1..18: mol_type = other DNA
taatcagactcactagag

SEQ ID NO: 1396 - DNA, 18 bp, synthetic construct
  source 1..18: mol_type = other DNA
taattcgtctcactatat

SEQ ID NO: 1397 - DNA, 18 bp, synthetic construct
  source 1..18: mol_type = other DNA
gaattcgactcgctatag

SEQ ID NO: 1398 - DNA, 18 bp, synthetic construct
  source 1..18: mol_type = other DNA
taaagcgactcactataa

SEQ ID NO: 1399 - DNA, 18 bp, synthetic construct
  source 1..18: mol_type = other DNA
taataagactcacgacag

SEQ ID NO: 1400 - DNA, 18 bp, synthetic construct
  source 1..18: mol_type = other DNA
taatacaactcactttat

SEQ ID NO: 1401 - DNA, 18 bp, synthetic construct
  source 1..18: mol_type = other DNA
taatacgactcattatca

SEQ ID NO: 1402 - DNA, 18 bp, synthetic construct
  source 1..18: mol_type = other DNA
taatacgactcgctattc

SEQ ID NO: 1403 - DNA, 18 bp, synthetic construct
  source 1..18: mol_type = other DNA
taatacgactctctctaa

SEQ ID NO: 1404 - DNA, 18 bp, synthetic construct
  source 1..18: mol_type = other DNA
taatatgactcactaaaa

SEQ ID NO: 1405 - DNA, 18 bp, synthetic construct
  source 1..18: mol_type = other DNA
taatccgactcacgacag

SEQ ID NO: 1406 - DNA, 18 bp, synthetic construct
  source 1..18: mol_type = other DNA
taatgcgactcactgtaa

SEQ ID NO: 1407 - DNA, 18 bp, synthetic construct
  source 1..18: mol_type = other DNA
taatgcgactcactttaa

SEQ ID NO: 1408 - DNA, 18 bp, synthetic construct
  source 1..18: mol_type = other DNA
taattggactcagtatag

SEQ ID NO: 1409 - DNA, 18 bp, synthetic construct
  source 1..18: mol_type = other DNA
tagtacggcgcactatag

SEQ ID NO: 1410 - DNA, 18 bp, synthetic construct
  source 1..18: mol_type = other DNA
tgatacgactcactatca

SEQ ID NO: 1411 - DNA, 18 bp, synthetic construct
  source 1..18: mol_type = other DNA
taatgcgactcacttcag

SEQ ID NO: 1412 - DNA, 18 bp, synthetic construct
  source 1..18: mol_type = other DNA
taaagcgactcactaaag

SEQ ID NO: 1413 - DNA, 18 bp, synthetic construct
  source 1..18: mol_type = other DNA
caatgcgactcactctag

SEQ ID NO: 1414 - DNA, 18 bp, synthetic construct
  source 1..18: mol_type = other DNA
taatataactcactctag

SEQ ID NO: 1415 - DNA, 18 bp, synthetic construct
  source 1..18: mol_type = other DNA
taattcgactcgctagag

SEQ ID NO: 1416 - DNA, 18 bp, synthetic construct
  source 1..18: mol_type = other DNA
taatgcgcctcactattg

SEQ ID NO: 1417 - DNA, 18 bp, synthetic construct
  source 1..18: mol_type = other DNA
ttatgcgactcactttag

SEQ ID NO: 1418 - DNA, 18 bp, synthetic construct
  source 1..18: mol_type = other DNA
aaatgcgactcactctag

SEQ ID NO: 1419 - DNA, 18 bp, synthetic construct
  source 1..18: mol_type = other DNA
taatccgactcgctattg

SEQ ID NO: 1420 - DNA, 18 bp, synthetic construct
  source 1..18: mol_type = other DNA
taataagactcgctatcg

SEQ ID NO: 1421 - DNA, 18 bp, synthetic construct
  source 1..18: mol_type = other DNA
taatacaactcgctacag

SEQ ID NO: 1422 - DNA, 18 bp, synthetic construct
  source 1..18: mol_type = other DNA
taattcgactcgctctag

SEQ ID NO: 1423 - DNA, 18 bp, synthetic construct
  source 1..18: mol_type = other DNA
tactacgactctctatgg

SEQ ID NO: 1424 - DNA, 18 bp, synthetic construct
  source 1..18: mol_type = other DNA
taattcgactcgctttag

SEQ ID NO: 1425 - DNA, 18 bp, synthetic construct
  source 1..18: mol_type = other DNA
caatacgactcactcttg

SEQ ID NO: 1426 - DNA, 18 bp, synthetic construct
  source 1..18: mol_type = other DNA
taatacgactcgccatcg

SEQ ID NO: 1427 - DNA, 18 bp, synthetic construct
  source 1..18: mol_type = other DNA
ttatacgactcgctacag

SEQ ID NO: 1428 - DNA, 18 bp, synthetic construct
  source 1..18: mol_type = other DNA
tattaggactcactctag

SEQ ID NO: 1429 - DNA, 18 bp, synthetic construct
  source 1..18: mol_type = other DNA
gaatatgacccactatag

SEQ ID NO: 1430 - DNA, 18 bp, synthetic construct
  source 1..18: mol_type = other DNA
ttatccgactcgctatag

SEQ ID NO: 1431 - DNA, 18 bp, synthetic construct
  source 1..18: mol_type = other DNA
aaataggactcactctag

SEQ ID NO: 1432 - DNA, 18 bp, synthetic construct
  source 1..18: mol_type = other DNA
tattgcgactcactagag

SEQ ID NO: 1433 - DNA, 18 bp, synthetic construct
  source 1..18: mol_type = other DNA
ttatacgcctcactagag

SEQ ID NO: 1434 - DNA, 18 bp, synthetic construct
  source 1..18: mol_type = other DNA
taaaatgactcacgatag

SEQ ID NO: 1435 - DNA, 18 bp, synthetic construct
  source 1..18: mol_type = other DNA
ctatacgactcgctatag

SEQ ID NO: 1436 - DNA, 18 bp, synthetic construct
  source 1..18: mol_type = other DNA
taaagcgactcactatgg

SEQ ID NO: 1437 - DNA, 18 bp, synthetic construct
  source 1..18: mol_type = other DNA
caaaacgactcactgtag

SEQ ID NO: 1438 - DNA, 18 bp, synthetic construct
  source 1..18: mol_type = other DNA
ttaagcgactcactatag

SEQ ID NO: 1439 - DNA, 18 bp, synthetic construct
  source 1..18: mol_type = other DNA
taatgcgcctcactctag

SEQ ID NO: 1440 - DNA, 18 bp, synthetic construct
  source 1..18: mol_type = other DNA
taattcgactcactccag

SEQ ID NO: 1441 - DNA, 18 bp, synthetic construct
  source 1..18: mol_type = other DNA
taattcgactcactatca

SEQ ID NO: 1442 - DNA, 18 bp, synthetic construct
  source 1..18: mol_type = other DNA
caatagaactcactatag

SEQ ID NO: 1443 - DNA, 18 bp, synthetic construct
  source 1..18: mol_type = other DNA
cgatacgacccactatag

SEQ ID NO: 1444 - DNA, 18 bp, synthetic construct
  source 1..18: mol_type = other DNA
taataggactcactttaa

SEQ ID NO: 1445 - DNA, 18 bp, synthetic construct
  source 1..18: mol_type = other DNA
taatacgtctcgctatcg

SEQ ID NO: 1446 - DNA, 18 bp, synthetic construct
  source 1..18: mol_type = other DNA
ttatgcgactcactctag

SEQ ID NO: 1447 - DNA, 18 bp, synthetic construct
  source 1..18: mol_type = other DNA
ttataggacgcactatag

SEQ ID NO: 1448 - DNA, 18 bp, synthetic construct
  source 1..18: mol_type = other DNA
tattacgactcgctattg

SEQ ID NO: 1449 - DNA, 18 bp, synthetic construct
  source 1..18: mol_type = other DNA
taataggactcacgattg

SEQ ID NO: 1450 - DNA, 18 bp, synthetic construct
  source 1..18: mol_type = other DNA
ttatacgactcactaccg

SEQ ID NO: 1451 - DNA, 18 bp, synthetic construct
  source 1..18: mol_type = other DNA
taaaacgactcactctgg

SEQ ID NO: 1452 - DNA, 18 bp, synthetic construct
  source 1..18: mol_type = other DNA
taataggactcaccctag

SEQ ID NO: 1453 - DNA, 18 bp, synthetic construct
  source 1..18: mol_type = other DNA
taatttgactcactgtag

SEQ ID NO: 1454 - DNA, 18 bp, synthetic construct
  source 1..18: mol_type = other DNA
gaaaacgactcactgtag

SEQ ID NO: 1455 - DNA, 18 bp, synthetic construct
  source 1..18: mol_type = other DNA
taatacgcctcgctattg

SEQ ID NO: 1456 - DNA, 18 bp, synthetic construct
  source 1..18: mol_type = other DNA
caattcgactcgctatag

SEQ ID NO: 1457 - DNA, 18 bp, synthetic construct
  source 1..18: mol_type = other DNA
taaaacgactcgccatag

SEQ ID NO: 1458 - DNA, 18 bp, synthetic construct
  source 1..18: mol_type = other DNA
taatgcgactcgctaaag

SEQ ID NO: 1459 - DNA, 18 bp, synthetic construct
  source 1..18: mol_type = other DNA
taaaaggactcacgatag

SEQ ID NO: 1460 - DNA, 18 bp, synthetic construct
  source 1..18: mol_type = other DNA
taataggactcgctatcg

SEQ ID NO: 1461 - DNA, 18 bp, synthetic construct
  source 1..18: mol_type = other DNA
taatgcgactcactaatg

SEQ ID NO: 1462 - DNA, 18 bp, synthetic construct
  source 1..18: mol_type = other DNA
taatgtgactcgctatag

SEQ ID NO: 1463 - DNA, 18 bp, synthetic construct
  source 1..18: mol_type = other DNA
taaaacgactcactgttg

SEQ ID NO: 1464 - DNA, 18 bp, synthetic construct
  source 1..18: mol_type = other DNA
tgataggactcactgtag

SEQ ID NO: 1465 - DNA, 18 bp, synthetic construct
  source 1..18: mol_type = other DNA
caatacgactcgctattg

SEQ ID NO: 1466 - DNA, 18 bp, synthetic construct
  source 1..18: mol_type = other DNA
ttattcgactcactatcg

SEQ ID NO: 1467 - DNA, 18 bp, synthetic construct
  source 1..18: mol_type = other DNA
taatacaactcacggtag

SEQ ID NO: 1468 - DNA, 18 bp, synthetic construct
  source 1..18: mol_type = other DNA
taatgagactcactctag

SEQ ID NO: 1469 - DNA, 18 bp, synthetic construct
  source 1..18: mol_type = other DNA
taattcgacgcgctatag

SEQ ID NO: 1470 - DNA, 18 bp, synthetic construct
  source 1..18: mol_type = other DNA
aaatgcgactcacgatag

SEQ ID NO: 1471 - DNA, 18 bp, synthetic construct
  source 1..18: mol_type = other DNA
taatacgactcgccacag

SEQ ID NO: 1472 - DNA, 18 bp, synthetic construct
  source 1..18: mol_type = other DNA
taatgcgcctcacaatag

SEQ ID NO: 1473 - DNA, 18 bp, synthetic construct
  source 1..18: mol_type = other DNA
tatttcgactcgctatag

SEQ ID NO: 1474 - DNA, 18 bp, synthetic construct
  source 1..18: mol_type = other DNA
caatacgactcacactag

SEQ ID NO: 1475 - DNA, 18 bp, synthetic construct
  source 1..18: mol_type = other DNA
aaataggactcactttag

SEQ ID NO: 1476 - DNA, 18 bp, synthetic construct
  source 1..18: mol_type = other DNA
taatacgactcaccaccg

SEQ ID NO: 1477 - DNA, 18 bp, synthetic construct
  source 1..18: mol_type = other DNA
aaatgcgcctcactatag

SEQ ID NO: 1478 - DNA, 18 bp, synthetic construct
  source 1..18: mol_type = other DNA
taaatcgactcgctatag

SEQ ID NO: 1479 - DNA, 18 bp, synthetic construct
  source 1..18: mol_type = other DNA
tgatactactcactctag

SEQ ID NO: 1480 - DNA, 18 bp, synthetic construct
  source 1..18: mol_type = other DNA
taatgcaactcactacag

SEQ ID NO: 1481 - DNA, 18 bp, synthetic construct
  source 1..18: mol_type = other DNA
taatatgactcgctatcg

SEQ ID NO: 1482 - DNA, 18 bp, synthetic construct
  source 1..18: mol_type = other DNA
tgattcgactcgctatag

SEQ ID NO: 1483 - DNA, 18 bp, synthetic construct
  source 1..18: mol_type = other DNA
taattcgtctcactatcg

SEQ ID NO: 1484 - DNA, 18 bp, synthetic construct
  source 1..18: mol_type = other DNA
taataggactcactgaag

SEQ ID NO: 1485 - DNA, 18 bp, synthetic construct
  source 1..18: mol_type = other DNA
ttatacgactcactccag

SEQ ID NO: 1486 - DNA, 18 bp, synthetic construct
  source 1..18: mol_type = other DNA
taattcgtctcactattg

SEQ ID NO: 1487 - DNA, 18 bp, synthetic construct
  source 1..18: mol_type = other DNA
caataagactcactctag

SEQ ID NO: 1488 - DNA, 18 bp, synthetic construct
  source 1..18: mol_type = other DNA
taatacaactcaccatcg

SEQ ID NO: 1489 - DNA, 18 bp, synthetic construct
  source 1..18: mol_type = other DNA
ttatgcgactcgctatag

SEQ ID NO: 1490 - DNA, 18 bp, synthetic construct
  source 1..18: mol_type = other DNA
tgatgcgactcactttag

SEQ ID NO: 1491 - DNA, 18 bp, synthetic construct
  source 1..18: mol_type = other DNA
caatgcgactcactttag

SEQ ID NO: 1492 - DNA, 18 bp, synthetic construct
  source 1..18: mol_type = other DNA
taatgcgactcagtaaag

SEQ ID NO: 1493 - DNA, 18 bp, synthetic construct
  source 1..18: mol_type = other DNA
ttatacgcctcactaaag

SEQ ID NO: 1494 - DNA, 18 bp, synthetic construct
  source 1..18: mol_type = other DNA
taaaacgactcacgaaag

SEQ ID NO: 1495 - DNA, 18 bp, synthetic construct
  source 1..18: mol_type = other DNA
taattcggctcactacag

SEQ ID NO: 1496 - DNA, 18 bp, synthetic construct
  source 1..18: mol_type = other DNA
taatacgactcgatatcg

SEQ ID NO: 1497 - DNA, 18 bp, synthetic construct
  source 1..18: mol_type = other DNA
taatacgactcgccattg

SEQ ID NO: 1498 - DNA, 18 bp, synthetic construct
  source 1..18: mol_type = other DNA
taatccgactcaccctag

SEQ ID NO: 1499 - DNA, 18 bp, synthetic construct
  source 1..18: mol_type = other DNA
taataggactcactccag

SEQ ID NO: 1500 - DNA, 18 bp, synthetic construct
  source 1..18: mol_type = other DNA
tgataggactcactctag

SEQ ID NO: 1501 - DNA, 18 bp, synthetic construct
  source 1..18: mol_type = other DNA
taatgcgcctcactacag

SEQ ID NO: 1502 - DNA, 18 bp, synthetic construct
  source 1..18: mol_type = other DNA
taatacgactcttcatag

SEQ ID NO: 1503 - DNA, 18 bp, synthetic construct
  source 1..18: mol_type = other DNA
taatgggactcactaaag

SEQ ID NO: 1504 - DNA, 18 bp, synthetic construct
  source 1..18: mol_type = other DNA
tattgcgactcactattg

SEQ ID NO: 1505 - DNA, 18 bp, synthetic construct
  source 1..18: mol_type = other DNA
tattgcgactcactaaag

SEQ ID NO: 1506 - DNA, 18 bp, synthetic construct
  source 1..18: mol_type = other DNA
aaattcgactcgctatag

SEQ ID NO: 1507 - DNA, 18 bp, synthetic construct
  source 1..18: mol_type = other DNA
ttagacgactcactacag

SEQ ID NO: 1508 - DNA, 18 bp, synthetic construct
  source 1..18: mol_type = other DNA
tgatgcgactcactaaag

SEQ ID NO: 1509 - DNA, 18 bp, synthetic construct
  source 1..18: mol_type = other DNA
ttatacgactcgccatag

SEQ ID NO: 1510 - DNA, 18 bp, synthetic construct
  source 1..18: mol_type = other DNA
aaataagactcactagag

SEQ ID NO: 1511 - DNA, 18 bp, synthetic construct
  source 1..18: mol_type = other DNA
ttaaacgcctcactatag

SEQ ID NO: 1512 - DNA, 18 bp, synthetic construct
  source 1..18: mol_type = other DNA
tattgcgtctcactatag

SEQ ID NO: 1513 - DNA, 18 bp, synthetic construct
  source 1..18: mol_type = other DNA
tattaggactcactacag

SEQ ID NO: 1514 - DNA, 18 bp, synthetic construct
  source 1..18: mol_type = other DNA
taaagcggctcactatag

SEQ ID NO: 1515 - DNA, 18 bp, synthetic construct
  source 1..18: mol_type = other DNA
taatgcgactcaccatcg

SEQ ID NO: 1516 - DNA, 18 bp, synthetic construct
  source 1..18: mol_type = other DNA
taatacgactcagtaacg

SEQ ID NO: 1517 - DNA, 18 bp, synthetic construct
  source 1..18: mol_type = other DNA
aaatgcgactcactatcg

SEQ ID NO: 1518 - DNA, 18 bp, synthetic construct
  source 1..18: mol_type = other DNA
caatacggctcactatcg

SEQ ID NO: 1519 - DNA, 18 bp, synthetic construct
  source 1..18: mol_type = other DNA
gaatgcgactcactaaag

SEQ ID NO: 1520 - DNA, 18 bp, synthetic construct
  source 1..18: mol_type = other DNA
taatgcgtctcactttag

SEQ ID NO: 1521 - DNA, 18 bp, synthetic construct
  source 1..18: mol_type = other DNA
ttatgcgactcactacag

SEQ ID NO: 1522 - DNA, 18 bp, synthetic construct
  source 1..18: mol_type = other DNA
tgatacgactcacttgag

SEQ ID NO: 1523 - DNA, 18 bp, synthetic construct
  source 1..18: mol_type = other DNA
taattcgactcaccatcg

SEQ ID NO: 1524 - DNA, 18 bp, synthetic construct
  source 1..18: mol_type = other DNA
taatacaactcgccatag

SEQ ID NO: 1525 - DNA, 18 bp, synthetic construct
  source 1..18: mol_type = other DNA
taataggactcgctctag

SEQ ID NO: 1526 - DNA, 18 bp, synthetic construct
  source 1..18: mol_type = other DNA
taaggcgactcactaaag

SEQ ID NO: 1527 - DNA, 18 bp, synthetic construct
  source 1..18: mol_type = other DNA
taatacgcatcactatgg

SEQ ID NO: 1528 - DNA, 18 bp, synthetic construct
  source 1..18: mol_type = other DNA
taatagcactcactctag

SEQ ID NO: 1529 - DNA, 18 bp, synthetic construct
  source 1..18: mol_type = other DNA
taatacgacttgctatcg

SEQ ID NO: 1530 - DNA, 18 bp, synthetic construct
  source 1..18: mol_type = other DNA
taatgcgcgtcactatag

SEQ ID NO: 1531 - DNA, 18 bp, synthetic construct
  source 1..18: mol_type = other DNA
taatacgtctcactaaaa

SEQ ID NO: 1532 - DNA, 18 bp, synthetic construct
  source 1..18: mol_type = other DNA
caataggactcaccatag

SEQ ID NO: 1533 - DNA, 18 bp, synthetic construct
  source 1..18: mol_type = other DNA
taatagggctcactatcg

SEQ ID NO: 1534 - DNA, 18 bp, synthetic construct
  source 1..18: mol_type = other DNA
taatgcgtctcactatat

SEQ ID NO: 1535 - DNA, 18 bp, synthetic construct
  source 1..18: mol_type = other DNA
tattacgtctcactataa

SEQ ID NO: 1536 - DNA, 18 bp, synthetic construct
  source 1..18: mol_type = other DNA
caatacgactcacaatac

SEQ ID NO: 1537 - DNA, 18 bp, synthetic construct
  source 1..18: mol_type = other DNA
taatacaactcactatca

SEQ ID NO: 1538 - DNA, 18 bp, synthetic construct
  source 1..18: mol_type = other DNA
taatacgactcaccacat

SEQ ID NO: 1539 - DNA, 18 bp, synthetic construct
  source 1..18: mol_type = other DNA
taatacgactcagtgttg

SEQ ID NO: 1540 - DNA, 18 bp, synthetic construct
  source 1..18: mol_type = other DNA
taatacgactggctatcg

SEQ ID NO: 1541 - DNA, 18 bp, synthetic construct
  source 1..18: mol_type = other DNA
taatatgactcacgatcg

SEQ ID NO: 1542 - DNA, 18 bp, synthetic construct
  source 1..18: mol_type = other DNA
taatgcgactcactacat

SEQ ID NO: 1543 - DNA, 18 bp, synthetic construct
  source 1..18: mol_type = other DNA
taatgcgactcagtctag

SEQ ID NO: 1544 - DNA, 18 bp, synthetic construct
  source 1..18: mol_type = other DNA
tactacgaggcactatag

SEQ ID NO: 1545 - DNA, 18 bp, synthetic construct
  source 1..18: mol_type = other DNA
tgatccgacgcactatag

SEQ ID NO: 1546 - DNA, 18 bp, synthetic construct
  source 1..18: mol_type = other DNA
ttatacgactcaccatac

SEQ ID NO: 1547 - DNA, 18 bp, synthetic construct
  source 1..18: mol_type = other DNA
ttataggactcactataa

SEQ ID NO: 1548 - DNA, 18 bp, synthetic construct
  source 1..18: mol_type = other DNA
aaatacgactcactagaa

SEQ ID NO: 1549 - DNA, 18 bp, synthetic construct
  source 1..18: mol_type = other DNA
caatacgactcacgctag

SEQ ID NO: 1550 - DNA, 18 bp, synthetic construct
  source 1..18: mol_type = other DNA
caatacgactcactaaat

SEQ ID NO: 1551 - DNA, 18 bp, synthetic construct
  source 1..18: mol_type = other DNA
caatacgactcactacat

SEQ ID NO: 1552 - DNA, 18 bp, synthetic construct
  source 1..18: mol_type = other DNA
caattcgactcactatat

SEQ ID NO: 1553 - DNA, 18 bp, synthetic construct
  source 1..18: mol_type = other DNA
cactgcgactcactatag

SEQ ID NO: 1554 - DNA, 18 bp, synthetic construct
  source 1..18: mol_type = other DNA
cagtacgactcactagag

SEQ ID NO: 1555 - DNA, 18 bp, synthetic construct
  source 1..18: mol_type = other DNA
cattacgactcactataa

SEQ ID NO: 1556 - DNA, 18 bp, synthetic construct
  source 1..18: mol_type = other DNA
gaagacgagtcactatag

SEQ ID NO: 1557 - DNA, 18 bp, synthetic construct
  source 1..18: mol_type = other DNA
gaatacgacccaatatag

SEQ ID NO: 1558 - DNA, 18 bp, synthetic construct
  source 1..18: mol_type = other DNA
gaatacgactcactaaaa

SEQ ID NO: 1559 - DNA, 18 bp, synthetic construct
  source 1..18: mol_type = other DNA
gaatacgactcactgaag

SEQ ID NO: 1560 - DNA, 18 bp, synthetic construct
  source 1..18: mol_type = other DNA
gaatacgactgaccatag

SEQ ID NO: 1561 - DNA, 18 bp, synthetic construct
  source 1..18: mol_type = other DNA
gaatgcgactaactatag

SEQ ID NO: 1562 - DNA, 18 bp, synthetic construct
  source 1..18: mol_type = other DNA
gaatgcgactcactttag

SEQ ID NO: 1563 - DNA, 18 bp, synthetic construct
  source 1..18: mol_type = other DNA
gattacgcctcactatag

SEQ ID NO: 1564 - DNA, 18 bp, synthetic construct
  source 1..18: mol_type = other DNA
taaaaagactcactataa

SEQ ID NO: 1565 - DNA, 18 bp, synthetic construct
  source 1..18: mol_type = other DNA
taaaaagactcactatat

SEQ ID NO: 1566 - DNA, 18 bp, synthetic construct
  source 1..18: mol_type = other DNA
taaaacgactcactacac

SEQ ID NO: 1567 - DNA, 18 bp, synthetic construct
  source 1..18: mol_type = other DNA
taaaacgactcactttaa

SEQ ID NO: 1568 - DNA, 18 bp, synthetic construct
  source 1..18: mol_type = other DNA
taaaccgactcactatac

SEQ ID NO: 1569 - DNA, 18 bp, synthetic construct
  source 1..18: mol_type = other DNA
taacacgacgcactctag

SEQ ID NO: 1570 - DNA, 18 bp, synthetic construct
  source 1..18: mol_type = other DNA
taacacgactcaatataa

SEQ ID NO: 1571 - DNA, 18 bp, synthetic construct
  source 1..18: mol_type = other DNA
taacgcgactcactatat

SEQ ID NO: 1572 - DNA, 18 bp, synthetic construct
  source 1..18: mol_type = other DNA
taagacgacccacgatag

SEQ ID NO: 1573 - DNA, 18 bp, synthetic construct
  source 1..18: mol_type = other DNA
taagacgactcactatta

SEQ ID NO: 1574 - DNA, 18 bp, synthetic construct
  source 1..18: mol_type = other DNA
taagacgactcactgtcg

SEQ ID NO: 1575 - DNA, 18 bp, synthetic construct
  source 1..18: mol_type = other DNA
taagacgactcattagag

SEQ ID NO: 1576 - DNA, 18 bp, synthetic construct
  source 1..18: mol_type = other DNA
taaggagactcactatag

SEQ ID NO: 1577 - DNA, 18 bp, synthetic construct
  source 1..18: mol_type = other DNA
taataagactcactctac

SEQ ID NO: 1578 - DNA, 18 bp, synthetic construct
  source 1..18: mol_type = other DNA
taataagacttactataa

SEQ ID NO: 1579 - DNA, 18 bp, synthetic construct
  source 1..18: mol_type = other DNA
taataaggctcactataa

SEQ ID NO: 1580 - DNA, 18 bp, synthetic construct
  source 1..18: mol_type = other DNA
taatacaactcacgatat

SEQ ID NO: 1581 - DNA, 18 bp, synthetic construct
  source 1..18: mol_type = other DNA
taatacaactcactatct

SEQ ID NO: 1582 - DNA, 18 bp, synthetic construct
  source 1..18: mol_type = other DNA
taatacaactcactctaa

SEQ ID NO: 1583 - DNA, 18 bp, synthetic construct
  source 1..18: mol_type = other DNA
taataccactcgccatag

SEQ ID NO: 1584 - DNA, 18 bp, synthetic construct
  source 1..18: mol_type = other DNA
taataccattcactgtag

SEQ ID NO: 1585 - DNA, 18 bp, synthetic construct
  source 1..18: mol_type = other DNA
taatacgaatcaatataa

SEQ ID NO: 1586 - DNA, 18 bp, synthetic construct
  source 1..18: mol_type = other DNA
taatacgaatcagcatag

SEQ ID NO: 1587 - DNA, 18 bp, synthetic construct
  source 1..18: mol_type = other DNA
taatacgacacaatatac

SEQ ID NO: 1588 - DNA, 18 bp, synthetic construct
  source 1..18: mol_type = other DNA
taatacgacacactacat

SEQ ID NO: 1589 - DNA, 18 bp, synthetic construct
  source 1..18: mol_type = other DNA
taatacgacacactatga

SEQ ID NO: 1590 - DNA, 18 bp, synthetic construct
  source 1..18: mol_type = other DNA
taatacgacacactttaa

SEQ ID NO: 1591 - DNA, 18 bp, synthetic construct
  source 1..18: mol_type = other DNA
taatacgacagactatac

SEQ ID NO: 1592 - DNA, 18 bp, synthetic construct
  source 1..18: mol_type = other DNA
taatacgacgaaccatag

SEQ ID NO: 1593 - DNA, 18 bp, synthetic construct
  source 1..18: mol_type = other DNA
taatacgacgcactgtcg

SEQ ID NO: 1594 - DNA, 18 bp, synthetic construct
  source 1..18: mol_type = other DNA
taatacgacgcgctatcg

SEQ ID NO: 1595 - DNA, 18 bp, synthetic construct
  source 1..18: mol_type = other DNA
taatacgactcaagagag

SEQ ID NO: 1596 - DNA, 18 bp, synthetic construct
  source 1..18: mol_type = other DNA
taatacgactcaccacac

SEQ ID NO: 1597 - DNA, 18 bp, synthetic construct
  source 1..18: mol_type = other DNA
taatacgactcaccatct

SEQ ID NO: 1598 - DNA, 18 bp, synthetic construct
  source 1..18: mol_type = other DNA
taatacgactcacgaacg

SEQ ID NO: 1599 - DNA, 18 bp, synthetic construct
  source 1..18: mol_type = other DNA
taatacgactcactccaa

SEQ ID NO: 1600 - DNA, 18 bp, synthetic construct
  source 1..18: mol_type = other DNA
taatacgactcactcgcg

SEQ ID NO: 1601 - DNA, 18 bp, synthetic construct
  source 1..18: mol_type = other DNA
taatacgactcactctga

SEQ ID NO: 1602 - DNA, 18 bp, synthetic construct
  source 1..18: mol_type = other DNA
taatacgactcactctgc

SEQ ID NO: 1603 - DNA, 18 bp, synthetic construct
  source 1..18: mol_type = other DNA
taatacgactcacttcaa

SEQ ID NO: 1604 - DNA, 18 bp, synthetic construct
  source 1..18: mol_type = other DNA
taatacgactcagtatcc

SEQ ID NO: 1605 - DNA, 18 bp, synthetic construct
  source 1..18: mol_type = other DNA
taatacgactccccataa

SEQ ID NO: 1606 - DNA, 18 bp, synthetic construct
  source 1..18: mol_type = other DNA
taatacgactcccgataa

SEQ ID NO: 1607 - DNA, 18 bp, synthetic construct
  source 1..18: mol_type = other DNA
taatacgactcccggtag

SEQ ID NO: 1608 - DNA, 18 bp, synthetic construct
  source 1..18: mol_type = other DNA
taatacgactcgccatat

SEQ ID NO: 1609 - DNA, 18 bp, synthetic construct
  source 1..18: mol_type = other DNA
taatacgactcgctatca

SEQ ID NO: 1610 - DNA, 18 bp, synthetic construct
  source 1..18: mol_type = other DNA
taatacgactcgctgtac

SEQ ID NO: 1611 - DNA, 18 bp, synthetic construct
  source 1..18: mol_type = other DNA
taatacgactcgggatag

SEQ ID NO: 1612 - DNA, 18 bp, synthetic construct
  source 1..18: mol_type = other DNA
taatacgactctctacac

SEQ ID NO: 1613 - DNA, 18 bp, synthetic construct
  source 1..18: mol_type = other DNA
taatacgactgactattc

SEQ ID NO: 1614 - DNA, 18 bp, synthetic construct
  source 1..18: mol_type = other DNA
taatacgattcacgataa

SEQ ID NO: 1615 - DNA, 18 bp, synthetic construct
  source 1..18: mol_type = other DNA
taatacgattcactatct

SEQ ID NO: 1616 - DNA, 18 bp, synthetic construct
  source 1..18: mol_type = other DNA
taatacgcatcactataa

SEQ ID NO: 1617 - DNA, 18 bp, synthetic construct
  source 1..18: mol_type = other DNA
taatacgcctcactaaac

SEQ ID NO: 1618 - DNA, 18 bp, synthetic construct
  source 1..18: mol_type = other DNA
taatacgcctcactacat

SEQ ID NO: 1619 - DNA, 18 bp, synthetic construct
  source 1..18: mol_type = other DNA
taatacgcctcactattc

SEQ ID NO: 1620 - DNA, 18 bp, synthetic construct
  source 1..18: mol_type = other DNA
taatacgcctcactctat

SEQ ID NO: 1621 - DNA, 18 bp, synthetic construct
  source 1..18: mol_type = other DNA
taatacgcctcgctataa

SEQ ID NO: 1622 - DNA, 18 bp, synthetic construct
  source 1..18: mol_type = other DNA
taatacggctcactattt

SEQ ID NO: 1623 - DNA, 18 bp, synthetic construct
  source 1..18: mol_type = other DNA
taatacgtcgcactgtag

SEQ ID NO: 1624 - DNA, 18 bp, synthetic construct
  source 1..18: mol_type = other DNA
taatacgtggcactatag

SEQ ID NO: 1625 - DNA, 18 bp, synthetic construct
  source 1..18: mol_type = other DNA
taatactactcagtataa

SEQ ID NO: 1626 - DNA, 18 bp, synthetic construct
  source 1..18: mol_type = other DNA
taataggacgcgctatag

SEQ ID NO: 1627 - DNA, 18 bp, synthetic construct
  source 1..18: mol_type = other DNA
taataggactcactagcg

SEQ ID NO: 1628 - DNA, 18 bp, synthetic construct
  source 1..18: mol_type = other DNA
taataggtctcactatat

SEQ ID NO: 1629 - DNA, 18 bp, synthetic construct
  source 1..18: mol_type = other DNA
taatatgactcacaatat

SEQ ID NO: 1630 - DNA, 18 bp, synthetic construct
  source 1..18: mol_type = other DNA
taatatgcctcactataa

SEQ ID NO: 1631 - DNA, 18 bp, synthetic construct
  source 1..18: mol_type = other DNA
taatatgcctcactatat

SEQ ID NO: 1632 - DNA, 18 bp, synthetic construct
  source 1..18: mol_type = other DNA
taatccaactcactatac

SEQ ID NO: 1633 - DNA, 18 bp, synthetic construct
  source 1..18: mol_type = other DNA
taatccgacacactataa

SEQ ID NO: 1634 - DNA, 18 bp, synthetic construct
  source 1..18: mol_type = other DNA
taatccgactcacaatac

SEQ ID NO: 1635 - DNA, 18 bp, synthetic construct
  source 1..18: mol_type = other DNA
taatccgactcactacat

SEQ ID NO: 1636 - DNA, 18 bp, synthetic construct
  source 1..18: mol_type = other DNA
taatccgactcactagaa

SEQ ID NO: 1637 - DNA, 18 bp, synthetic construct
  source 1..18: mol_type = other DNA
taatccgactcactatca

SEQ ID NO: 1638 - DNA, 18 bp, synthetic construct
  source 1..18: mol_type = other DNA
taatccgactctctataa

SEQ ID NO: 1639 - DNA, 18 bp, synthetic construct
  source 1..18: mol_type = other DNA
taatcggacttactatag

SEQ ID NO: 1640 - DNA, 18 bp, synthetic construct
  source 1..18: mol_type = other DNA
taatgcgactcactctaa

SEQ ID NO: 1641 - DNA, 18 bp, synthetic construct
  source 1..18: mol_type = other DNA
taatgcgactgactgtag

SEQ ID NO: 1642 - DNA, 18 bp, synthetic construct
  source 1..18: mol_type = other DNA
taatgcgtctcactatac

SEQ ID NO: 1643 - DNA, 18 bp, synthetic construct
  source 1..18: mol_type = other DNA
taatgctactcacgatag

SEQ ID NO: 1644 - DNA, 18 bp, synthetic construct
  source 1..18: mol_type = other DNA
taattcgacccactataa

SEQ ID NO: 1645 - DNA, 18 bp, synthetic construct
  source 1..18: mol_type = other DNA
taattcgactcactattt

SEQ ID NO: 1646 - DNA, 18 bp, synthetic construct
  source 1..18: mol_type = other DNA
taattcgactcgctatac

SEQ ID NO: 1647 - DNA, 18 bp, synthetic construct
  source 1..18: mol_type = other DNA
tactacgcctcgctatag

SEQ ID NO: 1648 - DNA, 18 bp, synthetic construct
  source 1..18: mol_type = other DNA
tactactactcactataa

SEQ ID NO: 1649 - DNA, 18 bp, synthetic construct
  source 1..18: mol_type = other DNA
tagtacgactcactgtac

SEQ ID NO: 1650 - DNA, 18 bp, synthetic construct
  source 1..18: mol_type = other DNA
tagtacgactccccatag

SEQ ID NO: 1651 - DNA, 18 bp, synthetic construct
  source 1..18: mol_type = other DNA
tagtaggactcactagag

SEQ ID NO: 1652 - DNA, 18 bp, synthetic construct
  source 1..18: mol_type = other DNA
tagtgcgacccactatag

SEQ ID NO: 1653 - DNA, 18 bp, synthetic construct
  source 1..18: mol_type = other DNA
tattacgactaactataa

SEQ ID NO: 1654 - DNA, 18 bp, synthetic construct
  source 1..18: mol_type = other DNA
tattgcgactcactatac

SEQ ID NO: 1655 - DNA, 18 bp, synthetic construct
  source 1..18: mol_type = other DNA
tatttcgactcactatac

SEQ ID NO: 1656 - DNA, 18 bp, synthetic construct
  source 1..18: mol_type = other DNA
tcatacgacacactataa

SEQ ID NO: 1657 - DNA, 18 bp, synthetic construct
  source 1..18: mol_type = other DNA
tcatacgacacactatac

SEQ ID NO: 1658 - DNA, 18 bp, synthetic construct
  source 1..18: mol_type = other DNA
tcatacgactcactaaac

SEQ ID NO: 1659 - DNA, 18 bp, synthetic construct
  source 1..18: mol_type = other DNA
tgatacgactcacaataa

SEQ ID NO: 1660 - DNA, 18 bp, synthetic construct
  source 1..18: mol_type = other DNA
tgatacgactcatgatag

SEQ ID NO: 1661 - DNA, 18 bp, synthetic construct
  source 1..18: mol_type = other DNA
tgttacgactcactatat

SEQ ID NO: 1662 - DNA, 18 bp, synthetic construct
  source 1..18: mol_type = other DNA
ttatacgactccctataa

SEQ ID NO: 1663 - DNA, 18 bp, synthetic construct
  source 1..18: mol_type = other DNA
ttatacgactcgctatat

SEQ ID NO: 1664 - DNA, 18 bp, synthetic construct
  source 1..18: mol_type = other DNA
ttatacgactctctatac

SEQ ID NO: 1665 - DNA, 18 bp, synthetic construct
  source 1..18: mol_type = other DNA
ttatacgcctcactataa

SEQ ID NO: 1666 - DNA, 18 bp, synthetic construct
  source 1..18: mol_type = other DNA
ttatacggctcactatat

SEQ ID NO: 1667 - DNA, 18 bp, synthetic construct
  source 1..18: mol_type = other DNA
ttatatgactcactatac

SEQ ID NO: 1668 - DNA, 18 bp, synthetic construct
  source 1..18: mol_type = other DNA
ttattcgactcactatac

SEQ ID NO: 1669 - DNA, 18 bp, synthetic construct
  source 1..18: mol_type = other DNA
taatgcgactcacttaag

SEQ ID NO: 1670 - DNA, 18 bp, synthetic construct
  source 1..18: mol_type = other DNA
aaatacgactcgctattg

SEQ ID NO: 1671 - DNA, 18 bp, synthetic construct
  source 1..18: mol_type = other DNA
taatagaactcactttag

SEQ ID NO: 1672 - DNA, 18 bp, synthetic construct
  source 1..18: mol_type = other DNA
tattgcgactccctatag

SEQ ID NO: 1673 - DNA, 18 bp, synthetic construct
  source 1..18: mol_type = other DNA
ttatgcgtctcactatag

SEQ ID NO: 1674 - DNA, 18 bp, synthetic construct
  source 1..18: mol_type = other DNA
tcatacgactcgctattg

SEQ ID NO: 1675 - DNA, 18 bp, synthetic construct
  source 1..18: mol_type = other DNA
taatacgactcgctttcg

SEQ ID NO: 1676 - DNA, 18 bp, synthetic construct
  source 1..18: mol_type = other DNA
taatacgcatcactattg

SEQ ID NO: 1677 - DNA, 18 bp, synthetic construct
  source 1..18: mol_type = other DNA
taatacggctcactactg

SEQ ID NO: 1678 - DNA, 18 bp, synthetic construct
  source 1..18: mol_type = other DNA
taaagcgactcactctag

SEQ ID NO: 1679 - DNA, 18 bp, synthetic construct
  source 1..18: mol_type = other DNA
taataagactcgccatag

SEQ ID NO: 1680 - DNA, 18 bp, synthetic construct
  source 1..18: mol_type = other DNA
taatgcgactcacactag

SEQ ID NO: 1681 - DNA, 18 bp, synthetic construct
  source 1..18: mol_type = other DNA
taataggactcagtctag

SEQ ID NO: 1682 - DNA, 18 bp, synthetic construct
  source 1..18: mol_type = other DNA
taataggactcactcttg

SEQ ID NO: 1683 - DNA, 18 bp, synthetic construct
  source 1..18: mol_type = other DNA
taaaacgcctcactatcg

SEQ ID NO: 1684 - DNA, 18 bp, synthetic construct
  source 1..18: mol_type = other DNA
ctctacgactcactatag

SEQ ID NO: 1685 - DNA, 18 bp, synthetic construct
  source 1..18: mol_type = other DNA
tattacgactcgctctag

SEQ ID NO: 1686 - DNA, 18 bp, synthetic construct
  source 1..18: mol_type = other DNA
taatgcaactcactttag

SEQ ID NO: 1687 - DNA, 18 bp, synthetic construct
  source 1..18: mol_type = other DNA
taatacgcgtcactctag

SEQ ID NO: 1688 - DNA, 18 bp, synthetic construct
  source 1..18: mol_type = other DNA
taatacgtgtcactattg

SEQ ID NO: 1689 - DNA, 18 bp, synthetic construct
  source 1..18: mol_type = other DNA
taatagaactcgctatag

SEQ ID NO: 1690 - DNA, 18 bp, synthetic construct
  source 1..18: mol_type = other DNA
taatacgactcactggtg

SEQ ID NO: 1691 - DNA, 18 bp, synthetic construct
  source 1..18: mol_type = other DNA
taatccgcctcactctag

SEQ ID NO: 1692 - DNA, 18 bp, synthetic construct
  source 1..18: mol_type = other DNA
tgatgcgactcactacag

SEQ ID NO: 1693 - DNA, 18 bp, synthetic construct
  source 1..18: mol_type = other DNA
taatgcaactcactaaag

SEQ ID NO: 1694 - DNA, 18 bp, synthetic construct
  source 1..18: mol_type = other DNA
tgatgcgactcactattg

SEQ ID NO: 1695 - DNA, 18 bp, synthetic construct
  source 1..18: mol_type = other DNA
taaaccgactcactaaag

SEQ ID NO: 1696 - DNA, 18 bp, synthetic construct
  source 1..18: mol_type = other DNA
ttatacggctcactatcg

SEQ ID NO: 1697 - DNA, 18 bp, synthetic construct
  source 1..18: mol_type = other DNA
taatacgtcccactctag

SEQ ID NO: 1698 - DNA, 18 bp, synthetic construct
  source 1..18: mol_type = other DNA
taattggactcactgtag

SEQ ID NO: 1699 - DNA, 18 bp, synthetic construct
  source 1..18: mol_type = other DNA
tgatgcgcctcactatag

SEQ ID NO: 1700 - DNA, 18 bp, synthetic construct
  source 1..18: mol_type = other DNA
taaagcgactcactattg

SEQ ID NO: 1701 - DNA, 18 bp, synthetic construct
  source 1..18: mol_type = other DNA
aaatagaactcactatag

SEQ ID NO: 1702 - DNA, 18 bp, synthetic construct
  source 1..18: mol_type = other DNA
ttatacgactcaccatcg

SEQ ID NO: 1703 - DNA, 18 bp, synthetic construct
  source 1..18: mol_type = other DNA
taatccgactcattatgg

SEQ ID NO: 1704 - DNA, 18 bp, synthetic construct
  source 1..18: mol_type = other DNA
tgataagactcactatgg

SEQ ID NO: 1705 - DNA, 18 bp, synthetic construct
  source 1..18: mol_type = other DNA
tattaagactcactagag

SEQ ID NO: 1706 - DNA, 18 bp, synthetic construct
  source 1..18: mol_type = other DNA
taatgcaactccctatag

SEQ ID NO: 1707 - DNA, 18 bp, synthetic construct
  source 1..18: mol_type = other DNA
gaatacgactctctacag

SEQ ID NO: 1708 - DNA, 18 bp, synthetic construct
  source 1..18: mol_type = other DNA
taatgcaactcactctag

SEQ ID NO: 1709 - DNA, 18 bp, synthetic construct
  source 1..18: mol_type = other DNA
taatatgacgcactacag

SEQ ID NO: 1710 - DNA, 18 bp, synthetic construct
  source 1..18: mol_type = other DNA
taataggactcgctattg

SEQ ID NO: 1711 - DNA, 18 bp, synthetic construct
  source 1..18: mol_type = other DNA
tatcgcgactcactatag

SEQ ID NO: 1712 - DNA, 18 bp, synthetic construct
  source 1..18: mol_type = other DNA
taatacgtctcactactg

SEQ ID NO: 1713 - DNA, 18 bp, synthetic construct
  source 1..18: mol_type = other DNA
taataggactcagaatag

SEQ ID NO: 1714 - DNA, 18 bp, synthetic construct
  source 1..18: mol_type = other DNA
taatacgactcactcccg

SEQ ID NO: 1715 - DNA, 18 bp, synthetic construct
  source 1..18: mol_type = other DNA
taaaacgcctcactaaag

SEQ ID NO: 1716 - DNA, 18 bp, synthetic construct
  source 1..18: mol_type = other DNA
ctatacgactcactgtag

SEQ ID NO: 1717 - DNA, 18 bp, synthetic construct
  source 1..18: mol_type = other DNA
tactacgtctcactctag

SEQ ID NO: 1718 - DNA, 18 bp, synthetic construct
  source 1..18: mol_type = other DNA
taattcaactcgctatag

SEQ ID NO: 1719 - DNA, 18 bp, synthetic construct
  source 1..18: mol_type = other DNA
aaaaacgcctcactatag

SEQ ID NO: 1720 - DNA, 18 bp, synthetic construct
  source 1..18: mol_type = other DNA
tactacgactcgctacag

SEQ ID NO: 1721 - DNA, 18 bp, synthetic construct
  source 1..18: mol_type = other DNA
tgatacgactcaatctag

SEQ ID NO: 1722 - DNA, 18 bp, synthetic construct
  source 1..18: mol_type = other DNA
aaatacaactcactagag

SEQ ID NO: 1723 - DNA, 18 bp, synthetic construct
  source 1..18: mol_type = other DNA
taatacgacccacttgag

SEQ ID NO: 1724 - DNA, 18 bp, synthetic construct
  source 1..18: mol_type = other DNA
ttattcggctcactatag

SEQ ID NO: 1725 - DNA, 18 bp, synthetic construct
  source 1..18: mol_type = other DNA
ttttacgactcactctag

SEQ ID NO: 1726 - DNA, 18 bp, synthetic construct
  source 1..18: mol_type = other DNA
taatacgcatcactttag

SEQ ID NO: 1727 - DNA, 18 bp, synthetic construct
  source 1..18: mol_type = other DNA
aaatacgactcacactag

SEQ ID NO: 1728 - DNA, 18 bp, synthetic construct
  source 1..18: mol_type = other DNA
gtatgcgactcactatag

SEQ ID NO: 1729 - DNA, 18 bp, synthetic construct
  source 1..18: mol_type = other DNA
taatacaactcactaccg

SEQ ID NO: 1730 - DNA, 18 bp, synthetic construct
  source 1..18: mol_type = other DNA
ttatacgacgcactatcg

SEQ ID NO: 1731 - DNA, 18 bp, synthetic construct
  source 1..18: mol_type = other DNA
taatacggctcactctcg

SEQ ID NO: 1732 - DNA, 18 bp, synthetic construct
  source 1..18: mol_type = other DNA
taatgcgactcggtatag

SEQ ID NO: 1733 - DNA, 18 bp, synthetic construct
  source 1..18: mol_type = other DNA
taacacgactcgctattg

SEQ ID NO: 1734 - DNA, 18 bp, synthetic construct
  source 1..18: mol_type = other DNA
taatacgacacaccatcg

SEQ ID NO: 1735 - DNA, 18 bp, synthetic construct
  source 1..18: mol_type = other DNA
tattgcgcctcactatag

SEQ ID NO: 1736 - DNA, 18 bp, synthetic construct
  source 1..18: mol_type = other DNA
taatgcgactcgctctag

SEQ ID NO: 1737 - DNA, 18 bp, synthetic construct
  source 1..18: mol_type = other DNA
taatgcgtctcactagag

SEQ ID NO: 1738 - DNA, 18 bp, synthetic construct
  source 1..18: mol_type = other DNA
taattcggctcgctatag

SEQ ID NO: 1739 - DNA, 18 bp, synthetic construct
  source 1..18: mol_type = other DNA
taaaacaactcactctag

SEQ ID NO: 1740 - DNA, 18 bp, synthetic construct
  source 1..18: mol_type = other DNA
taatacgactcacccaag

SEQ ID NO: 1741 - DNA, 18 bp, synthetic construct
  source 1..18: mol_type = other DNA
taatgcgactcacttttg

SEQ ID NO: 1742 - DNA, 18 bp, synthetic construct
  source 1..18: mol_type = other DNA
agctacgactcactatag

SEQ ID NO: 1743 - DNA, 18 bp, synthetic construct
  source 1..18: mol_type = other DNA
taatgcgcctcactttag

SEQ ID NO: 1744 - DNA, 18 bp, synthetic construct
  source 1..18: mol_type = other DNA
ttaaacgactcgctatag

SEQ ID NO: 1745 - DNA, 18 bp, synthetic construct
  source 1..18: mol_type = other DNA
taattagactcagtatag

SEQ ID NO: 1746 - DNA, 18 bp, synthetic construct
  source 1..18: mol_type = other DNA
cagtacgactcactttag

SEQ ID NO: 1747 - DNA, 18 bp, synthetic construct
  source 1..18: mol_type = other DNA
taatccgactcactaccg

SEQ ID NO: 1748 - DNA, 18 bp, synthetic construct
  source 1..18: mol_type = other DNA
gaattcgactcactatcg

SEQ ID NO: 1749 - DNA, 18 bp, synthetic construct
  source 1..18: mol_type = other DNA
taataggactcactggag

SEQ ID NO: 1750 - DNA, 18 bp, synthetic construct
  source 1..18: mol_type = other DNA
tagtactactcactgtag

SEQ ID NO: 1751 - DNA, 18 bp, synthetic construct
  source 1..18: mol_type = other DNA
taatgcgtctcactattg

SEQ ID NO: 1752 - DNA, 18 bp, synthetic construct
  source 1..18: mol_type = other DNA
taatacaactcgctattg

SEQ ID NO: 1753 - DNA, 18 bp, synthetic construct
  source 1..18: mol_type = other DNA
taataggactcactactg

SEQ ID NO: 1754 - DNA, 18 bp, synthetic construct
  source 1..18: mol_type = other DNA
taattcgactcactgtcg

SEQ ID NO: 1755 - DNA, 18 bp, synthetic construct
  source 1..18: mol_type = other DNA
tcattcgactcactatcg

SEQ ID NO: 1756 - DNA, 18 bp, synthetic construct
  source 1..18: mol_type = other DNA
caaaaggactcactatag

SEQ ID NO: 1757 - DNA, 18 bp, synthetic construct
  source 1..18: mol_type = other DNA
taatacaactcactactg

SEQ ID NO: 1758 - DNA, 18 bp, synthetic construct
  source 1..18: mol_type = other DNA
taatacgtctcgctattg

SEQ ID NO: 1759 - DNA, 18 bp, synthetic construct
  source 1..18: mol_type = other DNA
taattcgcctcactctag

SEQ ID NO: 1760 - DNA, 18 bp, synthetic construct
  source 1..18: mol_type = other DNA
taagacgaatcactctag

SEQ ID NO: 1761 - DNA, 18 bp, synthetic construct
  source 1..18: mol_type = other DNA
taaagcgactcactatcg

SEQ ID NO: 1762 - DNA, 18 bp, synthetic construct
  source 1..18: mol_type = other DNA
taatacgactagctatcg

SEQ ID NO: 1763 - DNA, 18 bp, synthetic construct
  source 1..18: mol_type = other DNA
taacacgcctcactaaag

SEQ ID NO: 1764 - DNA, 18 bp, synthetic construct
  source 1..18: mol_type = other DNA
taataagacgcactatcg

SEQ ID NO: 1765 - DNA, 18 bp, synthetic construct
  source 1..18: mol_type = other DNA
taatacgcctcactcaag

SEQ ID NO: 1766 - DNA, 18 bp, synthetic construct
  source 1..18: mol_type = other DNA
taatagaactcaccatag

SEQ ID NO: 1767 - DNA, 18 bp, synthetic construct
  source 1..18: mol_type = other DNA
taatccaactcactatcg

SEQ ID NO: 1768 - DNA, 18 bp, synthetic construct
  source 1..18: mol_type = other DNA
aaattcgactcactgtag

SEQ ID NO: 1769 - DNA, 18 bp, synthetic construct
  source 1..18: mol_type = other DNA
tattacgcgtcactatag

SEQ ID NO: 1770 - DNA, 18 bp, synthetic construct
  source 1..18: mol_type = other DNA
tattgcgactcactttag

SEQ ID NO: 1771 - DNA, 18 bp, synthetic construct
  source 1..18: mol_type = other DNA
tattacgcctcactctag

SEQ ID NO: 1772 - DNA, 18 bp, synthetic construct
  source 1..18: mol_type = other DNA
aaatgcgactcactaaag

SEQ ID NO: 1773 - DNA, 18 bp, synthetic construct
  source 1..18: mol_type = other DNA
aaatgcgactcactacag

SEQ ID NO: 1774 - DNA, 18 bp, synthetic construct
  source 1..18: mol_type = other DNA
taatacgactcgctcaag

SEQ ID NO: 1775 - DNA, 18 bp, synthetic construct
  source 1..18: mol_type = other DNA
ttatacgcatcactatag

SEQ ID NO: 1776 - DNA, 18 bp, synthetic construct
  source 1..18: mol_type = other DNA
ttataggactcactacag

SEQ ID NO: 1777 - DNA, 18 bp, synthetic construct
  source 1..18: mol_type = other DNA
taatacgagtcactgttg

SEQ ID NO: 1778 - DNA, 18 bp, synthetic construct
  source 1..18: mol_type = other DNA
ttaaacgactcactgtag

SEQ ID NO: 1779 - DNA, 18 bp, synthetic construct
  source 1..18: mol_type = other DNA
taattggactcgctatag

SEQ ID NO: 1780 - DNA, 18 bp, synthetic construct
  source 1..18: mol_type = other DNA
caatacacctcactatag

SEQ ID NO: 1781 - DNA, 18 bp, synthetic construct
  source 1..18: mol_type = other DNA
caataggactcactctag

SEQ ID NO: 1782 - DNA, 18 bp, synthetic construct
  source 1..18: mol_type = other DNA
taataggactcgctacag

SEQ ID NO: 1783 - DNA, 18 bp, synthetic construct
  source 1..18: mol_type = other DNA
taaaacgtctcactagag

SEQ ID NO: 1784 - DNA, 18 bp, synthetic construct
  source 1..18: mol_type = other DNA
cattatgactcactatag

SEQ ID NO: 1785 - DNA, 18 bp, synthetic construct
  source 1..18: mol_type = other DNA
aaataggactcactaaag

SEQ ID NO: 1786 - DNA, 18 bp, synthetic construct
  source 1..18: mol_type = other DNA
taatacgactcgctaacg

SEQ ID NO: 1787 - DNA, 18 bp, synthetic construct
  source 1..18: mol_type = other DNA
ttataggactcactttag

SEQ ID NO: 1788 - DNA, 18 bp, synthetic construct
  source 1..18: mol_type = other DNA
caaaacgactcgctatag

SEQ ID NO: 1789 - DNA, 18 bp, synthetic construct
  source 1..18: mol_type = other DNA
taatgcgactcactcaag

SEQ ID NO: 1790 - DNA, 18 bp, synthetic construct
  source 1..18: mol_type = other DNA
caatgcgactcactatcg

SEQ ID NO: 1791 - DNA, 18 bp, synthetic construct
  source 1..18: mol_type = other DNA
taatacaactcactagtg

SEQ ID NO: 1792 - DNA, 18 bp, synthetic construct
  source 1..18: mol_type = other DNA
tgatttgactcactatag

SEQ ID NO: 1793 - DNA, 18 bp, synthetic construct
  source 1..18: mol_type = other DNA
tattatgactcactgtag

SEQ ID NO: 1794 - DNA, 18 bp, synthetic construct
  source 1..18: mol_type = other DNA
tgaagcgactcactatag

SEQ ID NO: 1795 - DNA, 18 bp, synthetic construct
  source 1..18: mol_type = other DNA
caatacgactcgctacag

SEQ ID NO: 1796 - DNA, 18 bp, synthetic construct
  source 1..18: mol_type = other DNA
taaatcgactcactctag

SEQ ID NO: 1797 - DNA, 18 bp, synthetic construct
  source 1..18: mol_type = other DNA
ttatacgcctcactattg

SEQ ID NO: 1798 - DNA, 18 bp, synthetic construct
  source 1..18: mol_type = other DNA
taatacgactgcctattg

SEQ ID NO: 1799 - DNA, 18 bp, synthetic construct
  source 1..18: mol_type = other DNA
taataggactcacttttg

SEQ ID NO: 1800 - DNA, 18 bp, synthetic construct
  source 1..18: mol_type = other DNA
taatcggactctctatag

SEQ ID NO: 1801 - DNA, 18 bp, synthetic construct
  source 1..18: mol_type = other DNA
taatacgcttcagtatag

SEQ ID NO: 1802 - DNA, 18 bp, synthetic construct
  source 1..18: mol_type = other DNA
taatacgaatctctgtag

SEQ ID NO: 1803 - DNA, 18 bp, synthetic construct
  source 1..18: mol_type = other DNA
tattgcgactcactgtag

SEQ ID NO: 1804 - DNA, 18 bp, synthetic construct
  source 1..18: mol_type = other DNA
caatacgactcgctatcg

SEQ ID NO: 1805 - DNA, 18 bp, synthetic construct
  source 1..18: mol_type = other DNA
taacgcgactcactctag

SEQ ID NO: 1806 - DNA, 18 bp, synthetic construct
  source 1..18: mol_type = other DNA
ttttacgcctcactatag

SEQ ID NO: 1807 - DNA, 18 bp, synthetic construct
  source 1..18: mol_type = other DNA
tgaatcgactcactatag

SEQ ID NO: 1808 - DNA, 18 bp, synthetic construct
  source 1..18: mol_type = other DNA
taaaacgcctcactatgg

SEQ ID NO: 1809 - DNA, 18 bp, synthetic construct
  source 1..18: mol_type = other DNA
caatgcgactcactagag

SEQ ID NO: 1810 - DNA, 18 bp, synthetic construct
  source 1..18: mol_type = other DNA
taacgcgactcactaaag

SEQ ID NO: 1811 - DNA, 18 bp, synthetic construct
  source 1..18: mol_type = other DNA
caaaacgactcactctag

SEQ ID NO: 1812 - DNA, 18 bp, synthetic construct
  source 1..18: mol_type = other DNA
caattcgactcactgtag

SEQ ID NO: 1813 - DNA, 18 bp, synthetic construct
  source 1..18: mol_type = other DNA
tattccgcctcactatag

SEQ ID NO: 1814 - DNA, 18 bp, synthetic construct
  source 1..18: mol_type = other DNA
tatttcgcctcactatag

SEQ ID NO: 1815 - DNA, 18 bp, synthetic construct
  source 1..18: mol_type = other DNA
taattcggctcactatgg

SEQ ID NO: 1816 - DNA, 18 bp, synthetic construct
  source 1..18: mol_type = other DNA
tgataagactcactaaag

SEQ ID NO: 1817 - DNA, 18 bp, synthetic construct
  source 1..18: mol_type = other DNA
aaaggcgactcactatag

SEQ ID NO: 1818 - DNA, 18 bp, synthetic construct
  source 1..18: mol_type = other DNA
ctatacgactcactacag

SEQ ID NO: 1819 - DNA, 18 bp, synthetic construct
  source 1..18: mol_type = other DNA
taatagaactcactctag

SEQ ID NO: 1820 - DNA, 18 bp, synthetic construct
  source 1..18: mol_type = other DNA
ttaaacgactcactacag

SEQ ID NO: 1821 - DNA, 18 bp, synthetic construct
  source 1..18: mol_type = other DNA
taaaacaactcactgtag

SEQ ID NO: 1822 - DNA, 18 bp, synthetic construct
  source 1..18: mol_type = other DNA
ttataggactcactctag

SEQ ID NO: 1823 - DNA, 18 bp, synthetic construct
  source 1..18: mol_type = other DNA
tattaggactcactatcg

SEQ ID NO: 1824 - DNA, 18 bp, synthetic construct
  source 1..18: mol_type = other DNA
taaaacgactcagtctag

SEQ ID NO: 1825 - DNA, 18 bp, synthetic construct
  source 1..18: mol_type = other DNA
taaaaagactcactagag

SEQ ID NO: 1826 - DNA, 18 bp, synthetic construct
  source 1..18: mol_type = other DNA
taacacgactcgctatcg

SEQ ID NO: 1827 - DNA, 18 bp, synthetic construct
  source 1..18: mol_type = other DNA
taataagcctcactatgg

SEQ ID NO: 1828 - DNA, 18 bp, synthetic construct
  source 1..18: mol_type = other DNA
gaatacaactcactatgg

SEQ ID NO: 1829 - DNA, 18 bp, synthetic construct
  source 1..18: mol_type = other DNA
gaattcgactcactgtag

SEQ ID NO: 1830 - DNA, 18 bp, synthetic construct
  source 1..18: mol_type = other DNA
gactaggactcactatag

SEQ ID NO: 1831 - DNA, 18 bp, synthetic construct
  source 1..18: mol_type = other DNA
taaaacgcctcactatat

SEQ ID NO: 1832 - DNA, 18 bp, synthetic construct
  source 1..18: mol_type = other DNA
taataagagtgactatag

SEQ ID NO: 1833 - DNA, 18 bp, synthetic construct
  source 1..18: mol_type = other DNA
taatacgaatcactctcg

SEQ ID NO: 1834 - DNA, 18 bp, synthetic construct
  source 1..18: mol_type = other DNA
taatacgactatctataa

SEQ ID NO: 1835 - DNA, 18 bp, synthetic construct
  source 1..18: mol_type = other DNA
taatacgattcattataa

SEQ ID NO: 1836 - DNA, 18 bp, synthetic construct
  source 1..18: mol_type = other DNA
taatacgtatcactagag

SEQ ID NO: 1837 - DNA, 18 bp, synthetic construct
  source 1..18: mol_type = other DNA
taatgcgactcacgttag

SEQ ID NO: 1838 - DNA, 18 bp, synthetic construct
  source 1..18: mol_type = other DNA
tgagacgactcacgatag

SEQ ID NO: 1839 - DNA, 18 bp, synthetic construct
  source 1..18: mol_type = other DNA
taataggactcacttcag

SEQ ID NO: 1840 - DNA, 18 bp, synthetic construct
  source 1..18: mol_type = other DNA
taatgcgactcaccaaag

SEQ ID NO: 1841 - DNA, 18 bp, synthetic construct
  source 1..18: mol_type = other DNA
taatttgactcactctag

SEQ ID NO: 1842 - DNA, 18 bp, synthetic construct
  source 1..18: mol_type = other DNA
taatgcaactcactgtag

SEQ ID NO: 1843 - DNA, 18 bp, synthetic construct
  source 1..18: mol_type = other DNA
tgatacgcctcactaaag

SEQ ID NO: 1844 - DNA, 18 bp, synthetic construct
  source 1..18: mol_type = other DNA
ttgtacgactcactctag

SEQ ID NO: 1845 - DNA, 18 bp, synthetic construct
  source 1..18: mol_type = other DNA
taataggactctgtatag

SEQ ID NO: 1846 - DNA, 18 bp, synthetic construct
  source 1..18: mol_type = other DNA
tagtccgtctcactatag

SEQ ID NO: 1847 - DNA, 18 bp, synthetic construct
  source 1..18: mol_type = other DNA
tgatacgactcgctattg

SEQ ID NO: 1848 - DNA, 18 bp, synthetic construct
  source 1..18: mol_type = other DNA
tattaggactcagtatag

SEQ ID NO: 1849 - DNA, 18 bp, synthetic construct
  source 1..18: mol_type = other DNA
tcatgcgactcactatcg

SEQ ID NO: 1850 - DNA, 18 bp, synthetic construct
  source 1..18: mol_type = other DNA
taaagcgactcactagag

SEQ ID NO: 1851 - DNA, 18 bp, synthetic construct
  source 1..18: mol_type = other DNA
tattgcgactcactctag

SEQ ID NO: 1852 - DNA, 18 bp, synthetic construct
  source 1..18: mol_type = other DNA
taatacgactcactcgtg

SEQ ID NO: 1853 - DNA, 18 bp, synthetic construct
  source 1..18: mol_type = other DNA
taataggactcactaacg

SEQ ID NO: 1854 - DNA, 18 bp, synthetic construct
  source 1..18: mol_type = other DNA
ttatacggctcgctatag

SEQ ID NO: 1855 - DNA, 18 bp, synthetic construct
  source 1..18: mol_type = other DNA
taattagactcactctag

SEQ ID NO: 1856 - DNA, 18 bp, synthetic construct
  source 1..18: mol_type = other DNA
aaatacgactcactccag

SEQ ID NO: 1857 - DNA, 18 bp, synthetic construct
  source 1..18: mol_type = other DNA
taatacgcctcgctacag

SEQ ID NO: 1858 - DNA, 18 bp, synthetic construct
  source 1..18: mol_type = other DNA
caatacgactcacgaaag

SEQ ID NO: 1859 - DNA, 18 bp, synthetic construct
  source 1..18: mol_type = other DNA
taattcgactcaggatag

SEQ ID NO: 1860 - DNA, 18 bp, synthetic construct
  source 1..18: mol_type = other DNA
tgatgcgactcactatcg

SEQ ID NO: 1861 - DNA, 18 bp, synthetic construct
  source 1..18: mol_type = other DNA
ttatacgactcgctttag

SEQ ID NO: 1862 - DNA, 18 bp, synthetic construct
  source 1..18: mol_type = other DNA
taattggactcactctag

SEQ ID NO: 1863 - DNA, 18 bp, synthetic construct
  source 1..18: mol_type = other DNA
caatacgactcacttcag

SEQ ID NO: 1864 - DNA, 18 bp, synthetic construct
  source 1..18: mol_type = other DNA
taatacgcctcaccatgg

SEQ ID NO: 1865 - DNA, 18 bp, synthetic construct
  source 1..18: mol_type = other DNA
taattcgcctcgctatag

SEQ ID NO: 1866 - DNA, 18 bp, synthetic construct
  source 1..18: mol_type = other DNA
cagtacgacacactatag

SEQ ID NO: 1867 - DNA, 18 bp, synthetic construct
  source 1..18: mol_type = other DNA
taatacgcctcactaagg

SEQ ID NO: 1868 - DNA, 18 bp, synthetic construct
  source 1..18: mol_type = other DNA
taacacgactcgctctag

SEQ ID NO: 1869 - DNA, 18 bp, synthetic construct
  source 1..18: mol_type = other DNA
taataagactcagtacag

SEQ ID NO: 1870 - DNA, 18 bp, synthetic construct
  source 1..18: mol_type = other DNA
taatcggactcactttag

SEQ ID NO: 1871 - DNA, 18 bp, synthetic construct
  source 1..18: mol_type = other DNA
taaaaggactcactacag

SEQ ID NO: 1872 - DNA, 18 bp, synthetic construct
  source 1..18: mol_type = other DNA
taataggtctcactctag

SEQ ID NO: 1873 - DNA, 18 bp, synthetic construct
  source 1..18: mol_type = other DNA
tattaggactcactttag

SEQ ID NO: 1874 - DNA, 18 bp, synthetic construct
  source 1..18: mol_type = other DNA
tgaaacgactcactacag

SEQ ID NO: 1875 - DNA, 18 bp, synthetic construct
  source 1..18: mol_type = other DNA
tattaggactcactaaag

SEQ ID NO: 1876 - DNA, 18 bp, synthetic construct
  source 1..18: mol_type = other DNA
taatacgactcaccactg

SEQ ID NO: 1877 - DNA, 18 bp, synthetic construct
  source 1..18: mol_type = other DNA
taatacgcatcactaaag

SEQ ID NO: 1878 - DNA, 18 bp, synthetic construct
  source 1..18: mol_type = other DNA
tattgcgactcactacag

SEQ ID NO: 1879 - DNA, 18 bp, synthetic construct
  source 1..18: mol_type = other DNA
taatacaactcactccag

SEQ ID NO: 1880 - DNA, 18 bp, synthetic construct
  source 1..18: mol_type = other DNA
gtatacgactcactctag

SEQ ID NO: 1881 - DNA, 18 bp, synthetic construct
  source 1..18: mol_type = other DNA
gaataggactcactctag

SEQ ID NO: 1882 - DNA, 18 bp, synthetic construct
  source 1..18: mol_type = other DNA
taataggcctcactacag

SEQ ID NO: 1883 - DNA, 18 bp, synthetic construct
  source 1..18: mol_type = other DNA
taatccgactcactccag

SEQ ID NO: 1884 - DNA, 18 bp, synthetic construct
  source 1..18: mol_type = other DNA
taatgcgactcacattag

SEQ ID NO: 1885 - DNA, 18 bp, synthetic construct
  source 1..18: mol_type = other DNA
tattacgactcaccatcg

SEQ ID NO: 1886 - DNA, 18 bp, synthetic construct
  source 1..18: mol_type = other DNA
taatccgactcactcaag

SEQ ID NO: 1887 - DNA, 18 bp, synthetic construct
  source 1..18: mol_type = other DNA
ccaaacgactcactatag

SEQ ID NO: 1888 - DNA, 18 bp, synthetic construct
  source 1..18: mol_type = other DNA
ttattcgcctcactatag

SEQ ID NO: 1889 - DNA, 18 bp, synthetic construct
  source 1..18: mol_type = other DNA
ttttacgactcactatcg

SEQ ID NO: 1890 - DNA, 18 bp, synthetic construct
  source 1..18: mol_type = other DNA
ttatgcgactcactagag

SEQ ID NO: 1891 - DNA, 18 bp, synthetic construct
  source 1..18: mol_type = other DNA
taattcaactcactctag

SEQ ID NO: 1892 - DNA, 18 bp, synthetic construct
  source 1..18: mol_type = other DNA
aaattcgactcactatcg

SEQ ID NO: 1893 - DNA, 18 bp, synthetic construct
  source 1..18: mol_type = other DNA
taaaacgactcaggatag

SEQ ID NO: 1894 - DNA, 18 bp, synthetic construct
  source 1..18: mol_type = other DNA
taattcggctcactaaag

SEQ ID NO: 1895 - DNA, 18 bp, synthetic construct
  source 1..18: mol_type = other DNA
taatccgactcgctacag

SEQ ID NO: 1896 - DNA, 18 bp, synthetic construct
  source 1..18: mol_type = other DNA
taatccgcctcactaaag

SEQ ID NO: 1897 - DNA, 18 bp, synthetic construct
  source 1..18: mol_type = other DNA
taatgcgactcactcttg

SEQ ID NO: 1898 - DNA, 18 bp, synthetic construct
  source 1..18: mol_type = other DNA
taatacgcctcacttaag

SEQ ID NO: 1899 - DNA, 18 bp, synthetic construct
  source 1..18: mol_type = other DNA
ttatacggctcactattg

SEQ ID NO: 1900 - DNA, 18 bp, synthetic construct
  source 1..18: mol_type = other DNA
tattgcgactcagtatag

SEQ ID NO: 1901 - DNA, 18 bp, synthetic construct
  source 1..18: mol_type = other DNA
taatacgactcgcaatcg

SEQ ID NO: 1902 - DNA, 18 bp, synthetic construct
  source 1..18: mol_type = other DNA
taatacgactcgctagtg

SEQ ID NO: 1903 - DNA, 18 bp, synthetic construct
  source 1..18: mol_type = other DNA
taatctgactcactatgg

SEQ ID NO: 1904 - DNA, 18 bp, synthetic construct
  source 1..18: mol_type = other DNA
taatgcgacgcgctatag

SEQ ID NO: 1905 - DNA, 18 bp, synthetic construct
  source 1..18: mol_type = other DNA
gaatctgactcactatag

SEQ ID NO: 1906 - DNA, 18 bp, synthetic construct
  source 1..18: mol_type = other DNA
taataagactcactcttg

SEQ ID NO: 1907 - DNA, 18 bp, synthetic construct
  source 1..18: mol_type = other DNA
aaattcgactcactattg

SEQ ID NO: 1908 - DNA, 18 bp, synthetic construct
  source 1..18: mol_type = other DNA
taatacaactcagtaaag

SEQ ID NO: 1909 - DNA, 18 bp, synthetic construct
  source 1..18: mol_type = other DNA
taaaaagactcactctag

SEQ ID NO: 1910 - DNA, 18 bp, synthetic construct
  source 1..18: mol_type = other DNA
taatacgcctcactaatg

SEQ ID NO: 1911 - DNA, 18 bp, synthetic construct
  source 1..18: mol_type = other DNA
caatgtgactcactatag

SEQ ID NO: 1912 - DNA, 18 bp, synthetic construct
  source 1..18: mol_type = other DNA
taaaaggactcactctag

SEQ ID NO: 1913 - DNA, 18 bp, synthetic construct
  source 1..18: mol_type = other DNA
taatacgacgctccatag

SEQ ID NO: 1914 - DNA, 18 bp, synthetic construct
  source 1..18: mol_type = other DNA
taattagactcgctatag

SEQ ID NO: 1915 - DNA, 18 bp, synthetic construct
  source 1..18: mol_type = other DNA
caatacgactcactctcg

SEQ ID NO: 1916 - DNA, 18 bp, synthetic construct
  source 1..18: mol_type = other DNA
taacgcgactcactttag

SEQ ID NO: 1917 - DNA, 18 bp, synthetic construct
  source 1..18: mol_type = other DNA
taatcggactcactatcg

SEQ ID NO: 1918 - DNA, 18 bp, synthetic construct
  source 1..18: mol_type = other DNA
tataacgcctcactatag

SEQ ID NO: 1919 - DNA, 18 bp, synthetic construct
  source 1..18: mol_type = other DNA
taattcgcctcactaaag

SEQ ID NO: 1920 - DNA, 18 bp, synthetic construct
  source 1..18: mol_type = other DNA
ttatagaactcactatag

SEQ ID NO: 1921 - DNA, 18 bp, synthetic construct
  source 1..18: mol_type = other DNA
taaaaggactcagtatag

SEQ ID NO: 1922 - DNA, 18 bp, synthetic construct
  source 1..18: mol_type = other DNA
gaatgcgattcactatag

SEQ ID NO: 1923 - DNA, 18 bp, synthetic construct
  source 1..18: mol_type = other DNA
taattcgcctcactagag

SEQ ID NO: 1924 - DNA, 18 bp, synthetic construct
  source 1..18: mol_type = other DNA
taatacgactcagtgaag

SEQ ID NO: 1925 - DNA, 18 bp, synthetic construct
  source 1..18: mol_type = other DNA
aaatgcgactcactatgg

SEQ ID NO: 1926 - DNA, 18 bp, synthetic construct
  source 1..18: mol_type = other DNA
taatgcgactcgctgtag

SEQ ID NO: 1927 - DNA, 18 bp, synthetic construct
  source 1..18: mol_type = other DNA
aaaaaggactcactatag

SEQ ID NO: 1928 - DNA, 18 bp, synthetic construct
  source 1..18: mol_type = other DNA
caatacgactcaccatgg

SEQ ID NO: 1929 - DNA, 18 bp, synthetic construct
  source 1..18: mol_type = other DNA
aaatacgactcgctatcg

SEQ ID NO: 1930 - DNA, 18 bp, synthetic construct
  source 1..18: mol_type = other DNA
gaattcgactcactattg

SEQ ID NO: 1931 - DNA, 18 bp, synthetic construct
  source 1..18: mol_type = other DNA
taacagaactcactatag

SEQ ID NO: 1932 - DNA, 18 bp, synthetic construct
  source 1..18: mol_type = other DNA
tagtacgacccactaaag

SEQ ID NO: 1933 - DNA, 18 bp, synthetic construct
  source 1..18: mol_type = other DNA
taatacgactcgctcttg

SEQ ID NO: 1934 - DNA, 18 bp, synthetic construct
  source 1..18: mol_type = other DNA
taaagcgtctcactatag

SEQ ID NO: 1935 - DNA, 18 bp, synthetic construct
  source 1..18: mol_type = other DNA
ttatgcgactcactattg

SEQ ID NO: 1936 - DNA, 18 bp, synthetic construct
  source 1..18: mol_type = other DNA
tattacgactcactcttg

SEQ ID NO: 1937 - DNA, 18 bp, synthetic construct
  source 1..18: mol_type = other DNA
aaatacgcatcactatag

SEQ ID NO: 1938 - DNA, 18 bp, synthetic construct
  source 1..18: mol_type = other DNA
aaatatgactcactgtag

SEQ ID NO: 1939 - DNA, 18 bp, synthetic construct
  source 1..18: mol_type = other DNA
taatgcgactcgctttag

SEQ ID NO: 1940 - DNA, 18 bp, synthetic construct
  source 1..18: mol_type = other DNA
taatccaactcactgtag

SEQ ID NO: 1941 - DNA, 18 bp, synthetic construct
  source 1..18: mol_type = other DNA
tattaagactcactctag

SEQ ID NO: 1942 - DNA, 18 bp, synthetic construct
  source 1..18: mol_type = other DNA
taataggactcagtttag

SEQ ID NO: 1943 - DNA, 18 bp, synthetic construct
  source 1..18: mol_type = other DNA
taatacgacacgctatcg

SEQ ID NO: 1944 - DNA, 18 bp, synthetic construct
  source 1..18: mol_type = other DNA
taatccgactcacactag

SEQ ID NO: 1945 - DNA, 18 bp, synthetic construct
  source 1..18: mol_type = other DNA
taatgcaacccactatag

SEQ ID NO: 1946 - DNA, 18 bp, synthetic construct
  source 1..18: mol_type = other DNA
taaaacgactcgctacag

SEQ ID NO: 1947 - DNA, 18 bp, synthetic construct
  source 1..18: mol_type = other DNA
taatataactcactattg

SEQ ID NO: 1948 - DNA, 18 bp, synthetic construct
  source 1..18: mol_type = other DNA
taattcgcctcactttag

SEQ ID NO: 1949 - DNA, 18 bp, synthetic construct
  source 1..18: mol_type = other DNA
tatttcgactcactgtag

SEQ ID NO: 1950 - DNA, 18 bp, synthetic construct
  source 1..18: mol_type = other DNA
taattcgactcacggtag

SEQ ID NO: 1951 - DNA, 18 bp, synthetic construct
  source 1..18: mol_type = other DNA
taaaaggactcactatcg

SEQ ID NO: 1952 - DNA, 18 bp, synthetic construct
  source 1..18: mol_type = other DNA
caattcgactcactacag

SEQ ID NO: 1953 - DNA, 18 bp, synthetic construct
  source 1..18: mol_type = other DNA
taattcgagtcactaaag

SEQ ID NO: 1954 - DNA, 18 bp, synthetic construct
  source 1..18: mol_type = other DNA
ttttccgactcactatag

SEQ ID NO: 1955 - DNA, 18 bp, synthetic construct
  source 1..18: mol_type = other DNA
tcatacgactcactactg

SEQ ID NO: 1956 - DNA, 18 bp, synthetic construct
  source 1..18: mol_type = other DNA
taattcgtctcactagag

SEQ ID NO: 1957 - DNA, 18 bp, synthetic construct
  source 1..18: mol_type = other DNA
taattggactcactacag

SEQ ID NO: 1958 - DNA, 18 bp, synthetic construct
  source 1..18: mol_type = other DNA
ctatgcgactcactatag

SEQ ID NO: 1959 - DNA, 18 bp, synthetic construct
  source 1..18: mol_type = other DNA
taataggactcactttcg

SEQ ID NO: 1960 - DNA, 18 bp, synthetic construct
  source 1..18: mol_type = other DNA
ttatacgactcaccattg

SEQ ID NO: 1961 - DNA, 18 bp, synthetic construct
  source 1..18: mol_type = other DNA
taatccgcctcactttag

SEQ ID NO: 1962 - DNA, 18 bp, synthetic construct
  source 1..18: mol_type = other DNA
cattacgactcactgtag

SEQ ID NO: 1963 - DNA, 18 bp, synthetic construct
  source 1..18: mol_type = other DNA
taaaacgactcactttgg

SEQ ID NO: 1964 - DNA, 18 bp, synthetic construct
  source 1..18: mol_type = other DNA
ttttacgactcactacag

SEQ ID NO: 1965 - DNA, 18 bp, synthetic construct
  source 1..18: mol_type = other DNA
taattggactcactaaag

SEQ ID NO: 1966 - DNA, 18 bp, synthetic construct
  source 1..18: mol_type = other DNA
taatacgactcagtcttg

SEQ ID NO: 1967 - DNA, 18 bp, synthetic construct
  source 1..18: mol_type = other DNA
taattcggctcactagag

SEQ ID NO: 1968 - DNA, 18 bp, synthetic construct
  source 1..18: mol_type = other DNA
tattaggactcactataa

SEQ ID NO: 1969 - DNA, 18 bp, synthetic construct
  source 1..18: mol_type = other DNA
caattagactcactatag

SEQ ID NO: 1970 - DNA, 18 bp, synthetic construct
  source 1..18: mol_type = other DNA
gaatacgcctcacaatag

SEQ ID NO: 1971 - DNA, 18 bp, synthetic construct
  source 1..18: mol_type = other DNA
taatacgactcggtaaag

SEQ ID NO: 1972 - DNA, 18 bp, synthetic construct
  source 1..18: mol_type = other DNA
aaatacgactcactagtg

SEQ ID NO: 1973 - DNA, 18 bp, synthetic construct
  source 1..18: mol_type = other DNA
tcataggacacactatag

SEQ ID NO: 1974 - DNA, 18 bp, synthetic construct
  source 1..18: mol_type = other DNA
tcataagactcactatgg

SEQ ID NO: 1975 - DNA, 18 bp, synthetic construct
  source 1..18: mol_type = other DNA
caatacgactcagtacag

SEQ ID NO: 1976 - DNA, 18 bp, synthetic construct
  source 1..18: mol_type = other DNA
gaatacgcctcactagag

SEQ ID NO: 1977 - DNA, 18 bp, synthetic construct
  source 1..18: mol_type = other DNA
taattcgagtcgctatag

SEQ ID NO: 1978 - DNA, 18 bp, synthetic construct
  source 1..18: mol_type = other DNA
taataggactcagtacag

SEQ ID NO: 1979 - DNA, 18 bp, synthetic construct
  source 1..18: mol_type = other DNA
cgatacgactcactagag

SEQ ID NO: 1980 - DNA, 18 bp, synthetic construct
  source 1..18: mol_type = other DNA
taatgagactcactatcg

SEQ ID NO: 1981 - DNA, 18 bp, synthetic construct
  source 1..18: mol_type = other DNA
aaatacgactcgctctag

SEQ ID NO: 1982 - DNA, 18 bp, synthetic construct
  source 1..18: mol_type = other DNA
caatacgactcaccaaag

SEQ ID NO: 1983 - DNA, 18 bp, synthetic construct
  source 1..18: mol_type = other DNA
caatacgactcagtgtag

SEQ ID NO: 1984 - DNA, 18 bp, synthetic construct
  source 1..18: mol_type = other DNA
taacacgcctcactatcg

SEQ ID NO: 1985 - DNA, 18 bp, synthetic construct
  source 1..18: mol_type = other DNA
taatacgactaactccag

SEQ ID NO: 1986 - DNA, 18 bp, synthetic construct
  source 1..18: mol_type = other DNA
taatacgactcaatttaa

SEQ ID NO: 1987 - DNA, 18 bp, synthetic construct
  source 1..18: mol_type = other DNA
taatacgactcacaaaat

SEQ ID NO: 1988 - DNA, 18 bp, synthetic construct
  source 1..18: mol_type = other DNA
taatacgactcacgagtg

SEQ ID NO: 1989 - DNA, 18 bp, synthetic construct
  source 1..18: mol_type = other DNA
taatacgactcacttaat

SEQ ID NO: 1990 - DNA, 18 bp, synthetic construct
  source 1..18: mol_type = other DNA
taatacgactccctgtcg

SEQ ID NO: 1991 - DNA, 18 bp, synthetic construct
  source 1..18: mol_type = other DNA
taatacgactcgcgatcg

SEQ ID NO: 1992 - DNA, 18 bp, synthetic construct
  source 1..18: mol_type = other DNA
taatacgactctctatga

SEQ ID NO: 1993 - DNA, 18 bp, synthetic construct
  source 1..18: mol_type = other DNA
taatacgagtccctctag

SEQ ID NO: 1994 - DNA, 18 bp, synthetic construct
  source 1..18: mol_type = other DNA
taatacggctgagtatag

SEQ ID NO: 1995 - DNA, 18 bp, synthetic construct
  source 1..18: mol_type = other DNA
taatacggtgcactatag

SEQ ID NO: 1996 - DNA, 18 bp, synthetic construct
  source 1..18: mol_type = other DNA
taatagggctcactttag

SEQ ID NO: 1997 - DNA, 18 bp, synthetic construct
  source 1..18: mol_type = other DNA
taatgagactcgctatag

SEQ ID NO: 1998 - DNA, 18 bp, synthetic construct
  source 1..18: mol_type = other DNA
taatgcgactcactggag

SEQ ID NO: 1999 - DNA, 18 bp, synthetic construct
  source 1..18: mol_type = other DNA
taatgcgtctcactataa

SEQ ID NO: 2000 - DNA, 18 bp, synthetic construct
  source 1..18: mol_type = other DNA
taattcgagtcactatgg

SEQ ID NO: 2001 - DNA, 18 bp, synthetic construct
  source 1..18: mol_type = other DNA
tattacgactcactctaa

SEQ ID NO: 2002 - DNA, 18 bp, synthetic construct
  source 1..18: mol_type = other DNA
tattaggactcacgatag

SEQ ID NO: 2003 - DNA, 18 bp, synthetic construct
  source 1..18: mol_type = other DNA
tgttacgactcactataa

SEQ ID NO: 2004 - DNA, 18 bp, synthetic construct
  source 1..18: mol_type = other DNA
ttatccgactcactataa

SEQ ID NO: 2005 - DNA, 18 bp, synthetic construct
  source 1..18: mol_type = other DNA
aaatatgactcactatat

SEQ ID NO: 2006 - DNA, 18 bp, synthetic construct
  source 1..18: mol_type = other DNA
caatacgactcaccgtag

SEQ ID NO: 2007 - DNA, 18 bp, synthetic construct
  source 1..18: mol_type = other DNA
caatacgactctctatac

SEQ ID NO: 2008 - DNA, 18 bp, synthetic construct
  source 1..18: mol_type = other DNA
ctatacgactcactataa

SEQ ID NO: 2009 - DNA, 18 bp, synthetic construct
  source 1..18: mol_type = other DNA
gaatagcactcactatag

SEQ ID NO: 2010 - DNA, 18 bp, synthetic construct
  source 1..18: mol_type = other DNA
gaataggactcactatcg

SEQ ID NO: 2011 - DNA, 18 bp, synthetic construct
  source 1..18: mol_type = other DNA
taaaacgactcacaatat

SEQ ID NO: 2012 - DNA, 18 bp, synthetic construct
  source 1..18: mol_type = other DNA
taaaacgactcactatga

SEQ ID NO: 2013 - DNA, 18 bp, synthetic construct
  source 1..18: mol_type = other DNA
taacacaactcactagag

SEQ ID NO: 2014 - DNA, 18 bp, synthetic construct
  source 1..18: mol_type = other DNA
taacacgactcactatca

SEQ ID NO: 2015 - DNA, 18 bp, synthetic construct
  source 1..18: mol_type = other DNA
taataagactcactacat

SEQ ID NO: 2016 - DNA, 18 bp, synthetic construct
  source 1..18: mol_type = other DNA
taataagcttcactatag

SEQ ID NO: 2017 - DNA, 18 bp, synthetic construct
  source 1..18: mol_type = other DNA
taatacaactcaggatag

SEQ ID NO: 2018 - DNA, 18 bp, synthetic construct
  source 1..18: mol_type = other DNA
taatacaattcactataa

SEQ ID NO: 2019 - DNA, 18 bp, synthetic construct
  source 1..18: mol_type = other DNA
taataccacccactatgg

SEQ ID NO: 2020 - DNA, 18 bp, synthetic construct
  source 1..18: mol_type = other DNA
taataccactcaagatag

SEQ ID NO: 2021 - DNA, 18 bp, synthetic construct
  source 1..18: mol_type = other DNA
taataccactccctagag

SEQ ID NO: 2022 - DNA, 18 bp, synthetic construct
  source 1..18: mol_type = other DNA
taatacgaaccactatac

SEQ ID NO: 2023 - DNA, 18 bp, synthetic construct
  source 1..18: mol_type = other DNA
taatacgaattactataa

SEQ ID NO: 2024 - DNA, 18 bp, synthetic construct
  source 1..18: mol_type = other DNA
taatacgacccacgagag

SEQ ID NO: 2025 - DNA, 18 bp, synthetic construct
  source 1..18: mol_type = other DNA
taatacgacgcactgtgg

SEQ ID NO: 2026 - DNA, 18 bp, synthetic construct
  source 1..18: mol_type = other DNA
taatacgacgccctagag

SEQ ID NO: 2027 - DNA, 18 bp, synthetic construct
  source 1..18: mol_type = other DNA
taatacgactcacaatca

SEQ ID NO: 2028 - DNA, 18 bp, synthetic construct
  source 1..18: mol_type = other DNA
taatacgactcactcaat

SEQ ID NO: 2029 - DNA, 18 bp, synthetic construct
  source 1..18: mol_type = other DNA
taatacgactcactccac

SEQ ID NO: 2030 - DNA, 18 bp, synthetic construct
  source 1..18: mol_type = other DNA
taatacgactcattctat

SEQ ID NO: 2031 - DNA, 18 bp, synthetic construct
  source 1..18: mol_type = other DNA
taatacgactcgatataa

SEQ ID NO: 2032 - DNA, 18 bp, synthetic construct
  source 1..18: mol_type = other DNA
taatacgactggctacag

SEQ ID NO: 2033 - DNA, 18 bp, synthetic construct
  source 1..18: mol_type = other DNA
taatacgacttacgagag

SEQ ID NO: 2034 - DNA, 18 bp, synthetic construct
  source 1..18: mol_type = other DNA
taatacgacttactacat

SEQ ID NO: 2035 - DNA, 18 bp, synthetic construct
  source 1..18: mol_type = other DNA
taatacgacttactatca

SEQ ID NO: 2036 - DNA, 18 bp, synthetic construct
  source 1..18: mol_type = other DNA
taatacgagacactagag

SEQ ID NO: 2037 - DNA, 18 bp, synthetic construct
  source 1..18: mol_type = other DNA
taatacgccgccctatag

SEQ ID NO: 2038 - DNA, 18 bp, synthetic construct
  source 1..18: mol_type = other DNA
taatacgcctcactaaaa

SEQ ID NO: 2039 - DNA, 18 bp, synthetic construct
  source 1..18: mol_type = other DNA
taatacgcctcagtgtag

SEQ ID NO: 2040 - DNA, 18 bp, synthetic construct
  source 1..18: mol_type = other DNA
taatacgcgtcactatat

SEQ ID NO: 2041 - DNA, 18 bp, synthetic construct
  source 1..18: mol_type = other DNA
taatacggctcactattc

SEQ ID NO: 2042 - DNA, 18 bp, synthetic construct
  source 1..18: mol_type = other DNA
taatacgtctcaccatat

SEQ ID NO: 2043 - DNA, 18 bp, synthetic construct
  source 1..18: mol_type = other DNA
taatacgtctcactaaat

SEQ ID NO: 2044 - DNA, 18 bp, synthetic construct
  source 1..18: mol_type = other DNA
taatacgtctcgctatat

SEQ ID NO: 2045 - DNA, 18 bp, synthetic construct
  source 1..18: mol_type = other DNA
taatacgtctctctatac

SEQ ID NO: 2046 - DNA, 18 bp, synthetic construct
  source 1..18: mol_type = other DNA
taatagaactcactatat

SEQ ID NO: 2047 - DNA, 18 bp, synthetic construct
  source 1..18: mol_type = other DNA
taataggacccactataa

SEQ ID NO: 2048 - DNA, 18 bp, synthetic construct
  source 1..18: mol_type = other DNA
taataggactcacgatgg

SEQ ID NO: 2049 - DNA, 18 bp, synthetic construct
  source 1..18: mol_type = other DNA
taataggactgacgatag

SEQ ID NO: 2050 - DNA, 18 bp, synthetic construct
  source 1..18: mol_type = other DNA
taatatgactcactatga

SEQ ID NO: 2051 - DNA, 18 bp, synthetic construct
  source 1..18: mol_type = other DNA
taatatgactcactctat

SEQ ID NO: 2052 - DNA, 18 bp, synthetic construct
  source 1..18: mol_type = other DNA
taatcagactcactatat

SEQ ID NO: 2053 - DNA, 18 bp, synthetic construct
  source 1..18: mol_type = other DNA
taatccgactcaccatgg

SEQ ID NO: 2054 - DNA, 18 bp, synthetic construct
  source 1..18: mol_type = other DNA
taatccgtctcactatat

SEQ ID NO: 2055 - DNA, 18 bp, synthetic construct
  source 1..18: mol_type = other DNA
taatgcgactcactattt

SEQ ID NO: 2056 - DNA, 18 bp, synthetic construct
  source 1..18: mol_type = other DNA
taatgcgactcagtataa

SEQ ID NO: 2057 - DNA, 18 bp, synthetic construct
  source 1..18: mol_type = other DNA
taatgcgcctcactatat

SEQ ID NO: 2058 - DNA, 18 bp, synthetic construct
  source 1..18: mol_type = other DNA
taatgggactcactagag

SEQ ID NO: 2059 - DNA, 18 bp, synthetic construct
  source 1..18: mol_type = other DNA
tactacgactcactttaa

SEQ ID NO: 2060 - DNA, 18 bp, synthetic construct
  source 1..18: mol_type = other DNA
tactacgactctctataa

SEQ ID NO: 2061 - DNA, 18 bp, synthetic construct
  source 1..18: mol_type = other DNA
tagtacgaatcactgtag

SEQ ID NO: 2062 - DNA, 18 bp, synthetic construct
  source 1..18: mol_type = other DNA
tagtacgactcaccgtag

SEQ ID NO: 2063 - DNA, 18 bp, synthetic construct
  source 1..18: mol_type = other DNA
tagtacgactcactatga

SEQ ID NO: 2064 - DNA, 18 bp, synthetic construct
  source 1..18: mol_type = other DNA
tattacgactcactgtaa

SEQ ID NO: 2065 - DNA, 18 bp, synthetic construct
  source 1..18: mol_type = other DNA
tattacgattcactatat

SEQ ID NO: 2066 - DNA, 18 bp, synthetic construct
  source 1..18: mol_type = other DNA
tattactactcactatac

SEQ ID NO: 2067 - DNA, 18 bp, synthetic construct
  source 1..18: mol_type = other DNA
tcagacgcctcactatag

SEQ ID NO: 2068 - DNA, 18 bp, synthetic construct
  source 1..18: mol_type = other DNA
tcatacgacgcactaaag

SEQ ID NO: 2069 - DNA, 18 bp, synthetic construct
  source 1..18: mol_type = other DNA
tcatacgtctcactataa

SEQ ID NO: 2070 - DNA, 18 bp, synthetic construct
  source 1..18: mol_type = other DNA
tcatgcgactccctatag

SEQ ID NO: 2071 - DNA, 18 bp, synthetic construct
  source 1..18: mol_type = other DNA
tgataagactgactatag

SEQ ID NO: 2072 - DNA, 18 bp, synthetic construct
  source 1..18: mol_type = other DNA
tgatacgtctcactataa

SEQ ID NO: 2073 - DNA, 18 bp, synthetic construct
  source 1..18: mol_type = other DNA
tgataggactcactataa

SEQ ID NO: 2074 - DNA, 18 bp, synthetic construct
  source 1..18: mol_type = other DNA
tgatctgactcactatag

SEQ ID NO: 2075 - DNA, 18 bp, synthetic construct
  source 1..18: mol_type = other DNA
tgattcgactcactatat

SEQ ID NO: 2076 - DNA, 18 bp, synthetic construct
  source 1..18: mol_type = other DNA
ttatacgacacactatac

SEQ ID NO: 2077 - DNA, 18 bp, synthetic construct
  source 1..18: mol_type = other DNA
ttatacgactcaatataa

SEQ ID NO: 2078 - DNA, 18 bp, synthetic construct
  source 1..18: mol_type = other DNA
ttatacgactcactaaac

SEQ ID NO: 2079 - DNA, 18 bp, synthetic construct
  source 1..18: mol_type = other DNA
ttatacgactcactacat

SEQ ID NO: 2080 - DNA, 18 bp, synthetic construct
  source 1..18: mol_type = other DNA
ttatacgcctcactatac

SEQ ID NO: 2081 - DNA, 18 bp, synthetic construct
  source 1..18: mol_type = other DNA
ttatgcgactcactatat

SEQ ID NO: 2082 - DNA, 18 bp, synthetic construct
  source 1..18: mol_type = other DNA
taataggtctcactaaag

SEQ ID NO: 2083 - DNA, 18 bp, synthetic construct
  source 1..18: mol_type = other DNA
tattacaactcactctag

SEQ ID NO: 2084 - DNA, 18 bp, synthetic construct
  source 1..18: mol_type = other DNA
caataggactcactattg

SEQ ID NO: 2085 - DNA, 18 bp, synthetic construct
  source 1..18: mol_type = other DNA
ttataagactcgctatag

SEQ ID NO: 2086 - DNA, 18 bp, synthetic construct
  source 1..18: mol_type = other DNA
taataggactcacttaag

SEQ ID NO: 2087 - DNA, 18 bp, synthetic construct
  source 1..18: mol_type = other DNA
ttatccgactcactgtag

SEQ ID NO: 2088 - DNA, 18 bp, synthetic construct
  source 1..18: mol_type = other DNA
taatgcaactcgctatag

SEQ ID NO: 2089 - DNA, 18 bp, synthetic construct
  source 1..18: mol_type = other DNA
taatgcgactcactaagg

SEQ ID NO: 2090 - DNA, 18 bp, synthetic construct
  source 1..18: mol_type = other DNA
caatacggctcgctatag

SEQ ID NO: 2091 - DNA, 18 bp, synthetic construct
  source 1..18: mol_type = other DNA
caccacgactcactatag

SEQ ID NO: 2092 - DNA, 18 bp, synthetic construct
  source 1..18: mol_type = other DNA
gaatacgactcaccaaag

SEQ ID NO: 2093 - DNA, 18 bp, synthetic construct
  source 1..18: mol_type = other DNA
taattcgactcagtctag

SEQ ID NO: 2094 - DNA, 18 bp, synthetic construct
  source 1..18: mol_type = other DNA
tattacgcatcactatag

SEQ ID NO: 2095 - DNA, 18 bp, synthetic construct
  source 1..18: mol_type = other DNA
taaagcgactcactttag

SEQ ID NO: 2096 - DNA, 18 bp, synthetic construct
  source 1..18: mol_type = other DNA
tagtacgactctctctag

SEQ ID NO: 2097 - DNA, 18 bp, synthetic construct
  source 1..18: mol_type = other DNA
taataagcctcactattg

SEQ ID NO: 2098 - DNA, 18 bp, synthetic construct
  source 1..18: mol_type = other DNA
taatttgactcactagag

SEQ ID NO: 2099 - DNA, 18 bp, synthetic construct
  source 1..18: mol_type = other DNA
taaaacgactcgctaaag

SEQ ID NO: 2100 - DNA, 18 bp, synthetic construct
  source 1..18: mol_type = other DNA
taattcgactcgctatgg

SEQ ID NO: 2101 - DNA, 18 bp, synthetic construct
  source 1..18: mol_type = other DNA
taataaaactcactaaag

SEQ ID NO: 2102 - DNA, 18 bp, synthetic construct
  source 1..18: mol_type = other DNA
ctatacgtctcactatag

SEQ ID NO: 2103 - DNA, 18 bp, synthetic construct
  source 1..18: mol_type = other DNA
tgttacgcctcactatag

SEQ ID NO: 2104 - DNA, 18 bp, synthetic construct
  source 1..18: mol_type = other DNA
taatacgtctcactaccg

SEQ ID NO: 2105 - DNA, 18 bp, synthetic construct
  source 1..18: mol_type = other DNA
taaaaccgctcactatag

SEQ ID NO: 2106 - DNA, 18 bp, synthetic construct
  source 1..18: mol_type = other DNA
taatcccgctcactatag

SEQ ID NO: 2107 - DNA, 18 bp, synthetic construct
  source 1..18: mol_type = other DNA
taatgcgcatcactatag

SEQ ID NO: 2108 - DNA, 18 bp, synthetic construct
  source 1..18: mol_type = other DNA
caataggactcactttag

SEQ ID NO: 2109 - DNA, 18 bp, synthetic construct
  source 1..18: mol_type = other DNA
taatctgactcactaaag

SEQ ID NO: 2110 - DNA, 18 bp, synthetic construct
  source 1..18: mol_type = other DNA
tattaggtctcactatag

SEQ ID NO: 2111 - DNA, 18 bp, synthetic construct
  source 1..18: mol_type = other DNA
taatccaactcactacag

SEQ ID NO: 2112 - DNA, 18 bp, synthetic construct
  source 1..18: mol_type = other DNA
taatacaactcgctctag

SEQ ID NO: 2113 - DNA, 18 bp, synthetic construct
  source 1..18: mol_type = other DNA
taatccgccttactatag

SEQ ID NO: 2114 - DNA, 18 bp, synthetic construct
  source 1..18: mol_type = other DNA
taatagaactcactaaag

SEQ ID NO: 2115 - DNA, 18 bp, synthetic construct
  source 1..18: mol_type = other DNA
taattcgacgcactaaag

SEQ ID NO: 2116 - DNA, 18 bp, synthetic construct
  source 1..18: mol_type = other DNA
tatttcgactcactagag

SEQ ID NO: 2117 - DNA, 18 bp, synthetic construct
  source 1..18: mol_type = other DNA
taataagacccaccatag

SEQ ID NO: 2118 - DNA, 18 bp, synthetic construct
  source 1..18: mol_type = other DNA
taatacgactcgctccag

SEQ ID NO: 2119 - DNA, 18 bp, synthetic construct
  source 1..18: mol_type = other DNA
tgatacgagtcactattg

SEQ ID NO: 2120 - DNA, 18 bp, synthetic construct
  source 1..18: mol_type = other DNA
taaatcgactcactgtag

SEQ ID NO: 2121 - DNA, 18 bp, synthetic construct
  source 1..18: mol_type = other DNA
ttatacgactcagtacag

SEQ ID NO: 2122 - DNA, 18 bp, synthetic construct
  source 1..18: mol_type = other DNA
aaattcgactcactctag

SEQ ID NO: 2123 - DNA, 18 bp, synthetic construct
  source 1..18: mol_type = other DNA
taatgcgactcacgaaag

SEQ ID NO: 2124 - DNA, 18 bp, synthetic construct
  source 1..18: mol_type = other DNA
taaaacggctcaccatag

SEQ ID NO: 2125 - DNA, 18 bp, synthetic construct
  source 1..18: mol_type = other DNA
gaaaacgtctcactatag

SEQ ID NO: 2126 - DNA, 18 bp, synthetic construct
  source 1..18: mol_type = other DNA
gtaaacgactcactatag

SEQ ID NO: 2127 - DNA, 18 bp, synthetic construct
  source 1..18: mol_type = other DNA
taatgcgactcactaacg

SEQ ID NO: 2128 - DNA, 18 bp, synthetic construct
  source 1..18: mol_type = other DNA
tgttacgtctcactatag

SEQ ID NO: 2129 - DNA, 18 bp, synthetic construct
  source 1..18: mol_type = other DNA
aaaaacgactcactctag

SEQ ID NO: 2130 - DNA, 18 bp, synthetic construct
  source 1..18: mol_type = other DNA
taataaggctcactattg

SEQ ID NO: 2131 - DNA, 18 bp, synthetic construct
  source 1..18: mol_type = other DNA
tagtacgactcgctattg

SEQ ID NO: 2132 - DNA, 18 bp, synthetic construct
  source 1..18: mol_type = other DNA
taattggtctcactatag

SEQ ID NO: 2133 - DNA, 18 bp, synthetic construct
  source 1..18: mol_type = other DNA
caatacaactcgctatag

SEQ ID NO: 2134 - DNA, 18 bp, synthetic construct
  source 1..18: mol_type = other DNA
tgttacgactcgctatag

SEQ ID NO: 2135 - DNA, 18 bp, synthetic construct
  source 1..18: mol_type = other DNA
tgttgcgactcactatag

SEQ ID NO: 2136 - DNA, 18 bp, synthetic construct
  source 1..18: mol_type = other DNA
ttattcgtctcactatag

SEQ ID NO: 2137 - DNA, 18 bp, synthetic construct
  source 1..18: mol_type = other DNA
taattcgactcactaacg

SEQ ID NO: 2138 - DNA, 18 bp, synthetic construct
  source 1..18: mol_type = other DNA
taatccgactcgctatgg

SEQ ID NO: 2139 - DNA, 18 bp, synthetic construct
  source 1..18: mol_type = other DNA
taaaacgactcagtgtag

SEQ ID NO: 2140 - DNA, 18 bp, synthetic construct
  source 1..18: mol_type = other DNA
taatgcgtctcactatcg

SEQ ID NO: 2141 - DNA, 18 bp, synthetic construct
  source 1..18: mol_type = other DNA
taatgcaactcaccatag

SEQ ID NO: 2142 - DNA, 18 bp, synthetic construct
  source 1..18: mol_type = other DNA
ttataggactcactatcg

SEQ ID NO: 2143 - DNA, 18 bp, synthetic construct
  source 1..18: mol_type = other DNA
taataggactcagtaaag

SEQ ID NO: 2144 - DNA, 18 bp, synthetic construct
  source 1..18: mol_type = other DNA
taattcgactcactcttg

SEQ ID NO: 2145 - DNA, 18 bp, synthetic construct
  source 1..18: mol_type = other DNA
ttatacgactcgctaaag

SEQ ID NO: 2146 - DNA, 18 bp, synthetic construct
  source 1..18: mol_type = other DNA
tatttcgactcactatcg

SEQ ID NO: 2147 - DNA, 18 bp, synthetic construct
  source 1..18: mol_type = other DNA
aagtacgactcactgtag

SEQ ID NO: 2148 - DNA, 18 bp, synthetic construct
  source 1..18: mol_type = other DNA
taatacgcctcacggtag

SEQ ID NO: 2149 - DNA, 18 bp, synthetic construct
  source 1..18: mol_type = other DNA
aaataggactcgctatag

SEQ ID NO: 2150 - DNA, 18 bp, synthetic construct
  source 1..18: mol_type = other DNA
taatgggactcactacag

SEQ ID NO: 2151 - DNA, 18 bp, synthetic construct
  source 1..18: mol_type = other DNA
aaatacgcttcactatag

SEQ ID NO: 2152 - DNA, 18 bp, synthetic construct
  source 1..18: mol_type = other DNA
aaatgcgactcgctatag

SEQ ID NO: 2153 - DNA, 18 bp, synthetic construct
  source 1..18: mol_type = other DNA
taataagactcactactg

SEQ ID NO: 2154 - DNA, 18 bp, synthetic construct
  source 1..18: mol_type = other DNA
taatgggactcactctag

SEQ ID NO: 2155 - DNA, 18 bp, synthetic construct
  source 1..18: mol_type = other DNA
taattcgtctcactacag

SEQ ID NO: 2156 - DNA, 18 bp, synthetic construct
  source 1..18: mol_type = other DNA
aaatgcgactcactagag

SEQ ID NO: 2157 - DNA, 18 bp, synthetic construct
  source 1..18: mol_type = other DNA
taatacgtcccactatcg

SEQ ID NO: 2158 - DNA, 18 bp, synthetic construct
  source 1..18: mol_type = other DNA
taaagcgactcgctatag

SEQ ID NO: 2159 - DNA, 18 bp, synthetic construct
  source 1..18: mol_type = other DNA
ttatacaactcactacag

SEQ ID NO: 2160 - DNA, 18 bp, synthetic construct
  source 1..18: mol_type = other DNA
aaatgcgactcactattg

SEQ ID NO: 2161 - DNA, 18 bp, synthetic construct
  source 1..18: mol_type = other DNA
tattgcgactcgctatag

SEQ ID NO: 2162 - DNA, 18 bp, synthetic construct
  source 1..18: mol_type = other DNA
taaaaggactcactaaag

SEQ ID NO: 2163 - DNA, 18 bp, synthetic construct
  source 1..18: mol_type = other DNA
tactacgtctcactacag

SEQ ID NO: 2164 - DNA, 18 bp, synthetic construct
  source 1..18: mol_type = other DNA
taatacgactcggtattg

SEQ ID NO: 2165 - DNA, 18 bp, synthetic construct
  source 1..18: mol_type = other DNA
taattcgactcactgaag

SEQ ID NO: 2166 - DNA, 18 bp, synthetic construct
  source 1..18: mol_type = other DNA
taatacggctctctattg

SEQ ID NO: 2167 - DNA, 18 bp, synthetic construct
  source 1..18: mol_type = other DNA
taattcgactcgctgtag

SEQ ID NO: 2168 - DNA, 18 bp, synthetic construct
  source 1..18: mol_type = other DNA
taattcggctcactctag

SEQ ID NO: 2169 - DNA, 18 bp, synthetic construct
  source 1..18: mol_type = other DNA
ttaaacgactcactatcg

SEQ ID NO: 2170 - DNA, 18 bp, synthetic construct
  source 1..18: mol_type = other DNA
taataagcgtcactatag

SEQ ID NO: 2171 - DNA, 18 bp, synthetic construct
  source 1..18: mol_type = other DNA
taatatgactcgctattg

SEQ ID NO: 2172 - DNA, 18 bp, synthetic construct
  source 1..18: mol_type = other DNA
taatacgtcccactacag

SEQ ID NO: 2173 - DNA, 18 bp, synthetic construct
  source 1..18: mol_type = other DNA
ttatacgactcgctctag

SEQ ID NO: 2174 - DNA, 18 bp, synthetic construct
  source 1..18: mol_type = other DNA
caataggactcactagag

SEQ ID NO: 2175 - DNA, 18 bp, synthetic construct
  source 1..18: mol_type = other DNA
tagtacgactcgctatcg

SEQ ID NO: 2176 - DNA, 18 bp, synthetic construct
  source 1..18: mol_type = other DNA
caataggactcactatcg

SEQ ID NO: 2177 - DNA, 18 bp, synthetic construct
  source 1..18: mol_type = other DNA
taaaacgtctcactatat

SEQ ID NO: 2178 - DNA, 18 bp, synthetic construct
  source 1..18: mol_type = other DNA
taatacaactcactggag

SEQ ID NO: 2179 - DNA, 18 bp, synthetic construct
  source 1..18: mol_type = other DNA
taatacgaaccaccatag

SEQ ID NO: 2180 - DNA, 18 bp, synthetic construct
  source 1..18: mol_type = other DNA
taatacgacacactaggg

SEQ ID NO: 2181 - DNA, 18 bp, synthetic construct
  source 1..18: mol_type = other DNA
taatactactcaatataa

SEQ ID NO: 2182 - DNA, 18 bp, synthetic construct
  source 1..18: mol_type = other DNA
taatccgactcgcgatag

SEQ ID NO: 2183 - DNA, 18 bp, synthetic construct
  source 1..18: mol_type = other DNA
taatcgcactcactatag

SEQ ID NO: 2184 - DNA, 18 bp, synthetic construct
  source 1..18: mol_type = other DNA
taatgcaactcactatcg

SEQ ID NO: 2185 - DNA, 18 bp, synthetic construct
  source 1..18: mol_type = other DNA
tactacgactcactcgag

SEQ ID NO: 2186 - DNA, 18 bp, synthetic construct
  source 1..18: mol_type = other DNA
tattacgagtcactagag

SEQ ID NO: 2187 - DNA, 18 bp, synthetic construct
  source 1..18: mol_type = other DNA
tattgcgactcactatat

SEQ ID NO: 2188 - DNA, 18 bp, synthetic construct
  source 1..18: mol_type = other DNA
tcctacgactcactatgg

SEQ ID NO: 2189 - DNA, 18 bp, synthetic construct
  source 1..18: mol_type = other DNA
tgatacgagtcgctatag

SEQ ID NO: 2190 - DNA, 18 bp, synthetic construct
  source 1..18: mol_type = other DNA
taatacgactcacttctg

SEQ ID NO: 2191 - DNA, 18 bp, synthetic construct
  source 1..18: mol_type = other DNA
taattggactcactttag

SEQ ID NO: 2192 - DNA, 18 bp, synthetic construct
  source 1..18: mol_type = other DNA
tgttacaactcactatag

SEQ ID NO: 2193 - DNA, 18 bp, synthetic construct
  source 1..18: mol_type = other DNA
taatacgacacactactg

SEQ ID NO: 2194 - DNA, 18 bp, synthetic construct
  source 1..18: mol_type = other DNA
tattacgactcgctacag

SEQ ID NO: 2195 - DNA, 18 bp, synthetic construct
  source 1..18: mol_type = other DNA
taataagactcgctaaag

SEQ ID NO: 2196 - DNA, 18 bp, synthetic construct
  source 1..18: mol_type = other DNA
taaaacgactcaccgtag

SEQ ID NO: 2197 - DNA, 18 bp, synthetic construct
  source 1..18: mol_type = other DNA
tagtgcgactcactacag

SEQ ID NO: 2198 - DNA, 18 bp, synthetic construct
  source 1..18: mol_type = other DNA
ttttacgactcagtatag

SEQ ID NO: 2199 - DNA, 18 bp, synthetic construct
  source 1..18: mol_type = other DNA
tcattcgactcactgtag

SEQ ID NO: 2200 - DNA, 18 bp, synthetic construct
  source 1..18: mol_type = other DNA
taatagaactcactatcg

SEQ ID NO: 2201 - DNA, 18 bp, synthetic construct
  source 1..18: mol_type = other DNA
taatcagcctcactatag

SEQ ID NO: 2202 - DNA, 18 bp, synthetic construct
  source 1..18: mol_type = other DNA
taatctgcctcactatag

SEQ ID NO: 2203 - DNA, 18 bp, synthetic construct
  source 1..18: mol_type = other DNA
tattacgcctcactatgg

SEQ ID NO: 2204 - DNA, 18 bp, synthetic construct
  source 1..18: mol_type = other DNA
ttatacgcctcactctag

SEQ ID NO: 2205 - DNA, 18 bp, synthetic construct
  source 1..18: mol_type = other DNA
taatttgactcactacag

SEQ ID NO: 2206 - DNA, 18 bp, synthetic construct
  source 1..18: mol_type = other DNA
taacacgactcacgattg

SEQ ID NO: 2207 - DNA, 18 bp, synthetic construct
  source 1..18: mol_type = other DNA
taaagcgactcacgatag

SEQ ID NO: 2208 - DNA, 18 bp, synthetic construct
  source 1..18: mol_type = other DNA
taatccgactcacggtag

SEQ ID NO: 2209 - DNA, 18 bp, synthetic construct
  source 1..18: mol_type = other DNA
tataacgactcactacag

SEQ ID NO: 2210 - DNA, 18 bp, synthetic construct
  source 1..18: mol_type = other DNA
taatacaactcactctcg

SEQ ID NO: 2211 - DNA, 18 bp, synthetic construct
  source 1..18: mol_type = other DNA
taacacgactcactactg

SEQ ID NO: 2212 - DNA, 18 bp, synthetic construct
  source 1..18: mol_type = other DNA
taatcagactcactattg

SEQ ID NO: 2213 - DNA, 18 bp, synthetic construct
  source 1..18: mol_type = other DNA
ttatacaactcactttag

SEQ ID NO: 2214 - DNA, 18 bp, synthetic construct
  source 1..18: mol_type = other DNA
ttatacaactcactctag

SEQ ID NO: 2215 - DNA, 18 bp, synthetic construct
  source 1..18: mol_type = other DNA
aaataggactcactatcg

SEQ ID NO: 2216 - DNA, 18 bp, synthetic construct
  source 1..18: mol_type = other DNA
caacacgtctcactatag

SEQ ID NO: 2217 - DNA, 18 bp, synthetic construct
  source 1..18: mol_type = other DNA
gaatacgactcgctaaag

SEQ ID NO: 2218 - DNA, 18 bp, synthetic construct
  source 1..18: mol_type = other DNA
aaatacgactcaccacag

SEQ ID NO: 2219 - DNA, 18 bp, synthetic construct
  source 1..18: mol_type = other DNA
taaagggactcactatag

SEQ ID NO: 2220 - DNA, 18 bp, synthetic construct
  source 1..18: mol_type = other DNA
taatacaactcacgttag

SEQ ID NO: 2221 - DNA, 18 bp, synthetic construct
  source 1..18: mol_type = other DNA
tcatagaactcactatag

SEQ ID NO: 2222 - DNA, 18 bp, synthetic construct
  source 1..18: mol_type = other DNA
caatacgactcactgtcg

SEQ ID NO: 2223 - DNA, 18 bp, synthetic construct
  source 1..18: mol_type = other DNA
ttattggactcactatag

SEQ ID NO: 2224 - DNA, 18 bp, synthetic construct
  source 1..18: mol_type = other DNA
taattcgactcgatatag

SEQ ID NO: 2225 - DNA, 18 bp, synthetic construct
  source 1..18: mol_type = other DNA
ttatacgtctcactagag

SEQ ID NO: 2226 - DNA, 18 bp, synthetic construct
  source 1..18: mol_type = other DNA
taatgggactcactttag

SEQ ID NO: 2227 - DNA, 18 bp, synthetic construct
  source 1..18: mol_type = other DNA
ttatacgactcagtattg

SEQ ID NO: 2228 - DNA, 18 bp, synthetic construct
  source 1..18: mol_type = other DNA
taataaagctcactatag

SEQ ID NO: 2229 - DNA, 18 bp, synthetic construct
  source 1..18: mol_type = other DNA
ttatccgactcactctag

SEQ ID NO: 2230 - DNA, 18 bp, synthetic construct
  source 1..18: mol_type = other DNA
taatacgcctcagaatag

SEQ ID NO: 2231 - DNA, 18 bp, synthetic construct
  source 1..18: mol_type = other DNA
taatataactcacgatag

SEQ ID NO: 2232 - DNA, 18 bp, synthetic construct
  source 1..18: mol_type = other DNA
tgaaccgactcactatag

SEQ ID NO: 2233 - DNA, 18 bp, synthetic construct
  source 1..18: mol_type = other DNA
taatagcactcactatcg

SEQ ID NO: 2234 - DNA, 18 bp, synthetic construct
  source 1..18: mol_type = other DNA
taatacaactcactaacg

SEQ ID NO: 2235 - DNA, 18 bp, synthetic construct
  source 1..18: mol_type = other DNA
taataagcctcactaaag

SEQ ID NO: 2236 - DNA, 18 bp, synthetic construct
  source 1..18: mol_type = other DNA
taacaagactcagtatag

SEQ ID NO: 2237 - DNA, 18 bp, synthetic construct
  source 1..18: mol_type = other DNA
taacgcgactcagtatag

SEQ ID NO: 2238 - DNA, 18 bp, synthetic construct
  source 1..18: mol_type = other DNA
tcgtacgactcactacag

SEQ ID NO: 2239 - DNA, 18 bp, synthetic construct
  source 1..18: mol_type = other DNA
caatacgactcactgttg

SEQ ID NO: 2240 - DNA, 18 bp, synthetic construct
  source 1..18: mol_type = other DNA
taattcgcctcaccatag

SEQ ID NO: 2241 - DNA, 18 bp, synthetic construct
  source 1..18: mol_type = other DNA
taataaaactcactacag

SEQ ID NO: 2242 - DNA, 18 bp, synthetic construct
  source 1..18: mol_type = other DNA
taatgcgactcactgtcg

SEQ ID NO: 2243 - DNA, 18 bp, synthetic construct
  source 1..18: mol_type = other DNA
taaaaagactcactacag

SEQ ID NO: 2244 - DNA, 18 bp, synthetic construct
  source 1..18: mol_type = other DNA
taataggactcacgaaag

SEQ ID NO: 2245 - DNA, 18 bp, synthetic construct
  source 1..18: mol_type = other DNA
taataggactcaatctag

SEQ ID NO: 2246 - DNA, 18 bp, synthetic construct
  source 1..18: mol_type = other DNA
taatgcgaatcaccatag

SEQ ID NO: 2247 - DNA, 18 bp, synthetic construct
  source 1..18: mol_type = other DNA
taatgcgattcactatcg

SEQ ID NO: 2248 - DNA, 18 bp, synthetic construct
  source 1..18: mol_type = other DNA
taatgggactcactattg

SEQ ID NO: 2249 - DNA, 18 bp, synthetic construct
  source 1..18: mol_type = other DNA
tattacgactctctataa

SEQ ID NO: 2250 - DNA, 18 bp, synthetic construct
  source 1..18: mol_type = other DNA
tgatacgacacactatgg

SEQ ID NO: 2251 - DNA, 18 bp, synthetic construct
  source 1..18: mol_type = other DNA
gattacgactcactaaag

SEQ ID NO: 2252 - DNA, 18 bp, synthetic construct
  source 1..18: mol_type = other DNA
ttataggactcaccatag

SEQ ID NO: 2253 - DNA, 18 bp, synthetic construct
  source 1..18: mol_type = other DNA
caatccgactcactattg

SEQ ID NO: 2254 - DNA, 18 bp, synthetic construct
  source 1..18: mol_type = other DNA
taacacgcctcactattg

SEQ ID NO: 2255 - DNA, 18 bp, synthetic construct
  source 1..18: mol_type = other DNA
caatacgactcacttaag

SEQ ID NO: 2256 - DNA, 18 bp, synthetic construct
  source 1..18: mol_type = other DNA
ttttgcgactcactatag

SEQ ID NO: 2257 - DNA, 18 bp, synthetic construct
  source 1..18: mol_type = other DNA
ttatacgactcactctcg

SEQ ID NO: 2258 - DNA, 18 bp, synthetic construct
  source 1..18: mol_type = other DNA
taatacgactcgctgttg

SEQ ID NO: 2259 - DNA, 18 bp, synthetic construct
  source 1..18: mol_type = other DNA
taaaacgactcagtatcg

SEQ ID NO: 2260 - DNA, 18 bp, synthetic construct
  source 1..18: mol_type = other DNA
taatccaacgcactatag

SEQ ID NO: 2261 - DNA, 18 bp, synthetic construct
  source 1..18: mol_type = other DNA
taaaacgacgcactatcg

SEQ ID NO: 2262 - DNA, 18 bp, synthetic construct
  source 1..18: mol_type = other DNA
taattggactcactattg

SEQ ID NO: 2263 - DNA, 18 bp, synthetic construct
  source 1..18: mol_type = other DNA
taatgcgactcactttgg

SEQ ID NO: 2264 - DNA, 18 bp, synthetic construct
  source 1..18: mol_type = other DNA
ttaaacgactcacgatag

SEQ ID NO: 2265 - DNA, 18 bp, synthetic construct
  source 1..18: mol_type = other DNA
tttcacgactcactatag

SEQ ID NO: 2266 - DNA, 18 bp, synthetic construct
  source 1..18: mol_type = other DNA
caatgcgactcactaaag

SEQ ID NO: 2267 - DNA, 18 bp, synthetic construct
  source 1..18: mol_type = other DNA
taaaacgcatcactatag

SEQ ID NO: 2268 - DNA, 18 bp, synthetic construct
  source 1..18: mol_type = other DNA
tagtacgactcaccattg

SEQ ID NO: 2269 - DNA, 18 bp, synthetic construct
  source 1..18: mol_type = other DNA
ttatcagactcactatag

SEQ ID NO: 2270 - DNA, 18 bp, synthetic construct
  source 1..18: mol_type = other DNA
caatgcgtctcactatag

SEQ ID NO: 2271 - DNA, 18 bp, synthetic construct
  source 1..18: mol_type = other DNA
aaattcgactcacgatag

SEQ ID NO: 2272 - DNA, 18 bp, synthetic construct
  source 1..18: mol_type = other DNA
taattcgactcactcaag

SEQ ID NO: 2273 - DNA, 18 bp, synthetic construct
  source 1..18: mol_type = other DNA
ttatacgtctcactatcg

SEQ ID NO: 2274 - DNA, 18 bp, synthetic construct
  source 1..18: mol_type = other DNA
taatacgactctgtaaag

SEQ ID NO: 2275 - DNA, 18 bp, synthetic construct
  source 1..18: mol_type = other DNA
taatccgactcgctaaag

SEQ ID NO: 2276 - DNA, 18 bp, synthetic construct
  source 1..18: mol_type = other DNA
tataacgactcactctag

SEQ ID NO: 2277 - DNA, 18 bp, synthetic construct
  source 1..18: mol_type = other DNA
ctatacgactcactctag

SEQ ID NO: 2278 - DNA, 18 bp, synthetic construct
  source 1..18: mol_type = other DNA
ttttacgactcactgtag

SEQ ID NO: 2279 - DNA, 18 bp, synthetic construct
  source 1..18: mol_type = other DNA
taatactactcgctatcg

SEQ ID NO: 2280 - DNA, 18 bp, synthetic construct
  source 1..18: mol_type = other DNA
taattcgactcactaggg

SEQ ID NO: 2281 - DNA, 18 bp, synthetic construct
  source 1..18: mol_type = other DNA
tattacgactgactatcg

SEQ ID NO: 2282 - DNA, 18 bp, synthetic construct
  source 1..18: mol_type = other DNA
ttataagactcacgatag

SEQ ID NO: 2283 - DNA, 18 bp, synthetic construct
  source 1..18: mol_type = other DNA
aaatacgcctcactaaag

SEQ ID NO: 2284 - DNA, 18 bp, synthetic construct
  source 1..18: mol_type = other DNA
taattcgactcacgattg

SEQ ID NO: 2285 - DNA, 18 bp, synthetic construct
  source 1..18: mol_type = other DNA
taatacgactcactgacg

SEQ ID NO: 2286 - DNA, 18 bp, synthetic construct
  source 1..18: mol_type = other DNA
tatagcgactcactatag

SEQ ID NO: 2287 - DNA, 18 bp, synthetic construct
  source 1..18: mol_type = other DNA
aaacaggactcactatag

SEQ ID NO: 2288 - DNA, 18 bp, synthetic construct
  source 1..18: mol_type = other DNA
taattcgcctcactatgg

SEQ ID NO: 2289 - DNA, 18 bp, synthetic construct
  source 1..18: mol_type = other DNA
taatacgcctcacttttg

SEQ ID NO: 2290 - DNA, 18 bp, synthetic construct
  source 1..18: mol_type = other DNA
taaaatgactcactatgg

SEQ ID NO: 2291 - DNA, 18 bp, synthetic construct
  source 1..18: mol_type = other DNA
taataggactcactcaag

SEQ ID NO: 2292 - DNA, 18 bp, synthetic construct
  source 1..18: mol_type = other DNA
taaatcgcctcactatag

SEQ ID NO: 2293 - DNA, 18 bp, synthetic construct
  source 1..18: mol_type = other DNA
taattagactcactttag

SEQ ID NO: 2294 - DNA, 18 bp, synthetic construct
  source 1..18: mol_type = other DNA
taattcgatgcactatag

SEQ ID NO: 2295 - DNA, 18 bp, synthetic construct
  source 1..18: mol_type = other DNA
tgttacgactcactctag

SEQ ID NO: 2296 - DNA, 18 bp, synthetic construct
  source 1..18: mol_type = other DNA
ctatacgactcacgatag

SEQ ID NO: 2297 - DNA, 18 bp, synthetic construct
  source 1..18: mol_type = other DNA
taatacgcctcgctatcg

SEQ ID NO: 2298 - DNA, 18 bp, synthetic construct
  source 1..18: mol_type = other DNA
tcatacgactcacgaaag

SEQ ID NO: 2299 - DNA, 18 bp, synthetic construct
  source 1..18: mol_type = other DNA
taataccactcacgattg

SEQ ID NO: 2300 - DNA, 18 bp, synthetic construct
  source 1..18: mol_type = other DNA
taatacgacgcacactag

SEQ ID NO: 2301 - DNA, 18 bp, synthetic construct
  source 1..18: mol_type = other DNA
taatacgactcacgtgag

SEQ ID NO: 2302 - DNA, 18 bp, synthetic construct
  source 1..18: mol_type = other DNA
taatacgcctcactacgg

SEQ ID NO: 2303 - DNA, 18 bp, synthetic construct
  source 1..18: mol_type = other DNA
taattcgacgcaatatag

SEQ ID NO: 2304 - DNA, 18 bp, synthetic construct
  source 1..18: mol_type = other DNA
taaaaagactcgctatag

SEQ ID NO: 2305 - DNA, 18 bp, synthetic construct
  source 1..18: mol_type = other DNA
ttatgcgactcactatgg

SEQ ID NO: 2306 - DNA, 18 bp, synthetic construct
  source 1..18: mol_type = other DNA
taacgcaactcactatag

SEQ ID NO: 2307 - DNA, 18 bp, synthetic construct
  source 1..18: mol_type = other DNA
taattcggctcagtatag

SEQ ID NO: 2308 - DNA, 18 bp, synthetic construct
  source 1..18: mol_type = other DNA
taatgcgacgcaccatag

SEQ ID NO: 2309 - DNA, 18 bp, synthetic construct
  source 1..18: mol_type = other DNA
taatgctgctcactatag

SEQ ID NO: 2310 - DNA, 18 bp, synthetic construct
  source 1..18: mol_type = other DNA
gaagatgactcactatag

SEQ ID NO: 2311 - DNA, 18 bp, synthetic construct
  source 1..18: mol_type = other DNA
taaaacgactcacaataa

SEQ ID NO: 2312 - DNA, 18 bp, synthetic construct
  source 1..18: mol_type = other DNA
taagacgactcaccctag

SEQ ID NO: 2313 - DNA, 18 bp, synthetic construct
  source 1..18: mol_type = other DNA
taatacgactcacaattc

SEQ ID NO: 2314 - DNA, 18 bp, synthetic construct
  source 1..18: mol_type = other DNA
taatacgactcactcaaa

SEQ ID NO: 2315 - DNA, 18 bp, synthetic construct
  source 1..18: mol_type = other DNA
taatacgactcactttca

SEQ ID NO: 2316 - DNA, 18 bp, synthetic construct
  source 1..18: mol_type = other DNA
taatacgactctcgctag

SEQ ID NO: 2317 - DNA, 18 bp, synthetic construct
  source 1..18: mol_type = other DNA
taatacgactctctatca

SEQ ID NO: 2318 - DNA, 18 bp, synthetic construct
  source 1..18: mol_type = other DNA
taatacgcctgactattg

SEQ ID NO: 2319 - DNA, 18 bp, synthetic construct
  source 1..18: mol_type = other DNA
taatacggctcgctatgg

SEQ ID NO: 2320 - DNA, 18 bp, synthetic construct
  source 1..18: mol_type = other DNA
taatgcgactcactacgg

SEQ ID NO: 2321 - DNA, 18 bp, synthetic construct
  source 1..18: mol_type = other DNA
tagtacgactccctacag

SEQ ID NO: 2322 - DNA, 18 bp, synthetic construct
  source 1..18: mol_type = other DNA
tattacgacacactataa

SEQ ID NO: 2323 - DNA, 18 bp, synthetic construct
  source 1..18: mol_type = other DNA
aaatacgactcacaatat

SEQ ID NO: 2324 - DNA, 18 bp, synthetic construct
  source 1..18: mol_type = other DNA
aaatacgactcactacat

SEQ ID NO: 2325 - DNA, 18 bp, synthetic construct
  source 1..18: mol_type = other DNA
aaatacgactcactttaa

SEQ ID NO: 2326 - DNA, 18 bp, synthetic construct
  source 1..18: mol_type = other DNA
aaatacgactcactttac

SEQ ID NO: 2327 - DNA, 18 bp, synthetic construct
  source 1..18: mol_type = other DNA
caagacgcctcactatag

SEQ ID NO: 2328 - DNA, 18 bp, synthetic construct
  source 1..18: mol_type = other DNA
caataagactcactagag

SEQ ID NO: 2329 - DNA, 18 bp, synthetic construct
  source 1..18: mol_type = other DNA
cagtacgactcactatcg

SEQ ID NO: 2330 - DNA, 18 bp, synthetic construct
  source 1..18: mol_type = other DNA
gaatacgactcactgttg

SEQ ID NO: 2331 - DNA, 18 bp, synthetic construct
  source 1..18: mol_type = other DNA
gaatacgactcagtacag

SEQ ID NO: 2332 - DNA, 18 bp, synthetic construct
  source 1..18: mol_type = other DNA
gactacgactcactatgg

SEQ ID NO: 2333 - DNA, 18 bp, synthetic construct
  source 1..18: mol_type = other DNA
gcatacgactccctatag

SEQ ID NO: 2334 - DNA, 18 bp, synthetic construct
  source 1..18: mol_type = other DNA
taaaacgtctcactataa

SEQ ID NO: 2335 - DNA, 18 bp, synthetic construct
  source 1..18: mol_type = other DNA
taacacgactggctatag

SEQ ID NO: 2336 - DNA, 18 bp, synthetic construct
  source 1..18: mol_type = other DNA
taagcccactcactatag

SEQ ID NO: 2337 - DNA, 18 bp, synthetic construct
  source 1..18: mol_type = other DNA
taataagacacactagag

SEQ ID NO: 2338 - DNA, 18 bp, synthetic construct
  source 1..18: mol_type = other DNA
taataagactcactctaa

SEQ ID NO: 2339 - DNA, 18 bp, synthetic construct
  source 1..18: mol_type = other DNA
taatacaactcattatac

SEQ ID NO: 2340 - DNA, 18 bp, synthetic construct
  source 1..18: mol_type = other DNA
taatacaactctctataa

SEQ ID NO: 2341 - DNA, 18 bp, synthetic construct
  source 1..18: mol_type = other DNA
taataccaatcactataa

SEQ ID NO: 2342 - DNA, 18 bp, synthetic construct
  source 1..18: mol_type = other DNA
taatacgaatcactaaaa

SEQ ID NO: 2343 - DNA, 18 bp, synthetic construct
  source 1..18: mol_type = other DNA
taatacgaatcactattt

SEQ ID NO: 2344 - DNA, 18 bp, synthetic construct
  source 1..18: mol_type = other DNA
taatacgacgcaccatgg

SEQ ID NO: 2345 - DNA, 18 bp, synthetic construct
  source 1..18: mol_type = other DNA
taatacgactcaatgtaa

SEQ ID NO: 2346 - DNA, 18 bp, synthetic construct
  source 1..18: mol_type = other DNA
taatacgactcaccatcc

SEQ ID NO: 2347 - DNA, 18 bp, synthetic construct
  source 1..18: mol_type = other DNA
taatacgactcaccctgg

SEQ ID NO: 2348 - DNA, 18 bp, synthetic construct
  source 1..18: mol_type = other DNA
taatacgactcactaatt

SEQ ID NO: 2349 - DNA, 18 bp, synthetic construct
  source 1..18: mol_type = other DNA
taatacgactcactcttc

SEQ ID NO: 2350 - DNA, 18 bp, synthetic construct
  source 1..18: mol_type = other DNA
taatacgactcactttgc

SEQ ID NO: 2351 - DNA, 18 bp, synthetic construct
  source 1..18: mol_type = other DNA
taatacgactccctgcag

SEQ ID NO: 2352 - DNA, 18 bp, synthetic construct
  source 1..18: mol_type = other DNA
taatacgactccctgtac

SEQ ID NO: 2353 - DNA, 18 bp, synthetic construct
  source 1..18: mol_type = other DNA
taatacgaggcactaaag

SEQ ID NO: 2354 - DNA, 18 bp, synthetic construct
  source 1..18: mol_type = other DNA
taatacgagtcaccatcg

SEQ ID NO: 2355 - DNA, 18 bp, synthetic construct
  source 1..18: mol_type = other DNA
taatacgagtcacgatgg

SEQ ID NO: 2356 - DNA, 18 bp, synthetic construct
  source 1..18: mol_type = other DNA
taatacgagtcgctatcg

SEQ ID NO: 2357 - DNA, 18 bp, synthetic construct
  source 1..18: mol_type = other DNA
taatacgattcactaaac

SEQ ID NO: 2358 - DNA, 18 bp, synthetic construct
  source 1..18: mol_type = other DNA
taatacgcctcactttaa

SEQ ID NO: 2359 - DNA, 18 bp, synthetic construct
  source 1..18: mol_type = other DNA
taatacgcctcactttac

SEQ ID NO: 2360 - DNA, 18 bp, synthetic construct
  source 1..18: mol_type = other DNA
taatacgcctcagtatcg

SEQ ID NO: 2361 - DNA, 18 bp, synthetic construct
  source 1..18: mol_type = other DNA
taatacgtatcactatat

SEQ ID NO: 2362 - DNA, 18 bp, synthetic construct
  source 1..18: mol_type = other DNA
taatacgtctcactacat

SEQ ID NO: 2363 - DNA, 18 bp, synthetic construct
  source 1..18: mol_type = other DNA
taatactactcaatatac

SEQ ID NO: 2364 - DNA, 18 bp, synthetic construct
  source 1..18: mol_type = other DNA
taatactattcactataa

SEQ ID NO: 2365 - DNA, 18 bp, synthetic construct
  source 1..18: mol_type = other DNA
taataggactcactcgag

SEQ ID NO: 2366 - DNA, 18 bp, synthetic construct
  source 1..18: mol_type = other DNA
taataggactcactttat

SEQ ID NO: 2367 - DNA, 18 bp, synthetic construct
  source 1..18: mol_type = other DNA
taataggacttactacag

SEQ ID NO: 2368 - DNA, 18 bp, synthetic construct
  source 1..18: mol_type = other DNA
taatagtagtcactatag

SEQ ID NO: 2369 - DNA, 18 bp, synthetic construct
  source 1..18: mol_type = other DNA
taatatgacgcaccatag

SEQ ID NO: 2370 - DNA, 18 bp, synthetic construct
  source 1..18: mol_type = other DNA
taatatgacgcagtatag

SEQ ID NO: 2371 - DNA, 18 bp, synthetic construct
  source 1..18: mol_type = other DNA
taatccgactcactctgg

SEQ ID NO: 2372 - DNA, 18 bp, synthetic construct
  source 1..18: mol_type = other DNA
taatccgactcactgtaa

SEQ ID NO: 2373 - DNA, 18 bp, synthetic construct
  source 1..18: mol_type = other DNA
taatccgagtcagtatag

SEQ ID NO: 2374 - DNA, 18 bp, synthetic construct
  source 1..18: mol_type = other DNA
taatgcgactcactatca

SEQ ID NO: 2375 - DNA, 18 bp, synthetic construct
  source 1..18: mol_type = other DNA
taatgcgactcactcgag

SEQ ID NO: 2376 - DNA, 18 bp, synthetic construct
  source 1..18: mol_type = other DNA
taatgcgactcactgtat

SEQ ID NO: 2377 - DNA, 18 bp, synthetic construct
  source 1..18: mol_type = other DNA
taatgcgactcagtatgg

SEQ ID NO: 2378 - DNA, 18 bp, synthetic construct
  source 1..18: mol_type = other DNA
taatgcgactccctgtag

SEQ ID NO: 2379 - DNA, 18 bp, synthetic construct
  source 1..18: mol_type = other DNA
taatgcgcctcactatac

SEQ ID NO: 2380 - DNA, 18 bp, synthetic construct
  source 1..18: mol_type = other DNA
taatgggactcactatcg

SEQ ID NO: 2381 - DNA, 18 bp, synthetic construct
  source 1..18: mol_type = other DNA
taattcgactcacaatac

SEQ ID NO: 2382 - DNA, 18 bp, synthetic construct
  source 1..18: mol_type = other DNA
taattcgactcactattc

SEQ ID NO: 2383 - DNA, 18 bp, synthetic construct
  source 1..18: mol_type = other DNA
taatttgactcactataa

SEQ ID NO: 2384 - DNA, 18 bp, synthetic construct
  source 1..18: mol_type = other DNA
tactacgagtcaccatag

SEQ ID NO: 2385 - DNA, 18 bp, synthetic construct
  source 1..18: mol_type = other DNA
tagaacgactcactagag

SEQ ID NO: 2386 - DNA, 18 bp, synthetic construct
  source 1..18: mol_type = other DNA
tagtaagactcactagag

SEQ ID NO: 2387 - DNA, 18 bp, synthetic construct
  source 1..18: mol_type = other DNA
tatcacgactcactatat

SEQ ID NO: 2388 - DNA, 18 bp, synthetic construct
  source 1..18: mol_type = other DNA
tattaagactcactatac

SEQ ID NO: 2389 - DNA, 18 bp, synthetic construct
  source 1..18: mol_type = other DNA
tattacgactcaatatat

SEQ ID NO: 2390 - DNA, 18 bp, synthetic construct
  source 1..18: mol_type = other DNA
tattacgactcattataa

SEQ ID NO: 2391 - DNA, 18 bp, synthetic construct
  source 1..18: mol_type = other DNA
tcatacgattcactacag

SEQ ID NO: 2392 - DNA, 18 bp, synthetic construct
  source 1..18: mol_type = other DNA
tcatgcgagtcactatag

SEQ ID NO: 2393 - DNA, 18 bp, synthetic construct
  source 1..18: mol_type = other DNA
tcgtacgactcattatag

SEQ ID NO: 2394 - DNA, 18 bp, synthetic construct
  source 1..18: mol_type = other DNA
tgatgcgactcgctatag

SEQ ID NO: 2395 - DNA, 18 bp, synthetic construct
  source 1..18: mol_type = other DNA
tgattcgactcactataa

SEQ ID NO: 2396 - DNA, 18 bp, synthetic construct
  source 1..18: mol_type = other DNA
ttatacgactcactctaa

SEQ ID NO: 2397 - DNA, 18 bp, synthetic construct
  source 1..18: mol_type = other DNA
ttatatgactcactatat

SEQ ID NO: 2398 - DNA, 18 bp, synthetic construct
  source 1..18: mol_type = other DNA
ttatccgactcacgatag

SEQ ID NO: 2399 - DNA, 18 bp, synthetic construct
  source 1..18: mol_type = other DNA
ttattcgactcactatat

SEQ ID NO: 2400 - DNA, 18 bp, synthetic construct
  source 1..18: mol_type = other DNA
ttctacgactcactataa

SEQ ID NO: 2401 - DNA, 18 bp, synthetic construct
  source 1..18: mol_type = other DNA
ttattcgactcactacag

SEQ ID NO: 2402 - DNA, 18 bp, synthetic construct
  source 1..18: mol_type = other DNA
taataagactcacttttg

SEQ ID NO: 2403 - DNA, 18 bp, synthetic construct
  source 1..18: mol_type = other DNA
caataagactcactttag

SEQ ID NO: 2404 - DNA, 18 bp, synthetic construct
  source 1..18: mol_type = other DNA
taatacgtcttgctatag

SEQ ID NO: 2405 - DNA, 18 bp, synthetic construct
  source 1..18: mol_type = other DNA
ttatacgactcacagtag

SEQ ID NO: 2406 - DNA, 18 bp, synthetic construct
  source 1..18: mol_type = other DNA
caatacgactcactcaag

SEQ ID NO: 2407 - DNA, 18 bp, synthetic construct
  source 1..18: mol_type = other DNA
taaaacaactcactacag

SEQ ID NO: 2408 - DNA, 18 bp, synthetic construct
  source 1..18: mol_type = other DNA
taatagcactcactaaag

SEQ ID NO: 2409 - DNA, 18 bp, synthetic construct
  source 1..18: mol_type = other DNA
caatacgactcgctaaag

SEQ ID NO: 2410 - DNA, 18 bp, synthetic construct
  source 1..18: mol_type = other DNA
gaatacgactcacttaag

SEQ ID NO: 2411 - DNA, 18 bp, synthetic construct
  source 1..18: mol_type = other DNA
ttatacgcctcactgtag

SEQ ID NO: 2412 - DNA, 18 bp, synthetic construct
  source 1..18: mol_type = other DNA
tattacgcctcactaaag

SEQ ID NO: 2413 - DNA, 18 bp, synthetic construct
  source 1..18: mol_type = other DNA
tattacgactcgctaaag

SEQ ID NO: 2414 - DNA, 18 bp, synthetic construct
  source 1..18: mol_type = other DNA
taataggactcgctaaag

SEQ ID NO: 2415 - DNA, 18 bp, synthetic construct
  source 1..18: mol_type = other DNA
taattcgcctcactattg

SEQ ID NO: 2416 - DNA, 18 bp, synthetic construct
  source 1..18: mol_type = other DNA
ttaaaggactcactatag

SEQ ID NO: 2417 - DNA, 18 bp, synthetic construct
  source 1..18: mol_type = other DNA
ttatgggactcactatag

SEQ ID NO: 2418 - DNA, 18 bp, synthetic construct
  source 1..18: mol_type = other DNA
taataagactcaccatcg

SEQ ID NO: 2419 - DNA, 18 bp, synthetic construct
  source 1..18: mol_type = other DNA
taatatgactcactgtcg

SEQ ID NO: 2420 - DNA, 18 bp, synthetic construct
  source 1..18: mol_type = other DNA
taatataactcagtatag

SEQ ID NO: 2421 - DNA, 18 bp, synthetic construct
  source 1..18: mol_type = other DNA
ttataggactcagtatag

SEQ ID NO: 2422 - DNA, 18 bp, synthetic construct
  source 1..18: mol_type = other DNA
taattgaactcactatag

SEQ ID NO: 2423 - DNA, 18 bp, synthetic construct
  source 1..18: mol_type = other DNA
aaatacgactcgctaaag

SEQ ID NO: 2424 - DNA, 18 bp, synthetic construct
  source 1..18: mol_type = other DNA
tagtacgactcgctatgg

SEQ ID NO: 2425 - DNA, 18 bp, synthetic construct
  source 1..18: mol_type = other DNA
ttatacgactcagtagag

SEQ ID NO: 2426 - DNA, 18 bp, synthetic construct
  source 1..18: mol_type = other DNA
aaataagactcactacag

SEQ ID NO: 2427 - DNA, 18 bp, synthetic construct
  source 1..18: mol_type = other DNA
taattggactcaccatag

SEQ ID NO: 2428 - DNA, 18 bp, synthetic construct
  source 1..18: mol_type = other DNA
gaattcgactcacaatag

SEQ ID NO: 2429 - DNA, 18 bp, synthetic construct
  source 1..18: mol_type = other DNA
taatataactcactacag

SEQ ID NO: 2430 - DNA, 18 bp, synthetic construct
  source 1..18: mol_type = other DNA
taatacgcctcactactg

SEQ ID NO: 2431 - DNA, 18 bp, synthetic construct
  source 1..18: mol_type = other DNA
tcattcgactcactagag

SEQ ID NO: 2432 - DNA, 18 bp, synthetic construct
  source 1..18: mol_type = other DNA
taaaacgtctcactaaag

SEQ ID NO: 2433 - DNA, 18 bp, synthetic construct
  source 1..18: mol_type = other DNA
tcatgcgactcactttag

SEQ ID NO: 2434 - DNA, 18 bp, synthetic construct
  source 1..18: mol_type = other DNA
taatacgtgtctctatag

SEQ ID NO: 2435 - DNA, 18 bp, synthetic construct
  source 1..18: mol_type = other DNA
aaatgcgactcactgtag

SEQ ID NO: 2436 - DNA, 18 bp, synthetic construct
  source 1..18: mol_type = other DNA
taatacgcatcactctag

SEQ ID NO: 2437 - DNA, 18 bp, synthetic construct
  source 1..18: mol_type = other DNA
taatacgactcagttttg

SEQ ID NO: 2438 - DNA, 18 bp, synthetic construct
  source 1..18: mol_type = other DNA
caatacgactcacttttg

SEQ ID NO: 2439 - DNA, 18 bp, synthetic construct
  source 1..18: mol_type = other DNA
ttataggactcactaaag

SEQ ID NO: 2440 - DNA, 18 bp, synthetic construct
  source 1..18: mol_type = other DNA
tattgcgactcactatcg

SEQ ID NO: 2441 - DNA, 18 bp, synthetic construct
  source 1..18: mol_type = other DNA
ctatacgactcagtatag

SEQ ID NO: 2442 - DNA, 18 bp, synthetic construct
  source 1..18: mol_type = other DNA
taatatcgctcactatag

SEQ ID NO: 2443 - DNA, 18 bp, synthetic construct
  source 1..18: mol_type = other DNA
taatacgactcacctgag

SEQ ID NO: 2444 - DNA, 18 bp, synthetic construct
  source 1..18: mol_type = other DNA
taatcggactcacgatag

SEQ ID NO: 2445 - DNA, 18 bp, synthetic construct
  source 1..18: mol_type = other DNA
taatgcaactcagtatag

SEQ ID NO: 2446 - DNA, 18 bp, synthetic construct
  source 1..18: mol_type = other DNA
taatgcggctcactattg

SEQ ID NO: 2447 - DNA, 18 bp, synthetic construct
  source 1..18: mol_type = other DNA
gattacgactcactattg

SEQ ID NO: 2448 - DNA, 18 bp, synthetic construct
  source 1..18: mol_type = other DNA
taaaacgcctcactttag

SEQ ID NO: 2449 - DNA, 18 bp, synthetic construct
  source 1..18: mol_type = other DNA
taatactgctcactatcg

SEQ ID NO: 2450 - DNA, 18 bp, synthetic construct
  source 1..18: mol_type = other DNA
taattcgcctcactacag

SEQ ID NO: 2451 - DNA, 18 bp, synthetic construct
  source 1..18: mol_type = other DNA
taataagactctcgatag

SEQ ID NO: 2452 - DNA, 18 bp, synthetic construct
  source 1..18: mol_type = other DNA
taattcgactagctatag

SEQ ID NO: 2453 - DNA, 18 bp, synthetic construct
  source 1..18: mol_type = other DNA
taatacgactcactgccg

SEQ ID NO: 2454 - DNA, 18 bp, synthetic construct
  source 1..18: mol_type = other DNA
taatgagcctcactatag

SEQ ID NO: 2455 - DNA, 18 bp, synthetic construct
  source 1..18: mol_type = other DNA
taaaacgactcaccatcg

SEQ ID NO: 2456 - DNA, 18 bp, synthetic construct
  source 1..18: mol_type = other DNA
tgatacgactcactagtg

SEQ ID NO: 2457 - DNA, 18 bp, synthetic construct
  source 1..18: mol_type = other DNA
caagaggactcactatag

SEQ ID NO: 2458 - DNA, 18 bp, synthetic construct
  source 1..18: mol_type = other DNA
gaatacgacacaatatag

SEQ ID NO: 2459 - DNA, 18 bp, synthetic construct
  source 1..18: mol_type = other DNA
taagccgacttactatag

SEQ ID NO: 2460 - DNA, 18 bp, synthetic construct
  source 1..18: mol_type = other DNA
taatacggctcgccatag

SEQ ID NO: 2461 - DNA, 18 bp, synthetic construct
  source 1..18: mol_type = other DNA
ttatacgtctcactaaag

SEQ ID NO: 2462 - DNA, 18 bp, synthetic construct
  source 1..18: mol_type = other DNA
tattacggctcactatcg

SEQ ID NO: 2463 - DNA, 18 bp, synthetic construct
  source 1..18: mol_type = other DNA
taatacgactcacggttg

SEQ ID NO: 2464 - DNA, 18 bp, synthetic construct
  source 1..18: mol_type = other DNA
caaaacgactcagtatag

SEQ ID NO: 2465 - DNA, 18 bp, synthetic construct
  source 1..18: mol_type = other DNA
tcatacgactcacagtag

SEQ ID NO: 2466 - DNA, 18 bp, synthetic construct
  source 1..18: mol_type = other DNA
ttatacgaatcactctag

SEQ ID NO: 2467 - DNA, 18 bp, synthetic construct
  source 1..18: mol_type = other DNA
taatacaactcactgcag

SEQ ID NO: 2468 - DNA, 18 bp, synthetic construct
  source 1..18: mol_type = other DNA
gaattcgcctcactatag

SEQ ID NO: 2469 - DNA, 18 bp, synthetic construct
  source 1..18: mol_type = other DNA
tattacgactcactctcg

SEQ ID NO: 2470 - DNA, 18 bp, synthetic construct
  source 1..18: mol_type = other DNA
taatacgcttcactattg

SEQ ID NO: 2471 - DNA, 18 bp, synthetic construct
  source 1..18: mol_type = other DNA
taatcggactcactattg

SEQ ID NO: 2472 - DNA, 18 bp, synthetic construct
  source 1..18: mol_type = other DNA
taaaccgactcactatcg

SEQ ID NO: 2473 - DNA, 18 bp, synthetic construct
  source 1..18: mol_type = other DNA
taattcgactctgtatag

SEQ ID NO: 2474 - DNA, 18 bp, synthetic construct
  source 1..18: mol_type = other DNA
taatacgtcccactaaag

SEQ ID NO: 2475 - DNA, 18 bp, synthetic construct
  source 1..18: mol_type = other DNA
tataacgactcactatcg

SEQ ID NO: 2476 - DNA, 18 bp, synthetic construct
  source 1..18: mol_type = other DNA
ctatacgcctcactatag

SEQ ID NO: 2477 - DNA, 18 bp, synthetic construct
  source 1..18: mol_type = other DNA
taataggactcacagtag

SEQ ID NO: 2478 - DNA, 18 bp, synthetic construct
  source 1..18: mol_type = other DNA
gtatacgactcgctatag

SEQ ID NO: 2479 - DNA, 18 bp, synthetic construct
  source 1..18: mol_type = other DNA
taatgcgactcacaatcg

SEQ ID NO: 2480 - DNA, 18 bp, synthetic construct
  source 1..18: mol_type = other DNA
ttatacgtctcactattg

SEQ ID NO: 2481 - DNA, 18 bp, synthetic construct
  source 1..18: mol_type = other DNA
taatgcgattcactaaag

SEQ ID NO: 2482 - DNA, 18 bp, synthetic construct
  source 1..18: mol_type = other DNA
taattcgacttactgtag

SEQ ID NO: 2483 - DNA, 18 bp, synthetic construct
  source 1..18: mol_type = other DNA
taatgtgactcactaaag

SEQ ID NO: 2484 - DNA, 18 bp, synthetic construct
  source 1..18: mol_type = other DNA
caatttgactcactatag

SEQ ID NO: 2485 - DNA, 18 bp, synthetic construct
  source 1..18: mol_type = other DNA
caataagactcactacag

SEQ ID NO: 2486 - DNA, 18 bp, synthetic construct
  source 1..18: mol_type = other DNA
taaaaggactcactgtag

SEQ ID NO: 2487 - DNA, 18 bp, synthetic construct
  source 1..18: mol_type = other DNA
tattaagacgcactatag

SEQ ID NO: 2488 - DNA, 18 bp, synthetic construct
  source 1..18: mol_type = other DNA
taattggactcacgatag

SEQ ID NO: 2489 - DNA, 18 bp, synthetic construct
  source 1..18: mol_type = other DNA
aaatacgacgcactagag

SEQ ID NO: 2490 - DNA, 18 bp, synthetic construct
  source 1..18: mol_type = other DNA
gaatacgtctcactctag

SEQ ID NO: 2491 - DNA, 18 bp, synthetic construct
  source 1..18: mol_type = other DNA
taataggactcagcatag

SEQ ID NO: 2492 - DNA, 18 bp, synthetic construct
  source 1..18: mol_type = other DNA
taataggtcgcactatag

SEQ ID NO: 2493 - DNA, 18 bp, synthetic construct
  source 1..18: mol_type = other DNA
taatcggactcgctatag

SEQ ID NO: 2494 - DNA, 18 bp, synthetic construct
  source 1..18: mol_type = other DNA
taattggactcactatcg

SEQ ID NO: 2495 - DNA, 18 bp, synthetic construct
  source 1..18: mol_type = other DNA
tagtacgcctcactaaag

SEQ ID NO: 2496 - DNA, 18 bp, synthetic construct
  source 1..18: mol_type = other DNA
tcctgcgactcactatag

SEQ ID NO: 2497 - DNA, 18 bp, synthetic construct
  source 1..18: mol_type = other DNA
taacacgactcgctgtag

SEQ ID NO: 2498 - DNA, 18 bp, synthetic construct
  source 1..18: mol_type = other DNA
taagacgactcacaatcg

SEQ ID NO: 2499 - DNA, 18 bp, synthetic construct
  source 1..18: mol_type = other DNA
taagacgattaactatag

SEQ ID NO: 2500 - DNA, 18 bp, synthetic construct
  source 1..18: mol_type = other DNA
taatacgaatcactgtac

SEQ ID NO: 2501 - DNA, 18 bp, synthetic construct
  source 1..18: mol_type = other DNA
taatacgactaacggtag

SEQ ID NO: 2502 - DNA, 18 bp, synthetic construct
  source 1..18: mol_type = other DNA
taatacgactcaccaaac

SEQ ID NO: 2503 - DNA, 18 bp, synthetic construct
  source 1..18: mol_type = other DNA
taatacgccccactatcg

SEQ ID NO: 2504 - DNA, 18 bp, synthetic construct
  source 1..18: mol_type = other DNA
taatacggcgcactaaag

SEQ ID NO: 2505 - DNA, 18 bp, synthetic construct
  source 1..18: mol_type = other DNA
taataggcctcactgtag

SEQ ID NO: 2506 - DNA, 18 bp, synthetic construct
  source 1..18: mol_type = other DNA
taatccgcctcactatcg

SEQ ID NO: 2507 - DNA, 18 bp, synthetic construct
  source 1..18: mol_type = other DNA
taatgcgactccctacag

SEQ ID NO: 2508 - DNA, 18 bp, synthetic construct
  source 1..18: mol_type = other DNA
taatgcggctaactatag

SEQ ID NO: 2509 - DNA, 18 bp, synthetic construct
  source 1..18: mol_type = other DNA
taattcgactctctataa

SEQ ID NO: 2510 - DNA, 18 bp, synthetic construct
  source 1..18: mol_type = other DNA
tactacgacttactgtag

SEQ ID NO: 2511 - DNA, 18 bp, synthetic construct
  source 1..18: mol_type = other DNA
tattacgactcacgatgg

SEQ ID NO: 2512 - DNA, 18 bp, synthetic construct
  source 1..18: mol_type = other DNA
tgatgcgactcactgtag

SEQ ID NO: 2513 - DNA, 18 bp, synthetic construct
  source 1..18: mol_type = other DNA
aaataggactcactattg

SEQ ID NO: 2514 - DNA, 18 bp, synthetic construct
  source 1..18: mol_type = other DNA
taatccgcctcactacag

SEQ ID NO: 2515 - DNA, 18 bp, synthetic construct
  source 1..18: mol_type = other DNA
tattaggactcactagag

SEQ ID NO: 2516 - DNA, 18 bp, synthetic construct
  source 1..18: mol_type = other DNA
taataagaatcactatcg

SEQ ID NO: 2517 - DNA, 18 bp, synthetic construct
  source 1..18: mol_type = other DNA
taatacgactcactcctg

SEQ ID NO: 2518 - DNA, 18 bp, synthetic construct
  source 1..18: mol_type = other DNA
taatgcgactctctagag

SEQ ID NO: 2519 - DNA, 18 bp, synthetic construct
  source 1..18: mol_type = other DNA
ttaaaagactcactatag

SEQ ID NO: 2520 - DNA, 18 bp, synthetic construct
  source 1..18: mol_type = other DNA
taacacgactgactttag

SEQ ID NO: 2521 - DNA, 18 bp, synthetic construct
  source 1..18: mol_type = other DNA
taacgcgtctcactatag

SEQ ID NO: 2522 - DNA, 18 bp, synthetic construct
  source 1..18: mol_type = other DNA
taataagactcactacgg

SEQ ID NO: 2523 - DNA, 18 bp, synthetic construct
  source 1..18: mol_type = other DNA
taataaggctcgctatag

SEQ ID NO: 2524 - DNA, 18 bp, synthetic construct
  source 1..18: mol_type = other DNA
taatacgtctcactggag

SEQ ID NO: 2525 - DNA, 18 bp, synthetic construct
  source 1..18: mol_type = other DNA
taactcgactcgctatag

SEQ ID NO: 2526 - DNA, 18 bp, synthetic construct
  source 1..18: mol_type = other DNA
taatataactcgctatag

SEQ ID NO: 2527 - DNA, 18 bp, synthetic construct
  source 1..18: mol_type = other DNA
ttatacgcctcactacag

SEQ ID NO: 2528 - DNA, 18 bp, synthetic construct
  source 1..18: mol_type = other DNA
ttataggactcgctatag

SEQ ID NO: 2529 - DNA, 18 bp, synthetic construct
  source 1..18: mol_type = other DNA
caaaacgactcactacag

SEQ ID NO: 2530 - DNA, 18 bp, synthetic construct
  source 1..18: mol_type = other DNA
taaaacgcctcaccatag

SEQ ID NO: 2531 - DNA, 18 bp, synthetic construct
  source 1..18: mol_type = other DNA
taacacgattcactatgg

SEQ ID NO: 2532 - DNA, 18 bp, synthetic construct
  source 1..18: mol_type = other DNA
taatacgagtgactacag

SEQ ID NO: 2533 - DNA, 18 bp, synthetic construct
  source 1..18: mol_type = other DNA
taatacggcgcactattg

SEQ ID NO: 2534 - DNA, 18 bp, synthetic construct
  source 1..18: mol_type = other DNA
taatagggctcagtatag

SEQ ID NO: 2535 - DNA, 18 bp, synthetic construct
  source 1..18: mol_type = other DNA
taatatgactcgctacag

SEQ ID NO: 2536 - DNA, 18 bp, synthetic construct
  source 1..18: mol_type = other DNA
taatacgtctcactaatg

SEQ ID NO: 2537 - DNA, 18 bp, synthetic construct
  source 1..18: mol_type = other DNA
aaatacaactcactctag

SEQ ID NO: 2538 - DNA, 18 bp, synthetic construct
  source 1..18: mol_type = other DNA
tgatacgcctcactattg

SEQ ID NO: 2539 - DNA, 18 bp, synthetic construct
  source 1..18: mol_type = other DNA
taaatcgactcactacag

SEQ ID NO: 2540 - DNA, 18 bp, synthetic construct
  source 1..18: mol_type = other DNA
taattcgaatcgctatag

SEQ ID NO: 2541 - DNA, 18 bp, synthetic construct
  source 1..18: mol_type = other DNA
taatacgactcgctaatg

SEQ ID NO: 2542 - DNA, 18 bp, synthetic construct
  source 1..18: mol_type = other DNA
taatagaactcacaatag

SEQ ID NO: 2543 - DNA, 18 bp, synthetic construct
  source 1..18: mol_type = other DNA
tgatacggctcactattg

SEQ ID NO: 2544 - DNA, 18 bp, synthetic construct
  source 1..18: mol_type = other DNA
ttatatgcctcactatag

SEQ ID NO: 2545 - DNA, 18 bp, synthetic construct
  source 1..18: mol_type = other DNA
taaaacgactcactaccg

SEQ ID NO: 2546 - DNA, 18 bp, synthetic construct
  source 1..18: mol_type = other DNA
taatccgtctcgctatag

SEQ ID NO: 2547 - DNA, 18 bp, synthetic construct
  source 1..18: mol_type = other DNA
taagacgaatcactattg

SEQ ID NO: 2548 - DNA, 18 bp, synthetic construct
  source 1..18: mol_type = other DNA
taatacgacgcactccag

SEQ ID NO: 2549 - DNA, 18 bp, synthetic construct
  source 1..18: mol_type = other DNA
gtatacgactcactacag

SEQ ID NO: 2550 - DNA, 18 bp, synthetic construct
  source 1..18: mol_type = other DNA
taatacgactcaccctcg

SEQ ID NO: 2551 - DNA, 18 bp, synthetic construct
  source 1..18: mol_type = other DNA
taatacgactcattgtcg

SEQ ID NO: 2552 - DNA, 18 bp, synthetic construct
  source 1..18: mol_type = other DNA
taatacgactcggcatag

SEQ ID NO: 2553 - DNA, 18 bp, synthetic construct
  source 1..18: mol_type = other DNA
taatagtactcactctag

SEQ ID NO: 2554 - DNA, 18 bp, synthetic construct
  source 1..18: mol_type = other DNA
taatccgcctcactgtag

SEQ ID NO: 2555 - DNA, 18 bp, synthetic construct
  source 1..18: mol_type = other DNA
taatgcgactcactctgg

SEQ ID NO: 2556 - DNA, 18 bp, synthetic construct
  source 1..18: mol_type = other DNA
ttatacgactcactactg

SEQ ID NO: 2557 - DNA, 18 bp, synthetic construct
  source 1..18: mol_type = other DNA
atatgcgactcactatag

SEQ ID NO: 2558 - DNA, 18 bp, synthetic construct
  source 1..18: mol_type = other DNA
taatacaactcgctaaag

SEQ ID NO: 2559 - DNA, 18 bp, synthetic construct
  source 1..18: mol_type = other DNA
tactacgactctctacag

SEQ ID NO: 2560 - DNA, 18 bp, synthetic construct
  source 1..18: mol_type = other DNA
taaatggactcactatag

SEQ ID NO: 2561 - DNA, 18 bp, synthetic construct
  source 1..18: mol_type = other DNA
taatgcgaatcactttag

SEQ ID NO: 2562 - DNA, 18 bp, synthetic construct
  source 1..18: mol_type = other DNA
taaaacgactcaccattg

SEQ ID NO: 2563 - DNA, 18 bp, synthetic construct
  source 1..18: mol_type = other DNA
caaaacgcctcactatag

SEQ ID NO: 2564 - DNA, 18 bp, synthetic construct
  source 1..18: mol_type = other DNA
caatacgactcactaccg

SEQ ID NO: 2565 - DNA, 18 bp, synthetic construct
  source 1..18: mol_type = other DNA
taatacgacgcgctattg

SEQ ID NO: 2566 - DNA, 18 bp, synthetic construct
  source 1..18: mol_type = other DNA
taatgcgacttactacag

SEQ ID NO: 2567 - DNA, 18 bp, synthetic construct
  source 1..18: mol_type = other DNA
tattaggactcactgtag

SEQ ID NO: 2568 - DNA, 18 bp, synthetic construct
  source 1..18: mol_type = other DNA
aaatatgactcactagag

SEQ ID NO: 2569 - DNA, 18 bp, synthetic construct
  source 1..18: mol_type = other DNA
taattcgactcacgaaag

SEQ ID NO: 2570 - DNA, 18 bp, synthetic construct
  source 1..18: mol_type = other DNA
ttatatgactcactgtag

SEQ ID NO: 2571 - DNA, 18 bp, synthetic construct
  source 1..18: mol_type = other DNA
taatccgactcgctctag

SEQ ID NO: 2572 - DNA, 18 bp, synthetic construct
  source 1..18: mol_type = other DNA
tcatccgactcacaatag

SEQ ID NO: 2573 - DNA, 18 bp, synthetic construct
  source 1..18: mol_type = other DNA
tgatacgactcactactg

SEQ ID NO: 2574 - DNA, 18 bp, synthetic construct
  source 1..18: mol_type = other DNA
ttatacgactcactagtg

SEQ ID NO: 2575 - DNA, 18 bp, synthetic construct
  source 1..18: mol_type = other DNA
tactgcgtctcactatag

SEQ ID NO: 2576 - DNA, 18 bp, synthetic construct
  source 1..18: mol_type = other DNA
ttatacaactcgctatag

SEQ ID NO: 2577 - DNA, 18 bp, synthetic construct
  source 1..18: mol_type = other DNA
taattcgactcactgttg

SEQ ID NO: 2578 - DNA, 18 bp, synthetic construct
  source 1..18: mol_type = other DNA
taatacgactcacttatg

SEQ ID NO: 2579 - DNA, 18 bp, synthetic construct
  source 1..18: mol_type = other DNA
taattcgtctcactaaag

SEQ ID NO: 2580 - DNA, 18 bp, synthetic construct
  source 1..18: mol_type = other DNA
taatacgaatgactattg

SEQ ID NO: 2581 - DNA, 18 bp, synthetic construct
  source 1..18: mol_type = other DNA
taatacgactggctatgg

SEQ ID NO: 2582 - DNA, 18 bp, synthetic construct
  source 1..18: mol_type = other DNA
taatccgactcaatatcg

SEQ ID NO: 2583 - DNA, 18 bp, synthetic construct
  source 1..18: mol_type = other DNA
taatacgactcagttcag

SEQ ID NO: 2584 - DNA, 18 bp, synthetic construct
  source 1..18: mol_type = other DNA
caattcgactcactaaag

SEQ ID NO: 2585 - DNA, 18 bp, synthetic construct
  source 1..18: mol_type = other DNA
tattttgactcactatag

SEQ ID NO: 2586 - DNA, 18 bp, synthetic construct
  source 1..18: mol_type = other DNA
ttaaacgacgcactatag

SEQ ID NO: 2587 - DNA, 18 bp, synthetic construct
  source 1..18: mol_type = other DNA
tataacgactcactagag

SEQ ID NO: 2588 - DNA, 18 bp, synthetic construct
  source 1..18: mol_type = other DNA
taataagactcactctcg

SEQ ID NO: 2589 - DNA, 18 bp, synthetic construct
  source 1..18: mol_type = other DNA
taatgcgactcgccatag

SEQ ID NO: 2590 - DNA, 18 bp, synthetic construct
  source 1..18: mol_type = other DNA
taattagactcactacag

SEQ ID NO: 2591 - DNA, 18 bp, synthetic construct
  source 1..18: mol_type = other DNA
taaaaagtctcactatag

SEQ ID NO: 2592 - DNA, 18 bp, synthetic construct
  source 1..18: mol_type = other DNA
taaaacgcctcactattg

SEQ ID NO: 2593 - DNA, 18 bp, synthetic construct
  source 1..18: mol_type = other DNA
taatactgcccactatag

SEQ ID NO: 2594 - DNA, 18 bp, synthetic construct
  source 1..18: mol_type = other DNA
tactacgactcacttaag

SEQ ID NO: 2595 - DNA, 18 bp, synthetic construct
  source 1..18: mol_type = other DNA
taattagactcactattg

SEQ ID NO: 2596 - DNA, 18 bp, synthetic construct
  source 1..18: mol_type = other DNA
taaaatgactcactctag

SEQ ID NO: 2597 - DNA, 18 bp, synthetic construct
  source 1..18: mol_type = other DNA
tagttcgactcactacag

SEQ ID NO: 2598 - DNA, 18 bp, synthetic construct
  source 1..18: mol_type = other DNA
taatacgtcacactatcg

SEQ ID NO: 2599 - DNA, 18 bp, synthetic construct
  source 1..18: mol_type = other DNA
tagaacgtctcactatag

SEQ ID NO: 2600 - DNA, 18 bp, synthetic construct
  source 1..18: mol_type = other DNA
tattacgactcactttgg

SEQ ID NO: 2601 - DNA, 18 bp, synthetic construct
  source 1..18: mol_type = other DNA
tgattcgactcactacag

SEQ ID NO: 2602 - DNA, 18 bp, synthetic construct
  source 1..18: mol_type = other DNA
aaataagactcactctag

SEQ ID NO: 2603 - DNA, 18 bp, synthetic construct
  source 1..18: mol_type = other DNA
taaaacgagtcactttag

SEQ ID NO: 2604 - DNA, 18 bp, synthetic construct
  source 1..18: mol_type = other DNA
taaaacgcctcactacag

SEQ ID NO: 2605 - DNA, 18 bp, synthetic construct
  source 1..18: mol_type = other DNA
taatatgactcacgaaag

SEQ ID NO: 2606 - DNA, 18 bp, synthetic construct
  source 1..18: mol_type = other DNA
caatgcgactcaccatag

SEQ ID NO: 2607 - DNA, 18 bp, synthetic construct
  source 1..18: mol_type = other DNA
taatacgacacgctattg

SEQ ID NO: 2608 - DNA, 18 bp, synthetic construct
  source 1..18: mol_type = other DNA
taataaaactcactatcg

SEQ ID NO: 2609 - DNA, 18 bp, synthetic construct
  source 1..18: mol_type = other DNA
ttatagcactcactatag

SEQ ID NO: 2610 - DNA, 18 bp, synthetic construct
  source 1..18: mol_type = other DNA
tgattcgactcactctag

SEQ ID NO: 2611 - DNA, 18 bp, synthetic construct
  source 1..18: mol_type = other DNA
ttaaacgactcactagag

SEQ ID NO: 2612 - DNA, 18 bp, synthetic construct
  source 1..18: mol_type = other DNA
taatacggctcactttcg

SEQ ID NO: 2613 - DNA, 18 bp, synthetic construct
  source 1..18: mol_type = other DNA
taatacgactctctaccg

SEQ ID NO: 2614 - DNA, 18 bp, synthetic construct
  source 1..18: mol_type = other DNA
taatccgacgcactacag

SEQ ID NO: 2615 - DNA, 18 bp, synthetic construct
  source 1..18: mol_type = other DNA
tgttacgacgcactatag

SEQ ID NO: 2616 - DNA, 18 bp, synthetic construct
  source 1..18: mol_type = other DNA
caataggactcagtatag

SEQ ID NO: 2617 - DNA, 18 bp, synthetic construct
  source 1..18: mol_type = other DNA
gaatatgactcactgtag

SEQ ID NO: 2618 - DNA, 18 bp, synthetic construct
  source 1..18: mol_type = other DNA
taatacgactcaccccag

SEQ ID NO: 2619 - DNA, 18 bp, synthetic construct
  source 1..18: mol_type = other DNA
tgatatgactcactctag

SEQ ID NO: 2620 - DNA, 18 bp, synthetic construct
  source 1..18: mol_type = other DNA
taatacgactcgctaaaa

SEQ ID NO: 2621 - DNA, 18 bp, synthetic construct
  source 1..18: mol_type = other DNA
taatatgactcactagtg

SEQ ID NO: 2622 - DNA, 18 bp, synthetic construct
  source 1..18: mol_type = other DNA
gaataccactcacgatag

SEQ ID NO: 2623 - DNA, 18 bp, synthetic construct
  source 1..18: mol_type = other DNA
taataccactcactccag

SEQ ID NO: 2624 - DNA, 18 bp, synthetic construct
  source 1..18: mol_type = other DNA
taatacgacccgctaaag

SEQ ID NO: 2625 - DNA, 18 bp, synthetic construct
  source 1..18: mol_type = other DNA
taatacgactcaaaataa

SEQ ID NO: 2626 - DNA, 18 bp, synthetic construct
  source 1..18: mol_type = other DNA
taatacgattgactatgg

SEQ ID NO: 2627 - DNA, 18 bp, synthetic construct
  source 1..18: mol_type = other DNA
taatcggactcagtatag

SEQ ID NO: 2628 - DNA, 18 bp, synthetic construct
  source 1..18: mol_type = other DNA
tactgcaactcactatag

SEQ ID NO: 2629 - DNA, 18 bp, synthetic construct
  source 1..18: mol_type = other DNA
tattacgactcactatca

SEQ ID NO: 2630 - DNA, 18 bp, synthetic construct
  source 1..18: mol_type = other DNA
tgttccgactcactatag

SEQ ID NO: 2631 - DNA, 18 bp, synthetic construct
  source 1..18: mol_type = other DNA
ttatacgcctcgctatag

SEQ ID NO: 2632 - DNA, 18 bp, synthetic construct
  source 1..18: mol_type = other DNA
aaatacgactcacaataa

SEQ ID NO: 2633 - DNA, 18 bp, synthetic construct
  source 1..18: mol_type = other DNA
caacacgactcactatcg

SEQ ID NO: 2634 - DNA, 18 bp, synthetic construct
  source 1..18: mol_type = other DNA
caacaggactcactatag

SEQ ID NO: 2635 - DNA, 18 bp, synthetic construct
  source 1..18: mol_type = other DNA
caatacgactcactgcag

SEQ ID NO: 2636 - DNA, 18 bp, synthetic construct
  source 1..18: mol_type = other DNA
cagtacgactcactgtag

SEQ ID NO: 2637 - DNA, 18 bp, synthetic construct
  source 1..18: mol_type = other DNA
gaacacgacccactatag

SEQ ID NO: 2638 - DNA, 18 bp, synthetic construct
  source 1..18: mol_type = other DNA
gaaggcgactcactatag

SEQ ID NO: 2639 - DNA, 18 bp, synthetic construct
  source 1..18: mol_type = other DNA
gaatacgactcactctgg

SEQ ID NO: 2640 - DNA, 18 bp, synthetic construct
  source 1..18: mol_type = other DNA
gaatacgactcatcatag

SEQ ID NO: 2641 - DNA, 18 bp, synthetic construct
  source 1..18: mol_type = other DNA
gaatacgactcattatgg

SEQ ID NO: 2642 - DNA, 18 bp, synthetic construct
  source 1..18: mol_type = other DNA
gaatacgtctcactagag

SEQ ID NO: 2643 - DNA, 18 bp, synthetic construct
  source 1..18: mol_type = other DNA
gaatactgctcactatag

SEQ ID NO: 2644 - DNA, 18 bp, synthetic construct
  source 1..18: mol_type = other DNA
gaatgcgactcagtatag

SEQ ID NO: 2645 - DNA, 18 bp, synthetic construct
  source 1..18: mol_type = other DNA
taaaacggctcgctatag

SEQ ID NO: 2646 - DNA, 18 bp, synthetic construct
  source 1..18: mol_type = other DNA
taaagcgactcactgtag

SEQ ID NO: 2647 - DNA, 18 bp, synthetic construct
  source 1..18: mol_type = other DNA
taacacaactccctatag

SEQ ID NO: 2648 - DNA, 18 bp, synthetic construct
  source 1..18: mol_type = other DNA
taagaccacccactatag

SEQ ID NO: 2649 - DNA, 18 bp, synthetic construct
  source 1..18: mol_type = other DNA
taagaccgctcactatag

SEQ ID NO: 2650 - DNA, 18 bp, synthetic construct
  source 1..18: mol_type = other DNA
taagacgactgacaatag

SEQ ID NO: 2651 - DNA, 18 bp, synthetic construct
  source 1..18: mol_type = other DNA
taagccgactcaatatag

SEQ ID NO: 2652 - DNA, 18 bp, synthetic construct
  source 1..18: mol_type = other DNA
taataagacggactatag

SEQ ID NO: 2653 - DNA, 18 bp, synthetic construct
  source 1..18: mol_type = other DNA
taatacaacgcactatcg

SEQ ID NO: 2654 - DNA, 18 bp, synthetic construct
  source 1..18: mol_type = other DNA
taatacaactgactatat

SEQ ID NO: 2655 - DNA, 18 bp, synthetic construct
  source 1..18: mol_type = other DNA
taatacatctcactatat

SEQ ID NO: 2656 - DNA, 18 bp, synthetic construct
  source 1..18: mol_type = other DNA
taataccacgcagtatag

SEQ ID NO: 2657 - DNA, 18 bp, synthetic construct
  source 1..18: mol_type = other DNA
taataccactcgctatcg

SEQ ID NO: 2658 - DNA, 18 bp, synthetic construct
  source 1..18: mol_type = other DNA
taataccatgcactatag

SEQ ID NO: 2659 - DNA, 18 bp, synthetic construct
  source 1..18: mol_type = other DNA
taatacgacccacgatcg

SEQ ID NO: 2660 - DNA, 18 bp, synthetic construct
  source 1..18: mol_type = other DNA
taatacgacccactccag

SEQ ID NO: 2661 - DNA, 18 bp, synthetic construct
  source 1..18: mol_type = other DNA
taatacgacccagcatag

SEQ ID NO: 2662 - DNA, 18 bp, synthetic construct
  source 1..18: mol_type = other DNA
taatacgactcaccaaaa

SEQ ID NO: 2663 - DNA, 18 bp, synthetic construct
  source 1..18: mol_type = other DNA
taatacgactcacggtaa

SEQ ID NO: 2664 - DNA, 18 bp, synthetic construct
  source 1..18: mol_type = other DNA
taatacgactcactaaga

SEQ ID NO: 2665 - DNA, 18 bp, synthetic construct
  source 1..18: mol_type = other DNA
taatacgactcactaagc

SEQ ID NO: 2666 - DNA, 18 bp, synthetic construct
  source 1..18: mol_type = other DNA
taatacgactcactggcg

SEQ ID NO: 2667 - DNA, 18 bp, synthetic construct
  source 1..18: mol_type = other DNA
taatacgactcagggtag

SEQ ID NO: 2668 - DNA, 18 bp, synthetic construct
  source 1..18: mol_type = other DNA
taatacgactccctttaa

SEQ ID NO: 2669 - DNA, 18 bp, synthetic construct
  source 1..18: mol_type = other DNA
taatacgactcggtagag

SEQ ID NO: 2670 - DNA, 18 bp, synthetic construct
  source 1..18: mol_type = other DNA
taatacgactctctttat

SEQ ID NO: 2671 - DNA, 18 bp, synthetic construct
  source 1..18: mol_type = other DNA
taatacgactctgtataa

SEQ ID NO: 2672 - DNA, 18 bp, synthetic construct
  source 1..18: mol_type = other DNA
taatacgactggctgtag

SEQ ID NO: 2673 - DNA, 18 bp, synthetic construct
  source 1..18: mol_type = other DNA
taatacgactttctatat

SEQ ID NO: 2674 - DNA, 18 bp, synthetic construct
  source 1..18: mol_type = other DNA
taatacgagtcaatatcg

SEQ ID NO: 2675 - DNA, 18 bp, synthetic construct
  source 1..18: mol_type = other DNA
taatacgagtcactgtgg

SEQ ID NO: 2676 - DNA, 18 bp, synthetic construct
  source 1..18: mol_type = other DNA
taatacgatgcactatcg

SEQ ID NO: 2677 - DNA, 18 bp, synthetic construct
  source 1..18: mol_type = other DNA
taatacggctcgatatag

SEQ ID NO: 2678 - DNA, 18 bp, synthetic construct
  source 1..18: mol_type = other DNA
taatacgtcacactataa

SEQ ID NO: 2679 - DNA, 18 bp, synthetic construct
  source 1..18: mol_type = other DNA
taatacgtctcactattc

SEQ ID NO: 2680 - DNA, 18 bp, synthetic construct
  source 1..18: mol_type = other DNA
taatacgtctcactttat

SEQ ID NO: 2681 - DNA, 18 bp, synthetic construct
  source 1..18: mol_type = other DNA
taatactactcacgacag

SEQ ID NO: 2682 - DNA, 18 bp, synthetic construct
  source 1..18: mol_type = other DNA
taatactactcactatga

SEQ ID NO: 2683 - DNA, 18 bp, synthetic construct
  source 1..18: mol_type = other DNA
taatactactcactttac

SEQ ID NO: 2684 - DNA, 18 bp, synthetic construct
  source 1..18: mol_type = other DNA
taataggacccactatcg

SEQ ID NO: 2685 - DNA, 18 bp, synthetic construct
  source 1..18: mol_type = other DNA
taatatgactcactatca

SEQ ID NO: 2686 - DNA, 18 bp, synthetic construct
  source 1..18: mol_type = other DNA
taatatgactcactgtac

SEQ ID NO: 2687 - DNA, 18 bp, synthetic construct
  source 1..18: mol_type = other DNA
taatatgcctcactgtag

SEQ ID NO: 2688 - DNA, 18 bp, synthetic construct
  source 1..18: mol_type = other DNA
taatccgactcactacgg

SEQ ID NO: 2689 - DNA, 18 bp, synthetic construct
  source 1..18: mol_type = other DNA
taatgcgacccactagag

SEQ ID NO: 2690 - DNA, 18 bp, synthetic construct
  source 1..18: mol_type = other DNA
taatgcgactcacgatcg

SEQ ID NO: 2691 - DNA, 18 bp, synthetic construct
  source 1..18: mol_type = other DNA
taattcgactcaccataa

SEQ ID NO: 2692 - DNA, 18 bp, synthetic construct
  source 1..18: mol_type = other DNA
taattcgactcactttat

SEQ ID NO: 2693 - DNA, 18 bp, synthetic construct
  source 1..18: mol_type = other DNA
taattcgactcagtataa

SEQ ID NO: 2694 - DNA, 18 bp, synthetic construct
  source 1..18: mol_type = other DNA
tacgacgagtcactatag

SEQ ID NO: 2695 - DNA, 18 bp, synthetic construct
  source 1..18: mol_type = other DNA
tactacgactcacgattg

SEQ ID NO: 2696 - DNA, 18 bp, synthetic construct
  source 1..18: mol_type = other DNA
tactacgagtcgctatag

SEQ ID NO: 2697 - DNA, 18 bp, synthetic construct
  source 1..18: mol_type = other DNA
tagcaagactcactatag

SEQ ID NO: 2698 - DNA, 18 bp, synthetic construct
  source 1..18: mol_type = other DNA
tattacgacgcagtatag

SEQ ID NO: 2699 - DNA, 18 bp, synthetic construct
  source 1..18: mol_type = other DNA
tcacacgacccactatag

SEQ ID NO: 2700 - DNA, 18 bp, synthetic construct
  source 1..18: mol_type = other DNA
tcatacgactcactagtg

SEQ ID NO: 2701 - DNA, 18 bp, synthetic construct
  source 1..18: mol_type = other DNA
tcatacgactcactctgg

SEQ ID NO: 2702 - DNA, 18 bp, synthetic construct
  source 1..18: mol_type = other DNA
tcatacgactcagtgtag

SEQ ID NO: 2703 - DNA, 18 bp, synthetic construct
  source 1..18: mol_type = other DNA
tgagacgactcactttag

SEQ ID NO: 2704 - DNA, 18 bp, synthetic construct
  source 1..18: mol_type = other DNA
tgatacaactcaccatag

SEQ ID NO: 2705 - DNA, 18 bp, synthetic construct
  source 1..18: mol_type = other DNA
tgatacgactcactgtaa

SEQ ID NO: 2706 - DNA, 18 bp, synthetic construct
  source 1..18: mol_type = other DNA
tgatgcgactcactagag

SEQ ID NO: 2707 - DNA, 18 bp, synthetic construct
  source 1..18: mol_type = other DNA
ttagacgactcactgtag

SEQ ID NO: 2708 - DNA, 18 bp, synthetic construct
  source 1..18: mol_type = other DNA
ttatacgactcactatct

SEQ ID NO: 2709 - DNA, 18 bp, synthetic construct
  source 1..18: mol_type = other DNA
tgttacgactcactttag

SEQ ID NO: 2710 - DNA, 18 bp, synthetic construct
  source 1..18: mol_type = other DNA
taattcgactcacaatgg

SEQ ID NO: 2711 - DNA, 18 bp, synthetic construct
  source 1..18: mol_type = other DNA
taattcaactcactttag

SEQ ID NO: 2712 - DNA, 18 bp, synthetic construct
  source 1..18: mol_type = other DNA
ttataagactcactctag

SEQ ID NO: 2713 - DNA, 18 bp, synthetic construct
  source 1..18: mol_type = other DNA
taatcagactcactaaag

SEQ ID NO: 2714 - DNA, 18 bp, synthetic construct
  source 1..18: mol_type = other DNA
acttacgactcactatag

SEQ ID NO: 2715 - DNA, 18 bp, synthetic construct
  source 1..18: mol_type = other DNA
aaataagactcactgtag

SEQ ID NO: 2716 - DNA, 18 bp, synthetic construct
  source 1..18: mol_type = other DNA
taataagtctcactatcg

SEQ ID NO: 2717 - DNA, 18 bp, synthetic construct
  source 1..18: mol_type = other DNA
ttattcgactcactctag

SEQ ID NO: 2718 - DNA, 18 bp, synthetic construct
  source 1..18: mol_type = other DNA
taatacgactcagtttgg

SEQ ID NO: 2719 - DNA, 18 bp, synthetic construct
  source 1..18: mol_type = other DNA
taataagactcactccag

SEQ ID NO: 2720 - DNA, 18 bp, synthetic construct
  source 1..18: mol_type = other DNA
taattcgacgctctatag

SEQ ID NO: 2721 - DNA, 18 bp, synthetic construct
  source 1..18: mol_type = other DNA
ttatacgactcactcttg

SEQ ID NO: 2722 - DNA, 18 bp, synthetic construct
  source 1..18: mol_type = other DNA
aattaggactcactatag

SEQ ID NO: 2723 - DNA, 18 bp, synthetic construct
  source 1..18: mol_type = other DNA
tgaaacgactcgctatag

SEQ ID NO: 2724 - DNA, 18 bp, synthetic construct
  source 1..18: mol_type = other DNA
caatacgtctcactgtag

SEQ ID NO: 2725 - DNA, 18 bp, synthetic construct
  source 1..18: mol_type = other DNA
taatacgactcacttacg

SEQ ID NO: 2726 - DNA, 18 bp, synthetic construct
  source 1..18: mol_type = other DNA
taatacaactcacactag

SEQ ID NO: 2727 - DNA, 18 bp, synthetic construct
  source 1..18: mol_type = other DNA
taataagactcactgttg

SEQ ID NO: 2728 - DNA, 18 bp, synthetic construct
  source 1..18: mol_type = other DNA
tattacgactcactactg

SEQ ID NO: 2729 - DNA, 18 bp, synthetic construct
  source 1..18: mol_type = other DNA
taataaaactcgctatag

SEQ ID NO: 2730 - DNA, 18 bp, synthetic construct
  source 1..18: mol_type = other DNA
ttatacgcctcactatgg

SEQ ID NO: 2731 - DNA, 18 bp, synthetic construct
  source 1..18: mol_type = other DNA
taataagactcactttgg

SEQ ID NO: 2732 - DNA, 18 bp, synthetic construct
  source 1..18: mol_type = other DNA
caatacgactcactttcg

SEQ ID NO: 2733 - DNA, 18 bp, synthetic construct
  source 1..18: mol_type = other DNA
taatactacgcagtatag

SEQ ID NO: 2734 - DNA, 18 bp, synthetic construct
  source 1..18: mol_type = other DNA
tgatcctactcactatag

SEQ ID NO: 2735 - DNA, 18 bp, synthetic construct
  source 1..18: mol_type = other DNA
tattacgactcgccatag

SEQ ID NO: 2736 - DNA, 18 bp, synthetic construct
  source 1..18: mol_type = other DNA
ttaaacgtctcactatag

SEQ ID NO: 2737 - DNA, 18 bp, synthetic construct
  source 1..18: mol_type = other DNA
taatacgactcgctatta

SEQ ID NO: 2738 - DNA, 18 bp, synthetic construct
  source 1..18: mol_type = other DNA
taattggacgcactatag

SEQ ID NO: 2739 - DNA, 18 bp, synthetic construct
  source 1..18: mol_type = other DNA
ttatacgcctcactttag

SEQ ID NO: 2740 - DNA, 18 bp, synthetic construct
  source 1..18: mol_type = other DNA
taatatgagacactatag

SEQ ID NO: 2741 - DNA, 18 bp, synthetic construct
  source 1..18: mol_type = other DNA
ttatacgactcagtctag

SEQ ID NO: 2742 - DNA, 18 bp, synthetic construct
  source 1..18: mol_type = other DNA
tattacgactcaccttag

SEQ ID NO: 2743 - DNA, 18 bp, synthetic construct
  source 1..18: mol_type = other DNA
taataagactcactgtcg

SEQ ID NO: 2744 - DNA, 18 bp, synthetic construct
  source 1..18: mol_type = other DNA
caatgagactcactatag

SEQ ID NO: 2745 - DNA, 18 bp, synthetic construct
  source 1..18: mol_type = other DNA
taatcccactcactatcg

SEQ ID NO: 2746 - DNA, 18 bp, synthetic construct
  source 1..18: mol_type = other DNA
taatctgactcactagag

SEQ ID NO: 2747 - DNA, 18 bp, synthetic construct
  source 1..18: mol_type = other DNA
tgatacgactcactcgag

SEQ ID NO: 2748 - DNA, 18 bp, synthetic construct
  source 1..18: mol_type = other DNA
tatttggactcactatag

SEQ ID NO: 2749 - DNA, 18 bp, synthetic construct
  source 1..18: mol_type = other DNA
tattacgacttgctatag

SEQ ID NO: 2750 - DNA, 18 bp, synthetic construct
  source 1..18: mol_type = other DNA
ttatacgtctcactacag

SEQ ID NO: 2751 - DNA, 18 bp, synthetic construct
  source 1..18: mol_type = other DNA
agataagactcactatag

SEQ ID NO: 2752 - DNA, 18 bp, synthetic construct
  source 1..18: mol_type = other DNA
taatacgactcactgagg

SEQ ID NO: 2753 - DNA, 18 bp, synthetic construct
  source 1..18: mol_type = other DNA
taattcaactcactacag

SEQ ID NO: 2754 - DNA, 18 bp, synthetic construct
  source 1..18: mol_type = other DNA
taatgagactcactttag

SEQ ID NO: 2755 - DNA, 18 bp, synthetic construct
  source 1..18: mol_type = other DNA
taatacgactcgccaaag

SEQ ID NO: 2756 - DNA, 18 bp, synthetic construct
  source 1..18: mol_type = other DNA
taatccgactcactactg

SEQ ID NO: 2757 - DNA, 18 bp, synthetic construct
  source 1..18: mol_type = other DNA
ttataagactcactacag

SEQ ID NO: 2758 - DNA, 18 bp, synthetic construct
  source 1..18: mol_type = other DNA
taatgctcctcactatag

SEQ ID NO: 2759 - DNA, 18 bp, synthetic construct
  source 1..18: mol_type = other DNA
taatatgactcactaccg

SEQ ID NO: 2760 - DNA, 18 bp, synthetic construct
  source 1..18: mol_type = other DNA
tagttcgactcgctatag

SEQ ID NO: 2761 - DNA, 18 bp, synthetic construct
  source 1..18: mol_type = other DNA
tgatgcgactcactatgg

SEQ ID NO: 2762 - DNA, 18 bp, synthetic construct
  source 1..18: mol_type = other DNA
taattaaactcactatag

SEQ ID NO: 2763 - DNA, 18 bp, synthetic construct
  source 1..18: mol_type = other DNA
taacacgtctcactaaag

SEQ ID NO: 2764 - DNA, 18 bp, synthetic construct
  source 1..18: mol_type = other DNA
taatacgactcagaattg

SEQ ID NO: 2765 - DNA, 18 bp, synthetic construct
  source 1..18: mol_type = other DNA
cattacgactcgctatag

SEQ ID NO: 2766 - DNA, 18 bp, synthetic construct
  source 1..18: mol_type = other DNA
taataggactcactaatg

SEQ ID NO: 2767 - DNA, 18 bp, synthetic construct
  source 1..18: mol_type = other DNA
aaatgcgactcactttag

SEQ ID NO: 2768 - DNA, 18 bp, synthetic construct
  source 1..18: mol_type = other DNA
tatcatgactcactatag

SEQ ID NO: 2769 - DNA, 18 bp, synthetic construct
  source 1..18: mol_type = other DNA
taatacggctcaatattg

SEQ ID NO: 2770 - DNA, 18 bp, synthetic construct
  source 1..18: mol_type = other DNA
ttttaggactcactatag

SEQ ID NO: 2771 - DNA, 18 bp, synthetic construct
  source 1..18: mol_type = other DNA
taaaacgtctcactgtag

SEQ ID NO: 2772 - DNA, 18 bp, synthetic construct
  source 1..18: mol_type = other DNA
tattacggctcaccatag

SEQ ID NO: 2773 - DNA, 18 bp, synthetic construct
  source 1..18: mol_type = other DNA
ttattagactcactatag

SEQ ID NO: 2774 - DNA, 18 bp, synthetic construct
  source 1..18: mol_type = other DNA
tatcacgtctcactatag

SEQ ID NO: 2775 - DNA, 18 bp, synthetic construct
  source 1..18: mol_type = other DNA
tattacgcctcactattg

SEQ ID NO: 2776 - DNA, 18 bp, synthetic construct
  source 1..18: mol_type = other DNA
aaaaacgactcactttag

SEQ ID NO: 2777 - DNA, 18 bp, synthetic construct
  source 1..18: mol_type = other DNA
ttgaacgactcactatag

SEQ ID NO: 2778 - DNA, 18 bp, synthetic construct
  source 1..18: mol_type = other DNA
taatacgactcgcttttg

SEQ ID NO: 2779 - DNA, 18 bp, synthetic construct
  source 1..18: mol_type = other DNA
tatttcgtctcactatag

SEQ ID NO: 2780 - DNA, 18 bp, synthetic construct
  source 1..18: mol_type = other DNA
taatgtaactcactatag

SEQ ID NO: 2781 - DNA, 18 bp, synthetic construct
  source 1..18: mol_type = other DNA
ctataagactcactatag

SEQ ID NO: 2782 - DNA, 18 bp, synthetic construct
  source 1..18: mol_type = other DNA
taaaacgaatcactatgg

SEQ ID NO: 2783 - DNA, 18 bp, synthetic construct
  source 1..18: mol_type = other DNA
taatatgactcacttcag

SEQ ID NO: 2784 - DNA, 18 bp, synthetic construct
  source 1..18: mol_type = other DNA
taaaacgagtcactaaag

SEQ ID NO: 2785 - DNA, 18 bp, synthetic construct
  source 1..18: mol_type = other DNA
tattgagactcactatag

SEQ ID NO: 2786 - DNA, 18 bp, synthetic construct
  source 1..18: mol_type = other DNA
gaatatgactcactaaag

SEQ ID NO: 2787 - DNA, 18 bp, synthetic construct
  source 1..18: mol_type = other DNA
taatgcgactcacagtag

SEQ ID NO: 2788 - DNA, 18 bp, synthetic construct
  source 1..18: mol_type = other DNA
tagtaggactcactaaag

SEQ ID NO: 2789 - DNA, 18 bp, synthetic construct
  source 1..18: mol_type = other DNA
caatacgactcactgaag

SEQ ID NO: 2790 - DNA, 18 bp, synthetic construct
  source 1..18: mol_type = other DNA
taatacgcctcaccgtag

SEQ ID NO: 2791 - DNA, 18 bp, synthetic construct
  source 1..18: mol_type = other DNA
aaatacgacgcaccatag

SEQ ID NO: 2792 - DNA, 18 bp, synthetic construct
  source 1..18: mol_type = other DNA
caataagactcactgtag

SEQ ID NO: 2793 - DNA, 18 bp, synthetic construct
  source 1..18: mol_type = other DNA
gaatacgacccaccatag

SEQ ID NO: 2794 - DNA, 18 bp, synthetic construct
  source 1..18: mol_type = other DNA
taaaacgactcactttat

SEQ ID NO: 2795 - DNA, 18 bp, synthetic construct
  source 1..18: mol_type = other DNA
taataagaaccactatag

SEQ ID NO: 2796 - DNA, 18 bp, synthetic construct
  source 1..18: mol_type = other DNA
taatacgactcgatatgg

SEQ ID NO: 2797 - DNA, 18 bp, synthetic construct
  source 1..18: mol_type = other DNA
taatacgactctggatag

SEQ ID NO: 2798 - DNA, 18 bp, synthetic construct
  source 1..18: mol_type = other DNA
taatacgagtccctacag

SEQ ID NO: 2799 - DNA, 18 bp, synthetic construct
  source 1..18: mol_type = other DNA
taatacgattcgctctag

SEQ ID NO: 2800 - DNA, 18 bp, synthetic construct
  source 1..18: mol_type = other DNA
taatactactgactacag

SEQ ID NO: 2801 - DNA, 18 bp, synthetic construct
  source 1..18: mol_type = other DNA
taataggactcaatagag

SEQ ID NO: 2802 - DNA, 18 bp, synthetic construct
  source 1..18: mol_type = other DNA
taatgcgactcaccagag

SEQ ID NO: 2803 - DNA, 18 bp, synthetic construct
  source 1..18: mol_type = other DNA
taatgcgactcactgtgg

SEQ ID NO: 2804 - DNA, 18 bp, synthetic construct
  source 1..18: mol_type = other DNA
taattcgcctcactgtag

SEQ ID NO: 2805 - DNA, 18 bp, synthetic construct
  source 1..18: mol_type = other DNA
tactacgactcactccag

SEQ ID NO: 2806 - DNA, 18 bp, synthetic construct
  source 1..18: mol_type = other DNA
tactacggctcactatcg

SEQ ID NO: 2807 - DNA, 18 bp, synthetic construct
  source 1..18: mol_type = other DNA
tagaacgcctcactatag

SEQ ID NO: 2808 - DNA, 18 bp, synthetic construct
  source 1..18: mol_type = other DNA
tagtacgactaactagag

SEQ ID NO: 2809 - DNA, 18 bp, synthetic construct
  source 1..18: mol_type = other DNA
tattacgactcactgtac

SEQ ID NO: 2810 - DNA, 18 bp, synthetic construct
  source 1..18: mol_type = other DNA
tgatacgagtcacaatag

SEQ ID NO: 2811 - DNA, 18 bp, synthetic construct
  source 1..18: mol_type = other DNA
aaactcgactcactatag

SEQ ID NO: 2812 - DNA, 18 bp, synthetic construct
  source 1..18: mol_type = other DNA
ttatacgactcactgttg

SEQ ID NO: 2813 - DNA, 18 bp, synthetic construct
  source 1..18: mol_type = other DNA
ttatacgcctcaccatag

SEQ ID NO: 2814 - DNA, 18 bp, synthetic construct
  source 1..18: mol_type = other DNA
tcttacgactaactatag

SEQ ID NO: 2815 - DNA, 18 bp, synthetic construct
  source 1..18: mol_type = other DNA
ttattcgactcactaaag

SEQ ID NO: 2816 - DNA, 18 bp, synthetic construct
  source 1..18: mol_type = other DNA
tattatgactcactagag

SEQ ID NO: 2817 - DNA, 18 bp, synthetic construct
  source 1..18: mol_type = other DNA
tgatacaactcactttag

SEQ ID NO: 2818 - DNA, 18 bp, synthetic construct
  source 1..18: mol_type = other DNA
ttatatgactcactttag

SEQ ID NO: 2819 - DNA, 18 bp, synthetic construct
  source 1..18: mol_type = other DNA
tatcacgactcactttag

SEQ ID NO: 2820 - DNA, 18 bp, synthetic construct
  source 1..18: mol_type = other DNA
tataatgactcactatag

SEQ ID NO: 2821 - DNA, 18 bp, synthetic construct
  source 1..18: mol_type = other DNA
taacacgactcactctgg

SEQ ID NO: 2822 - DNA, 18 bp, synthetic construct
  source 1..18: mol_type = other DNA
taatacaactcactgtcg

SEQ ID NO: 2823 - DNA, 18 bp, synthetic construct
  source 1..18: mol_type = other DNA
taatacgacgccctattg

SEQ ID NO: 2824 - DNA, 18 bp, synthetic construct
  source 1..18: mol_type = other DNA
taatacggctcgctattg

SEQ ID NO: 2825 - DNA, 18 bp, synthetic construct
  source 1..18: mol_type = other DNA
taatataactcactaaag

SEQ ID NO: 2826 - DNA, 18 bp, synthetic construct
  source 1..18: mol_type = other DNA
taatacgtctcgctaaag

SEQ ID NO: 2827 - DNA, 18 bp, synthetic construct
  source 1..18: mol_type = other DNA
tataacgactcactaaag

SEQ ID NO: 2828 - DNA, 18 bp, synthetic construct
  source 1..18: mol_type = other DNA
aattacgactcgctatag

SEQ ID NO: 2829 - DNA, 18 bp, synthetic construct
  source 1..18: mol_type = other DNA
caaaccgactcactatag

SEQ ID NO: 2830 - DNA, 18 bp, synthetic construct
  source 1..18: mol_type = other DNA
caataggactcactacag

SEQ ID NO: 2831 - DNA, 18 bp, synthetic construct
  source 1..18: mol_type = other DNA
gattaagactcactatag

SEQ ID NO: 2832 - DNA, 18 bp, synthetic construct
  source 1..18: mol_type = other DNA
taacacggctcaatatag

SEQ ID NO: 2833 - DNA, 18 bp, synthetic construct
  source 1..18: mol_type = other DNA
taataagactgactctag

SEQ ID NO: 2834 - DNA, 18 bp, synthetic construct
  source 1..18: mol_type = other DNA
taatacgacgcaccttag

SEQ ID NO: 2835 - DNA, 18 bp, synthetic construct
  source 1..18: mol_type = other DNA
taatacgactcgcaacag

SEQ ID NO: 2836 - DNA, 18 bp, synthetic construct
  source 1..18: mol_type = other DNA
taatcctactcactgtag

SEQ ID NO: 2837 - DNA, 18 bp, synthetic construct
  source 1..18: mol_type = other DNA
taatgcgactcacgctag

SEQ ID NO: 2838 - DNA, 18 bp, synthetic construct
  source 1..18: mol_type = other DNA
tactataactcactatag

SEQ ID NO: 2839 - DNA, 18 bp, synthetic construct
  source 1..18: mol_type = other DNA
tgctgcgactcactatag

SEQ ID NO: 2840 - DNA, 18 bp, synthetic construct
  source 1..18: mol_type = other DNA
aaaaacgactcgctatag

SEQ ID NO: 2841 - DNA, 18 bp, synthetic construct
  source 1..18: mol_type = other DNA
aaatacgactcactactg

SEQ ID NO: 2842 - DNA, 18 bp, synthetic construct
  source 1..18: mol_type = other DNA
ttttacgactcgctatag

SEQ ID NO: 2843 - DNA, 18 bp, synthetic construct
  source 1..18: mol_type = other DNA
taataggactctctacag

SEQ ID NO: 2844 - DNA, 18 bp, synthetic construct
  source 1..18: mol_type = other DNA
taattcgactcaatatcg

SEQ ID NO: 2845 - DNA, 18 bp, synthetic construct
  source 1..18: mol_type = other DNA
tattacaactcacgatag

SEQ ID NO: 2846 - DNA, 18 bp, synthetic construct
  source 1..18: mol_type = other DNA
taatgcgactcacaaaag

SEQ ID NO: 2847 - DNA, 18 bp, synthetic construct
  source 1..18: mol_type = other DNA
aaataggactcacaatag

SEQ ID NO: 2848 - DNA, 18 bp, synthetic construct
  source 1..18: mol_type = other DNA
taattcgcctcactatcg

SEQ ID NO: 2849 - DNA, 18 bp, synthetic construct
  source 1..18: mol_type = other DNA
taatacgacacactcgag

SEQ ID NO: 2850 - DNA, 18 bp, synthetic construct
  source 1..18: mol_type = other DNA
taatatgacagactatag

SEQ ID NO: 2851 - DNA, 18 bp, synthetic construct
  source 1..18: mol_type = other DNA
tttttcgactcactatag

SEQ ID NO: 2852 - DNA, 18 bp, synthetic construct
  source 1..18: mol_type = other DNA
taatccgtctcactttag

SEQ ID NO: 2853 - DNA, 18 bp, synthetic construct
  source 1..18: mol_type = other DNA
caaagcgactcactatag

SEQ ID NO: 2854 - DNA, 18 bp, synthetic construct
  source 1..18: mol_type = other DNA
caatacgactcagtctag

SEQ ID NO: 2855 - DNA, 18 bp, synthetic construct
  source 1..18: mol_type = other DNA
taatacgagtcgctattg

SEQ ID NO: 2856 - DNA, 18 bp, synthetic construct
  source 1..18: mol_type = other DNA
taataggactcaccattg

SEQ ID NO: 2857 - DNA, 18 bp, synthetic construct
  source 1..18: mol_type = other DNA
ttaaacgactcactttag

SEQ ID NO: 2858 - DNA, 18 bp, synthetic construct
  source 1..18: mol_type = other DNA
aattacgactcagtatag

SEQ ID NO: 2859 - DNA, 18 bp, synthetic construct
  source 1..18: mol_type = other DNA
tcattcgactcgctatag

SEQ ID NO: 2860 - DNA, 18 bp, synthetic construct
  source 1..18: mol_type = other DNA
ttataagactcactatgg

SEQ ID NO: 2861 - DNA, 18 bp, synthetic construct
  source 1..18: mol_type = other DNA
gatttcgactcactatag

SEQ ID NO: 2862 - DNA, 18 bp, synthetic construct
  source 1..18: mol_type = other DNA
taataagactcactagtg

SEQ ID NO: 2863 - DNA, 18 bp, synthetic construct
  source 1..18: mol_type = other DNA
taatacgtctcacaatcg

SEQ ID NO: 2864 - DNA, 18 bp, synthetic construct
  source 1..18: mol_type = other DNA
taattcgactcacttcag

SEQ ID NO: 2865 - DNA, 18 bp, synthetic construct
  source 1..18: mol_type = other DNA
aaatacgactcaccatcg

SEQ ID NO: 2866 - DNA, 18 bp, synthetic construct
  source 1..18: mol_type = other DNA
ttattcgactcactgtag

SEQ ID NO: 2867 - DNA, 18 bp, synthetic construct
  source 1..18: mol_type = other DNA
taatatgactcactctcg

SEQ ID NO: 2868 - DNA, 18 bp, synthetic construct
  source 1..18: mol_type = other DNA
taatgcgactctctctag

SEQ ID NO: 2869 - DNA, 18 bp, synthetic construct
  source 1..18: mol_type = other DNA
taatatgtctcgctatag

SEQ ID NO: 2870 - DNA, 18 bp, synthetic construct
  source 1..18: mol_type = other DNA
taatatgactcacttttg

SEQ ID NO: 2871 - DNA, 18 bp, synthetic construct
  source 1..18: mol_type = other DNA
ttatacgtctcgctatag

SEQ ID NO: 2872 - DNA, 18 bp, synthetic construct
  source 1..18: mol_type = other DNA
caaatcgactcactatag

SEQ ID NO: 2873 - DNA, 18 bp, synthetic construct
  source 1..18: mol_type = other DNA
ttttacgactcactttag

SEQ ID NO: 2874 - DNA, 18 bp, synthetic construct
  source 1..18: mol_type = other DNA
tagtacgaatcactttag

SEQ ID NO: 2875 - DNA, 18 bp, synthetic construct
  source 1..18: mol_type = other DNA
caatacaactcactacag

SEQ ID NO: 2876 - DNA, 18 bp, synthetic construct
  source 1..18: mol_type = other DNA
ttttacgactcactagag

SEQ ID NO: 2877 - DNA, 18 bp, synthetic construct
  source 1..18: mol_type = other DNA
taatacgactaactgcag

SEQ ID NO: 2878 - DNA, 18 bp, synthetic construct
  source 1..18: mol_type = other DNA
taatacggctcacaatcg

SEQ ID NO: 2879 - DNA, 18 bp, synthetic construct
  source 1..18: mol_type = other DNA
ttatacaactcacgatag

SEQ ID NO: 2880 - DNA, 18 bp, synthetic construct
  source 1..18: mol_type = other DNA
caatacgactcacaatcg

SEQ ID NO: 2881 - DNA, 18 bp, synthetic construct
  source 1..18: mol_type = other DNA
taaaaagactcactgtag

SEQ ID NO: 2882 - DNA, 18 bp, synthetic construct
  source 1..18: mol_type = other DNA
taatacgactcgccagag

SEQ ID NO: 2883 - DNA, 18 bp, synthetic construct
  source 1..18: mol_type = other DNA
taatcggaatcactatag

SEQ ID NO: 2884 - DNA, 18 bp, synthetic construct
  source 1..18: mol_type = other DNA
taatgcgactaactacag

SEQ ID NO: 2885 - DNA, 18 bp, synthetic construct
  source 1..18: mol_type = other DNA
taatgcgcctcaccatag

SEQ ID NO: 2886 - DNA, 18 bp, synthetic construct
  source 1..18: mol_type = other DNA
taattcgactcattgtag

SEQ ID NO: 2887 - DNA, 18 bp, synthetic construct
  source 1..18: mol_type = other DNA
taggacgactctctatag

SEQ ID NO: 2888 - DNA, 18 bp, synthetic construct
  source 1..18: mol_type = other DNA
tgatacgacacactctag

SEQ ID NO: 2889 - DNA, 18 bp, synthetic construct
  source 1..18: mol_type = other DNA
ttatacgacacactgtag

SEQ ID NO: 2890 - DNA, 18 bp, synthetic construct
  source 1..18: mol_type = other DNA
taatacgactcactgatg

SEQ ID NO: 2891 - DNA, 18 bp, synthetic construct
  source 1..18: mol_type = other DNA
taatatgactcactactg

SEQ ID NO: 2892 - DNA, 18 bp, synthetic construct
  source 1..18: mol_type = other DNA
taatacgtgtcattatag

SEQ ID NO: 2893 - DNA, 18 bp, synthetic construct
  source 1..18: mol_type = other DNA
taaaacgactcactccag

SEQ ID NO: 2894 - DNA, 18 bp, synthetic construct
  source 1..18: mol_type = other DNA
taagacaactcacgatag

SEQ ID NO: 2895 - DNA, 18 bp, synthetic construct
  source 1..18: mol_type = other DNA
taatacgcatcaccatag

SEQ ID NO: 2896 - DNA, 18 bp, synthetic construct
  source 1..18: mol_type = other DNA
taatcagactcgctatag

SEQ ID NO: 2897 - DNA, 18 bp, synthetic construct
  source 1..18: mol_type = other DNA
cagtacgactcactattg

SEQ ID NO: 2898 - DNA, 18 bp, synthetic construct
  source 1..18: mol_type = other DNA
gacttcgactcactatag

SEQ ID NO: 2899 - DNA, 18 bp, synthetic construct
  source 1..18: mol_type = other DNA
taaaacgacgcgctatag

SEQ ID NO: 2900 - DNA, 18 bp, synthetic construct
  source 1..18: mol_type = other DNA
taacacggctcagtatag

SEQ ID NO: 2901 - DNA, 18 bp, synthetic construct
  source 1..18: mol_type = other DNA
taataccactcactgtcg

SEQ ID NO: 2902 - DNA, 18 bp, synthetic construct
  source 1..18: mol_type = other DNA
taatacgactaactaggg

SEQ ID NO: 2903 - DNA, 18 bp, synthetic construct
  source 1..18: mol_type = other DNA
taatacgactaactatta

SEQ ID NO: 2904 - DNA, 18 bp, synthetic construct
  source 1..18: mol_type = other DNA
taatacgactcgatctag

SEQ ID NO: 2905 - DNA, 18 bp, synthetic construct
  source 1..18: mol_type = other DNA
taataggactcactaccg

SEQ ID NO: 2906 - DNA, 18 bp, synthetic construct
  source 1..18: mol_type = other DNA
taatccgactcaagatag

SEQ ID NO: 2907 - DNA, 18 bp, synthetic construct
  source 1..18: mol_type = other DNA
taatccgactgagtatag

SEQ ID NO: 2908 - DNA, 18 bp, synthetic construct
  source 1..18: mol_type = other DNA
taatccgtctcactataa

SEQ ID NO: 2909 - DNA, 18 bp, synthetic construct
  source 1..18: mol_type = other DNA
taatgcggctcactatcg

SEQ ID NO: 2910 - DNA, 18 bp, synthetic construct
  source 1..18: mol_type = other DNA
taattctacgcactatag

SEQ ID NO: 2911 - DNA, 18 bp, synthetic construct
  source 1..18: mol_type = other DNA
tactaggactcactacag

SEQ ID NO: 2912 - DNA, 18 bp, synthetic construct
  source 1..18: mol_type = other DNA
tatttcgactcactataa

SEQ ID NO: 2913 - DNA, 18 bp, synthetic construct
  source 1..18: mol_type = other DNA
tcacacgactcactatcg

SEQ ID NO: 2914 - DNA, 18 bp, synthetic construct
  source 1..18: mol_type = other DNA
tcataccactcgctatag

SEQ ID NO: 2915 - DNA, 18 bp, synthetic construct
  source 1..18: mol_type = other DNA
tcatacgactcgctatcg

SEQ ID NO: 2916 - DNA, 18 bp, synthetic construct
  source 1..18: mol_type = other DNA
ttacacgactcactctag

SEQ ID NO: 2917 - DNA, 18 bp, synthetic construct
  source 1..18: mol_type = other DNA
aaatacgactcactattc

SEQ ID NO: 2918 - DNA, 18 bp, synthetic construct
  source 1..18: mol_type = other DNA
caatacgacccactatcg

SEQ ID NO: 2919 - DNA, 18 bp, synthetic construct
  source 1..18: mol_type = other DNA
caatacgactcactctgg

SEQ ID NO: 2920 - DNA, 18 bp, synthetic construct
  source 1..18: mol_type = other DNA
caatacgactcattataa

SEQ ID NO: 2921 - DNA, 18 bp, synthetic construct
  source 1..18: mol_type = other DNA
gaacacgacttactatag

SEQ ID NO: 2922 - DNA, 18 bp, synthetic construct
  source 1..18: mol_type = other DNA
gaagacgactcagtatag

SEQ ID NO: 2923 - DNA, 18 bp, synthetic construct
  source 1..18: mol_type = other DNA
gaatacgacttgctatag

SEQ ID NO: 2924 - DNA, 18 bp, synthetic construct
  source 1..18: mol_type = other DNA
gaatacgattcaatatag

SEQ ID NO: 2925 - DNA, 18 bp, synthetic construct
  source 1..18: mol_type = other DNA
gaataggactcaatatag

SEQ ID NO: 2926 - DNA, 18 bp, synthetic construct
  source 1..18: mol_type = other DNA
gactacgacacactatag

SEQ ID NO: 2927 - DNA, 18 bp, synthetic construct
  source 1..18: mol_type = other DNA
ggatacgactcaccatag

SEQ ID NO: 2928 - DNA, 18 bp, synthetic construct
  source 1..18: mol_type = other DNA
gtatacgactcagtatag

SEQ ID NO: 2929 - DNA, 18 bp, synthetic construct
  source 1..18: mol_type = other DNA
taacaccactcactctag

SEQ ID NO: 2930 - DNA, 18 bp, synthetic construct
  source 1..18: mol_type = other DNA
taacatgactcactagag

SEQ ID NO: 2931 - DNA, 18 bp, synthetic construct
  source 1..18: mol_type = other DNA
taacccgactcacgatag

SEQ ID NO: 2932 - DNA, 18 bp, synthetic construct
  source 1..18: mol_type = other DNA
taagacgactcagtatgg

SEQ ID NO: 2933 - DNA, 18 bp, synthetic construct
  source 1..18: mol_type = other DNA
taagactactcactctag

SEQ ID NO: 2934 - DNA, 18 bp, synthetic construct
  source 1..18: mol_type = other DNA
taataagactcacgctag

SEQ ID NO: 2935 - DNA, 18 bp, synthetic construct
  source 1..18: mol_type = other DNA
taatacagctcagtatag

SEQ ID NO: 2936 - DNA, 18 bp, synthetic construct
  source 1..18: mol_type = other DNA
taataccactcaccagag

SEQ ID NO: 2937 - DNA, 18 bp, synthetic construct
  source 1..18: mol_type = other DNA
taatacgacacactatca

SEQ ID NO: 2938 - DNA, 18 bp, synthetic construct
  source 1..18: mol_type = other DNA
taatacgacgcagcatag

SEQ ID NO: 2939 - DNA, 18 bp, synthetic construct
  source 1..18: mol_type = other DNA
taatacgactaactaaaa

SEQ ID NO: 2940 - DNA, 18 bp, synthetic construct
  source 1..18: mol_type = other DNA
taatacgactcacaggag

SEQ ID NO: 2941 - DNA, 18 bp, synthetic construct
  source 1..18: mol_type = other DNA
taatacgactcactgaaa

SEQ ID NO: 2942 - DNA, 18 bp, synthetic construct
  source 1..18: mol_type = other DNA
taatacgactcgcgttag

SEQ ID NO: 2943 - DNA, 18 bp, synthetic construct
  source 1..18: mol_type = other DNA
taatacgactcgctacgg

SEQ ID NO: 2944 - DNA, 18 bp, synthetic construct
  source 1..18: mol_type = other DNA
taatacgactcgctcgag

SEQ ID NO: 2945 - DNA, 18 bp, synthetic construct
  source 1..18: mol_type = other DNA
taatacgactctctagaa

SEQ ID NO: 2946 - DNA, 18 bp, synthetic construct
  source 1..18: mol_type = other DNA
taatacgagtcaggatag

SEQ ID NO: 2947 - DNA, 18 bp, synthetic construct
  source 1..18: mol_type = other DNA
taatacgagtcgctctag

SEQ ID NO: 2948 - DNA, 18 bp, synthetic construct
  source 1..18: mol_type = other DNA
taatacgagtgacgatag

SEQ ID NO: 2949 - DNA, 18 bp, synthetic construct
  source 1..18: mol_type = other DNA
taatacgattgactataa

SEQ ID NO: 2950 - DNA, 18 bp, synthetic construct
  source 1..18: mol_type = other DNA
taatacgccgcaatatag

SEQ ID NO: 2951 - DNA, 18 bp, synthetic construct
  source 1..18: mol_type = other DNA
taatacgcctccgtatag

SEQ ID NO: 2952 - DNA, 18 bp, synthetic construct
  source 1..18: mol_type = other DNA
taatacgcctgaatatag

SEQ ID NO: 2953 - DNA, 18 bp, synthetic construct
  source 1..18: mol_type = other DNA
taatacggcccactctag

SEQ ID NO: 2954 - DNA, 18 bp, synthetic construct
  source 1..18: mol_type = other DNA
taatacggctcgctacag

SEQ ID NO: 2955 - DNA, 18 bp, synthetic construct
  source 1..18: mol_type = other DNA
taatacgtatcactataa

SEQ ID NO: 2956 - DNA, 18 bp, synthetic construct
  source 1..18: mol_type = other DNA
taatacgtctcactatca

SEQ ID NO: 2957 - DNA, 18 bp, synthetic construct
  source 1..18: mol_type = other DNA
taatacgtctcactttac

SEQ ID NO: 2958 - DNA, 18 bp, synthetic construct
  source 1..18: mol_type = other DNA
taatacgtctcgctataa

SEQ ID NO: 2959 - DNA, 18 bp, synthetic construct
  source 1..18: mol_type = other DNA
taataggacccactacag

SEQ ID NO: 2960 - DNA, 18 bp, synthetic construct
  source 1..18: mol_type = other DNA
taataggattcactgtag

SEQ ID NO: 2961 - DNA, 18 bp, synthetic construct
  source 1..18: mol_type = other DNA
taatatgaatcacgatag

SEQ ID NO: 2962 - DNA, 18 bp, synthetic construct
  source 1..18: mol_type = other DNA
taatatgactcacaataa

SEQ ID NO: 2963 - DNA, 18 bp, synthetic construct
  source 1..18: mol_type = other DNA
taatccgacgcagtatag

SEQ ID NO: 2964 - DNA, 18 bp, synthetic construct
  source 1..18: mol_type = other DNA
taatctgactgactatag

SEQ ID NO: 2965 - DNA, 18 bp, synthetic construct
  source 1..18: mol_type = other DNA
taatgcgactcaccacag

SEQ ID NO: 2966 - DNA, 18 bp, synthetic construct
  source 1..18: mol_type = other DNA
taatgcgactcgttatag

SEQ ID NO: 2967 - DNA, 18 bp, synthetic construct
  source 1..18: mol_type = other DNA
taatgcgactgaccatag

SEQ ID NO: 2968 - DNA, 18 bp, synthetic construct
  source 1..18: mol_type = other DNA
taatgcgcctcagtatag

SEQ ID NO: 2969 - DNA, 18 bp, synthetic construct
  source 1..18: mol_type = other DNA
taattcgactctctatat

SEQ ID NO: 2970 - DNA, 18 bp, synthetic construct
  source 1..18: mol_type = other DNA
tactacgacgcactctag

SEQ ID NO: 2971 - DNA, 18 bp, synthetic construct
  source 1..18: mol_type = other DNA
tactacgactgagtatag

SEQ ID NO: 2972 - DNA, 18 bp, synthetic construct
  source 1..18: mol_type = other DNA
tactacgcctgactatag

SEQ ID NO: 2973 - DNA, 18 bp, synthetic construct
  source 1..18: mol_type = other DNA
tactacggcccactatag

SEQ ID NO: 2974 - DNA, 18 bp, synthetic construct
  source 1..18: mol_type = other DNA
tactatgactaactatag

SEQ ID NO: 2975 - DNA, 18 bp, synthetic construct
  source 1..18: mol_type = other DNA
tagtacgactcactaggg

SEQ ID NO: 2976 - DNA, 18 bp, synthetic construct
  source 1..18: mol_type = other DNA
tagtacgactcgccatag

SEQ ID NO: 2977 - DNA, 18 bp, synthetic construct
  source 1..18: mol_type = other DNA
tcataggactcactatgg

SEQ ID NO: 2978 - DNA, 18 bp, synthetic construct
  source 1..18: mol_type = other DNA
tcatagggctcactatag

SEQ ID NO: 2979 - DNA, 18 bp, synthetic construct
  source 1..18: mol_type = other DNA
tgataagactcactgtag

SEQ ID NO: 2980 - DNA, 18 bp, synthetic construct
  source 1..18: mol_type = other DNA
tgatacgaatcactagag

SEQ ID NO: 2981 - DNA, 18 bp, synthetic construct
  source 1..18: mol_type = other DNA
tgattcgactcactagag

SEQ ID NO: 2982 - DNA, 18 bp, synthetic construct
  source 1..18: mol_type = other DNA
ttatacgacccactctag

SEQ ID NO: 2983 - DNA, 18 bp, synthetic construct
  source 1..18: mol_type = other DNA
ttatacgtctcactatat

SEQ ID NO: 2984 - DNA, 18 bp, synthetic construct
  source 1..18: mol_type = other DNA
ttatgcgactcagtatag

SEQ ID NO: 2985 - DNA, 18 bp, synthetic construct
  source 1..18: mol_type = other DNA
ttatacgtctcactgtag

SEQ ID NO: 2986 - DNA, 18 bp, synthetic construct
  source 1..18: mol_type = other DNA
taattcgactcacttttg

SEQ ID NO: 2987 - DNA, 18 bp, synthetic construct
  source 1..18: mol_type = other DNA
tattacaactcagtatag

SEQ ID NO: 2988 - DNA, 18 bp, synthetic construct
  source 1..18: mol_type = other DNA
tattcagactcactatag

SEQ ID NO: 2989 - DNA, 18 bp, synthetic construct
  source 1..18: mol_type = other DNA
taaaacaactcaccatag

SEQ ID NO: 2990 - DNA, 18 bp, synthetic construct
  source 1..18: mol_type = other DNA
taattcgactctctatgg

SEQ ID NO: 2991 - DNA, 18 bp, synthetic construct
  source 1..18: mol_type = other DNA
taattcgcttcactatag

SEQ ID NO: 2992 - DNA, 18 bp, synthetic construct
  source 1..18: mol_type = other DNA
taattcgactcactgcag

SEQ ID NO: 2993 - DNA, 18 bp, synthetic construct
  source 1..18: mol_type = other DNA
tattgcgactcaccatag

SEQ ID NO: 2994 - DNA, 18 bp, synthetic construct
  source 1..18: mol_type = other DNA
taattcgactctctattg

SEQ ID NO: 2995 - DNA, 18 bp, synthetic construct
  source 1..18: mol_type = other DNA
tgatacgtctcactaaag

SEQ ID NO: 2996 - DNA, 18 bp, synthetic construct
  source 1..18: mol_type = other DNA
taatacgcttcactatcg

SEQ ID NO: 2997 - DNA, 18 bp, synthetic construct
  source 1..18: mol_type = other DNA
aaatacgactcacgctag

SEQ ID NO: 2998 - DNA, 18 bp, synthetic construct
  source 1..18: mol_type = other DNA
taatacgactcaccaacg

SEQ ID NO: 2999 - DNA, 18 bp, synthetic construct
  source 1..18: mol_type = other DNA
ttataggactcactgtag

SEQ ID NO: 3000 - DNA, 18 bp, synthetic construct
  source 1..18: mol_type = other DNA
caaaacgactcactttag

SEQ ID NO: 3001 - DNA, 18 bp, synthetic construct
  source 1..18: mol_type = other DNA
tacaccgactcactatag

SEQ ID NO: 3002 - DNA, 18 bp, synthetic construct
  source 1..18: mol_type = other DNA
aaattcgactcaccatag

SEQ ID NO: 3003 - DNA, 18 bp, synthetic construct
  source 1..18: mol_type = other DNA
taatttgactcactaaag

SEQ ID NO: 3004 - DNA, 18 bp, synthetic construct
  source 1..18: mol_type = other DNA
taaaataactcactatag

SEQ ID NO: 3005 - DNA, 18 bp, synthetic construct
  source 1..18: mol_type = other DNA
ttatttgactcactatag

SEQ ID NO: 3006 - DNA, 18 bp, synthetic construct
  source 1..18: mol_type = other DNA
taatccgactcactagtg

SEQ ID NO: 3007 - DNA, 18 bp, synthetic construct
  source 1..18: mol_type = other DNA
taatgagactcactaaag

SEQ ID NO: 3008 - DNA, 18 bp, synthetic construct
  source 1..18: mol_type = other DNA
caagacgacttactatag

SEQ ID NO: 3009 - DNA, 18 bp, synthetic construct
  source 1..18: mol_type = other DNA
taagacgacttgctatag

SEQ ID NO: 3010 - DNA, 18 bp, synthetic construct
  source 1..18: mol_type = other DNA
taataggactcagtattg

SEQ ID NO: 3011 - DNA, 18 bp, synthetic construct
  source 1..18: mol_type = other DNA
taattcgactcgcgatag

SEQ ID NO: 3012 - DNA, 18 bp, synthetic construct
  source 1..18: mol_type = other DNA
taatacgactcacagttg

SEQ ID NO: 3013 - DNA, 18 bp, synthetic construct
  source 1..18: mol_type = other DNA
taatacgcctctctacag

SEQ ID NO: 3014 - DNA, 18 bp, synthetic construct
  source 1..18: mol_type = other DNA
taattagactcactgtag

SEQ ID NO: 3015 - DNA, 18 bp, synthetic construct
  source 1..18: mol_type = other DNA
tattacaactcactgtag

SEQ ID NO: 3016 - DNA, 18 bp, synthetic construct
  source 1..18: mol_type = other DNA
taatacgcctcactcttg

SEQ ID NO: 3017 - DNA, 18 bp, synthetic construct
  source 1..18: mol_type = other DNA
taaaacaactcgctatag

SEQ ID NO: 3018 - DNA, 18 bp, synthetic construct
  source 1..18: mol_type = other DNA
taatacgtctcgctatgg

SEQ ID NO: 3019 - DNA, 18 bp, synthetic construct
  source 1..18: mol_type = other DNA
ttattcgactcactagag

SEQ ID NO: 3020 - DNA, 18 bp, synthetic construct
  source 1..18: mol_type = other DNA
ttatacaactcactatcg

SEQ ID NO: 3021 - DNA, 18 bp, synthetic construct
  source 1..18: mol_type = other DNA
ttatacgactctctgtag

SEQ ID NO: 3022 - DNA, 18 bp, synthetic construct
  source 1..18: mol_type = other DNA
taatacgcatcactatcg

SEQ ID NO: 3023 - DNA, 18 bp, synthetic construct
  source 1..18: mol_type = other DNA
taataggactcactaagg

SEQ ID NO: 3024 - DNA, 18 bp, synthetic construct
  source 1..18: mol_type = other DNA
taatatgactcactgttg

SEQ ID NO: 3025 - DNA, 18 bp, synthetic construct
  source 1..18: mol_type = other DNA
ttatacgactcagtatcg

SEQ ID NO: 3026 - DNA, 18 bp, synthetic construct
  source 1..18: mol_type = other DNA
caatacgcatcactatag

SEQ ID NO: 3027 - DNA, 18 bp, synthetic construct
  source 1..18: mol_type = other DNA
taaaacgactcactacgg

SEQ ID NO: 3028 - DNA, 18 bp, synthetic construct
  source 1..18: mol_type = other DNA
taacacgcctcgctatag

SEQ ID NO: 3029 - DNA, 18 bp, synthetic construct
  source 1..18: mol_type = other DNA
taataagactcagtgtag

SEQ ID NO: 3030 - DNA, 18 bp, synthetic construct
  source 1..18: mol_type = other DNA
taatgggactcagtatag

SEQ ID NO: 3031 - DNA, 18 bp, synthetic construct
  source 1..18: mol_type = other DNA
tgatacaacccactatag

SEQ ID NO: 3032 - DNA, 18 bp, synthetic construct
  source 1..18: mol_type = other DNA
tattaagactcactacag

SEQ ID NO: 3033 - DNA, 18 bp, synthetic construct
  source 1..18: mol_type = other DNA
tgatacgtctcactacag

SEQ ID NO: 3034 - DNA, 18 bp, synthetic construct
  source 1..18: mol_type = other DNA
taattcgactcacgttag

SEQ ID NO: 3035 - DNA, 18 bp, synthetic construct
  source 1..18: mol_type = other DNA
ttatacgactctctatgg

SEQ ID NO: 3036 - DNA, 18 bp, synthetic construct
  source 1..18: mol_type = other DNA
aaatacgactcactgtcg

SEQ ID NO: 3037 - DNA, 18 bp, synthetic construct
  source 1..18: mol_type = other DNA
taatcggactcactctag

SEQ ID NO: 3038 - DNA, 18 bp, synthetic construct
  source 1..18: mol_type = other DNA
tatcacgactcactgtag

SEQ ID NO: 3039 - DNA, 18 bp, synthetic construct
  source 1..18: mol_type = other DNA
taatacgtctcacttcag

SEQ ID NO: 3040 - DNA, 18 bp, synthetic construct
  source 1..18: mol_type = other DNA
taatacgactcaccttgg

SEQ ID NO: 3041 - DNA, 18 bp, synthetic construct
  source 1..18: mol_type = other DNA
taatacgactctatagag

SEQ ID NO: 3042 - DNA, 18 bp, synthetic construct
  source 1..18: mol_type = other DNA
tagtacacctcactatag

SEQ ID NO: 3043 - DNA, 18 bp, synthetic construct
  source 1..18: mol_type = other DNA
ttttacgtctcactatag

SEQ ID NO: 3044 - DNA, 18 bp, synthetic construct
  source 1..18: mol_type = other DNA
taatagctctcactatag

SEQ ID NO: 3045 - DNA, 18 bp, synthetic construct
  source 1..18: mol_type = other DNA
tattacgactcaccctag

SEQ ID NO: 3046 - DNA, 18 bp, synthetic construct
  source 1..18: mol_type = other DNA
tattacgtctcactctag

SEQ ID NO: 3047 - DNA, 18 bp, synthetic construct
  source 1..18: mol_type = other DNA
taaaacgactcacactag

SEQ ID NO: 3048 - DNA, 18 bp, synthetic construct
  source 1..18: mol_type = other DNA
taattcgtctcactctag

SEQ ID NO: 3049 - DNA, 18 bp, synthetic construct
  source 1..18: mol_type = other DNA
ttatgcaactcactatag

SEQ ID NO: 3050 - DNA, 18 bp, synthetic construct
  source 1..18: mol_type = other DNA
ttataggactcactattg

SEQ ID NO: 3051 - DNA, 18 bp, synthetic construct
  source 1..18: mol_type = other DNA
ttataagactcactagag

SEQ ID NO: 3052 - DNA, 18 bp, synthetic construct
  source 1..18: mol_type = other DNA
aaatgcgactcaccatag

SEQ ID NO: 3053 - DNA, 18 bp, synthetic construct
  source 1..18: mol_type = other DNA
tattacgactcactacgg

SEQ ID NO: 3054 - DNA, 18 bp, synthetic construct
  source 1..18: mol_type = other DNA
caatacgactaactctag

SEQ ID NO: 3055 - DNA, 18 bp, synthetic construct
  source 1..18: mol_type = other DNA
gaaatcgactcactatag

SEQ ID NO: 3056 - DNA, 18 bp, synthetic construct
  source 1..18: mol_type = other DNA
gtatatgactcactatag

SEQ ID NO: 3057 - DNA, 18 bp, synthetic construct
  source 1..18: mol_type = other DNA
taataagactcactaggg

SEQ ID NO: 3058 - DNA, 18 bp, synthetic construct
  source 1..18: mol_type = other DNA
taatacgactcaataccg

SEQ ID NO: 3059 - DNA, 18 bp, synthetic construct
  source 1..18: mol_type = other DNA
taatacgagtgacaatag

SEQ ID NO: 3060 - DNA, 18 bp, synthetic construct
  source 1..18: mol_type = other DNA
taatccgactcaccatcg

SEQ ID NO: 3061 - DNA, 18 bp, synthetic construct
  source 1..18: mol_type = other DNA
tattacgacgcactatcg

SEQ ID NO: 3062 - DNA, 18 bp, synthetic construct
  source 1..18: mol_type = other DNA
tgatacgtctcagtatag

SEQ ID NO: 3063 - DNA, 18 bp, synthetic construct
  source 1..18: mol_type = other DNA
cgatacgacttactatag

SEQ ID NO: 3064 - DNA, 18 bp, synthetic construct
  source 1..18: mol_type = other DNA
gaatacgactccttatag

SEQ ID NO: 3065 - DNA, 18 bp, synthetic construct
  source 1..18: mol_type = other DNA
gattacgactcactgtag

SEQ ID NO: 3066 - DNA, 18 bp, synthetic construct
  source 1..18: mol_type = other DNA
taaaacgactcactatcc

SEQ ID NO: 3067 - DNA, 18 bp, synthetic construct
  source 1..18: mol_type = other DNA
taaaaggactcactagag

SEQ ID NO: 3068 - DNA, 18 bp, synthetic construct
  source 1..18: mol_type = other DNA
taagaccactcagtatag

SEQ ID NO: 3069 - DNA, 18 bp, synthetic construct
  source 1..18: mol_type = other DNA
taagacgccacactatag

SEQ ID NO: 3070 - DNA, 18 bp, synthetic construct
  source 1..18: mol_type = other DNA
taataaaacgcactatag

SEQ ID NO: 3071 - DNA, 18 bp, synthetic construct
  source 1..18: mol_type = other DNA
taataacactcaccatag

SEQ ID NO: 3072 - DNA, 18 bp, synthetic construct
  source 1..18: mol_type = other DNA
taataagacccactatgg

SEQ ID NO: 3073 - DNA, 18 bp, synthetic construct
  source 1..18: mol_type = other DNA
taatacgactaactctcg

SEQ ID NO: 3074 - DNA, 18 bp, synthetic construct
  source 1..18: mol_type = other DNA
taatacgactcaatagcg

SEQ ID NO: 3075 - DNA, 18 bp, synthetic construct
  source 1..18: mol_type = other DNA
taatacgcatcactgtag

SEQ ID NO: 3076 - DNA, 18 bp, synthetic construct
  source 1..18: mol_type = other DNA
taatagcactcaccatag

SEQ ID NO: 3077 - DNA, 18 bp, synthetic construct
  source 1..18: mol_type = other DNA
taatccgactaactctag

SEQ ID NO: 3078 - DNA, 18 bp, synthetic construct
  source 1..18: mol_type = other DNA
taatgcgactccccatag

SEQ ID NO: 3079 - DNA, 18 bp, synthetic construct
  source 1..18: mol_type = other DNA
taatgtgactccctatag

SEQ ID NO: 3080 - DNA, 18 bp, synthetic construct
  source 1..18: mol_type = other DNA
tactacgcatcactatag

SEQ ID NO: 3081 - DNA, 18 bp, synthetic construct
  source 1..18: mol_type = other DNA
tatgacgactcactacag

SEQ ID NO: 3082 - DNA, 18 bp, synthetic construct
  source 1..18: mol_type = other DNA
tattacgactcactttac

SEQ ID NO: 3083 - DNA, 18 bp, synthetic construct
  source 1..18: mol_type = other DNA
ttggacgactcactatag

SEQ ID NO: 3084 - DNA, 18 bp, synthetic construct
  source 1..18: mol_type = other DNA
ttaaacgactcactctag

SEQ ID NO: 3085 - DNA, 18 bp, synthetic construct
  source 1..18: mol_type = other DNA
ttatctgactcactatag

SEQ ID NO: 3086 - DNA, 18 bp, synthetic construct
  source 1..18: mol_type = other DNA
taatacaactcacttaag

SEQ ID NO: 3087 - DNA, 18 bp, synthetic construct
  source 1..18: mol_type = other DNA
aaattcgcctcactatag

SEQ ID NO: 3088 - DNA, 18 bp, synthetic construct
  source 1..18: mol_type = other DNA
tattaagactcactaaag

SEQ ID NO: 3089 - DNA, 18 bp, synthetic construct
  source 1..18: mol_type = other DNA
tgataagactcactttag

SEQ ID NO: 3090 - DNA, 18 bp, synthetic construct
  source 1..18: mol_type = other DNA
taatgagactcactattg

SEQ ID NO: 3091 - DNA, 18 bp, synthetic construct
  source 1..18: mol_type = other DNA
taatacgactcgatattg

SEQ ID NO: 3092 - DNA, 18 bp, synthetic construct
  source 1..18: mol_type = other DNA
tatttcgactcactctag

SEQ ID NO: 3093 - DNA, 18 bp, synthetic construct
  source 1..18: mol_type = other DNA
tgatacgtctcactctag

SEQ ID NO: 3094 - DNA, 18 bp, synthetic construct
  source 1..18: mol_type = other DNA
taatacgccccactttag

SEQ ID NO: 3095 - DNA, 18 bp, synthetic construct
  source 1..18: mol_type = other DNA
taatactactaactatcg

SEQ ID NO: 3096 - DNA, 18 bp, synthetic construct
  source 1..18: mol_type = other DNA
tattacaactcactatcg

SEQ ID NO: 3097 - DNA, 18 bp, synthetic construct
  source 1..18: mol_type = other DNA
taaagtgactcactatag

SEQ ID NO: 3098 - DNA, 18 bp, synthetic construct
  source 1..18: mol_type = other DNA
ttataggcctcactatag

SEQ ID NO: 3099 - DNA, 18 bp, synthetic construct
  source 1..18: mol_type = other DNA
cattacgactcactttag

SEQ ID NO: 3100 - DNA, 18 bp, synthetic construct
  source 1..18: mol_type = other DNA
aattacgactcaccatag

SEQ ID NO: 3101 - DNA, 18 bp, synthetic construct
  source 1..18: mol_type = other DNA
taatacaactcaccacag

SEQ ID NO: 3102 - DNA, 18 bp, synthetic construct
  source 1..18: mol_type = other DNA
gaataagacccactatag

SEQ ID NO: 3103 - DNA, 18 bp, synthetic construct
  source 1..18: mol_type = other DNA
taaggcgactcactattg

SEQ ID NO: 3104 - DNA, 18 bp, synthetic construct
  source 1..18: mol_type = other DNA
taataagcctcactatcg

SEQ ID NO: 3105 - DNA, 18 bp, synthetic construct
  source 1..18: mol_type = other DNA
tattacgactaactagag

SEQ ID NO: 3106 - DNA, 18 bp, synthetic construct
  source 1..18: mol_type = other DNA
tgattcgactcactattg

SEQ ID NO: 3107 - DNA, 18 bp, synthetic construct
  source 1..18: mol_type = other DNA
taattcgactcactctcg

SEQ ID NO: 3108 - DNA, 18 bp, synthetic construct
  source 1..18: mol_type = other DNA
taatacaactcactttgg

SEQ ID NO: 3109 - DNA, 18 bp, synthetic construct
  source 1..18: mol_type = other DNA
taatacgactcagtaatg

SEQ ID NO: 3110 - DNA, 18 bp, synthetic construct
  source 1..18: mol_type = other DNA
taatacgcctcacagtag

SEQ ID NO: 3111 - DNA, 18 bp, synthetic construct
  source 1..18: mol_type = other DNA
tagtacggctcactatcg

SEQ ID NO: 3112 - DNA, 18 bp, synthetic construct
  source 1..18: mol_type = other DNA
tgatacgcctcactttag

SEQ ID NO: 3113 - DNA, 18 bp, synthetic construct
  source 1..18: mol_type = other DNA
taaaacgtctcactttag

SEQ ID NO: 3114 - DNA, 18 bp, synthetic construct
  source 1..18: mol_type = other DNA
taatacaactcactcttg

SEQ ID NO: 3115 - DNA, 18 bp, synthetic construct
  source 1..18: mol_type = other DNA
taaaacgactcaccctag

SEQ ID NO: 3116 - DNA, 18 bp, synthetic construct
  source 1..18: mol_type = other DNA
taatagaactcagtatag

SEQ ID NO: 3117 - DNA, 18 bp, synthetic construct
  source 1..18: mol_type = other DNA
taccacgactcattatag

SEQ ID NO: 3118 - DNA, 18 bp, synthetic construct
  source 1..18: mol_type = other DNA
tgatacgacagactatag

SEQ ID NO: 3119 - DNA, 18 bp, synthetic construct
  source 1..18: mol_type = other DNA
tattacgactcactgttg

SEQ ID NO: 3120 - DNA, 18 bp, synthetic construct
  source 1..18: mol_type = other DNA
taatttgactcgctatag

SEQ ID NO: 3121 - DNA, 18 bp, synthetic construct
  source 1..18: mol_type = other DNA
tataaggactcactatag

SEQ ID NO: 3122 - DNA, 18 bp, synthetic construct
  source 1..18: mol_type = other DNA
ttttacaactcactatag

SEQ ID NO: 3123 - DNA, 18 bp, synthetic construct
  source 1..18: mol_type = other DNA
taaaacgactcaatctag

SEQ ID NO: 3124 - DNA, 18 bp, synthetic construct
  source 1..18: mol_type = other DNA
taatacgactcactaata

SEQ ID NO: 3125 - DNA, 18 bp, synthetic construct
  source 1..18: mol_type = other DNA
taatacgactcgctgtcg

SEQ ID NO: 3126 - DNA, 18 bp, synthetic construct
  source 1..18: mol_type = other DNA
ttacacgactcactattg

SEQ ID NO: 3127 - DNA, 18 bp, synthetic construct
  source 1..18: mol_type = other DNA
taataagactcactgaag

SEQ ID NO: 3128 - DNA, 18 bp, synthetic construct
  source 1..18: mol_type = other DNA
ttacacgactcactgtag

SEQ ID NO: 3129 - DNA, 18 bp, synthetic construct
  source 1..18: mol_type = other DNA
ttatacgactcattctag

SEQ ID NO: 3130 - DNA, 18 bp, synthetic construct
  source 1..18: mol_type = other DNA
ttaatcgactcactatag

SEQ ID NO: 3131 - DNA, 18 bp, synthetic construct
  source 1..18: mol_type = other DNA
taatcggactcactaaag

SEQ ID NO: 3132 - DNA, 18 bp, synthetic construct
  source 1..18: mol_type = other DNA
tactacgactcgctattg

SEQ ID NO: 3133 - DNA, 18 bp, synthetic construct
  source 1..18: mol_type = other DNA
tattacaactcactttag

SEQ ID NO: 3134 - DNA, 18 bp, synthetic construct
  source 1..18: mol_type = other DNA
cattacgtctcactatag

SEQ ID NO: 3135 - DNA, 18 bp, synthetic construct
  source 1..18: mol_type = other DNA
ttatacgactcacttttg

SEQ ID NO: 3136 - DNA, 18 bp, synthetic construct
  source 1..18: mol_type = other DNA
taataagtctcgctatag

SEQ ID NO: 3137 - DNA, 18 bp, synthetic construct
  source 1..18: mol_type = other DNA
taattagtctcactatag

SEQ ID NO: 3138 - DNA, 18 bp, synthetic construct
  source 1..18: mol_type = other DNA
ttatacgactcacttcag

SEQ ID NO: 3139 - DNA, 18 bp, synthetic construct
  source 1..18: mol_type = other DNA
ttatacgactctctacag

SEQ ID NO: 3140 - DNA, 18 bp, synthetic construct
  source 1..18: mol_type = other DNA
taatacgactcgcttaag

SEQ ID NO: 3141 - DNA, 18 bp, synthetic construct
  source 1..18: mol_type = other DNA
tattacgtctcactaaag

SEQ ID NO: 3142 - DNA, 18 bp, synthetic construct
  source 1..18: mol_type = other DNA
tatttcgactcactttag

SEQ ID NO: 3143 - DNA, 18 bp, synthetic construct
  source 1..18: mol_type = other DNA
taaaaagactcactaaag

SEQ ID NO: 3144 - DNA, 18 bp, synthetic construct
  source 1..18: mol_type = other DNA
taatacagctcactattg

SEQ ID NO: 3145 - DNA, 18 bp, synthetic construct
  source 1..18: mol_type = other DNA
taatacgacttgctattg

SEQ ID NO: 3146 - DNA, 18 bp, synthetic construct
  source 1..18: mol_type = other DNA
caattcgactcactatcg

SEQ ID NO: 3147 - DNA, 18 bp, synthetic construct
  source 1..18: mol_type = other DNA
taatccgacgcactttag

SEQ ID NO: 3148 - DNA, 18 bp, synthetic construct
  source 1..18: mol_type = other DNA
taataatactcagtatag

SEQ ID NO: 3149 - DNA, 18 bp, synthetic construct
  source 1..18: mol_type = other DNA
taataggtctcactacag

SEQ ID NO: 3150 - DNA, 18 bp, synthetic construct
  source 1..18: mol_type = other DNA
taatatgacccactgtag

SEQ ID NO: 3151 - DNA, 18 bp, synthetic construct
  source 1..18: mol_type = other DNA
taatgtgactcactctag

SEQ ID NO: 3152 - DNA, 18 bp, synthetic construct
  source 1..18: mol_type = other DNA
tcatacgagtcactacag

SEQ ID NO: 3153 - DNA, 18 bp, synthetic construct
  source 1..18: mol_type = other DNA
ttctccgactcactatag

SEQ ID NO: 3154 - DNA, 18 bp, synthetic construct
  source 1..18: mol_type = other DNA
taatacgagtcactaatg

SEQ ID NO: 3155 - DNA, 18 bp, synthetic construct
  source 1..18: mol_type = other DNA
tattacgactctcgatag

SEQ ID NO: 3156 - DNA, 18 bp, synthetic construct
  source 1..18: mol_type = other DNA
taaaacgtctcactatcg

SEQ ID NO: 3157 - DNA, 18 bp, synthetic construct
  source 1..18: mol_type = other DNA
taattggactcacaatag

SEQ ID NO: 3158 - DNA, 18 bp, synthetic construct
  source 1..18: mol_type = other DNA
ctataggactcactatag

SEQ ID NO: 3159 - DNA, 18 bp, synthetic construct
  source 1..18: mol_type = other DNA
taatacgactaactactg

SEQ ID NO: 3160 - DNA, 18 bp, synthetic construct
  source 1..18: mol_type = other DNA
taatagaattcactatag

SEQ ID NO: 3161 - DNA, 18 bp, synthetic construct
  source 1..18: mol_type = other DNA
taatatgacgcactaaag

SEQ ID NO: 3162 - DNA, 18 bp, synthetic construct
  source 1..18: mol_type = other DNA
taatatgcgtcactatag

SEQ ID NO: 3163 - DNA, 18 bp, synthetic construct
  source 1..18: mol_type = other DNA
taataatgctcactatag

SEQ ID NO: 3164 - DNA, 18 bp, synthetic construct
  source 1..18: mol_type = other DNA
taatacgactcacgcaag

SEQ ID NO: 3165 - DNA, 18 bp, synthetic construct
  source 1..18: mol_type = other DNA
taatacgactggctattg

SEQ ID NO: 3166 - DNA, 18 bp, synthetic construct
  source 1..18: mol_type = other DNA
taatacgcatcagtatag

SEQ ID NO: 3167 - DNA, 18 bp, synthetic construct
  source 1..18: mol_type = other DNA
taataggactcaaaatag

SEQ ID NO: 3168 - DNA, 18 bp, synthetic construct
  source 1..18: mol_type = other DNA
tagtacgactcactcgag

SEQ ID NO: 3169 - DNA, 18 bp, synthetic construct
  source 1..18: mol_type = other DNA
gtatacgactcaccatag

SEQ ID NO: 3170 - DNA, 18 bp, synthetic construct
  source 1..18: mol_type = other DNA
taaatcgactcactataa

SEQ ID NO: 3171 - DNA, 18 bp, synthetic construct
  source 1..18: mol_type = other DNA
taacaaaactcactatag

SEQ ID NO: 3172 - DNA, 18 bp, synthetic construct
  source 1..18: mol_type = other DNA
taagacgacacactacag

SEQ ID NO: 3173 - DNA, 18 bp, synthetic construct
  source 1..18: mol_type = other DNA
taagacgactaactacag

SEQ ID NO: 3174 - DNA, 18 bp, synthetic construct
  source 1..18: mol_type = other DNA
taataagactaactacag

SEQ ID NO: 3175 - DNA, 18 bp, synthetic construct
  source 1..18: mol_type = other DNA
taatacgactcacttaaa

SEQ ID NO: 3176 - DNA, 18 bp, synthetic construct
  source 1..18: mol_type = other DNA
taatacgactcacttgaa

SEQ ID NO: 3177 - DNA, 18 bp, synthetic construct
  source 1..18: mol_type = other DNA
taatacgagcaactatag

SEQ ID NO: 3178 - DNA, 18 bp, synthetic construct
  source 1..18: mol_type = other DNA
taatacgcctcactaccg

SEQ ID NO: 3179 - DNA, 18 bp, synthetic construct
  source 1..18: mol_type = other DNA
taatacgcctcagtctag

SEQ ID NO: 3180 - DNA, 18 bp, synthetic construct
  source 1..18: mol_type = other DNA
taatacgcctccctctag

SEQ ID NO: 3181 - DNA, 18 bp, synthetic construct
  source 1..18: mol_type = other DNA
taatacgtctccctataa

SEQ ID NO: 3182 - DNA, 18 bp, synthetic construct
  source 1..18: mol_type = other DNA
taatgcgactcattacag

SEQ ID NO: 3183 - DNA, 18 bp, synthetic construct
  source 1..18: mol_type = other DNA
tactacgacttgctatag

SEQ ID NO: 3184 - DNA, 18 bp, synthetic construct
  source 1..18: mol_type = other DNA
tcatccgactcattatag

SEQ ID NO: 3185 - DNA, 18 bp, synthetic construct
  source 1..18: mol_type = other DNA
tgctacgacttactatag

SEQ ID NO: 3186 - DNA, 18 bp, synthetic construct
  source 1..18: mol_type = other DNA
aaagacgactcaccatag

SEQ ID NO: 3187 - DNA, 18 bp, synthetic construct
  source 1..18: mol_type = other DNA
aaatacaactcacgatag

SEQ ID NO: 3188 - DNA, 18 bp, synthetic construct
  source 1..18: mol_type = other DNA
aaatacgacccactgtag

SEQ ID NO: 3189 - DNA, 18 bp, synthetic construct
  source 1..18: mol_type = other DNA
caatacgacgaactatag

SEQ ID NO: 3190 - DNA, 18 bp, synthetic construct
  source 1..18: mol_type = other DNA
caatacgactcggtatag

SEQ ID NO: 3191 - DNA, 18 bp, synthetic construct
  source 1..18: mol_type = other DNA
caatacgattcagtatag

SEQ ID NO: 3192 - DNA, 18 bp, synthetic construct
  source 1..18: mol_type = other DNA
caataggacccactatag

SEQ ID NO: 3193 - DNA, 18 bp, synthetic construct
  source 1..18: mol_type = other DNA
caatgcgactcactacag

SEQ ID NO: 3194 - DNA, 18 bp, synthetic construct
  source 1..18: mol_type = other DNA
cactacgactcaatatag

SEQ ID NO: 3195 - DNA, 18 bp, synthetic construct
  source 1..18: mol_type = other DNA
cagtacaactcactatag

SEQ ID NO: 3196 - DNA, 18 bp, synthetic construct
  source 1..18: mol_type = other DNA
gaataagactcgctatag

SEQ ID NO: 3197 - DNA, 18 bp, synthetic construct
  source 1..18: mol_type = other DNA
gaataagacttactatag

SEQ ID NO: 3198 - DNA, 18 bp, synthetic construct
  source 1..18: mol_type = other DNA
gaatacgtctccctatag

SEQ ID NO: 3199 - DNA, 18 bp, synthetic construct
  source 1..18: mol_type = other DNA
gaataggacacactatag

SEQ ID NO: 3200 - DNA, 18 bp, synthetic construct
  source 1..18: mol_type = other DNA
gaattcgactcactagag

SEQ ID NO: 3201 - DNA, 18 bp, synthetic construct
  source 1..18: mol_type = other DNA
gattacgactcactagag

SEQ ID NO: 3202 - DNA, 18 bp, synthetic construct
  source 1..18: mol_type = other DNA
taacacgcgtcactatag

SEQ ID NO: 3203 - DNA, 18 bp, synthetic construct
  source 1..18: mol_type = other DNA
taacaggacccactatag

SEQ ID NO: 3204 - DNA, 18 bp, synthetic construct
  source 1..18: mol_type = other DNA
taacccgactcactctag

SEQ ID NO: 3205 - DNA, 18 bp, synthetic construct
  source 1..18: mol_type = other DNA
taagaccactcactatcg

SEQ ID NO: 3206 - DNA, 18 bp, synthetic construct
  source 1..18: mol_type = other DNA
taagacgacacgctatag

SEQ ID NO: 3207 - DNA, 18 bp, synthetic construct
  source 1..18: mol_type = other DNA
taagacgccttactatag

SEQ ID NO: 3208 - DNA, 18 bp, synthetic construct
  source 1..18: mol_type = other DNA
taagtcggctcactatag

SEQ ID NO: 3209 - DNA, 18 bp, synthetic construct
  source 1..18: mol_type = other DNA
taataagactctctatat

SEQ ID NO: 3210 - DNA, 18 bp, synthetic construct
  source 1..18: mol_type = other DNA
taataccacgcactgtag

SEQ ID NO: 3211 - DNA, 18 bp, synthetic construct
  source 1..18: mol_type = other DNA
taatacgacacactaaaa

SEQ ID NO: 3212 - DNA, 18 bp, synthetic construct
  source 1..18: mol_type = other DNA
taatacgacacactattc

SEQ ID NO: 3213 - DNA, 18 bp, synthetic construct
  source 1..18: mol_type = other DNA
taatacgacccaatgtag

SEQ ID NO: 3214 - DNA, 18 bp, synthetic construct
  source 1..18: mol_type = other DNA
taatacgacccgctatgg

SEQ ID NO: 3215 - DNA, 18 bp, synthetic construct
  source 1..18: mol_type = other DNA
taatacgacgccctaaag

SEQ ID NO: 3216 - DNA, 18 bp, synthetic construct
  source 1..18: mol_type = other DNA
taatacgacgctatatag

SEQ ID NO: 3217 - DNA, 18 bp, synthetic construct
  source 1..18: mol_type = other DNA
taatacgactcaagatcg

SEQ ID NO: 3218 - DNA, 18 bp, synthetic construct
  source 1..18: mol_type = other DNA
taatacgactcacttcac

SEQ ID NO: 3219 - DNA, 18 bp, synthetic construct
  source 1..18: mol_type = other DNA
taatacgactggccatag

SEQ ID NO: 3220 - DNA, 18 bp, synthetic construct
  source 1..18: mol_type = other DNA
taatacgacttactacgg

SEQ ID NO: 3221 - DNA, 18 bp, synthetic construct
  source 1..18: mol_type = other DNA
taatacgagtcaatgtag

SEQ ID NO: 3222 - DNA, 18 bp, synthetic construct
  source 1..18: mol_type = other DNA
taatacgattcactaaaa

SEQ ID NO: 3223 - DNA, 18 bp, synthetic construct
  source 1..18: mol_type = other DNA
taatacgcccccctatag

SEQ ID NO: 3224 - DNA, 18 bp, synthetic construct
  source 1..18: mol_type = other DNA
taatacgcctcagtatgg

SEQ ID NO: 3225 - DNA, 18 bp, synthetic construct
  source 1..18: mol_type = other DNA
taatacgcctccccatag

SEQ ID NO: 3226 - DNA, 18 bp, synthetic construct
  source 1..18: mol_type = other DNA
taatacgcttcactagag

SEQ ID NO: 3227 - DNA, 18 bp, synthetic construct
  source 1..18: mol_type = other DNA
taatacggctcattctag

SEQ ID NO: 3228 - DNA, 18 bp, synthetic construct
  source 1..18: mol_type = other DNA
taatacgtctcacaataa

SEQ ID NO: 3229 - DNA, 18 bp, synthetic construct
  source 1..18: mol_type = other DNA
taataggagtcactatgg

SEQ ID NO: 3230 - DNA, 18 bp, synthetic construct
  source 1..18: mol_type = other DNA
taatatgactcacgctag

SEQ ID NO: 3231 - DNA, 18 bp, synthetic construct
  source 1..18: mol_type = other DNA
taatccgactcgcaatag

SEQ ID NO: 3232 - DNA, 18 bp, synthetic construct
  source 1..18: mol_type = other DNA
taatccgagtcactatcg

SEQ ID NO: 3233 - DNA, 18 bp, synthetic construct
  source 1..18: mol_type = other DNA
taatccgcatcactatag

SEQ ID NO: 3234 - DNA, 18 bp, synthetic construct
  source 1..18: mol_type = other DNA
taatgcgactcactctcg

SEQ ID NO: 3235 - DNA, 18 bp, synthetic construct
  source 1..18: mol_type = other DNA
taatgcgactcatgatag

SEQ ID NO: 3236 - DNA, 18 bp, synthetic construct
  source 1..18: mol_type = other DNA
taatgggacacactatag

SEQ ID NO: 3237 - DNA, 18 bp, synthetic construct
  source 1..18: mol_type = other DNA
taattcgacgcagtatag

SEQ ID NO: 3238 - DNA, 18 bp, synthetic construct
  source 1..18: mol_type = other DNA
tacgacggctcactatag

SEQ ID NO: 3239 - DNA, 18 bp, synthetic construct
  source 1..18: mol_type = other DNA
tactacgcctccctatag

SEQ ID NO: 3240 - DNA, 18 bp, synthetic construct
  source 1..18: mol_type = other DNA
tactaggactcactatcg

SEQ ID NO: 3241 - DNA, 18 bp, synthetic construct
  source 1..18: mol_type = other DNA
tactgcgactcactagag

SEQ ID NO: 3242 - DNA, 18 bp, synthetic construct
  source 1..18: mol_type = other DNA
tacttcgactcactagag

SEQ ID NO: 3243 - DNA, 18 bp, synthetic construct
  source 1..18: mol_type = other DNA
tagtacgactcagtctag

SEQ ID NO: 3244 - DNA, 18 bp, synthetic construct
  source 1..18: mol_type = other DNA
tagtacgactcgctacag

SEQ ID NO: 3245 - DNA, 18 bp, synthetic construct
  source 1..18: mol_type = other DNA
tagtaggacttactatag

SEQ ID NO: 3246 - DNA, 18 bp, synthetic construct
  source 1..18: mol_type = other DNA
tattacgactcacaatac

SEQ ID NO: 3247 - DNA, 18 bp, synthetic construct
  source 1..18: mol_type = other DNA
tattacgactcactgtgg

SEQ ID NO: 3248 - DNA, 18 bp, synthetic construct
  source 1..18: mol_type = other DNA
tattacgactcactttat

SEQ ID NO: 3249 - DNA, 18 bp, synthetic construct
  source 1..18: mol_type = other DNA
tattatgactcactatat

SEQ ID NO: 3250 - DNA, 18 bp, synthetic construct
  source 1..18: mol_type = other DNA
tcatacgacgcactacag

SEQ ID NO: 3251 - DNA, 18 bp, synthetic construct
  source 1..18: mol_type = other DNA
tcatacgactcagtagag

SEQ ID NO: 3252 - DNA, 18 bp, synthetic construct
  source 1..18: mol_type = other DNA
tcccacgactcactatag

SEQ ID NO: 3253 - DNA, 18 bp, synthetic construct
  source 1..18: mol_type = other DNA
tgatacgactcactctaa

SEQ ID NO: 3254 - DNA, 18 bp, synthetic construct
  source 1..18: mol_type = other DNA
tgatatgactcactagag

SEQ ID NO: 3255 - DNA, 18 bp, synthetic construct
  source 1..18: mol_type = other DNA
ttatacgactcacaataa

SEQ ID NO: 3256 - DNA, 18 bp, synthetic construct
  source 1..18: mol_type = other DNA
ttatacgactgacgatag

SEQ ID NO: 3257 - DNA, 18 bp, synthetic construct
  source 1..18: mol_type = other DNA
ttatacgacttactataa

SEQ ID NO: 3258 - DNA, 18 bp, synthetic construct
  source 1..18: mol_type = other DNA
ttatacgtctcactatac

SEQ ID NO: 3259 - DNA, 18 bp, synthetic construct
  source 1..18: mol_type = other DNA
ttttacgactcactataa

SEQ ID NO: 3260 - DNA, 18 bp, synthetic construct
  source 1..18: mol_type = other DNA
taattcgactctctaaag

SEQ ID NO: 3261 - DNA, 18 bp, synthetic construct
  source 1..18: mol_type = other DNA
taatacgactcacttagg

SEQ ID NO: 3262 - DNA, 18 bp, synthetic construct
  source 1..18: mol_type = other DNA
tatttagactcactatag

SEQ ID NO: 3263 - DNA, 18 bp, synthetic construct
  source 1..18: mol_type = other DNA
tattgcgattcactatag

SEQ ID NO: 3264 - DNA, 18 bp, synthetic construct
  source 1..18: mol_type = other DNA
aattacgactcactgtag

SEQ ID NO: 3265 - DNA, 18 bp, synthetic construct
  source 1..18: mol_type = other DNA
taattcgtctcaccatag

SEQ ID NO: 3266 - DNA, 18 bp, synthetic construct
  source 1..18: mol_type = other DNA
taataaaactcactctag

SEQ ID NO: 3267 - DNA, 18 bp, synthetic construct
  source 1..18: mol_type = other DNA
taataagagtcactaaag

SEQ ID NO: 3268 - DNA, 18 bp, synthetic construct
  source 1..18: mol_type = other DNA
ttataagcctcactatag

SEQ ID NO: 3269 - DNA, 18 bp, synthetic construct
  source 1..18: mol_type = other DNA
tattacaactcactattg

SEQ ID NO: 3270 - DNA, 18 bp, synthetic construct
  source 1..18: mol_type = other DNA
taaatcgactcactttag

SEQ ID NO: 3271 - DNA, 18 bp, synthetic construct
  source 1..18: mol_type = other DNA
ttataccgctcactatag

SEQ ID NO: 3272 - DNA, 18 bp, synthetic construct
  source 1..18: mol_type = other DNA
tagtacaactcactacag

SEQ ID NO: 3273 - DNA, 18 bp, synthetic construct
  source 1..18: mol_type = other DNA
ctatacgactcactttag

SEQ ID NO: 3274 - DNA, 18 bp, synthetic construct
  source 1..18: mol_type = other DNA
tattacgtgtcactatag

SEQ ID NO: 3275 - DNA, 18 bp, synthetic construct
  source 1..18: mol_type = other DNA
taataagtgtcactatag

SEQ ID NO: 3276 - DNA, 18 bp, synthetic construct
  source 1..18: mol_type = other DNA
taataggactcgccatag

SEQ ID NO: 3277 - DNA, 18 bp, synthetic construct
  source 1..18: mol_type = other DNA
taatatgactcactaagg

SEQ ID NO: 3278 - DNA, 18 bp, synthetic construct
  source 1..18: mol_type = other DNA
taatatgactcactgtgg

SEQ ID NO: 3279 - DNA, 18 bp, synthetic construct
  source 1..18: mol_type = other DNA
caaaacgactcacaatag

SEQ ID NO: 3280 - DNA, 18 bp, synthetic construct
  source 1..18: mol_type = other DNA
taatacgtctcaccatcg

SEQ ID NO: 3281 - DNA, 18 bp, synthetic construct
  source 1..18: mol_type = other DNA
caattcaactcactatag

SEQ ID NO: 3282 - DNA, 18 bp, synthetic construct
  source 1..18: mol_type = other DNA
ttatacgactcactaagg

SEQ ID NO: 3283 - DNA, 18 bp, synthetic construct
  source 1..18: mol_type = other DNA
ttttacgactcaccatag

SEQ ID NO: 3284 - DNA, 18 bp, synthetic construct
  source 1..18: mol_type = other DNA
taataagactcaccttag

SEQ ID NO: 3285 - DNA, 18 bp, synthetic construct
  source 1..18: mol_type = other DNA
ttattcgactcactttag

SEQ ID NO: 3286 - DNA, 18 bp, synthetic construct
  source 1..18: mol_type = other DNA
aaatacgtctcactctag

SEQ ID NO: 3287 - DNA, 18 bp, synthetic construct
  source 1..18: mol_type = other DNA
taaaccgactcaccatag

SEQ ID NO: 3288 - DNA, 18 bp, synthetic construct
  source 1..18: mol_type = other DNA
taattcgactcacgatcg

SEQ ID NO: 3289 - DNA, 18 bp, synthetic construct
  source 1..18: mol_type = other DNA
tcataccactcactacag

SEQ ID NO: 3290 - DNA, 18 bp, synthetic construct
  source 1..18: mol_type = other DNA
taatacgcctcacttcag

SEQ ID NO: 3291 - DNA, 18 bp, synthetic construct
  source 1..18: mol_type = other DNA
taacacgactctctattg

SEQ ID NO: 3292 - DNA, 18 bp, synthetic construct
  source 1..18: mol_type = other DNA
aattacgcctcactatag

SEQ ID NO: 3293 - DNA, 18 bp, synthetic construct
  source 1..18: mol_type = other DNA
tgattcgcctcactatag

SEQ ID NO: 3294 - DNA, 18 bp, synthetic construct
  source 1..18: mol_type = other DNA
aaacgcgactcactatag

SEQ ID NO: 3295 - DNA, 18 bp, synthetic construct
  source 1..18: mol_type = other DNA
tatcacgcctcactatag

SEQ ID NO: 3296 - DNA, 18 bp, synthetic construct
  source 1..18: mol_type = other DNA
taatacgagtcactactg

SEQ ID NO: 3297 - DNA, 18 bp, synthetic construct
  source 1..18: mol_type = other DNA
taatacggatcaccatag

SEQ ID NO: 3298 - DNA, 18 bp, synthetic construct
  source 1..18: mol_type = other DNA
taatacggctagctatag

SEQ ID NO: 3299 - DNA, 18 bp, synthetic construct
  source 1..18: mol_type = other DNA
taatccgaatcactctag

SEQ ID NO: 3300 - DNA, 18 bp, synthetic construct
  source 1..18: mol_type = other DNA
taatgagactcactacag

SEQ ID NO: 3301 - DNA, 18 bp, synthetic construct
  source 1..18: mol_type = other DNA
taatgcgaatcgctatag

SEQ ID NO: 3302 - DNA, 18 bp, synthetic construct
  source 1..18: mol_type = other DNA
tgatacgacgcactattg

SEQ ID NO: 3303 - DNA, 18 bp, synthetic construct
  source 1..18: mol_type = other DNA
tgataggactcactaaag

SEQ ID NO: 3304 - DNA, 18 bp, synthetic construct
  source 1..18: mol_type = other DNA
ttataggactcactatgg

SEQ ID NO: 3305 - DNA, 18 bp, synthetic construct
  source 1..18: mol_type = other DNA
tctttcgactcactatag

SEQ ID NO: 3306 - DNA, 18 bp, synthetic construct
  source 1..18: mol_type = other DNA
ctatccgactcactatag

SEQ ID NO: 3307 - DNA, 18 bp, synthetic construct
  source 1..18: mol_type = other DNA
taatacgactctctgaag

SEQ ID NO: 3308 - DNA, 18 bp, synthetic construct
  source 1..18: mol_type = other DNA
taatacgtctcgctacag

SEQ ID NO: 3309 - DNA, 18 bp, synthetic construct
  source 1..18: mol_type = other DNA
taatatgactcacttgag

SEQ ID NO: 3310 - DNA, 18 bp, synthetic construct
  source 1..18: mol_type = other DNA
tgatacaactcacaatag

SEQ ID NO: 3311 - DNA, 18 bp, synthetic construct
  source 1..18: mol_type = other DNA
taatacgactagctattg

SEQ ID NO: 3312 - DNA, 18 bp, synthetic construct
  source 1..18: mol_type = other DNA
tattacgactcactcaag

SEQ ID NO: 3313 - DNA, 18 bp, synthetic construct
  source 1..18: mol_type = other DNA
ttatacaactcagtatag

SEQ ID NO: 3314 - DNA, 18 bp, synthetic construct
  source 1..18: mol_type = other DNA
taaaacgactcaccatgg

SEQ ID NO: 3315 - DNA, 18 bp, synthetic construct
  source 1..18: mol_type = other DNA
caatacgactcacggtag

SEQ ID NO: 3316 - DNA, 18 bp, synthetic construct
  source 1..18: mol_type = other DNA
caattcgactcactagag

SEQ ID NO: 3317 - DNA, 18 bp, synthetic construct
  source 1..18: mol_type = other DNA
tattacgagtcagtatag

SEQ ID NO: 3318 - DNA, 18 bp, synthetic construct
  source 1..18: mol_type = other DNA
tcatatgactcactatgg

SEQ ID NO: 3319 - DNA, 18 bp, synthetic construct
  source 1..18: mol_type = other DNA
ttatacgactcactgcag

SEQ ID NO: 3320 - DNA, 18 bp, synthetic construct
  source 1..18: mol_type = other DNA
ttatacgactcaggatag

SEQ ID NO: 3321 - DNA, 18 bp, synthetic construct
  source 1..18: mol_type = other DNA
aaatacgactcactgcag

SEQ ID NO: 3322 - DNA, 18 bp, synthetic construct
  source 1..18: mol_type = other DNA
caatatgactgactatag

SEQ ID NO: 3323 - DNA, 18 bp, synthetic construct
  source 1..18: mol_type = other DNA
gaatgcgcctcactatag

SEQ ID NO: 3324 - DNA, 18 bp, synthetic construct
  source 1..18: mol_type = other DNA
taaaccgactcactagag

SEQ ID NO: 3325 - DNA, 18 bp, synthetic construct
  source 1..18: mol_type = other DNA
taacacgacttactatcg

SEQ ID NO: 3326 - DNA, 18 bp, synthetic construct
  source 1..18: mol_type = other DNA
taaggcgactctctatag

SEQ ID NO: 3327 - DNA, 18 bp, synthetic construct
  source 1..18: mol_type = other DNA
taatacgacgttctatag

SEQ ID NO: 3328 - DNA, 18 bp, synthetic construct
  source 1..18: mol_type = other DNA
taatacgactcacttttt

SEQ ID NO: 3329 - DNA, 18 bp, synthetic construct
  source 1..18: mol_type = other DNA
taatacgcctcaggatag

SEQ ID NO: 3330 - DNA, 18 bp, synthetic construct
  source 1..18: mol_type = other DNA
taataggactcaccagag

SEQ ID NO: 3331 - DNA, 18 bp, synthetic construct
  source 1..18: mol_type = other DNA
taatccgactctgtatag

SEQ ID NO: 3332 - DNA, 18 bp, synthetic construct
  source 1..18: mol_type = other DNA
taatcggactcacaatag

SEQ ID NO: 3333 - DNA, 18 bp, synthetic construct
  source 1..18: mol_type = other DNA
taatgcgaatcactctag

SEQ ID NO: 3334 - DNA, 18 bp, synthetic construct
  source 1..18: mol_type = other DNA
taatgcgacccaatatag

SEQ ID NO: 3335 - DNA, 18 bp, synthetic construct
  source 1..18: mol_type = other DNA
taattcgacgaactatag

SEQ ID NO: 3336 - DNA, 18 bp, synthetic construct
  source 1..18: mol_type = other DNA
tattacgaagcactatag

SEQ ID NO: 3337 - DNA, 18 bp, synthetic construct
  source 1..18: mol_type = other DNA
tcataagactcactatcg

SEQ ID NO: 3338 - DNA, 18 bp, synthetic construct
  source 1..18: mol_type = other DNA
tcatacgactcaccacag

SEQ ID NO: 3339 - DNA, 18 bp, synthetic construct
  source 1..18: mol_type = other DNA
tcatatgactcactatcg

SEQ ID NO: 3340 - DNA, 18 bp, synthetic construct
  source 1..18: mol_type = other DNA
tcatgcgactcactacag

SEQ ID NO: 3341 - DNA, 18 bp, synthetic construct
  source 1..18: mol_type = other DNA
taatacgtatcactctag

SEQ ID NO: 3342 - DNA, 18 bp, synthetic construct
  source 1..18: mol_type = other DNA
taattcgactctctacag

SEQ ID NO: 3343 - DNA, 18 bp, synthetic construct
  source 1..18: mol_type = other DNA
tagtacaactcactctag

SEQ ID NO: 3344 - DNA, 18 bp, synthetic construct
  source 1..18: mol_type = other DNA
taatacgcctcaccttag

SEQ ID NO: 3345 - DNA, 18 bp, synthetic construct
  source 1..18: mol_type = other DNA
taatacgactcacctttg

SEQ ID NO: 3346 - DNA, 18 bp, synthetic construct
  source 1..18: mol_type = other DNA
caattcgactcactctag

SEQ ID NO: 3347 - DNA, 18 bp, synthetic construct
  source 1..18: mol_type = other DNA
aaatttgactcactatag

SEQ ID NO: 3348 - DNA, 18 bp, synthetic construct
  source 1..18: mol_type = other DNA
ttatacgactcacgaaag

SEQ ID NO: 3349 - DNA, 18 bp, synthetic construct
  source 1..18: mol_type = other DNA
taataagactgacaatag

SEQ ID NO: 3350 - DNA, 18 bp, synthetic construct
  source 1..18: mol_type = other DNA
taatacgactccctgttg

SEQ ID NO: 3351 - DNA, 18 bp, synthetic construct
  source 1..18: mol_type = other DNA
taaaacaactcactattg

SEQ ID NO: 3352 - DNA, 18 bp, synthetic construct
  source 1..18: mol_type = other DNA
ttatacgactcaccctag

SEQ ID NO: 3353 - DNA, 18 bp, synthetic construct
  source 1..18: mol_type = other DNA
taaatcgtctcactatag

SEQ ID NO: 3354 - DNA, 18 bp, synthetic construct
  source 1..18: mol_type = other DNA
taatacaactcacttcag

SEQ ID NO: 3355 - DNA, 18 bp, synthetic construct
  source 1..18: mol_type = other DNA
tattagaactcactatag

SEQ ID NO: 3356 - DNA, 18 bp, synthetic construct
  source 1..18: mol_type = other DNA
tcatacgagtgactatag

SEQ ID NO: 3357 - DNA, 18 bp, synthetic construct
  source 1..18: mol_type = other DNA
taaagagactcactatag

SEQ ID NO: 3358 - DNA, 18 bp, synthetic construct
  source 1..18: mol_type = other DNA
taataacactccctatag

SEQ ID NO: 3359 - DNA, 18 bp, synthetic construct
  source 1..18: mol_type = other DNA
taatgcgactaaccatag

SEQ ID NO: 3360 - DNA, 18 bp, synthetic construct
  source 1..18: mol_type = other DNA
tacaacgactcaccatag

SEQ ID NO: 3361 - DNA, 18 bp, synthetic construct
  source 1..18: mol_type = other DNA
tcatacgactcagtatgg

SEQ ID NO: 3362 - DNA, 18 bp, synthetic construct
  source 1..18: mol_type = other DNA
tattaagactcacaatag

SEQ ID NO: 3363 - DNA, 18 bp, synthetic construct
  source 1..18: mol_type = other DNA
taaaacgactcactactg

SEQ ID NO: 3364 - DNA, 18 bp, synthetic construct
  source 1..18: mol_type = other DNA
taatccgtctcactatcg

SEQ ID NO: 3365 - DNA, 18 bp, synthetic construct
  source 1..18: mol_type = other DNA
tattaagactcgctatag

SEQ ID NO: 3366 - DNA, 18 bp, synthetic construct
  source 1..18: mol_type = other DNA
taattcgtctcactttag

SEQ ID NO: 3367 - DNA, 18 bp, synthetic construct
  source 1..18: mol_type = other DNA
taataagactcacttcag

SEQ ID NO: 3368 - DNA, 18 bp, synthetic construct
  source 1..18: mol_type = other DNA
taatacaactcactcaag

SEQ ID NO: 3369 - DNA, 18 bp, synthetic construct
  source 1..18: mol_type = other DNA
gaatacgactcacttttg

SEQ ID NO: 3370 - DNA, 18 bp, synthetic construct
  source 1..18: mol_type = other DNA
gaatacgacccactttag

SEQ ID NO: 3371 - DNA, 18 bp, synthetic construct
  source 1..18: mol_type = other DNA
taataagactcacgaaag

SEQ ID NO: 3372 - DNA, 18 bp, synthetic construct
  source 1..18: mol_type = other DNA
taataagactcactaccg

SEQ ID NO: 3373 - DNA, 18 bp, synthetic construct
  source 1..18: mol_type = other DNA
taatacgaatcatgatag

SEQ ID NO: 3374 - DNA, 18 bp, synthetic construct
  source 1..18: mol_type = other DNA
taatacgacgcactcaag

SEQ ID NO: 3375 - DNA, 18 bp, synthetic construct
  source 1..18: mol_type = other DNA
taatccgatccactatag

SEQ ID NO: 3376 - DNA, 18 bp, synthetic construct
  source 1..18: mol_type = other DNA
tactaggactcactctag

SEQ ID NO: 3377 - DNA, 18 bp, synthetic construct
  source 1..18: mol_type = other DNA
tgatatgactaactatag

SEQ ID NO: 3378 - DNA, 18 bp, synthetic construct
  source 1..18: mol_type = other DNA
taatacgactcacatcag

SEQ ID NO: 3379 - DNA, 18 bp, synthetic construct
  source 1..18: mol_type = other DNA
caatctgactcactatag

SEQ ID NO: 3380 - DNA, 18 bp, synthetic construct
  source 1..18: mol_type = other DNA
taataagactcaccagag

SEQ ID NO: 3381 - DNA, 18 bp, synthetic construct
  source 1..18: mol_type = other DNA
taatacgactcactgctg

SEQ ID NO: 3382 - DNA, 18 bp, synthetic construct
  source 1..18: mol_type = other DNA
taatacgactcgacatag

SEQ ID NO: 3383 - DNA, 18 bp, synthetic construct
  source 1..18: mol_type = other DNA
taattcgccccactatag

SEQ ID NO: 3384 - DNA, 18 bp, synthetic construct
  source 1..18: mol_type = other DNA
ttatccgactcaccatag

SEQ ID NO: 3385 - DNA, 18 bp, synthetic construct
  source 1..18: mol_type = other DNA
ttttatgactcactatag

SEQ ID NO: 3386 - DNA, 18 bp, synthetic construct
  source 1..18: mol_type = other DNA
ttatacgactcactcaag

SEQ ID NO: 3387 - DNA, 18 bp, synthetic construct
  source 1..18: mol_type = other DNA
aattgcgactcactatag

SEQ ID NO: 3388 - DNA, 18 bp, synthetic construct
  source 1..18: mol_type = other DNA
taaaatgactcagtatag

SEQ ID NO: 3389 - DNA, 18 bp, synthetic construct
  source 1..18: mol_type = other DNA
taaaccgactcactctag

SEQ ID NO: 3390 - DNA, 18 bp, synthetic construct
  source 1..18: mol_type = other DNA
taaaaagactcactatcg

SEQ ID NO: 3391 - DNA, 18 bp, synthetic construct
  source 1..18: mol_type = other DNA
taattcgactcactttgg

SEQ ID NO: 3392 - DNA, 18 bp, synthetic construct
  source 1..18: mol_type = other DNA
caataggactcactgtag

SEQ ID NO: 3393 - DNA, 18 bp, synthetic construct
  source 1..18: mol_type = other DNA
taatacgactcgttattg

SEQ ID NO: 3394 - DNA, 18 bp, synthetic construct
  source 1..18: mol_type = other DNA
tcttgcgactcactatag

SEQ ID NO: 3395 - DNA, 18 bp, synthetic construct
  source 1..18: mol_type = other DNA
tattccgactcactattg

SEQ ID NO: 3396 - DNA, 18 bp, synthetic construct
  source 1..18: mol_type = other DNA
ttattcgactcagtatag

SEQ ID NO: 3397 - DNA, 18 bp, synthetic construct
  source 1..18: mol_type = other DNA
taatccgactcacttaag

SEQ ID NO: 3398 - DNA, 18 bp, synthetic construct
  source 1..18: mol_type = other DNA
tataacgactcacgatag

SEQ ID NO: 3399 - DNA, 18 bp, synthetic construct
  source 1..18: mol_type = other DNA
aactacgactcagtatag

SEQ ID NO: 3400 - DNA, 18 bp, synthetic construct
  source 1..18: mol_type = other DNA
taataccaatcactgtag

SEQ ID NO: 3401 - DNA, 18 bp, synthetic construct
  source 1..18: mol_type = other DNA
taatacgactcagtccag

SEQ ID NO: 3402 - DNA, 18 bp, synthetic construct
  source 1..18: mol_type = other DNA
taatacgccgcactattg

SEQ ID NO: 3403 - DNA, 18 bp, synthetic construct
  source 1..18: mol_type = other DNA
taatatgaatcactatcg

SEQ ID NO: 3404 - DNA, 18 bp, synthetic construct
  source 1..18: mol_type = other DNA
taatccgactccctttag

SEQ ID NO: 3405 - DNA, 18 bp, synthetic construct
  source 1..18: mol_type = other DNA
taatgcgaatcactatcg

SEQ ID NO: 3406 - DNA, 18 bp, synthetic construct
  source 1..18: mol_type = other DNA
tactgcgactcactattg

SEQ ID NO: 3407 - DNA, 18 bp, synthetic construct
  source 1..18: mol_type = other DNA
tcatacgcctcactattg

SEQ ID NO: 3408 - DNA, 18 bp, synthetic construct
  source 1..18: mol_type = other DNA
caatccgactcactatgg

SEQ ID NO: 3409 - DNA, 18 bp, synthetic construct
  source 1..18: mol_type = other DNA
gaatacgactcagtattg

SEQ ID NO: 3410 - DNA, 18 bp, synthetic construct
  source 1..18: mol_type = other DNA
gattacaactcactatag

SEQ ID NO: 3411 - DNA, 18 bp, synthetic construct
  source 1..18: mol_type = other DNA
taaaacgactcacggtag

SEQ ID NO: 3412 - DNA, 18 bp, synthetic construct
  source 1..18: mol_type = other DNA
taagacgactagctatag

SEQ ID NO: 3413 - DNA, 18 bp, synthetic construct
  source 1..18: mol_type = other DNA
taatacgacgtactctag

SEQ ID NO: 3414 - DNA, 18 bp, synthetic construct
  source 1..18: mol_type = other DNA
taatacgactggctctag

SEQ ID NO: 3415 - DNA, 18 bp, synthetic construct
  source 1..18: mol_type = other DNA
taatacgatgcacaatag

SEQ ID NO: 3416 - DNA, 18 bp, synthetic construct
  source 1..18: mol_type = other DNA
taatacggctcacgattg

SEQ ID NO: 3417 - DNA, 18 bp, synthetic construct
  source 1..18: mol_type = other DNA
taatcctactcgctatag

SEQ ID NO: 3418 - DNA, 18 bp, synthetic construct
  source 1..18: mol_type = other DNA
taatgcgactaactatcg

SEQ ID NO: 3419 - DNA, 18 bp, synthetic construct
  source 1..18: mol_type = other DNA
tactacgcgtcactatag

SEQ ID NO: 3420 - DNA, 18 bp, synthetic construct
  source 1..18: mol_type = other DNA
taggacgactcaatatag

SEQ ID NO: 3421 - DNA, 18 bp, synthetic construct
  source 1..18: mol_type = other DNA
tagtacgtgtcactatag

SEQ ID NO: 3422 - DNA, 18 bp, synthetic construct
  source 1..18: mol_type = other DNA
tagtccgactcactgtag

SEQ ID NO: 3423 - DNA, 18 bp, synthetic construct
  source 1..18: mol_type = other DNA
tgagacgtctcactatag

SEQ ID NO: 3424 - DNA, 18 bp, synthetic construct
  source 1..18: mol_type = other DNA
tgataggacgcactatag

SEQ ID NO: 3425 - DNA, 18 bp, synthetic construct
  source 1..18: mol_type = other DNA
tgatgcgactcactctag

SEQ ID NO: 3426 - DNA, 18 bp, synthetic construct
  source 1..18: mol_type = other DNA
aaagacgactcattatag

SEQ ID NO: 3427 - DNA, 18 bp, synthetic construct
  source 1..18: mol_type = other DNA
aaatacgactcgccatag

SEQ ID NO: 3428 - DNA, 18 bp, synthetic construct
  source 1..18: mol_type = other DNA
aaatacgagtcacgatag

SEQ ID NO: 3429 - DNA, 18 bp, synthetic construct
  source 1..18: mol_type = other DNA
aaatacgagtcactataa

SEQ ID NO: 3430 - DNA, 18 bp, synthetic construct
  source 1..18: mol_type = other DNA
atatacgactcactataa

SEQ ID NO: 3431 - DNA, 18 bp, synthetic construct
  source 1..18: mol_type = other DNA
caagacgactcaccatag

SEQ ID NO: 3432 - DNA, 18 bp, synthetic construct
  source 1..18: mol_type = other DNA
ccatacgactcactataa

SEQ ID NO: 3433 - DNA, 18 bp, synthetic construct
  source 1..18: mol_type = other DNA
gaaaacgactcacgatag

SEQ ID NO: 3434 - DNA, 18 bp, synthetic construct
  source 1..18: mol_type = other DNA
gaataagactcactgtag

SEQ ID NO: 3435 - DNA, 18 bp, synthetic construct
  source 1..18: mol_type = other DNA
gaatacgactcaccatcg

SEQ ID NO: 3436 - DNA, 18 bp, synthetic construct
  source 1..18: mol_type = other DNA
gaatacgactcgcaatag

SEQ ID NO: 3437 - DNA, 18 bp, synthetic construct
  source 1..18: mol_type = other DNA
gaatacgacttattatag

SEQ ID NO: 3438 - DNA, 18 bp, synthetic construct
  source 1..18: mol_type = other DNA
gaatacgatgcactatag

SEQ ID NO: 3439 - DNA, 18 bp, synthetic construct
  source 1..18: mol_type = other DNA
gaatccgactcactctag

SEQ ID NO: 3440 - DNA, 18 bp, synthetic construct
  source 1..18: mol_type = other DNA
gaatgcgacttactatag

SEQ ID NO: 3441 - DNA, 18 bp, synthetic construct
  source 1..18: mol_type = other DNA
taacaggactgactatag

SEQ ID NO: 3442 - DNA, 18 bp, synthetic construct
  source 1..18: mol_type = other DNA
taagacgaatcactgtag

SEQ ID NO: 3443 - DNA, 18 bp, synthetic construct
  source 1..18: mol_type = other DNA
taagacgaccaactatag

SEQ ID NO: 3444 - DNA, 18 bp, synthetic construct
  source 1..18: mol_type = other DNA
taagacgactaacgatag

SEQ ID NO: 3445 - DNA, 18 bp, synthetic construct
  source 1..18: mol_type = other DNA
taagacgactgactaaag

SEQ ID NO: 3446 - DNA, 18 bp, synthetic construct
  source 1..18: mol_type = other DNA
taagacgagtcactttag

SEQ ID NO: 3447 - DNA, 18 bp, synthetic construct
  source 1..18: mol_type = other DNA
taataacactcacgatag

SEQ ID NO: 3448 - DNA, 18 bp, synthetic construct
  source 1..18: mol_type = other DNA
taataaggctcaatatag

SEQ ID NO: 3449 - DNA, 18 bp, synthetic construct
  source 1..18: mol_type = other DNA
taatacaactcacaataa

SEQ ID NO: 3450 - DNA, 18 bp, synthetic construct
  source 1..18: mol_type = other DNA
taataccactagctatag

SEQ ID NO: 3451 - DNA, 18 bp, synthetic construct
  source 1..18: mol_type = other DNA
taataccactcaccctag

SEQ ID NO: 3452 - DNA, 18 bp, synthetic construct
  source 1..18: mol_type = other DNA
taataccactcacgagag

SEQ ID NO: 3453 - DNA, 18 bp, synthetic construct
  source 1..18: mol_type = other DNA
taatacgaatcacaatac

SEQ ID NO: 3454 - DNA, 18 bp, synthetic construct
  source 1..18: mol_type = other DNA
taatacgacacgcgatag

SEQ ID NO: 3455 - DNA, 18 bp, synthetic construct
  source 1..18: mol_type = other DNA
taatacgacccaccctag

SEQ ID NO: 3456 - DNA, 18 bp, synthetic construct
  source 1..18: mol_type = other DNA
taatacgacccattgtag

SEQ ID NO: 3457 - DNA, 18 bp, synthetic construct
  source 1..18: mol_type = other DNA
taatacgacgcagtgtag

SEQ ID NO: 3458 - DNA, 18 bp, synthetic construct
  source 1..18: mol_type = other DNA
taatacgactaactaccg

SEQ ID NO: 3459 - DNA, 18 bp, synthetic construct
  source 1..18: mol_type = other DNA
taatacgactcacgactg

SEQ ID NO: 3460 - DNA, 18 bp, synthetic construct
  source 1..18: mol_type = other DNA
taatacgactccctagcg

SEQ ID NO: 3461 - DNA, 18 bp, synthetic construct
  source 1..18: mol_type = other DNA
taatacgagtcacgatcg

SEQ ID NO: 3462 - DNA, 18 bp, synthetic construct
  source 1..18: mol_type = other DNA
taatacggctcgctataa

SEQ ID NO: 3463 - DNA, 18 bp, synthetic construct
  source 1..18: mol_type = other DNA
taatacgtctcactatct

SEQ ID NO: 3464 - DNA, 18 bp, synthetic construct
  source 1..18: mol_type = other DNA
taatagaacccactatag

SEQ ID NO: 3465 - DNA, 18 bp, synthetic construct
  source 1..18: mol_type = other DNA
taatagggcttactatag

SEQ ID NO: 3466 - DNA, 18 bp, synthetic construct
  source 1..18: mol_type = other DNA
taatcagacgcactatag

SEQ ID NO: 3467 - DNA, 18 bp, synthetic construct
  source 1..18: mol_type = other DNA
taatcccactcgctatag

SEQ ID NO: 3468 - DNA, 18 bp, synthetic construct
  source 1..18: mol_type = other DNA
taatccgactagctatag

SEQ ID NO: 3469 - DNA, 18 bp, synthetic construct
  source 1..18: mol_type = other DNA
taatccgactcattagag

SEQ ID NO: 3470 - DNA, 18 bp, synthetic construct
  source 1..18: mol_type = other DNA
taatccgactcggtatag

SEQ ID NO: 3471 - DNA, 18 bp, synthetic construct
  source 1..18: mol_type = other DNA
taatgccactcactatcg

SEQ ID NO: 3472 - DNA, 18 bp, synthetic construct
  source 1..18: mol_type = other DNA
taatgcgaatcacgatag

SEQ ID NO: 3473 - DNA, 18 bp, synthetic construct
  source 1..18: mol_type = other DNA
taatgcgactcagtagag

SEQ ID NO: 3474 - DNA, 18 bp, synthetic construct
  source 1..18: mol_type = other DNA
taatgcgacttactgtag

SEQ ID NO: 3475 - DNA, 18 bp, synthetic construct
  source 1..18: mol_type = other DNA
taatgcgacttagtatag

SEQ ID NO: 3476 - DNA, 18 bp, synthetic construct
  source 1..18: mol_type = other DNA
taatgcgcctcactatcg

SEQ ID NO: 3477 - DNA, 18 bp, synthetic construct
  source 1..18: mol_type = other DNA
taatgcgcctcactatgg

SEQ ID NO: 3478 - DNA, 18 bp, synthetic construct
  source 1..18: mol_type = other DNA
taatgggacgcactatag

SEQ ID NO: 3479 - DNA, 18 bp, synthetic construct
  source 1..18: mol_type = other DNA
taattcgactcactttac

SEQ ID NO: 3480 - DNA, 18 bp, synthetic construct
  source 1..18: mol_type = other DNA
tactacgactcagtatcg

SEQ ID NO: 3481 - DNA, 18 bp, synthetic construct
  source 1..18: mol_type = other DNA
tactacgagtcactctag

SEQ ID NO: 3482 - DNA, 18 bp, synthetic construct
  source 1..18: mol_type = other DNA
tactcccactcactatag

SEQ ID NO: 3483 - DNA, 18 bp, synthetic construct
  source 1..18: mol_type = other DNA
tactgcgactcactatgg

SEQ ID NO: 3484 - DNA, 18 bp, synthetic construct
  source 1..18: mol_type = other DNA
tactgcgactcagtatag

SEQ ID NO: 3485 - DNA, 18 bp, synthetic construct
  source 1..18: mol_type = other DNA
tagaacgactcacgatag

SEQ ID NO: 3486 - DNA, 18 bp, synthetic construct
  source 1..18: mol_type = other DNA
tagtacgtctccctatag

SEQ ID NO: 3487 - DNA, 18 bp, synthetic construct
  source 1..18: mol_type = other DNA
tagtccgacccactatag

SEQ ID NO: 3488 - DNA, 18 bp, synthetic construct
  source 1..18: mol_type = other DNA
tattacgacgcaccatag

SEQ ID NO: 3489 - DNA, 18 bp, synthetic construct
  source 1..18: mol_type = other DNA
tcatacgattcaccatag

SEQ ID NO: 3490 - DNA, 18 bp, synthetic construct
  source 1..18: mol_type = other DNA
tcatacggcgcactatag

SEQ ID NO: 3491 - DNA, 18 bp, synthetic construct
  source 1..18: mol_type = other DNA
tcgtacgactcaccatag

SEQ ID NO: 3492 - DNA, 18 bp, synthetic construct
  source 1..18: mol_type = other DNA
tgaaaggactcactatag

SEQ ID NO: 3493 - DNA, 18 bp, synthetic construct
  source 1..18: mol_type = other DNA
tgatacgactcactttaa

SEQ ID NO: 3494 - DNA, 18 bp, synthetic construct
  source 1..18: mol_type = other DNA
tgatacgactccctatgg

SEQ ID NO: 3495 - DNA, 18 bp, synthetic construct
  source 1..18: mol_type = other DNA
tgattcgactcactatgg

SEQ ID NO: 3496 - DNA, 18 bp, synthetic construct
  source 1..18: mol_type = other DNA
ttagacgactcactctag

SEQ ID NO: 3497 - DNA, 18 bp, synthetic construct
  source 1..18: mol_type = other DNA
taatccgactctctctag

SEQ ID NO: 3498 - DNA, 18 bp, synthetic construct
  source 1..18: mol_type = other DNA
taacacgactcactacgg

SEQ ID NO: 3499 - DNA, 18 bp, synthetic construct
  source 1..18: mol_type = other DNA
taatacaaagcactatag

SEQ ID NO: 3500 - DNA, 18 bp, synthetic construct
  source 1..18: mol_type = other DNA
taatacaactgactatgg

SEQ ID NO: 3501 - DNA, 18 bp, synthetic construct
  source 1..18: mol_type = other DNA
taatacgaccaactatcg

SEQ ID NO: 3502 - DNA, 18 bp, synthetic construct
  source 1..18: mol_type = other DNA
taatacgactcagtagtg

SEQ ID NO: 3503 - DNA, 18 bp, synthetic construct
  source 1..18: mol_type = other DNA
taatacgactcgcgacag

SEQ ID NO: 3504 - DNA, 18 bp, synthetic construct
  source 1..18: mol_type = other DNA
taatacgtctcgctctag

SEQ ID NO: 3505 - DNA, 18 bp, synthetic construct
  source 1..18: mol_type = other DNA
taatatgactctctagag

SEQ ID NO: 3506 - DNA, 18 bp, synthetic construct
  source 1..18: mol_type = other DNA
taatgcgactaactctag

SEQ ID NO: 3507 - DNA, 18 bp, synthetic construct
  source 1..18: mol_type = other DNA
taatgcgcctcgctatag

SEQ ID NO: 3508 - DNA, 18 bp, synthetic construct
  source 1..18: mol_type = other DNA
taatgctactcactctag

SEQ ID NO: 3509 - DNA, 18 bp, synthetic construct
  source 1..18: mol_type = other DNA
tactccgactcactctag

SEQ ID NO: 3510 - DNA, 18 bp, synthetic construct
  source 1..18: mol_type = other DNA
tatcacgactcaccatag

SEQ ID NO: 3511 - DNA, 18 bp, synthetic construct
  source 1..18: mol_type = other DNA
tcaaaccactcactatag

SEQ ID NO: 3512 - DNA, 18 bp, synthetic construct
  source 1..18: mol_type = other DNA
tcatacgactcacaagag

SEQ ID NO: 3513 - DNA, 18 bp, synthetic construct
  source 1..18: mol_type = other DNA
tgatacgactcactaacg

SEQ ID NO: 3514 - DNA, 18 bp, synthetic construct
  source 1..18: mol_type = other DNA
tgctacgactcactgtag

SEQ ID NO: 3515 - DNA, 18 bp, synthetic construct
  source 1..18: mol_type = other DNA
ctttacgactcactatag

SEQ ID NO: 3516 - DNA, 18 bp, synthetic construct
  source 1..18: mol_type = other DNA
ttataagactcactttag

SEQ ID NO: 3517 - DNA, 18 bp, synthetic construct
  source 1..18: mol_type = other DNA
taatatgtctcactgtag

SEQ ID NO: 3518 - DNA, 18 bp, synthetic construct
  source 1..18: mol_type = other DNA
ttatacgactcacaatgg

SEQ ID NO: 3519 - DNA, 18 bp, synthetic construct
  source 1..18: mol_type = other DNA
gtatacgactcactaaag

SEQ ID NO: 3520 - DNA, 18 bp, synthetic construct
  source 1..18: mol_type = other DNA
cattacgactcactctag

SEQ ID NO: 3521 - DNA, 18 bp, synthetic construct
  source 1..18: mol_type = other DNA
taaaacgactcaccaaag

SEQ ID NO: 3522 - DNA, 18 bp, synthetic construct
  source 1..18: mol_type = other DNA
taatacgtctcacactag

SEQ ID NO: 3523 - DNA, 18 bp, synthetic construct
  source 1..18: mol_type = other DNA
tttaacgactcactatag

SEQ ID NO: 3524 - DNA, 18 bp, synthetic construct
  source 1..18: mol_type = other DNA
tgatacgaaacactatag

SEQ ID NO: 3525 - DNA, 18 bp, synthetic construct
  source 1..18: mol_type = other DNA
ttatacggctcactacag

SEQ ID NO: 3526 - DNA, 18 bp, synthetic construct
  source 1..18: mol_type = other DNA
taaaacgactcactcttg

SEQ ID NO: 3527 - DNA, 18 bp, synthetic construct
  source 1..18: mol_type = other DNA
taatgcgtctcacaatag

SEQ ID NO: 3528 - DNA, 18 bp, synthetic construct
  source 1..18: mol_type = other DNA
taatagcacacactatag

SEQ ID NO: 3529 - DNA, 18 bp, synthetic construct
  source 1..18: mol_type = other DNA
aaatacgcctcactagag

SEQ ID NO: 3530 - DNA, 18 bp, synthetic construct
  source 1..18: mol_type = other DNA
caatacgcctcactattg

SEQ ID NO: 3531 - DNA, 18 bp, synthetic construct
  source 1..18: mol_type = other DNA
taaaacggctcactatcg

SEQ ID NO: 3532 - DNA, 18 bp, synthetic construct
  source 1..18: mol_type = other DNA
taatacgactcccactag

SEQ ID NO: 3533 - DNA, 18 bp, synthetic construct
  source 1..18: mol_type = other DNA
tcctacaactcactatag

SEQ ID NO: 3534 - DNA, 18 bp, synthetic construct
  source 1..18: mol_type = other DNA
taatatgtctcactatcg

SEQ ID NO: 3535 - DNA, 18 bp, synthetic construct
  source 1..18: mol_type = other DNA
ttatccgactcactacag

SEQ ID NO: 3536 - DNA, 18 bp, synthetic construct
  source 1..18: mol_type = other DNA
taatatcactctctatag

SEQ ID NO: 3537 - DNA, 18 bp, synthetic construct
  source 1..18: mol_type = other DNA
taatacgactcaccaagg

SEQ ID NO: 3538 - DNA, 18 bp, synthetic construct
  source 1..18: mol_type = other DNA
tcattggactcactatag

SEQ ID NO: 3539 - DNA, 18 bp, synthetic construct
  source 1..18: mol_type = other DNA
tcgtacgactcactttag

SEQ ID NO: 3540 - DNA, 18 bp, synthetic construct
  source 1..18: mol_type = other DNA
tattacaactcgctatag

SEQ ID NO: 3541 - DNA, 18 bp, synthetic construct
  source 1..18: mol_type = other DNA
tattacgactcactgaag

SEQ ID NO: 3542 - DNA, 18 bp, synthetic construct
  source 1..18: mol_type = other DNA
ttatacgactcacttaag

SEQ ID NO: 3543 - DNA, 18 bp, synthetic construct
  source 1..18: mol_type = other DNA
taagaagtctcactatag

SEQ ID NO: 3544 - DNA, 18 bp, synthetic construct
  source 1..18: mol_type = other DNA
taagacgtctcactatcg

SEQ ID NO: 3545 - DNA, 18 bp, synthetic construct
  source 1..18: mol_type = other DNA
taataagaatcactacag

SEQ ID NO: 3546 - DNA, 18 bp, synthetic construct
  source 1..18: mol_type = other DNA
taataccattcagtatag

SEQ ID NO: 3547 - DNA, 18 bp, synthetic construct
  source 1..18: mol_type = other DNA
taatacgactctgtacag

SEQ ID NO: 3548 - DNA, 18 bp, synthetic construct
  source 1..18: mol_type = other DNA
taatacgtctcaccagag

SEQ ID NO: 3549 - DNA, 18 bp, synthetic construct
  source 1..18: mol_type = other DNA
tactacgactaactgtag

SEQ ID NO: 3550 - DNA, 18 bp, synthetic construct
  source 1..18: mol_type = other DNA
tgaaacgactcacgatag

SEQ ID NO: 3551 - DNA, 18 bp, synthetic construct
  source 1..18: mol_type = other DNA
tgatacgactgactttag

SEQ ID NO: 3552 - DNA, 18 bp, synthetic construct
  source 1..18: mol_type = other DNA
ttataggtctcactatag

SEQ ID NO: 3553 - DNA, 18 bp, synthetic construct
  source 1..18: mol_type = other DNA
taatactactcactaatg

SEQ ID NO: 3554 - DNA, 18 bp, synthetic construct
  source 1..18: mol_type = other DNA
taaaacgtctcactctag

SEQ ID NO: 3555 - DNA, 18 bp, synthetic construct
  source 1..18: mol_type = other DNA
aaatacgactcacttcag

SEQ ID NO: 3556 - DNA, 18 bp, synthetic construct
  source 1..18: mol_type = other DNA
taataggtctcactatgg

SEQ ID NO: 3557 - DNA, 18 bp, synthetic construct
  source 1..18: mol_type = other DNA
taatacgactcactcatg

SEQ ID NO: 3558 - DNA, 18 bp, synthetic construct
  source 1..18: mol_type = other DNA
taatacgtctcactcaag

SEQ ID NO: 3559 - DNA, 18 bp, synthetic construct
  source 1..18: mol_type = other DNA
taattcggctcactttag

SEQ ID NO: 3560 - DNA, 18 bp, synthetic construct
  source 1..18: mol_type = other DNA
tcatacgactcactcttg

SEQ ID NO: 3561 - DNA, 18 bp, synthetic construct
  source 1..18: mol_type = other DNA
ttgtgcgactcactatag

SEQ ID NO: 3562 - DNA, 18 bp, synthetic construct
  source 1..18: mol_type = other DNA
taattagactcacaatag

SEQ ID NO: 3563 - DNA, 18 bp, synthetic construct
  source 1..18: mol_type = other DNA
taatacggctcacaattg

SEQ ID NO: 3564 - DNA, 18 bp, synthetic construct
  source 1..18: mol_type = other DNA
tatatcgactcactatag

SEQ ID NO: 3565 - DNA, 18 bp, synthetic construct
  source 1..18: mol_type = other DNA
tataacgactcactttag

SEQ ID NO: 3566 - DNA, 18 bp, synthetic construct
  source 1..18: mol_type = other DNA
taatacgaatcgctattg

SEQ ID NO: 3567 - DNA, 18 bp, synthetic construct
  source 1..18: mol_type = other DNA
taatccgtctcagtatag

SEQ ID NO: 3568 - DNA, 18 bp, synthetic construct
  source 1..18: mol_type = other DNA
taatgagtctcactatag

SEQ ID NO: 3569 - DNA, 18 bp, synthetic construct
  source 1..18: mol_type = other DNA
taaaaagactcagtatag

SEQ ID NO: 3570 - DNA, 18 bp, synthetic construct
  source 1..18: mol_type = other DNA
taatacgactcacaaccg

SEQ ID NO: 3571 - DNA, 18 bp, synthetic construct
  source 1..18: mol_type = other DNA
taatacgcataactatag

SEQ ID NO: 3572 - DNA, 18 bp, synthetic construct
  source 1..18: mol_type = other DNA
tattgcgactcaatatag

SEQ ID NO: 3573 - DNA, 18 bp, synthetic construct
  source 1..18: mol_type = other DNA
taatacgacttagcatag

SEQ ID NO: 3574 - DNA, 18 bp, synthetic construct
  source 1..18: mol_type = other DNA
taattcgcctcagtatag

SEQ ID NO: 3575 - DNA, 18 bp, synthetic construct
  source 1..18: mol_type = other DNA
tcacactactcactatag

SEQ ID NO: 3576 - DNA, 18 bp, synthetic construct
  source 1..18: mol_type = other DNA
tgatacggcacactatag

SEQ ID NO: 3577 - DNA, 18 bp, synthetic construct
  source 1..18: mol_type = other DNA
caatccgactcactaaag

SEQ ID NO: 3578 - DNA, 18 bp, synthetic construct
  source 1..18: mol_type = other DNA
gattacgactcactatcg

SEQ ID NO: 3579 - DNA, 18 bp, synthetic construct
  source 1..18: mol_type = other DNA
taagaagagtcactatag

SEQ ID NO: 3580 - DNA, 18 bp, synthetic construct
  source 1..18: mol_type = other DNA
taataacactcactatcg

SEQ ID NO: 3581 - DNA, 18 bp, synthetic construct
  source 1..18: mol_type = other DNA
taatacagctaactatag

SEQ ID NO: 3582 - DNA, 18 bp, synthetic construct
  source 1..18: mol_type = other DNA
taatacccctcactctag

SEQ ID NO: 3583 - DNA, 18 bp, synthetic construct
  source 1..18: mol_type = other DNA
taatacgaaccactacag

SEQ ID NO: 3584 - DNA, 18 bp, synthetic construct
  source 1..18: mol_type = other DNA
taatacgacgcactttcg

SEQ ID NO: 3585 - DNA, 18 bp, synthetic construct
  source 1..18: mol_type = other DNA
taatacgacgctgtatag

SEQ ID NO: 3586 - DNA, 18 bp, synthetic construct
  source 1..18: mol_type = other DNA
taatacgactcactctcc

SEQ ID NO: 3587 - DNA, 18 bp, synthetic construct
  source 1..18: mol_type = other DNA
taatacgactcgttatcg

SEQ ID NO: 3588 - DNA, 18 bp, synthetic construct
  source 1..18: mol_type = other DNA
taatacgattggctatag

SEQ ID NO: 3589 - DNA, 18 bp, synthetic construct
  source 1..18: mol_type = other DNA
taatacgccttactagag

SEQ ID NO: 3590 - DNA, 18 bp, synthetic construct
  source 1..18: mol_type = other DNA
taatacgcgtcactaaag

SEQ ID NO: 3591 - DNA, 18 bp, synthetic construct
  source 1..18: mol_type = other DNA
taatacggctcatcatag

SEQ ID NO: 3592 - DNA, 18 bp, synthetic construct
  source 1..18: mol_type = other DNA
taatacgtctctctataa

SEQ ID NO: 3593 - DNA, 18 bp, synthetic construct
  source 1..18: mol_type = other DNA
taataggcctcactatcg

SEQ ID NO: 3594 - DNA, 18 bp, synthetic construct
  source 1..18: mol_type = other DNA
taatccgactcactgtcg

SEQ ID NO: 3595 - DNA, 18 bp, synthetic construct
  source 1..18: mol_type = other DNA
taatccgactctctgtag

SEQ ID NO: 3596 - DNA, 18 bp, synthetic construct
  source 1..18: mol_type = other DNA
tactacgattgactatag

SEQ ID NO: 3597 - DNA, 18 bp, synthetic construct
  source 1..18: mol_type = other DNA
tagtacgagtcactgtag

SEQ ID NO: 3598 - DNA, 18 bp, synthetic construct
  source 1..18: mol_type = other DNA
tatcccgactcactatag

SEQ ID NO: 3599 - DNA, 18 bp, synthetic construct
  source 1..18: mol_type = other DNA
ttatacgtctcactataa

SEQ ID NO: 3600 - DNA, 18 bp, synthetic construct
  source 1..18: mol_type = other DNA
aaaaacgactcactgtag

SEQ ID NO: 3601 - DNA, 18 bp, synthetic construct
  source 1..18: mol_type = other DNA
taatacaactcactttcg

SEQ ID NO: 3602 - DNA, 18 bp, synthetic construct
  source 1..18: mol_type = other DNA
taatacgagtcattattg

SEQ ID NO: 3603 - DNA, 18 bp, synthetic construct
  source 1..18: mol_type = other DNA
taatgcgaatcactaaag

SEQ ID NO: 3604 - DNA, 18 bp, synthetic construct
  source 1..18: mol_type = other DNA
taaaacgactcacgttag

SEQ ID NO: 3605 - DNA, 18 bp, synthetic construct
  source 1..18: mol_type = other DNA
ttataagactcactattg

SEQ ID NO: 3606 - DNA, 18 bp, synthetic construct
  source 1..18: mol_type = other DNA
taatacaactcactaatg

SEQ ID NO: 3607 - DNA, 18 bp, synthetic construct
  source 1..18: mol_type = other DNA
taatactactcgctattg

SEQ ID NO: 3608 - DNA, 18 bp, synthetic construct
  source 1..18: mol_type = other DNA
taattcgactcactacgg

SEQ ID NO: 3609 - DNA, 18 bp, synthetic construct
  source 1..18: mol_type = other DNA
tattacgacacactagag

SEQ ID NO: 3610 - DNA, 18 bp, synthetic construct
  source 1..18: mol_type = other DNA
caatacgactcgctgtag

SEQ ID NO: 3611 - DNA, 18 bp, synthetic construct
  source 1..18: mol_type = other DNA
taaaaccactcgctatag

SEQ ID NO: 3612 - DNA, 18 bp, synthetic construct
  source 1..18: mol_type = other DNA
taataaggctcactatcg

SEQ ID NO: 3613 - DNA, 18 bp, synthetic construct
  source 1..18: mol_type = other DNA
taataccactcacactag

SEQ ID NO: 3614 - DNA, 18 bp, synthetic construct
  source 1..18: mol_type = other DNA
taatacgacaaactagag

SEQ ID NO: 3615 - DNA, 18 bp, synthetic construct
  source 1..18: mol_type = other DNA
taatatcactcagtatag

SEQ ID NO: 3616 - DNA, 18 bp, synthetic construct
  source 1..18: mol_type = other DNA
taatccgactctcgatag

SEQ ID NO: 3617 - DNA, 18 bp, synthetic construct
  source 1..18: mol_type = other DNA
taatgcgcctcaatatag

SEQ ID NO: 3618 - DNA, 18 bp, synthetic construct
  source 1..18: mol_type = other DNA
tactgcgactcactaaag

SEQ ID NO: 3619 - DNA, 18 bp, synthetic construct
  source 1..18: mol_type = other DNA
ttattcaactcactatag

SEQ ID NO: 3620 - DNA, 18 bp, synthetic construct
  source 1..18: mol_type = other DNA
ttatacgactcactgtcg

SEQ ID NO: 3621 - DNA, 18 bp, synthetic construct
  source 1..18: mol_type = other DNA
taataaaactcactattg

SEQ ID NO: 3622 - DNA, 18 bp, synthetic construct
  source 1..18: mol_type = other DNA
taattcgactcaccctag

SEQ ID NO: 3623 - DNA, 18 bp, synthetic construct
  source 1..18: mol_type = other DNA
ttatacgactcacttgag

SEQ ID NO: 3624 - DNA, 18 bp, synthetic construct
  source 1..18: mol_type = other DNA
aaacacgcctcactatag

SEQ ID NO: 3625 - DNA, 18 bp, synthetic construct
  source 1..18: mol_type = other DNA
caatacgactctctatgg

SEQ ID NO: 3626 - DNA, 18 bp, synthetic construct
  source 1..18: mol_type = other DNA
gaatacgactcaccattg

SEQ ID NO: 3627 - DNA, 18 bp, synthetic construct
  source 1..18: mol_type = other DNA
taatacaactcactctgg

SEQ ID NO: 3628 - DNA, 18 bp, synthetic construct
  source 1..18: mol_type = other DNA
taatacgactaactaacg

SEQ ID NO: 3629 - DNA, 18 bp, synthetic construct
  source 1..18: mol_type = other DNA
taatacgactagccatag

SEQ ID NO: 3630 - DNA, 18 bp, synthetic construct
  source 1..18: mol_type = other DNA
taatacgactcgataaag

SEQ ID NO: 3631 - DNA, 18 bp, synthetic construct
  source 1..18: mol_type = other DNA
taatacgactctgtatcg

SEQ ID NO: 3632 - DNA, 18 bp, synthetic construct
  source 1..18: mol_type = other DNA
taatacgagtcgctgtag

SEQ ID NO: 3633 - DNA, 18 bp, synthetic construct
  source 1..18: mol_type = other DNA
taatacaactcacttttg

SEQ ID NO: 3634 - DNA, 18 bp, synthetic construct
  source 1..18: mol_type = other DNA
taatgcaactcactattg

SEQ ID NO: 3635 - DNA, 18 bp, synthetic construct
  source 1..18: mol_type = other DNA
tgattcgactcacaatag

SEQ ID NO: 3636 - DNA, 18 bp, synthetic construct
  source 1..18: mol_type = other DNA
taaaacaactcactttag

SEQ ID NO: 3637 - DNA, 18 bp, synthetic construct
  source 1..18: mol_type = other DNA
taattcgactcacaatcg

SEQ ID NO: 3638 - DNA, 18 bp, synthetic construct
  source 1..18: mol_type = other DNA
aaatacgcctcattatag

SEQ ID NO: 3639 - DNA, 18 bp, synthetic construct
  source 1..18: mol_type = other DNA
taatgcgtctcacgatag

SEQ ID NO: 3640 - DNA, 18 bp, synthetic construct
  source 1..18: mol_type = other DNA
tgaaaagactcactatag

SEQ ID NO: 3641 - DNA, 18 bp, synthetic construct
  source 1..18: mol_type = other DNA
tattccgaatcactatag

SEQ ID NO: 3642 - DNA, 18 bp, synthetic construct
  source 1..18: mol_type = other DNA
taacaagactcactctag

SEQ ID NO: 3643 - DNA, 18 bp, synthetic construct
  source 1..18: mol_type = other DNA
taatgaaactcactatag

SEQ ID NO: 3644 - DNA, 18 bp, synthetic construct
  source 1..18: mol_type = other DNA
aaattcgtctcactatag

SEQ ID NO: 3645 - DNA, 18 bp, synthetic construct
  source 1..18: mol_type = other DNA
taataagactcactttcg

SEQ ID NO: 3646 - DNA, 18 bp, synthetic construct
  source 1..18: mol_type = other DNA
taatacgtctcaccaaag

SEQ ID NO: 3647 - DNA, 18 bp, synthetic construct
  source 1..18: mol_type = other DNA
tgtttcgactcactatag

SEQ ID NO: 3648 - DNA, 18 bp, synthetic construct
  source 1..18: mol_type = other DNA
tataacgactcgctatag

SEQ ID NO: 3649 - DNA, 18 bp, synthetic construct
  source 1..18: mol_type = other DNA
aaatacgacttactaaag

SEQ ID NO: 3650 - DNA, 18 bp, synthetic construct
  source 1..18: mol_type = other DNA
taatacaactctctctag

SEQ ID NO: 3651 - DNA, 18 bp, synthetic construct
  source 1..18: mol_type = other DNA
tattacgactcacttcag

SEQ ID NO: 3652 - DNA, 18 bp, synthetic construct
  source 1..18: mol_type = other DNA
ttatatgactcactaaag

SEQ ID NO: 3653 - DNA, 18 bp, synthetic construct
  source 1..18: mol_type = other DNA
ttatgagactcactatag

SEQ ID NO: 3654 - DNA, 18 bp, synthetic construct
  source 1..18: mol_type = other DNA
ctatacgactcacaatag

SEQ ID NO: 3655 - DNA, 18 bp, synthetic construct
  source 1..18: mol_type = other DNA
taatacgaatcattacag

SEQ ID NO: 3656 - DNA, 18 bp, synthetic construct
  source 1..18: mol_type = other DNA
taaaacgtctcgctatag

SEQ ID NO: 3657 - DNA, 18 bp, synthetic construct
  source 1..18: mol_type = other DNA
aaatacgactagctatag

SEQ ID NO: 3658 - DNA, 18 bp, synthetic construct
  source 1..18: mol_type = other DNA
taataacactcactacag

SEQ ID NO: 3659 - DNA, 18 bp, synthetic construct
  source 1..18: mol_type = other DNA
aaatgcgactaactatag

SEQ ID NO: 3660 - DNA, 18 bp, synthetic construct
  source 1..18: mol_type = other DNA
taatccgagtcattatag

SEQ ID NO: 3661 - DNA, 18 bp, synthetic construct
  source 1..18: mol_type = other DNA
taatccgattcactacag

SEQ ID NO: 3662 - DNA, 18 bp, synthetic construct
  source 1..18: mol_type = other DNA
taatgcgacttactttag

SEQ ID NO: 3663 - DNA, 18 bp, synthetic construct
  source 1..18: mol_type = other DNA
taatgcgtctcactctag

SEQ ID NO: 3664 - DNA, 18 bp, synthetic construct
  source 1..18: mol_type = other DNA
tactcctactcactatag

SEQ ID NO: 3665 - DNA, 18 bp, synthetic construct
  source 1..18: mol_type = other DNA
tgttaggactcactatag

SEQ ID NO: 3666 - DNA, 18 bp, synthetic construct
  source 1..18: mol_type = other DNA
caattcgacgcactatag

SEQ ID NO: 3667 - DNA, 18 bp, synthetic construct
  source 1..18: mol_type = other DNA
taaaacgactcgctatgg

SEQ ID NO: 3668 - DNA, 18 bp, synthetic construct
  source 1..18: mol_type = other DNA
taacaggactcaccatag

SEQ ID NO: 3669 - DNA, 18 bp, synthetic construct
  source 1..18: mol_type = other DNA
taataagactcatgatag

SEQ ID NO: 3670 - DNA, 18 bp, synthetic construct
  source 1..18: mol_type = other DNA
taataagcctcactgtag

SEQ ID NO: 3671 - DNA, 18 bp, synthetic construct
  source 1..18: mol_type = other DNA
taataaggctcaccatag

SEQ ID NO: 3672 - DNA, 18 bp, synthetic construct
  source 1..18: mol_type = other DNA
taatacgacgcactttgg

SEQ ID NO: 3673 - DNA, 18 bp, synthetic construct
  source 1..18: mol_type = other DNA
taatacgactcggtatcg

SEQ ID NO: 3674 - DNA, 18 bp, synthetic construct
  source 1..18: mol_type = other DNA
taatacgcctgacgatag

SEQ ID NO: 3675 - DNA, 18 bp, synthetic construct
  source 1..18: mol_type = other DNA
taatacggatcagtatag

SEQ ID NO: 3676 - DNA, 18 bp, synthetic construct
  source 1..18: mol_type = other DNA
taatacggcacactatcg

SEQ ID NO: 3677 - DNA, 18 bp, synthetic construct
  source 1..18: mol_type = other DNA
taatagaactcaatatag

SEQ ID NO: 3678 - DNA, 18 bp, synthetic construct
  source 1..18: mol_type = other DNA
taataggactcaatatgg

SEQ ID NO: 3679 - DNA, 18 bp, synthetic construct
  source 1..18: mol_type = other DNA
taataggcctcacgatag

SEQ ID NO: 3680 - DNA, 18 bp, synthetic construct
  source 1..18: mol_type = other DNA
taatatgactcacgattg

SEQ ID NO: 3681 - DNA, 18 bp, synthetic construct
  source 1..18: mol_type = other DNA
taatccgcctcaatatag

SEQ ID NO: 3682 - DNA, 18 bp, synthetic construct
  source 1..18: mol_type = other DNA
taatgcgactgcctatag

SEQ ID NO: 3683 - DNA, 18 bp, synthetic construct
  source 1..18: mol_type = other DNA
taatgcgtctcagtatag

SEQ ID NO: 3684 - DNA, 18 bp, synthetic construct
  source 1..18: mol_type = other DNA
taatgggactcactgtag

SEQ ID NO: 3685 - DNA, 18 bp, synthetic construct
  source 1..18: mol_type = other DNA
taattgggctcactatag

SEQ ID NO: 3686 - DNA, 18 bp, synthetic construct
  source 1..18: mol_type = other DNA
tagtacgactcactgtcg

SEQ ID NO: 3687 - DNA, 18 bp, synthetic construct
  source 1..18: mol_type = other DNA
tattacgacccactatcg

SEQ ID NO: 3688 - DNA, 18 bp, synthetic construct
  source 1..18: mol_type = other DNA
tcatacgactcaacatag

SEQ ID NO: 3689 - DNA, 18 bp, synthetic construct
  source 1..18: mol_type = other DNA
tgctacgactcaatatag

SEQ ID NO: 3690 - DNA, 18 bp, synthetic construct
  source 1..18: mol_type = other DNA
aaataggacgcactatag

SEQ ID NO: 3691 - DNA, 18 bp, synthetic construct
  source 1..18: mol_type = other DNA
aactacggctcactatag

SEQ ID NO: 3692 - DNA, 18 bp, synthetic construct
  source 1..18: mol_type = other DNA
caatacgactcgcgatag

SEQ ID NO: 3693 - DNA, 18 bp, synthetic construct
  source 1..18: mol_type = other DNA
caatacgatccactatag

SEQ ID NO: 3694 - DNA, 18 bp, synthetic construct
  source 1..18: mol_type = other DNA
caatagcactcactatag

SEQ ID NO: 3695 - DNA, 18 bp, synthetic construct
  source 1..18: mol_type = other DNA
gaatacgactcacactag

SEQ ID NO: 3696 - DNA, 18 bp, synthetic construct
  source 1..18: mol_type = other DNA
gaatacgtgtcactatag

SEQ ID NO: 3697 - DNA, 18 bp, synthetic construct
  source 1..18: mol_type = other DNA
gaatgccactcactatag

SEQ ID NO: 3698 - DNA, 18 bp, synthetic construct
  source 1..18: mol_type = other DNA
taacacgacgcactatcg

SEQ ID NO: 3699 - DNA, 18 bp, synthetic construct
  source 1..18: mol_type = other DNA
taacacgactcgccatag

SEQ ID NO: 3700 - DNA, 18 bp, synthetic construct
  source 1..18: mol_type = other DNA
taacacgactcgcgatag

SEQ ID NO: 3701 - DNA, 18 bp, synthetic construct
  source 1..18: mol_type = other DNA
taacgcgactcaccatag

SEQ ID NO: 3702 - DNA, 18 bp, synthetic construct
  source 1..18: mol_type = other DNA
taacgcgactctctatag

SEQ ID NO: 3703 - DNA, 18 bp, synthetic construct
  source 1..18: mol_type = other DNA
taaggcgactcactgtag

SEQ ID NO: 3704 - DNA, 18 bp, synthetic construct
  source 1..18: mol_type = other DNA
taataagactctctataa

SEQ ID NO: 3705 - DNA, 18 bp, synthetic construct
  source 1..18: mol_type = other DNA
taataaggctcactacag

SEQ ID NO: 3706 - DNA, 18 bp, synthetic construct
  source 1..18: mol_type = other DNA
taatacaactgactagag

SEQ ID NO: 3707 - DNA, 18 bp, synthetic construct
  source 1..18: mol_type = other DNA
taatacgaatgcctatag

SEQ ID NO: 3708 - DNA, 18 bp, synthetic construct
  source 1..18: mol_type = other DNA
taatacgaccaactgtag

SEQ ID NO: 3709 - DNA, 18 bp, synthetic construct
  source 1..18: mol_type = other DNA
taatacgacccagtagag

SEQ ID NO: 3710 - DNA, 18 bp, synthetic construct
  source 1..18: mol_type = other DNA
taatacgactcacaaaac

SEQ ID NO: 3711 - DNA, 18 bp, synthetic construct
  source 1..18: mol_type = other DNA
taatacgactcactaaca

SEQ ID NO: 3712 - DNA, 18 bp, synthetic construct
  source 1..18: mol_type = other DNA
taatacgactcactgggg

SEQ ID NO: 3713 - DNA, 18 bp, synthetic construct
  source 1..18: mol_type = other DNA
taatacgactcacttaac

SEQ ID NO: 3714 - DNA, 18 bp, synthetic construct
  source 1..18: mol_type = other DNA
taatacgactcagagtag

SEQ ID NO: 3715 - DNA, 18 bp, synthetic construct
  source 1..18: mol_type = other DNA
taatacgactcatgatcg

SEQ ID NO: 3716 - DNA, 18 bp, synthetic construct
  source 1..18: mol_type = other DNA
taatacgactccttgtag

SEQ ID NO: 3717 - DNA, 18 bp, synthetic construct
  source 1..18: mol_type = other DNA
taatacgactcgttctag

SEQ ID NO: 3718 - DNA, 18 bp, synthetic construct
  source 1..18: mol_type = other DNA
taatacgactgagtattg

SEQ ID NO: 3719 - DNA, 18 bp, synthetic construct
  source 1..18: mol_type = other DNA
taatacgagtccctatcg

SEQ ID NO: 3720 - DNA, 18 bp, synthetic construct
  source 1..18: mol_type = other DNA
taatacgagtccctgtag

SEQ ID NO: 3721 - DNA, 18 bp, synthetic construct
  source 1..18: mol_type = other DNA
taatacgagtgaatatag

SEQ ID NO: 3722 - DNA, 18 bp, synthetic construct
  source 1..18: mol_type = other DNA
taatacgattcacgagag

SEQ ID NO: 3723 - DNA, 18 bp, synthetic construct
  source 1..18: mol_type = other DNA
taatacgattctcgatag

SEQ ID NO: 3724 - DNA, 18 bp, synthetic construct
  source 1..18: mol_type = other DNA
taatacgcctaaccatag

SEQ ID NO: 3725 - DNA, 18 bp, synthetic construct
  source 1..18: mol_type = other DNA
taatacgcctcgctctag

SEQ ID NO: 3726 - DNA, 18 bp, synthetic construct
  source 1..18: mol_type = other DNA
taatacgcgtcactttag

SEQ ID NO: 3727 - DNA, 18 bp, synthetic construct
  source 1..18: mol_type = other DNA
taatacggatcactacag

SEQ ID NO: 3728 - DNA, 18 bp, synthetic construct
  source 1..18: mol_type = other DNA
taatacggctcactaccg

SEQ ID NO: 3729 - DNA, 18 bp, synthetic construct
  source 1..18: mol_type = other DNA
taatacgtctcactttaa

SEQ ID NO: 3730 - DNA, 18 bp, synthetic construct
  source 1..18: mol_type = other DNA
taatagggctcaccatag

SEQ ID NO: 3731 - DNA, 18 bp, synthetic construct
  source 1..18: mol_type = other DNA
taatatggctcactatcg

SEQ ID NO: 3732 - DNA, 18 bp, synthetic construct
  source 1..18: mol_type = other DNA
taatcggactcaccatag

SEQ ID NO: 3733 - DNA, 18 bp, synthetic construct
  source 1..18: mol_type = other DNA
taatgcgcctccctatag

SEQ ID NO: 3734 - DNA, 18 bp, synthetic construct
  source 1..18: mol_type = other DNA
taatgggactcaccatag

SEQ ID NO: 3735 - DNA, 18 bp, synthetic construct
  source 1..18: mol_type = other DNA
taattagactcactataa

SEQ ID NO: 3736 - DNA, 18 bp, synthetic construct
  source 1..18: mol_type = other DNA
taattcgactcactgtac

SEQ ID NO: 3737 - DNA, 18 bp, synthetic construct
  source 1..18: mol_type = other DNA
taatttgacgcactatag

SEQ ID NO: 3738 - DNA, 18 bp, synthetic construct
  source 1..18: mol_type = other DNA
tactacgacacactatcg

SEQ ID NO: 3739 - DNA, 18 bp, synthetic construct
  source 1..18: mol_type = other DNA
tagcacgactcactacag

SEQ ID NO: 3740 - DNA, 18 bp, synthetic construct
  source 1..18: mol_type = other DNA
tagtacgactcatgatag

SEQ ID NO: 3741 - DNA, 18 bp, synthetic construct
  source 1..18: mol_type = other DNA
tagtacgagtcaccatag

SEQ ID NO: 3742 - DNA, 18 bp, synthetic construct
  source 1..18: mol_type = other DNA
tattacaacgcactatag

SEQ ID NO: 3743 - DNA, 18 bp, synthetic construct
  source 1..18: mol_type = other DNA
tattacgacttactataa

SEQ ID NO: 3744 - DNA, 18 bp, synthetic construct
  source 1..18: mol_type = other DNA
tattacgaggcactatag

SEQ ID NO: 3745 - DNA, 18 bp, synthetic construct
  source 1..18: mol_type = other DNA
tcagaccactcactatag

SEQ ID NO: 3746 - DNA, 18 bp, synthetic construct
  source 1..18: mol_type = other DNA
tcatacgactcgccatag

SEQ ID NO: 3747 - DNA, 18 bp, synthetic construct
  source 1..18: mol_type = other DNA
tcatacggcacactatag

SEQ ID NO: 3748 - DNA, 18 bp, synthetic construct
  source 1..18: mol_type = other DNA
tcatacggctcactagag

SEQ ID NO: 3749 - DNA, 18 bp, synthetic construct
  source 1..18: mol_type = other DNA
tcatacggctcactatcg

SEQ ID NO: 3750 - DNA, 18 bp, synthetic construct
  source 1..18: mol_type = other DNA
tcatatgactcactagag

SEQ ID NO: 3751 - DNA, 18 bp, synthetic construct
  source 1..18: mol_type = other DNA
tgataagcctcactatag

SEQ ID NO: 3752 - DNA, 18 bp, synthetic construct
  source 1..18: mol_type = other DNA
tgatacgactcaccatgg

SEQ ID NO: 3753 - DNA, 18 bp, synthetic construct
  source 1..18: mol_type = other DNA
tgatacgcctaactatag

SEQ ID NO: 3754 - DNA, 18 bp, synthetic construct
  source 1..18: mol_type = other DNA
tgattcgactccctatag

SEQ ID NO: 3755 - DNA, 18 bp, synthetic construct
  source 1..18: mol_type = other DNA
ttatacgactcactaaaa

SEQ ID NO: 3756 - DNA, 18 bp, synthetic construct
  source 1..18: mol_type = other DNA
ttatacgactcactttat

SEQ ID NO: 3757 - DNA, 18 bp, synthetic construct
  source 1..18: mol_type = other DNA
taatacgactcacattgg

SEQ ID NO: 3758 - DNA, 18 bp, synthetic construct
  source 1..18: mol_type = other DNA
taataagactctctaaag

SEQ ID NO: 3759 - DNA, 18 bp, synthetic construct
  source 1..18: mol_type = other DNA
taatagcactcactttag

SEQ ID NO: 3760 - DNA, 18 bp, synthetic construct
  source 1..18: mol_type = other DNA
taatacgtctccctatgg

SEQ ID NO: 3761 - DNA, 18 bp, synthetic construct
  source 1..18: mol_type = other DNA
taatacgtctcgatatag

SEQ ID NO: 3762 - DNA, 18 bp, synthetic construct
  source 1..18: mol_type = other DNA
taattccactcaccatag

SEQ ID NO: 3763 - DNA, 18 bp, synthetic construct
  source 1..18: mol_type = other DNA
gtatacgactcactttag

SEQ ID NO: 3764 - DNA, 18 bp, synthetic construct
  source 1..18: mol_type = other DNA
aaataagacccactatag

SEQ ID NO: 3765 - DNA, 18 bp, synthetic construct
  source 1..18: mol_type = other DNA
aaatacgactcactaacg

SEQ ID NO: 3766 - DNA, 18 bp, synthetic construct
  source 1..18: mol_type = other DNA
gtatacgcctcactatag

SEQ ID NO: 3767 - DNA, 18 bp, synthetic construct
  source 1..18: mol_type = other DNA
taatccgccacactatag

SEQ ID NO: 3768 - DNA, 18 bp, synthetic construct
  source 1..18: mol_type = other DNA
taataagtctcactacag

SEQ ID NO: 3769 - DNA, 18 bp, synthetic construct
  source 1..18: mol_type = other DNA
atatacaactcactatag

SEQ ID NO: 3770 - DNA, 18 bp, synthetic construct
  source 1..18: mol_type = other DNA
taatacgtctcaccattg

SEQ ID NO: 3771 - DNA, 18 bp, synthetic construct
  source 1..18: mol_type = other DNA
taatataactcacaatag

SEQ ID NO: 3772 - DNA, 18 bp, synthetic construct
  source 1..18: mol_type = other DNA
tattacaactcactagag

SEQ ID NO: 3773 - DNA, 18 bp, synthetic construct
  source 1..18: mol_type = other DNA
ttttaagactcactatag

SEQ ID NO: 3774 - DNA, 18 bp, synthetic construct
  source 1..18: mol_type = other DNA
taaaacgactcactagtg

SEQ ID NO: 3775 - DNA, 18 bp, synthetic construct
  source 1..18: mol_type = other DNA
taatacgtctcgccatag

SEQ ID NO: 3776 - DNA, 18 bp, synthetic construct
  source 1..18: mol_type = other DNA
taaaccggctcactatag

SEQ ID NO: 3777 - DNA, 18 bp, synthetic construct
  source 1..18: mol_type = other DNA
taacaggattcactatag

SEQ ID NO: 3778 - DNA, 18 bp, synthetic construct
  source 1..18: mol_type = other DNA
taagccgactcactttag

SEQ ID NO: 3779 - DNA, 18 bp, synthetic construct
  source 1..18: mol_type = other DNA
taatacaacgcaatatag

SEQ ID NO: 3780 - DNA, 18 bp, synthetic construct
  source 1..18: mol_type = other DNA
taatacgaattactgtag

SEQ ID NO: 3781 - DNA, 18 bp, synthetic construct
  source 1..18: mol_type = other DNA
taatacgagtcactttcg

SEQ ID NO: 3782 - DNA, 18 bp, synthetic construct
  source 1..18: mol_type = other DNA
taatactactaagtatag

SEQ ID NO: 3783 - DNA, 18 bp, synthetic construct
  source 1..18: mol_type = other DNA
taatctgactcactacag

SEQ ID NO: 3784 - DNA, 18 bp, synthetic construct
  source 1..18: mol_type = other DNA
taatgcgactaattatag

SEQ ID NO: 3785 - DNA, 18 bp, synthetic construct
  source 1..18: mol_type = other DNA
tagtgcgactcactttag

SEQ ID NO: 3786 - DNA, 18 bp, synthetic construct
  source 1..18: mol_type = other DNA
tcattcgacccactatag

SEQ ID NO: 3787 - DNA, 18 bp, synthetic construct
  source 1..18: mol_type = other DNA
tgatccgattcactatag

SEQ ID NO: 3788 - DNA, 18 bp, synthetic construct
  source 1..18: mol_type = other DNA
tgattcgactcactgtag

SEQ ID NO: 3789 - DNA, 18 bp, synthetic construct
  source 1..18: mol_type = other DNA
tagtacgtctcactattg

SEQ ID NO: 3790 - DNA, 18 bp, synthetic construct
  source 1..18: mol_type = other DNA
taatatatctcactatag

SEQ ID NO: 3791 - DNA, 18 bp, synthetic construct
  source 1..18: mol_type = other DNA
taatacgattcgctattg

SEQ ID NO: 3792 - DNA, 18 bp, synthetic construct
  source 1..18: mol_type = other DNA
tattatgactcactacag

SEQ ID NO: 3793 - DNA, 18 bp, synthetic construct
  source 1..18: mol_type = other DNA
tgattcgtctcactatag

SEQ ID NO: 3794 - DNA, 18 bp, synthetic construct
  source 1..18: mol_type = other DNA
taaaacgaatccctatag

SEQ ID NO: 3795 - DNA, 18 bp, synthetic construct
  source 1..18: mol_type = other DNA
ttatacgcctcactatcg

SEQ ID NO: 3796 - DNA, 18 bp, synthetic construct
  source 1..18: mol_type = other DNA
taaaccgactcactacag

SEQ ID NO: 3797 - DNA, 18 bp, synthetic construct
  source 1..18: mol_type = other DNA
taaagcgactcacaatag

SEQ ID NO: 3798 - DNA, 18 bp, synthetic construct
  source 1..18: mol_type = other DNA
tactacaactcactattg

SEQ ID NO: 3799 - DNA, 18 bp, synthetic construct
  source 1..18: mol_type = other DNA
ttatacgactcactttcg

SEQ ID NO: 3800 - DNA, 18 bp, synthetic construct
  source 1..18: mol_type = other DNA
taaatcggctcactatag

SEQ ID NO: 3801 - DNA, 18 bp, synthetic construct
  source 1..18: mol_type = other DNA
taatacgccacattatag

SEQ ID NO: 3802 - DNA, 18 bp, synthetic construct
  source 1..18: mol_type = other DNA
aaatccgactcactctag

SEQ ID NO: 3803 - DNA, 18 bp, synthetic construct
  source 1..18: mol_type = other DNA
ttatacgactcacactag

SEQ ID NO: 3804 - DNA, 18 bp, synthetic construct
  source 1..18: mol_type = other DNA
gtatacgactcactattg

SEQ ID NO: 3805 - DNA, 18 bp, synthetic construct
  source 1..18: mol_type = other DNA
taacacgactcgctaaag

SEQ ID NO: 3806 - DNA, 18 bp, synthetic construct
  source 1..18: mol_type = other DNA
taattcgactcggtatag

SEQ ID NO: 3807 - DNA, 18 bp, synthetic construct
  source 1..18: mol_type = other DNA
ttataggactcactagag

SEQ ID NO: 3808 - DNA, 18 bp, synthetic construct
  source 1..18: mol_type = other DNA
aaagtcgactcactatag

SEQ ID NO: 3809 - DNA, 18 bp, synthetic construct
  source 1..18: mol_type = other DNA
caataacactcactatag

SEQ ID NO: 3810 - DNA, 18 bp, synthetic construct
  source 1..18: mol_type = other DNA
caatgcgactcgctatag

SEQ ID NO: 3811 - DNA, 18 bp, synthetic construct
  source 1..18: mol_type = other DNA
gaatacgacacactaaag

SEQ ID NO: 3812 - DNA, 18 bp, synthetic construct
  source 1..18: mol_type = other DNA
taacacgactccctaaag

SEQ ID NO: 3813 - DNA, 18 bp, synthetic construct
  source 1..18: mol_type = other DNA
taacccggctcactatag

SEQ ID NO: 3814 - DNA, 18 bp, synthetic construct
  source 1..18: mol_type = other DNA
taagacgactcactaagg

SEQ ID NO: 3815 - DNA, 18 bp, synthetic construct
  source 1..18: mol_type = other DNA
taataagagccactatag

SEQ ID NO: 3816 - DNA, 18 bp, synthetic construct
  source 1..18: mol_type = other DNA
taataccactaactgtag

SEQ ID NO: 3817 - DNA, 18 bp, synthetic construct
  source 1..18: mol_type = other DNA
taataccactcaccgtag

SEQ ID NO: 3818 - DNA, 18 bp, synthetic construct
  source 1..18: mol_type = other DNA
taatacgactcaacgtag

SEQ ID NO: 3819 - DNA, 18 bp, synthetic construct
  source 1..18: mol_type = other DNA
taatacgactcaccaggg

SEQ ID NO: 3820 - DNA, 18 bp, synthetic construct
  source 1..18: mol_type = other DNA
taataggaataactatag

SEQ ID NO: 3821 - DNA, 18 bp, synthetic construct
  source 1..18: mol_type = other DNA
taataggactcaccatcg

SEQ ID NO: 3822 - DNA, 18 bp, synthetic construct
  source 1..18: mol_type = other DNA
taatccgcctcaccatag

SEQ ID NO: 3823 - DNA, 18 bp, synthetic construct
  source 1..18: mol_type = other DNA
taattcgactcacgctag

SEQ ID NO: 3824 - DNA, 18 bp, synthetic construct
  source 1..18: mol_type = other DNA
tactacgcctcactatgg

SEQ ID NO: 3825 - DNA, 18 bp, synthetic construct
  source 1..18: mol_type = other DNA
tagtaagactcactacag

SEQ ID NO: 3826 - DNA, 18 bp, synthetic construct
  source 1..18: mol_type = other DNA
tgatacgactcacgaaag

SEQ ID NO: 3827 - DNA, 18 bp, synthetic construct
  source 1..18: mol_type = other DNA
tgatacgtctcacgatag

SEQ ID NO: 3828 - DNA, 18 bp, synthetic construct
  source 1..18: mol_type = other DNA
tgatgctactcactatag

SEQ ID NO: 3829 - DNA, 18 bp, synthetic construct
  source 1..18: mol_type = other DNA
ttatacgagtcactagag

SEQ ID NO: 3830 - DNA, 18 bp, synthetic construct
  source 1..18: mol_type = other DNA
aaaaacgactcactaaag

SEQ ID NO: 3831 - DNA, 18 bp, synthetic construct
  source 1..18: mol_type = other DNA
aaatacaactcactttag

SEQ ID NO: 3832 - DNA, 18 bp, synthetic construct
  source 1..18: mol_type = other DNA
aaatgcgactcacaatag

SEQ ID NO: 3833 - DNA, 18 bp, synthetic construct
  source 1..18: mol_type = other DNA
tctaacgactcactatag

SEQ ID NO: 3834 - DNA, 18 bp, synthetic construct
  source 1..18: mol_type = other DNA
aaatataactcactatag

SEQ ID NO: 3835 - DNA, 18 bp, synthetic construct
  source 1..18: mol_type = other DNA
caatacaactcacaatag

SEQ ID NO: 3836 - DNA, 18 bp, synthetic construct
  source 1..18: mol_type = other DNA
taatacgtcttaccatag

SEQ ID NO: 3837 - DNA, 18 bp, synthetic construct
  source 1..18: mol_type = other DNA
taattcgtctcaatatag

SEQ ID NO: 3838 - DNA, 18 bp, synthetic construct
  source 1..18: mol_type = other DNA
aaatacgactcactaagg

SEQ ID NO: 3839 - DNA, 18 bp, synthetic construct
  source 1..18: mol_type = other DNA
taatacgtttcactaaag

SEQ ID NO: 3840 - DNA, 18 bp, synthetic construct
  source 1..18: mol_type = other DNA
taatccgactcactaacg

SEQ ID NO: 3841 - DNA, 18 bp, synthetic construct
  source 1..18: mol_type = other DNA
taaaacggatcactatag

SEQ ID NO: 3842 - DNA, 18 bp, synthetic construct
  source 1..18: mol_type = other DNA
taaaaggacgcactatag

SEQ ID NO: 3843 - DNA, 18 bp, synthetic construct
  source 1..18: mol_type = other DNA
taatacgacgcactaatg

SEQ ID NO: 3844 - DNA, 18 bp, synthetic construct
  source 1..18: mol_type = other DNA
taatacgactagctctag

SEQ ID NO: 3845 - DNA, 18 bp, synthetic construct
  source 1..18: mol_type = other DNA
taatacgactgtctatgg

SEQ ID NO: 3846 - DNA, 18 bp, synthetic construct
  source 1..18: mol_type = other DNA
taatacgtctcactccag

SEQ ID NO: 3847 - DNA, 18 bp, synthetic construct
  source 1..18: mol_type = other DNA
taatactactcactcgag

SEQ ID NO: 3848 - DNA, 18 bp, synthetic construct
  source 1..18: mol_type = other DNA
taatatgactcgttatag

SEQ ID NO: 3849 - DNA, 18 bp, synthetic construct
  source 1..18: mol_type = other DNA
taatccgactcactcttg

SEQ ID NO: 3850 - DNA, 18 bp, synthetic construct
  source 1..18: mol_type = other DNA
taatccgactcgccatag

SEQ ID NO: 3851 - DNA, 18 bp, synthetic construct
  source 1..18: mol_type = other DNA
taatttgactcactatcg

SEQ ID NO: 3852 - DNA, 18 bp, synthetic construct
  source 1..18: mol_type = other DNA
tagtgcgaatcactatag

SEQ ID NO: 3853 - DNA, 18 bp, synthetic construct
  source 1..18: mol_type = other DNA
tgatacgactaactctag

SEQ ID NO: 3854 - DNA, 18 bp, synthetic construct
  source 1..18: mol_type = other DNA
taaaaggactcactattg

SEQ ID NO: 3855 - DNA, 18 bp, synthetic construct
  source 1..18: mol_type = other DNA
taattagcctcactatag

SEQ ID NO: 3856 - DNA, 18 bp, synthetic construct
  source 1..18: mol_type = other DNA
caatatgcctcactatag

SEQ ID NO: 3857 - DNA, 18 bp, synthetic construct
  source 1..18: mol_type = other DNA
taatacgacacgctgtag

SEQ ID NO: 3858 - DNA, 18 bp, synthetic construct
  source 1..18: mol_type = other DNA
taatccgcctcactattg

SEQ ID NO: 3859 - DNA, 18 bp, synthetic construct
  source 1..18: mol_type = other DNA
tgatacgacacattatag

SEQ ID NO: 3860 - DNA, 18 bp, synthetic construct
  source 1..18: mol_type = other DNA
atatacgactcactatcg

SEQ ID NO: 3861 - DNA, 18 bp, synthetic construct
  source 1..18: mol_type = other DNA
taataaaactcactttag

SEQ ID NO: 3862 - DNA, 18 bp, synthetic construct
  source 1..18: mol_type = other DNA
aattacgactcactaaag

SEQ ID NO: 3863 - DNA, 18 bp, synthetic construct
  source 1..18: mol_type = other DNA
taaagcgcctcactatag

SEQ ID NO: 3864 - DNA, 18 bp, synthetic construct
  source 1..18: mol_type = other DNA
tagtacaactcactaaag

SEQ ID NO: 3865 - DNA, 18 bp, synthetic construct
  source 1..18: mol_type = other DNA
tgatatgactcactttag

SEQ ID NO: 3866 - DNA, 18 bp, synthetic construct
  source 1..18: mol_type = other DNA
tattgcgactcacaatag

SEQ ID NO: 3867 - DNA, 18 bp, synthetic construct
  source 1..18: mol_type = other DNA
caatacgactcactactg

SEQ ID NO: 3868 - DNA, 18 bp, synthetic construct
  source 1..18: mol_type = other DNA
taatatgtgtcactatag

SEQ ID NO: 3869 - DNA, 18 bp, synthetic construct
  source 1..18: mol_type = other DNA
taaaacgactctctaaag

SEQ ID NO: 3870 - DNA, 18 bp, synthetic construct
  source 1..18: mol_type = other DNA
atatacgactcactacag

SEQ ID NO: 3871 - DNA, 18 bp, synthetic construct
  source 1..18: mol_type = other DNA
tataacaactcactatag

SEQ ID NO: 3872 - DNA, 18 bp, synthetic construct
  source 1..18: mol_type = other DNA
ttattcgactcaccatag

SEQ ID NO: 3873 - DNA, 18 bp, synthetic construct
  source 1..18: mol_type = other DNA
ttatacgactcacaattg

SEQ ID NO: 3874 - DNA, 18 bp, synthetic construct
  source 1..18: mol_type = other DNA
ttatatgactcactattg

SEQ ID NO: 3875 - DNA, 18 bp, synthetic construct
  source 1..18: mol_type = other DNA
atttacgactcactatag

SEQ ID NO: 3876 - DNA, 18 bp, synthetic construct
  source 1..18: mol_type = other DNA
taatacgtctctctatcg

SEQ ID NO: 3877 - DNA, 18 bp, synthetic construct
  source 1..18: mol_type = other DNA
taaaccgactcattatag

SEQ ID NO: 3878 - DNA, 18 bp, synthetic construct
  source 1..18: mol_type = other DNA
aagtacaactcactatag

SEQ ID NO: 3879 - DNA, 18 bp, synthetic construct
  source 1..18: mol_type = other DNA
taataagactctctctag

SEQ ID NO: 3880 - DNA, 18 bp, synthetic construct
  source 1..18: mol_type = other DNA
taatacgacctactaaag

SEQ ID NO: 3881 - DNA, 18 bp, synthetic construct
  source 1..18: mol_type = other DNA
taatacgactcaatcttg

SEQ ID NO: 3882 - DNA, 18 bp, synthetic construct
  source 1..18: mol_type = other DNA
taatacgactcgcaatgg

SEQ ID NO: 3883 - DNA, 18 bp, synthetic construct
  source 1..18: mol_type = other DNA
taatacgcctcactaacg

SEQ ID NO: 3884 - DNA, 18 bp, synthetic construct
  source 1..18: mol_type = other DNA
aaatccgactcgctatag

SEQ ID NO: 3885 - DNA, 18 bp, synthetic construct
  source 1..18: mol_type = other DNA
caacactactcactatag

SEQ ID NO: 3886 - DNA, 18 bp, synthetic construct
  source 1..18: mol_type = other DNA
caatgcgactctctatag

SEQ ID NO: 3887 - DNA, 18 bp, synthetic construct
  source 1..18: mol_type = other DNA
cattacgacccactatag

SEQ ID NO: 3888 - DNA, 18 bp, synthetic construct
  source 1..18: mol_type = other DNA
taatacaactcattatcg

SEQ ID NO: 3889 - DNA, 18 bp, synthetic construct
  source 1..18: mol_type = other DNA
taatacagctcaccatag

SEQ ID NO: 3890 - DNA, 18 bp, synthetic construct
  source 1..18: mol_type = other DNA
taatacgccacgctatag

SEQ ID NO: 3891 - DNA, 18 bp, synthetic construct
  source 1..18: mol_type = other DNA
taattcgacccattatag

SEQ ID NO: 3892 - DNA, 18 bp, synthetic construct
  source 1..18: mol_type = other DNA
tcatacgactcacaacag

SEQ ID NO: 3893 - DNA, 18 bp, synthetic construct
  source 1..18: mol_type = other DNA
ttatacgcgtcactatag

SEQ ID NO: 3894 - DNA, 18 bp, synthetic construct
  source 1..18: mol_type = other DNA
caatacgaatcaccatag

SEQ ID NO: 3895 - DNA, 18 bp, synthetic construct
  source 1..18: mol_type = other DNA
caatacgactcaccatcg

SEQ ID NO: 3896 - DNA, 18 bp, synthetic construct
  source 1..18: mol_type = other DNA
gattacgactcacaatag

SEQ ID NO: 3897 - DNA, 18 bp, synthetic construct
  source 1..18: mol_type = other DNA
taagaagattcactatag

SEQ ID NO: 3898 - DNA, 18 bp, synthetic construct
  source 1..18: mol_type = other DNA
taaggcgactcactatgg

SEQ ID NO: 3899 - DNA, 18 bp, synthetic construct
  source 1..18: mol_type = other DNA
taatacccatcactatag

SEQ ID NO: 3900 - DNA, 18 bp, synthetic construct
  source 1..18: mol_type = other DNA
taatacgacccgctattg

SEQ ID NO: 3901 - DNA, 18 bp, synthetic construct
  source 1..18: mol_type = other DNA
taatacgacggattatag

SEQ ID NO: 3902 - DNA, 18 bp, synthetic construct
  source 1..18: mol_type = other DNA
taatacgcatcaatatag

SEQ ID NO: 3903 - DNA, 18 bp, synthetic construct
  source 1..18: mol_type = other DNA
taattccactcgctatag

SEQ ID NO: 3904 - DNA, 18 bp, synthetic construct
  source 1..18: mol_type = other DNA
tacttcgactcgctatag

SEQ ID NO: 3905 - DNA, 18 bp, synthetic construct
  source 1..18: mol_type = other DNA
tgataagacacactatag

SEQ ID NO: 3906 - DNA, 18 bp, synthetic construct
  source 1..18: mol_type = other DNA
tgttacgactcacgatag

SEQ ID NO: 3907 - DNA, 18 bp, synthetic construct
  source 1..18: mol_type = other DNA
ttctacgactcactacag

SEQ ID NO: 3908 - DNA, 18 bp, synthetic construct
  source 1..18: mol_type = other DNA
aaatacgactcagtatgg

SEQ ID NO: 3909 - DNA, 18 bp, synthetic construct
  source 1..18: mol_type = other DNA
aaatacgactcgctacag

SEQ ID NO: 3910 - DNA, 18 bp, synthetic construct
  source 1..18: mol_type = other DNA
aaatactcctcactatag

SEQ ID NO: 3911 - DNA, 18 bp, synthetic construct
  source 1..18: mol_type = other DNA
acatacgactcactctag

SEQ ID NO: 3912 - DNA, 18 bp, synthetic construct
  source 1..18: mol_type = other DNA
caatacgagttactatag

SEQ ID NO: 3913 - DNA, 18 bp, synthetic construct
  source 1..18: mol_type = other DNA
caatgcgactcacaatag

SEQ ID NO: 3914 - DNA, 18 bp, synthetic construct
  source 1..18: mol_type = other DNA
taaaacgacgcactagag

SEQ ID NO: 3915 - DNA, 18 bp, synthetic construct
  source 1..18: mol_type = other DNA
taacacgactgactaaag

SEQ ID NO: 3916 - DNA, 18 bp, synthetic construct
  source 1..18: mol_type = other DNA
taagacgacgcactattg

SEQ ID NO: 3917 - DNA, 18 bp, synthetic construct
  source 1..18: mol_type = other DNA
taataagactcgctacag

SEQ ID NO: 3918 - DNA, 18 bp, synthetic construct
  source 1..18: mol_type = other DNA
taataccactcacttgag

SEQ ID NO: 3919 - DNA, 18 bp, synthetic construct
  source 1..18: mol_type = other DNA
taatacgaaggactatag

SEQ ID NO: 3920 - DNA, 18 bp, synthetic construct
  source 1..18: mol_type = other DNA
taatacgacgaagtatag

SEQ ID NO: 3921 - DNA, 18 bp, synthetic construct
  source 1..18: mol_type = other DNA
taatacgcctcactgttg

SEQ ID NO: 3922 - DNA, 18 bp, synthetic construct
  source 1..18: mol_type = other DNA
taatacggctcgctaaag

SEQ ID NO: 3923 - DNA, 18 bp, synthetic construct
  source 1..18: mol_type = other DNA
taatacgtgtcgctatag

SEQ ID NO: 3924 - DNA, 18 bp, synthetic construct
  source 1..18: mol_type = other DNA
taatagcactcactacag

SEQ ID NO: 3925 - DNA, 18 bp, synthetic construct
  source 1..18: mol_type = other DNA
taataggtctcgctatag

SEQ ID NO: 3926 - DNA, 18 bp, synthetic construct
  source 1..18: mol_type = other DNA
taatatgactaactatcg

SEQ ID NO: 3927 - DNA, 18 bp, synthetic construct
  source 1..18: mol_type = other DNA
taatatggctcgctatag

SEQ ID NO: 3928 - DNA, 18 bp, synthetic construct
  source 1..18: mol_type = other DNA
taatccgactcagtatgg

SEQ ID NO: 3929 - DNA, 18 bp, synthetic construct
  source 1..18: mol_type = other DNA
taatccgcctcacgatag

SEQ ID NO: 3930 - DNA, 18 bp, synthetic construct
  source 1..18: mol_type = other DNA
taattcgactcactggag

SEQ ID NO: 3931 - DNA, 18 bp, synthetic construct
  source 1..18: mol_type = other DNA
taattcgactgagtatag

SEQ ID NO: 3932 - DNA, 18 bp, synthetic construct
  source 1..18: mol_type = other DNA
tactaagactcgctatag

SEQ ID NO: 3933 - DNA, 18 bp, synthetic construct
  source 1..18: mol_type = other DNA
tagaacggctcactatag

SEQ ID NO: 3934 - DNA, 18 bp, synthetic construct
  source 1..18: mol_type = other DNA
tagtacgactcactgttg

SEQ ID NO: 3935 - DNA, 18 bp, synthetic construct
  source 1..18: mol_type = other DNA
tagtacgactccctttag

SEQ ID NO: 3936 - DNA, 18 bp, synthetic construct
  source 1..18: mol_type = other DNA
tagtactactcactacag

SEQ ID NO: 3937 - DNA, 18 bp, synthetic construct
  source 1..18: mol_type = other DNA
tattacgacgcactaaag

SEQ ID NO: 3938 - DNA, 18 bp, synthetic construct
  source 1..18: mol_type = other DNA
tgaaacgactcactatcg

SEQ ID NO: 3939 - DNA, 18 bp, synthetic construct
  source 1..18: mol_type = other DNA
tgatccgactgactatag

SEQ ID NO: 3940 - DNA, 18 bp, synthetic construct
  source 1..18: mol_type = other DNA
aagtacgactgactatag

SEQ ID NO: 3941 - DNA, 18 bp, synthetic construct
  source 1..18: mol_type = other DNA
agatacgactcactagag

SEQ ID NO: 3942 - DNA, 18 bp, synthetic construct
  source 1..18: mol_type = other DNA
caataagactcactatgg

SEQ ID NO: 3943 - DNA, 18 bp, synthetic construct
  source 1..18: mol_type = other DNA
caatacgactcgccatag

SEQ ID NO: 3944 - DNA, 18 bp, synthetic construct
  source 1..18: mol_type = other DNA
caatacggctcaatatag

SEQ ID NO: 3945 - DNA, 18 bp, synthetic construct
  source 1..18: mol_type = other DNA
caatacggctccctatag

SEQ ID NO: 3946 - DNA, 18 bp, synthetic construct
  source 1..18: mol_type = other DNA
gaatacgacttactttag

SEQ ID NO: 3947 - DNA, 18 bp, synthetic construct
  source 1..18: mol_type = other DNA
gaataggactcattatag

SEQ ID NO: 3948 - DNA, 18 bp, synthetic construct
  source 1..18: mol_type = other DNA
gattacgacccactatag

SEQ ID NO: 3949 - DNA, 18 bp, synthetic construct
  source 1..18: mol_type = other DNA
gcatacggctcactatag

SEQ ID NO: 3950 - DNA, 18 bp, synthetic construct
  source 1..18: mol_type = other DNA
gtatacgactcactagag

SEQ ID NO: 3951 - DNA, 18 bp, synthetic construct
  source 1..18: mol_type = other DNA
taaaacgactcactgtac

SEQ ID NO: 3952 - DNA, 18 bp, synthetic construct
  source 1..18: mol_type = other DNA
taaacggactcactatag

SEQ ID NO: 3953 - DNA, 18 bp, synthetic construct
  source 1..18: mol_type = other DNA
taacaccacccactatag

SEQ ID NO: 3954 - DNA, 18 bp, synthetic construct
  source 1..18: mol_type = other DNA
taacagcactcactatag

SEQ ID NO: 3955 - DNA, 18 bp, synthetic construct
  source 1..18: mol_type = other DNA
taagacgaatcactatcg

SEQ ID NO: 3956 - DNA, 18 bp, synthetic construct
  source 1..18: mol_type = other DNA
taagacgacttactgtag

SEQ ID NO: 3957 - DNA, 18 bp, synthetic construct
  source 1..18: mol_type = other DNA
taagacgattcactacag

SEQ ID NO: 3958 - DNA, 18 bp, synthetic construct
  source 1..18: mol_type = other DNA
taataaaactcactatgg

SEQ ID NO: 3959 - DNA, 18 bp, synthetic construct
  source 1..18: mol_type = other DNA
taataagactcactttat

SEQ ID NO: 3960 - DNA, 18 bp, synthetic construct
  source 1..18: mol_type = other DNA
taataagagtaactatag

SEQ ID NO: 3961 - DNA, 18 bp, synthetic construct
  source 1..18: mol_type = other DNA
taataaggctcactctag

SEQ ID NO: 3962 - DNA, 18 bp, synthetic construct
  source 1..18: mol_type = other DNA
taatacaagtccctatag

SEQ ID NO: 3963 - DNA, 18 bp, synthetic construct
  source 1..18: mol_type = other DNA
taataccacgccctatag

SEQ ID NO: 3964 - DNA, 18 bp, synthetic construct
  source 1..18: mol_type = other DNA
taataccactgactgtag

SEQ ID NO: 3965 - DNA, 18 bp, synthetic construct
  source 1..18: mol_type = other DNA
taataccgctccctatag

SEQ ID NO: 3966 - DNA, 18 bp, synthetic construct
  source 1..18: mol_type = other DNA
taatacgaatcgctgtag

SEQ ID NO: 3967 - DNA, 18 bp, synthetic construct
  source 1..18: mol_type = other DNA
taatacgacacactgtac

SEQ ID NO: 3968 - DNA, 18 bp, synthetic construct
  source 1..18: mol_type = other DNA
taatacgacccactagcg

SEQ ID NO: 3969 - DNA, 18 bp, synthetic construct
  source 1..18: mol_type = other DNA
taatacgacccgatatag

SEQ ID NO: 3970 - DNA, 18 bp, synthetic construct
  source 1..18: mol_type = other DNA
taatacgactcactctta

SEQ ID NO: 3971 - DNA, 18 bp, synthetic construct
  source 1..18: mol_type = other DNA
taatacgactcactgtta

SEQ ID NO: 3972 - DNA, 18 bp, synthetic construct
  source 1..18: mol_type = other DNA
taatacgactcattatct

SEQ ID NO: 3973 - DNA, 18 bp, synthetic construct
  source 1..18: mol_type = other DNA
taatacgactccgtctag

SEQ ID NO: 3974 - DNA, 18 bp, synthetic construct
  source 1..18: mol_type = other DNA
taatacgagtgtctatag

SEQ ID NO: 3975 - DNA, 18 bp, synthetic construct
  source 1..18: mol_type = other DNA
taatacgattaagtatag

SEQ ID NO: 3976 - DNA, 18 bp, synthetic construct
  source 1..18: mol_type = other DNA
taatacgccccactagag

SEQ ID NO: 3977 - DNA, 18 bp, synthetic construct
  source 1..18: mol_type = other DNA
taatacggccgactatag

SEQ ID NO: 3978 - DNA, 18 bp, synthetic construct
  source 1..18: mol_type = other DNA
taatacggctcagaatag

SEQ ID NO: 3979 - DNA, 18 bp, synthetic construct
  source 1..18: mol_type = other DNA
taatacgtctcactatcc

SEQ ID NO: 3980 - DNA, 18 bp, synthetic construct
  source 1..18: mol_type = other DNA
taatactacccactagag

SEQ ID NO: 3981 - DNA, 18 bp, synthetic construct
  source 1..18: mol_type = other DNA
taataggactcactgtgg

SEQ ID NO: 3982 - DNA, 18 bp, synthetic construct
  source 1..18: mol_type = other DNA
taatatgacccactaaag

SEQ ID NO: 3983 - DNA, 18 bp, synthetic construct
  source 1..18: mol_type = other DNA
taatatgactctctataa

SEQ ID NO: 3984 - DNA, 18 bp, synthetic construct
  source 1..18: mol_type = other DNA
taatatggctcactagag

SEQ ID NO: 3985 - DNA, 18 bp, synthetic construct
  source 1..18: mol_type = other DNA
taatcggactgactatag

SEQ ID NO: 3986 - DNA, 18 bp, synthetic construct
  source 1..18: mol_type = other DNA
taatctgactcactgtag

SEQ ID NO: 3987 - DNA, 18 bp, synthetic construct
  source 1..18: mol_type = other DNA
taatgagacgcactatag

SEQ ID NO: 3988 - DNA, 18 bp, synthetic construct
  source 1..18: mol_type = other DNA
taatgcaacgcactatag

SEQ ID NO: 3989 - DNA, 18 bp, synthetic construct
  source 1..18: mol_type = other DNA
taatgccagtcactatag

SEQ ID NO: 3990 - DNA, 18 bp, synthetic construct
  source 1..18: mol_type = other DNA
taatgggactccctatag

SEQ ID NO: 3991 - DNA, 18 bp, synthetic construct
  source 1..18: mol_type = other DNA
taattcaactcactataa

SEQ ID NO: 3992 - DNA, 18 bp, synthetic construct
  source 1..18: mol_type = other DNA
taattccagtcactatag

SEQ ID NO: 3993 - DNA, 18 bp, synthetic construct
  source 1..18: mol_type = other DNA
taattcgactcattataa

SEQ ID NO: 3994 - DNA, 18 bp, synthetic construct
  source 1..18: mol_type = other DNA
tacgacgactcactattg

SEQ ID NO: 3995 - DNA, 18 bp, synthetic construct
  source 1..18: mol_type = other DNA
tactacgacgcactattg

SEQ ID NO: 3996 - DNA, 18 bp, synthetic construct
  source 1..18: mol_type = other DNA
tactacgactcaccacag

SEQ ID NO: 3997 - DNA, 18 bp, synthetic construct
  source 1..18: mol_type = other DNA
tactacgactcaccatcg

SEQ ID NO: 3998 - DNA, 18 bp, synthetic construct
  source 1..18: mol_type = other DNA
tactacgatgcactatag

SEQ ID NO: 3999 - DNA, 18 bp, synthetic construct
  source 1..18: mol_type = other DNA
taggacgactgactatag

SEQ ID NO: 4000 - DNA, 18 bp, synthetic construct
  source 1..18: mol_type = other DNA
tagtacgactcactttaa

SEQ ID NO: 4001 - DNA, 18 bp, synthetic construct
  source 1..18: mol_type = other DNA
tagtacgactcaggatag

SEQ ID NO: 4002 - DNA, 18 bp, synthetic construct
  source 1..18: mol_type = other DNA
tagtacgactcgttatag

SEQ ID NO: 4003 - DNA, 18 bp, synthetic construct
  source 1..18: mol_type = other DNA
tagtacgcctcgctatag

SEQ ID NO: 4004 - DNA, 18 bp, synthetic construct
  source 1..18: mol_type = other DNA
tagtgcgactcgctatag

SEQ ID NO: 4005 - DNA, 18 bp, synthetic construct
  source 1..18: mol_type = other DNA
tatgacgactcagtatag

SEQ ID NO: 4006 - DNA, 18 bp, synthetic construct
  source 1..18: mol_type = other DNA
tattacgactcaagatag

SEQ ID NO: 4007 - DNA, 18 bp, synthetic construct
  source 1..18: mol_type = other DNA
tattccgactgactatag

SEQ ID NO: 4008 - DNA, 18 bp, synthetic construct
  source 1..18: mol_type = other DNA
tcataagacccactatag

SEQ ID NO: 4009 - DNA, 18 bp, synthetic construct
  source 1..18: mol_type = other DNA
tcatacgacgcactctag

SEQ ID NO: 4010 - DNA, 18 bp, synthetic construct
  source 1..18: mol_type = other DNA
tcatacgactcactgtgg

SEQ ID NO: 4011 - DNA, 18 bp, synthetic construct
  source 1..18: mol_type = other DNA
tcatacgagtcgctatag

SEQ ID NO: 4012 - DNA, 18 bp, synthetic construct
  source 1..18: mol_type = other DNA
tcatccgactcactgtag

SEQ ID NO: 4013 - DNA, 18 bp, synthetic construct
  source 1..18: mol_type = other DNA
tcattcgactcacgatag

SEQ ID NO: 4014 - DNA, 18 bp, synthetic construct
  source 1..18: mol_type = other DNA
tgagacgactcaccatag

SEQ ID NO: 4015 - DNA, 18 bp, synthetic construct
  source 1..18: mol_type = other DNA
tgatacgacgcaccatag

SEQ ID NO: 4016 - DNA, 18 bp, synthetic construct
  source 1..18: mol_type = other DNA
tgatacgactcagaatag

SEQ ID NO: 4017 - DNA, 18 bp, synthetic construct
  source 1..18: mol_type = other DNA
tgataggacccactatag

SEQ ID NO: 4018 - DNA, 18 bp, synthetic construct
  source 1..18: mol_type = other DNA
tgatccgagtcactatag

SEQ ID NO: 4019 - DNA, 18 bp, synthetic construct
  source 1..18: mol_type = other DNA
tgatgcgactcaccatag

SEQ ID NO: 4020 - DNA, 18 bp, synthetic construct
  source 1..18: mol_type = other DNA
tggtgcgactcactatag

SEQ ID NO: 4021 - DNA, 18 bp, synthetic construct
  source 1..18: mol_type = other DNA
ttataagactcactataa

SEQ ID NO: 4022 - DNA, 18 bp, synthetic construct
  source 1..18: mol_type = other DNA
ttaaacgactcactaaag

SEQ ID NO: 4023 - DNA, 18 bp, synthetic construct
  source 1..18: mol_type = other DNA
taatacggcacactattg

SEQ ID NO: 4024 - DNA, 18 bp, synthetic construct
  source 1..18: mol_type = other DNA
taattcgactcaccaaag

SEQ ID NO: 4025 - DNA, 18 bp, synthetic construct
  source 1..18: mol_type = other DNA
tgaaacgactcactattg

SEQ ID NO: 4026 - DNA, 18 bp, synthetic construct
  source 1..18: mol_type = other DNA
ttaaacgactcactatgg

SEQ ID NO: 4027 - DNA, 18 bp, synthetic construct
  source 1..18: mol_type = other DNA
ttatatgactcactacag

SEQ ID NO: 4028 - DNA, 18 bp, synthetic construct
  source 1..18: mol_type = other DNA
taattcaactcactgtag

SEQ ID NO: 4029 - DNA, 18 bp, synthetic construct
  source 1..18: mol_type = other DNA
tgatgcgactcacaatag

SEQ ID NO: 4030 - DNA, 18 bp, synthetic construct
  source 1..18: mol_type = other DNA
tattacgactcagtttag

SEQ ID NO: 4031 - DNA, 18 bp, synthetic construct
  source 1..18: mol_type = other DNA
tcatccgactcactttag

SEQ ID NO: 4032 - DNA, 18 bp, synthetic construct
  source 1..18: mol_type = other DNA
ttttacgactcaatatag

SEQ ID NO: 4033 - DNA, 18 bp, synthetic construct
  source 1..18: mol_type = other DNA
taatacgtctcacttaag

SEQ ID NO: 4034 - DNA, 18 bp, synthetic construct
  source 1..18: mol_type = other DNA
taatccaactcactattg

SEQ ID NO: 4035 - DNA, 18 bp, synthetic construct
  source 1..18: mol_type = other DNA
taatttgagtcactatag

SEQ ID NO: 4036 - DNA, 18 bp, synthetic construct
  source 1..18: mol_type = other DNA
tcttacgactcactatcg

SEQ ID NO: 4037 - DNA, 18 bp, synthetic construct
  source 1..18: mol_type = other DNA
ttatacgactcgctatgg

SEQ ID NO: 4038 - DNA, 18 bp, synthetic construct
  source 1..18: mol_type = other DNA
tcatacgtctcactattg

SEQ ID NO: 4039 - DNA, 18 bp, synthetic construct
  source 1..18: mol_type = other DNA
taatcagactcactctag

SEQ ID NO: 4040 - DNA, 18 bp, synthetic construct
  source 1..18: mol_type = other DNA
tattacgcctgactatag

SEQ ID NO: 4041 - DNA, 18 bp, synthetic construct
  source 1..18: mol_type = other DNA
taaaacgactcactaatg

SEQ ID NO: 4042 - DNA, 18 bp, synthetic construct
  source 1..18: mol_type = other DNA
ttattcgactcactattg

SEQ ID NO: 4043 - DNA, 18 bp, synthetic construct
  source 1..18: mol_type = other DNA
tcatacgactcactaatg

SEQ ID NO: 4044 - DNA, 18 bp, synthetic construct
  source 1..18: mol_type = other DNA
tatttcgactcactattg

SEQ ID NO: 4045 - DNA, 18 bp, synthetic construct
  source 1..18: mol_type = other DNA
taatacgactcgatacag

SEQ ID NO: 4046 - DNA, 18 bp, synthetic construct
  source 1..18: mol_type = other DNA
aaatacgcctcactacag

SEQ ID NO: 4047 - DNA, 18 bp, synthetic construct
  source 1..18: mol_type = other DNA
taaaacgactccctgtag

SEQ ID NO: 4048 - DNA, 18 bp, synthetic construct
  source 1..18: mol_type = other DNA
taatacgaccccctaaag

SEQ ID NO: 4049 - DNA, 18 bp, synthetic construct
  source 1..18: mol_type = other DNA
taatactagtcactctag

SEQ ID NO: 4050 - DNA, 18 bp, synthetic construct
  source 1..18: mol_type = other DNA
tactacgactcaatatcg

SEQ ID NO: 4051 - DNA, 18 bp, synthetic construct
  source 1..18: mol_type = other DNA
tagtacaaatcactatag

SEQ ID NO: 4052 - DNA, 18 bp, synthetic construct
  source 1..18: mol_type = other DNA
tattacgcctcacgatag

SEQ ID NO: 4053 - DNA, 18 bp, synthetic construct
  source 1..18: mol_type = other DNA
tgatacgacccactattg

SEQ ID NO: 4054 - DNA, 18 bp, synthetic construct
  source 1..18: mol_type = other DNA
taatacgccttactaaag

SEQ ID NO: 4055 - DNA, 18 bp, synthetic construct
  source 1..18: mol_type = other DNA
taattagacccactatag

SEQ ID NO: 4056 - DNA, 18 bp, synthetic construct
  source 1..18: mol_type = other DNA
taatttgcctcactatag

SEQ ID NO: 4057 - DNA, 18 bp, synthetic construct
  source 1..18: mol_type = other DNA
ttatccgtctcactatag

SEQ ID NO: 4058 - DNA, 18 bp, synthetic construct
  source 1..18: mol_type = other DNA
taaaacgactcgctttag

SEQ ID NO: 4059 - DNA, 18 bp, synthetic construct
  source 1..18: mol_type = other DNA
aaatacaactcactacag

SEQ ID NO: 4060 - DNA, 18 bp, synthetic construct
  source 1..18: mol_type = other DNA
taattcgcctcaatatag

SEQ ID NO: 4061 - DNA, 18 bp, synthetic construct
  source 1..18: mol_type = other DNA
tcattcgactcactacag

SEQ ID NO: 4062 - DNA, 18 bp, synthetic construct
  source 1..18: mol_type = other DNA
ttttacgacgcactatag

SEQ ID NO: 4063 - DNA, 18 bp, synthetic construct
  source 1..18: mol_type = other DNA
taacacgactcacttttg

SEQ ID NO: 4064 - DNA, 18 bp, synthetic construct
  source 1..18: mol_type = other DNA
aaattcggctcactatag

SEQ ID NO: 4065 - DNA, 18 bp, synthetic construct
  source 1..18: mol_type = other DNA
ttaaacaactcactatag

SEQ ID NO: 4066 - DNA, 18 bp, synthetic construct
  source 1..18: mol_type = other DNA
taaaacgactcagtttag

SEQ ID NO: 4067 - DNA, 18 bp, synthetic construct
  source 1..18: mol_type = other DNA
taatgcgtctcactgtag

SEQ ID NO: 4068 - DNA, 18 bp, synthetic construct
  source 1..18: mol_type = other DNA
tactacgtctcaccatag

SEQ ID NO: 4069 - DNA, 18 bp, synthetic construct
  source 1..18: mol_type = other DNA
gaattcgactcactttag

SEQ ID NO: 4070 - DNA, 18 bp, synthetic construct
  source 1..18: mol_type = other DNA
taaaacgacccattatag

SEQ ID NO: 4071 - DNA, 18 bp, synthetic construct
  source 1..18: mol_type = other DNA
taatacgacgcaccattg

SEQ ID NO: 4072 - DNA, 18 bp, synthetic construct
  source 1..18: mol_type = other DNA
taatccaactcagtatag

SEQ ID NO: 4073 - DNA, 18 bp, synthetic construct
  source 1..18: mol_type = other DNA
taattcgactcagtattg

SEQ ID NO: 4074 - DNA, 18 bp, synthetic construct
  source 1..18: mol_type = other DNA
aaatacgactcgctagag

SEQ ID NO: 4075 - DNA, 18 bp, synthetic construct
  source 1..18: mol_type = other DNA
aagtacgactcagtatag

SEQ ID NO: 4076 - DNA, 18 bp, synthetic construct
  source 1..18: mol_type = other DNA
gaatacaactcactattg

SEQ ID NO: 4077 - DNA, 18 bp, synthetic construct
  source 1..18: mol_type = other DNA
gaatacgcctcactaaag

SEQ ID NO: 4078 - DNA, 18 bp, synthetic construct
  source 1..18: mol_type = other DNA
taaaacgactcaccagag

SEQ ID NO: 4079 - DNA, 18 bp, synthetic construct
  source 1..18: mol_type = other DNA
taacacgactcattacag

SEQ ID NO: 4080 - DNA, 18 bp, synthetic construct
  source 1..18: mol_type = other DNA
taataaaagtcactatag

SEQ ID NO: 4081 - DNA, 18 bp, synthetic construct
  source 1..18: mol_type = other DNA
taatacaactcactcgag

SEQ ID NO: 4082 - DNA, 18 bp, synthetic construct
  source 1..18: mol_type = other DNA
taataccacccactctag

SEQ ID NO: 4083 - DNA, 18 bp, synthetic construct
  source 1..18: mol_type = other DNA
taatacctctcactctag

SEQ ID NO: 4084 - DNA, 18 bp, synthetic construct
  source 1..18: mol_type = other DNA
taatacgaatcaggatag

SEQ ID NO: 4085 - DNA, 18 bp, synthetic construct
  source 1..18: mol_type = other DNA
taatacgaatcgctatgg

SEQ ID NO: 4086 - DNA, 18 bp, synthetic construct
  source 1..18: mol_type = other DNA
taatacgaatcgctctag

SEQ ID NO: 4087 - DNA, 18 bp, synthetic construct
  source 1..18: mol_type = other DNA
taatacgaatgagtatag

SEQ ID NO: 4088 - DNA, 18 bp, synthetic construct
  source 1..18: mol_type = other DNA
taatacgacgcaatattg

SEQ ID NO: 4089 - DNA, 18 bp, synthetic construct
  source 1..18: mol_type = other DNA
taatacgactatcgatag

SEQ ID NO: 4090 - DNA, 18 bp, synthetic construct
  source 1..18: mol_type = other DNA
taatacgccgcactaaag

SEQ ID NO: 4091 - DNA, 18 bp, synthetic construct
  source 1..18: mol_type = other DNA
taatccgagtcaatatag

SEQ ID NO: 4092 - DNA, 18 bp, synthetic construct
  source 1..18: mol_type = other DNA
taattggactccctatag

SEQ ID NO: 4093 - DNA, 18 bp, synthetic construct
  source 1..18: mol_type = other DNA
tacgacaactcactatag

SEQ ID NO: 4094 - DNA, 18 bp, synthetic construct
  source 1..18: mol_type = other DNA
tactacgccacactatag

SEQ ID NO: 4095 - DNA, 18 bp, synthetic construct
  source 1..18: mol_type = other DNA
tactatgactcactatgg

SEQ ID NO: 4096 - DNA, 18 bp, synthetic construct
  source 1..18: mol_type = other DNA
tattacgactcacgatcg

SEQ ID NO: 4097 - DNA, 18 bp, synthetic construct
  source 1..18: mol_type = other DNA
tattccgactcactatcg

SEQ ID NO: 4098 - DNA, 18 bp, synthetic construct
  source 1..18: mol_type = other DNA
tcataagactcactctag

SEQ ID NO: 4099 - DNA, 18 bp, synthetic construct
  source 1..18: mol_type = other DNA
tcatatgactgactatag

SEQ ID NO: 4100 - DNA, 18 bp, synthetic construct
  source 1..18: mol_type = other DNA
tgataggactcactacag

SEQ ID NO: 4101 - DNA, 18 bp, synthetic construct
  source 1..18: mol_type = other DNA
ttatacgactccctacag

SEQ ID NO: 4102 - DNA, 18 bp, synthetic construct
  source 1..18: mol_type = other DNA
taaaacgacacaccatag

SEQ ID NO: 4103 - DNA, 18 bp, synthetic construct
  source 1..18: mol_type = other DNA
tattacgacttactattg

SEQ ID NO: 4104 - DNA, 18 bp, synthetic construct
  source 1..18: mol_type = other DNA
ttatacgactcactaacg

SEQ ID NO: 4105 - DNA, 18 bp, synthetic construct
  source 1..18: mol_type = other DNA
taatacgactcactacct

SEQ ID NO: 4106 - DNA, 18 bp, synthetic construct
  source 1..18: mol_type = other DNA
tattatgcctcactatag

SEQ ID NO: 4107 - DNA, 18 bp, synthetic construct
  source 1..18: mol_type = other DNA
tgttatgactcactatag

SEQ ID NO: 4108 - DNA, 18 bp, synthetic construct
  source 1..18: mol_type = other DNA
agatacgactcactattg

SEQ ID NO: 4109 - DNA, 18 bp, synthetic construct
  source 1..18: mol_type = other DNA
tattccgtctcactatag

SEQ ID NO: 4110 - DNA, 18 bp, synthetic construct
  source 1..18: mol_type = other DNA
aaatacgactaactatgg

SEQ ID NO: 4111 - DNA, 18 bp, synthetic construct
  source 1..18: mol_type = other DNA
taatacgactcaatttcg

SEQ ID NO: 4112 - DNA, 18 bp, synthetic construct
  source 1..18: mol_type = other DNA
taatacgactcattaagg

SEQ ID NO: 4113 - DNA, 18 bp, synthetic construct
  source 1..18: mol_type = other DNA
taatccgattcattatag

SEQ ID NO: 4114 - DNA, 18 bp, synthetic construct
  source 1..18: mol_type = other DNA
taatgcgactaactttag

SEQ ID NO: 4115 - DNA, 18 bp, synthetic construct
  source 1..18: mol_type = other DNA
tacttcgactcactatcg

SEQ ID NO: 4116 - DNA, 18 bp, synthetic construct
  source 1..18: mol_type = other DNA
taaaacgtctcactattg

SEQ ID NO: 4117 - DNA, 18 bp, synthetic construct
  source 1..18: mol_type = other DNA
aaatacgcctcactctag

SEQ ID NO: 4118 - DNA, 18 bp, synthetic construct
  source 1..18: mol_type = other DNA
taaaaagactgactatag

SEQ ID NO: 4119 - DNA, 18 bp, synthetic construct
  source 1..18: mol_type = other DNA
taatacaactccctgtag

SEQ ID NO: 4120 - DNA, 18 bp, synthetic construct
  source 1..18: mol_type = other DNA
taatacgattcgccatag

SEQ ID NO: 4121 - DNA, 18 bp, synthetic construct
  source 1..18: mol_type = other DNA
taatacgattgactattg

SEQ ID NO: 4122 - DNA, 18 bp, synthetic construct
  source 1..18: mol_type = other DNA
taatacgcctcacactag

SEQ ID NO: 4123 - DNA, 18 bp, synthetic construct
  source 1..18: mol_type = other DNA
taatacgcctcactttcg

SEQ ID NO: 4124 - DNA, 18 bp, synthetic construct
  source 1..18: mol_type = other DNA
taatacgccttaccatag

SEQ ID NO: 4125 - DNA, 18 bp, synthetic construct
  source 1..18: mol_type = other DNA
taatacggctcaccatgg

SEQ ID NO: 4126 - DNA, 18 bp, synthetic construct
  source 1..18: mol_type = other DNA
taataggactcacttgag

SEQ ID NO: 4127 - DNA, 18 bp, synthetic construct
  source 1..18: mol_type = other DNA
taatgcgtctgactatag

SEQ ID NO: 4128 - DNA, 18 bp, synthetic construct
  source 1..18: mol_type = other DNA
taattcgactccccatag

SEQ ID NO: 4129 - DNA, 18 bp, synthetic construct
  source 1..18: mol_type = other DNA
tattacgaatgactatag

SEQ ID NO: 4130 - DNA, 18 bp, synthetic construct
  source 1..18: mol_type = other DNA
tattacgactcccgatag

SEQ ID NO: 4131 - DNA, 18 bp, synthetic construct
  source 1..18: mol_type = other DNA
tcatacgactcattatcg

SEQ ID NO: 4132 - DNA, 18 bp, synthetic construct
  source 1..18: mol_type = other DNA
tgatacgactagctatag

SEQ ID NO: 4133 - DNA, 18 bp, synthetic construct
  source 1..18: mol_type = other DNA
ttacacgcctcactatag

SEQ ID NO: 4134 - DNA, 18 bp, synthetic construct
  source 1..18: mol_type = other DNA
taatccgactcactgttg

SEQ ID NO: 4135 - DNA, 18 bp, synthetic construct
  source 1..18: mol_type = other DNA
gattacgactcactatgg

SEQ ID NO: 4136 - DNA, 18 bp, synthetic construct
  source 1..18: mol_type = other DNA
taataagactagctatag

SEQ ID NO: 4137 - DNA, 18 bp, synthetic construct
  source 1..18: mol_type = other DNA
tgatacgactaaccatag

SEQ ID NO: 4138 - DNA, 18 bp, synthetic construct
  source 1..18: mol_type = other DNA
ttatccgcctcactatag

SEQ ID NO: 4139 - DNA, 18 bp, synthetic construct
  source 1..18: mol_type = other DNA
aaatacaactcactaaag

SEQ ID NO: 4140 - DNA, 18 bp, synthetic construct
  source 1..18: mol_type = other DNA
tattacgacacgctatag

SEQ ID NO: 4141 - DNA, 18 bp, synthetic construct
  source 1..18: mol_type = other DNA
taataggtctcactattg

SEQ ID NO: 4142 - DNA, 18 bp, synthetic construct
  source 1..18: mol_type = other DNA
taatacgagttaatatag

SEQ ID NO: 4143 - DNA, 18 bp, synthetic construct
  source 1..18: mol_type = other DNA
taaagcgactaactatag

SEQ ID NO: 4144 - DNA, 18 bp, synthetic construct
  source 1..18: mol_type = other DNA
taataagcctcactttag

SEQ ID NO: 4145 - DNA, 18 bp, synthetic construct
  source 1..18: mol_type = other DNA
tattaggactctctatag

SEQ ID NO: 4146 - DNA, 18 bp, synthetic construct
  source 1..18: mol_type = other DNA
taaatagactcactatag

SEQ ID NO: 4147 - DNA, 18 bp, synthetic construct
  source 1..18: mol_type = other DNA
tattacgactcattatgg

SEQ ID NO: 4148 - DNA, 18 bp, synthetic construct
  source 1..18: mol_type = other DNA
ttataggactcacaatag

SEQ ID NO: 4149 - DNA, 18 bp, synthetic construct
  source 1..18: mol_type = other DNA
tattacaactcactaaag

SEQ ID NO: 4150 - DNA, 18 bp, synthetic construct
  source 1..18: mol_type = other DNA
taatacgactcaatcaag

SEQ ID NO: 4151 - DNA, 18 bp, synthetic construct
  source 1..18: mol_type = other DNA
taattcgaatcactatcg

SEQ ID NO: 4152 - DNA, 18 bp, synthetic construct
  source 1..18: mol_type = other DNA
aaatacgactcactcaag

SEQ ID NO: 4153 - DNA, 18 bp, synthetic construct
  source 1..18: mol_type = other DNA
tattccgactcactaaag

SEQ ID NO: 4154 - DNA, 18 bp, synthetic construct
  source 1..18: mol_type = other DNA
taattcgtgtcactatag

SEQ ID NO: 4155 - DNA, 18 bp, synthetic construct
  source 1..18: mol_type = other DNA
tatttcgactcacaatag

SEQ ID NO: 4156 - DNA, 18 bp, synthetic construct
  source 1..18: mol_type = other DNA
tacaacgactcaatatag

SEQ ID NO: 4157 - DNA, 18 bp, synthetic construct
  source 1..18: mol_type = other DNA
taataagactcaccacag

SEQ ID NO: 4158 - DNA, 18 bp, synthetic construct
  source 1..18: mol_type = other DNA
taatacggctcaccattg

SEQ ID NO: 4159 - DNA, 18 bp, synthetic construct
  source 1..18: mol_type = other DNA
tataacgactcactatgg

SEQ ID NO: 4160 - DNA, 18 bp, synthetic construct
  source 1..18: mol_type = other DNA
caaaacgactcaatatag

SEQ ID NO: 4161 - DNA, 18 bp, synthetic construct
  source 1..18: mol_type = other DNA
gaatacgactcactactg

SEQ ID NO: 4162 - DNA, 18 bp, synthetic construct
  source 1..18: mol_type = other DNA
taaaacgactccatatag

SEQ ID NO: 4163 - DNA, 18 bp, synthetic construct
  source 1..18: mol_type = other DNA
taataccactcgctattg

SEQ ID NO: 4164 - DNA, 18 bp, synthetic construct
  source 1..18: mol_type = other DNA
taataccgctcactttag

SEQ ID NO: 4165 - DNA, 18 bp, synthetic construct
  source 1..18: mol_type = other DNA
taatacgactcaatccag

SEQ ID NO: 4166 - DNA, 18 bp, synthetic construct
  source 1..18: mol_type = other DNA
taatacgactgattgtag

SEQ ID NO: 4167 - DNA, 18 bp, synthetic construct
  source 1..18: mol_type = other DNA
taatgcgaaacactatag

SEQ ID NO: 4168 - DNA, 18 bp, synthetic construct
  source 1..18: mol_type = other DNA
taatgcgactcaatatgg

SEQ ID NO: 4169 - DNA, 18 bp, synthetic construct
  source 1..18: mol_type = other DNA
taatgcgcctaactatag

SEQ ID NO: 4170 - DNA, 18 bp, synthetic construct
  source 1..18: mol_type = other DNA
tactccgactcactttag

SEQ ID NO: 4171 - DNA, 18 bp, synthetic construct
  source 1..18: mol_type = other DNA
tggtacgactcaccatag

SEQ ID NO: 4172 - DNA, 18 bp, synthetic construct
  source 1..18: mol_type = other DNA
taaaacgactcagtaaag

SEQ ID NO: 4173 - DNA, 18 bp, synthetic construct
  source 1..18: mol_type = other DNA
caatatgactcactacag

SEQ ID NO: 4174 - DNA, 18 bp, synthetic construct
  source 1..18: mol_type = other DNA
taacacgcctcacaatag

SEQ ID NO: 4175 - DNA, 18 bp, synthetic construct
  source 1..18: mol_type = other DNA
taatacgaatcattagag

SEQ ID NO: 4176 - DNA, 18 bp, synthetic construct
  source 1..18: mol_type = other DNA
taatacgactcaataacg

SEQ ID NO: 4177 - DNA, 18 bp, synthetic construct
  source 1..18: mol_type = other DNA
taattcgacttgctatag

SEQ ID NO: 4178 - DNA, 18 bp, synthetic construct
  source 1..18: mol_type = other DNA
tagtacaactcactatcg

SEQ ID NO: 4179 - DNA, 18 bp, synthetic construct
  source 1..18: mol_type = other DNA
tattacgactcattagag

SEQ ID NO: 4180 - DNA, 18 bp, synthetic construct
  source 1..18: mol_type = other DNA
caatatgactcacgatag

SEQ ID NO: 4181 - DNA, 18 bp, synthetic construct
  source 1..18: mol_type = other DNA
taaaacgactcacttgag

SEQ ID NO: 4182 - DNA, 18 bp, synthetic construct
  source 1..18: mol_type = other DNA
taacaagactcacgatag

SEQ ID NO: 4183 - DNA, 18 bp, synthetic construct
  source 1..18: mol_type = other DNA
taacacaactgactatag

SEQ ID NO: 4184 - DNA, 18 bp, synthetic construct
  source 1..18: mol_type = other DNA
taacatgacgcactatag

SEQ ID NO: 4185 - DNA, 18 bp, synthetic construct
  source 1..18: mol_type = other DNA
taagacgacaaactatag

SEQ ID NO: 4186 - DNA, 18 bp, synthetic construct
  source 1..18: mol_type = other DNA
taagacgacacaatatag

SEQ ID NO: 4187 - DNA, 18 bp, synthetic construct
  source 1..18: mol_type = other DNA
taagacgattctctatag

SEQ ID NO: 4188 - DNA, 18 bp, synthetic construct
  source 1..18: mol_type = other DNA
taatacaacgcactacag

SEQ ID NO: 4189 - DNA, 18 bp, synthetic construct
  source 1..18: mol_type = other DNA
taatacgactcgctgtgg

SEQ ID NO: 4190 - DNA, 18 bp, synthetic construct
  source 1..18: mol_type = other DNA
taatactactaactacag

SEQ ID NO: 4191 - DNA, 18 bp, synthetic construct
  source 1..18: mol_type = other DNA
taataggactcaccatgg

SEQ ID NO: 4192 - DNA, 18 bp, synthetic construct
  source 1..18: mol_type = other DNA
taataggcctaactatag

SEQ ID NO: 4193 - DNA, 18 bp, synthetic construct
  source 1..18: mol_type = other DNA
taatatggatcactatag

SEQ ID NO: 4194 - DNA, 18 bp, synthetic construct
  source 1..18: mol_type = other DNA
taatgcaactcactatgg

SEQ ID NO: 4195 - DNA, 18 bp, synthetic construct
  source 1..18: mol_type = other DNA
taatgccactcactaaag

SEQ ID NO: 4196 - DNA, 18 bp, synthetic construct
  source 1..18: mol_type = other DNA
taatgcgactcacttgag

SEQ ID NO: 4197 - DNA, 18 bp, synthetic construct
  source 1..18: mol_type = other DNA
tactccgaatcactatag

SEQ ID NO: 4198 - DNA, 18 bp, synthetic construct
  source 1..18: mol_type = other DNA
tattacgacccgctatag

SEQ ID NO: 4199 - DNA, 18 bp, synthetic construct
  source 1..18: mol_type = other DNA
tattccgacccactatag

SEQ ID NO: 4200 - DNA, 18 bp, synthetic construct
  source 1..18: mol_type = other DNA
tcaaacggctcactatag

SEQ ID NO: 4201 - DNA, 18 bp, synthetic construct
  source 1..18: mol_type = other DNA
tcatacgcctcactaaag

SEQ ID NO: 4202 - DNA, 18 bp, synthetic construct
  source 1..18: mol_type = other DNA
tcatacggctcattatag

SEQ ID NO: 4203 - DNA, 18 bp, synthetic construct
  source 1..18: mol_type = other DNA
tcataggactcgctatag

SEQ ID NO: 4204 - DNA, 18 bp, synthetic construct
  source 1..18: mol_type = other DNA
tcatccgactcactacag

SEQ ID NO: 4205 - DNA, 18 bp, synthetic construct
  source 1..18: mol_type = other DNA
tgatacacctcactatag

SEQ ID NO: 4206 - DNA, 18 bp, synthetic construct
  source 1..18: mol_type = other DNA
tgatacgacacactgtag

SEQ ID NO: 4207 - DNA, 18 bp, synthetic construct
  source 1..18: mol_type = other DNA
tgatacggctcattatag

SEQ ID NO: 4208 - DNA, 18 bp, synthetic construct
  source 1..18: mol_type = other DNA
tggtacaactcactatag

SEQ ID NO: 4209 - DNA, 18 bp, synthetic construct
  source 1..18: mol_type = other DNA
ttatacgcctccctatag

SEQ ID NO: 4210 - DNA, 18 bp, synthetic construct
  source 1..18: mol_type = other DNA
ttatccggctcactatag

SEQ ID NO: 4211 - DNA, 18 bp, synthetic construct
  source 1..18: mol_type = other DNA
aaacacgactccctatag

SEQ ID NO: 4212 - DNA, 18 bp, synthetic construct
  source 1..18: mol_type = other DNA
aaagaagactcactatag

SEQ ID NO: 4213 - DNA, 18 bp, synthetic construct
  source 1..18: mol_type = other DNA
aaagacgattcactatag

SEQ ID NO: 4214 - DNA, 18 bp, synthetic construct
  source 1..18: mol_type = other DNA
aaatacaacgcactatag

SEQ ID NO: 4215 - DNA, 18 bp, synthetic construct
  source 1..18: mol_type = other DNA
aaatatgacgcactatag

SEQ ID NO: 4216 - DNA, 18 bp, synthetic construct
  source 1..18: mol_type = other DNA
aattacgactcactataa

SEQ ID NO: 4217 - DNA, 18 bp, synthetic construct
  source 1..18: mol_type = other DNA
caagacggctcactatag

SEQ ID NO: 4218 - DNA, 18 bp, synthetic construct
  source 1..18: mol_type = other DNA
caataccactcactgtag

SEQ ID NO: 4219 - DNA, 18 bp, synthetic construct
  source 1..18: mol_type = other DNA
caatacgactcagtattg

SEQ ID NO: 4220 - DNA, 18 bp, synthetic construct
  source 1..18: mol_type = other DNA
caatacgagtcactatgg

SEQ ID NO: 4221 - DNA, 18 bp, synthetic construct
  source 1..18: mol_type = other DNA
cagtacgactcactatgg

SEQ ID NO: 4222 - DNA, 18 bp, synthetic construct
  source 1..18: mol_type = other DNA
ccataggactcactatag

SEQ ID NO: 4223 - DNA, 18 bp, synthetic construct
  source 1..18: mol_type = other DNA
cgatacgactcactatgg

SEQ ID NO: 4224 - DNA, 18 bp, synthetic construct
  source 1..18: mol_type = other DNA
gaatacggctcactattg

SEQ ID NO: 4225 - DNA, 18 bp, synthetic construct
  source 1..18: mol_type = other DNA
gaatgcgactcactattg

SEQ ID NO: 4226 - DNA, 18 bp, synthetic construct
  source 1..18: mol_type = other DNA
gaattcgattcactatag

SEQ ID NO: 4227 - DNA, 18 bp, synthetic construct
  source 1..18: mol_type = other DNA
gagtacgactcactaaag

SEQ ID NO: 4228 - DNA, 18 bp, synthetic construct
  source 1..18: mol_type = other DNA
gcatacgactcaatatag

SEQ ID NO: 4229 - DNA, 18 bp, synthetic construct
  source 1..18: mol_type = other DNA
taaaacgacgcactacag

SEQ ID NO: 4230 - DNA, 18 bp, synthetic construct
  source 1..18: mol_type = other DNA
taaaacgactcacgctag

SEQ ID NO: 4231 - DNA, 18 bp, synthetic construct
  source 1..18: mol_type = other DNA
taacacgactcaatgtag

SEQ ID NO: 4232 - DNA, 18 bp, synthetic construct
  source 1..18: mol_type = other DNA
taacacgcatcactatag

SEQ ID NO: 4233 - DNA, 18 bp, synthetic construct
  source 1..18: mol_type = other DNA
taagaggactcaatatag

SEQ ID NO: 4234 - DNA, 18 bp, synthetic construct
  source 1..18: mol_type = other DNA
taatacaactcactaggg

SEQ ID NO: 4235 - DNA, 18 bp, synthetic construct
  source 1..18: mol_type = other DNA
taataccactgcctatag

SEQ ID NO: 4236 - DNA, 18 bp, synthetic construct
  source 1..18: mol_type = other DNA
taatacccctcactgtag

SEQ ID NO: 4237 - DNA, 18 bp, synthetic construct
  source 1..18: mol_type = other DNA
taatacgaatcaccctag

SEQ ID NO: 4238 - DNA, 18 bp, synthetic construct
  source 1..18: mol_type = other DNA
taatacgaatgactatcg

SEQ ID NO: 4239 - DNA, 18 bp, synthetic construct
  source 1..18: mol_type = other DNA
taatacgaatgactctag

SEQ ID NO: 4240 - DNA, 18 bp, synthetic construct
  source 1..18: mol_type = other DNA
taatacgactaaccagag

SEQ ID NO: 4241 - DNA, 18 bp, synthetic construct
  source 1..18: mol_type = other DNA
taatacgactcagtacgg

SEQ ID NO: 4242 - DNA, 18 bp, synthetic construct
  source 1..18: mol_type = other DNA
taatacgactccgtttag

SEQ ID NO: 4243 - DNA, 18 bp, synthetic construct
  source 1..18: mol_type = other DNA
taatacgagtcactccag

SEQ ID NO: 4244 - DNA, 18 bp, synthetic construct
  source 1..18: mol_type = other DNA
taatacgattccctgtag

SEQ ID NO: 4245 - DNA, 18 bp, synthetic construct
  source 1..18: mol_type = other DNA
taatacgcctccttatag

SEQ ID NO: 4246 - DNA, 18 bp, synthetic construct
  source 1..18: mol_type = other DNA
taatacggctcgttatag

SEQ ID NO: 4247 - DNA, 18 bp, synthetic construct
  source 1..18: mol_type = other DNA
taatactagtcaccatag

SEQ ID NO: 4248 - DNA, 18 bp, synthetic construct
  source 1..18: mol_type = other DNA
taatagaactcactatgg

SEQ ID NO: 4249 - DNA, 18 bp, synthetic construct
  source 1..18: mol_type = other DNA
taataggactcacgttag

SEQ ID NO: 4250 - DNA, 18 bp, synthetic construct
  source 1..18: mol_type = other DNA
taataggagtcaatatag

SEQ ID NO: 4251 - DNA, 18 bp, synthetic construct
  source 1..18: mol_type = other DNA
taataggcctgactatag

SEQ ID NO: 4252 - DNA, 18 bp, synthetic construct
  source 1..18: mol_type = other DNA
taatagggctcacaatag

SEQ ID NO: 4253 - DNA, 18 bp, synthetic construct
  source 1..18: mol_type = other DNA
taatatgactcactagcg

SEQ ID NO: 4254 - DNA, 18 bp, synthetic construct
  source 1..18: mol_type = other DNA
taatccgaatcactagag

SEQ ID NO: 4255 - DNA, 18 bp, synthetic construct
  source 1..18: mol_type = other DNA
taatccgactaactacag

SEQ ID NO: 4256 - DNA, 18 bp, synthetic construct
  source 1..18: mol_type = other DNA
taatccggctcactatgg

SEQ ID NO: 4257 - DNA, 18 bp, synthetic construct
  source 1..18: mol_type = other DNA
taatccggctcactctag

SEQ ID NO: 4258 - DNA, 18 bp, synthetic construct
  source 1..18: mol_type = other DNA
taatcctacgcactatag

SEQ ID NO: 4259 - DNA, 18 bp, synthetic construct
  source 1..18: mol_type = other DNA
taatgcaaatcactatag

SEQ ID NO: 4260 - DNA, 18 bp, synthetic construct
  source 1..18: mol_type = other DNA
taatgcgactcaatacag

SEQ ID NO: 4261 - DNA, 18 bp, synthetic construct
  source 1..18: mol_type = other DNA
tacgacgactcgctatag

SEQ ID NO: 4262 - DNA, 18 bp, synthetic construct
  source 1..18: mol_type = other DNA
tactaagactcactacag

SEQ ID NO: 4263 - DNA, 18 bp, synthetic construct
  source 1..18: mol_type = other DNA
tactaagagtcactatag

SEQ ID NO: 4264 - DNA, 18 bp, synthetic construct
  source 1..18: mol_type = other DNA
tactacggcgcactatag

SEQ ID NO: 4265 - DNA, 18 bp, synthetic construct
  source 1..18: mol_type = other DNA
tactaggattcactatag

SEQ ID NO: 4266 - DNA, 18 bp, synthetic construct
  source 1..18: mol_type = other DNA
tactatgactcagtatag

SEQ ID NO: 4267 - DNA, 18 bp, synthetic construct
  source 1..18: mol_type = other DNA
tagtgccactcactatag

SEQ ID NO: 4268 - DNA, 18 bp, synthetic construct
  source 1..18: mol_type = other DNA
tagtgcgacttactatag

SEQ ID NO: 4269 - DNA, 18 bp, synthetic construct
  source 1..18: mol_type = other DNA
tattacgactcactaaaa

SEQ ID NO: 4270 - DNA, 18 bp, synthetic construct
  source 1..18: mol_type = other DNA
tattacgactcagtagag

SEQ ID NO: 4271 - DNA, 18 bp, synthetic construct
  source 1..18: mol_type = other DNA
tcataccactccctatag

SEQ ID NO: 4272 - DNA, 18 bp, synthetic construct
  source 1..18: mol_type = other DNA
tcatacgacccagtatag

SEQ ID NO: 4273 - DNA, 18 bp, synthetic construct
  source 1..18: mol_type = other DNA
tcatacgacgtactatag

SEQ ID NO: 4274 - DNA, 18 bp, synthetic construct
  source 1..18: mol_type = other DNA
tcattcggctcactatag

SEQ ID NO: 4275 - DNA, 18 bp, synthetic construct
  source 1..18: mol_type = other DNA
tcctacgactcgctatag

SEQ ID NO: 4276 - DNA, 18 bp, synthetic construct
  source 1..18: mol_type = other DNA
taattcgactcactaatg

SEQ ID NO: 4277 - DNA, 18 bp, synthetic construct
  source 1..18: mol_type = other DNA
taatacgactcacaaagg

SEQ ID NO: 4278 - DNA, 18 bp, synthetic construct
  source 1..18: mol_type = other DNA
taaaacgactcactaagg

SEQ ID NO: 4279 - DNA, 18 bp, synthetic construct
  source 1..18: mol_type = other DNA
taatacgtctcactttgg

SEQ ID NO: 4280 - DNA, 18 bp, synthetic construct
  source 1..18: mol_type = other DNA
taatgcgtctcaatatag

SEQ ID NO: 4281 - DNA, 18 bp, synthetic construct
  source 1..18: mol_type = other DNA
tagtacgacttaccatag

SEQ ID NO: 4282 - DNA, 18 bp, synthetic construct
  source 1..18: mol_type = other DNA
taatacgactcacaccag

SEQ ID NO: 4283 - DNA, 18 bp, synthetic construct
  source 1..18: mol_type = other DNA
taaaatgactcactaaag

SEQ ID NO: 4284 - DNA, 18 bp, synthetic construct
  source 1..18: mol_type = other DNA
ttaaccgactcactatag

SEQ ID NO: 4285 - DNA, 18 bp, synthetic construct
  source 1..18: mol_type = other DNA
taataccacacaccatag

SEQ ID NO: 4286 - DNA, 18 bp, synthetic construct
  source 1..18: mol_type = other DNA
taataggtctcactatcg

SEQ ID NO: 4287 - DNA, 18 bp, synthetic construct
  source 1..18: mol_type = other DNA
tcatacgactcactaacg

SEQ ID NO: 4288 - DNA, 18 bp, synthetic construct
  source 1..18: mol_type = other DNA
tgatacgactcactgaag

SEQ ID NO: 4289 - DNA, 18 bp, synthetic construct
  source 1..18: mol_type = other DNA
ttttacgactcacgatag

SEQ ID NO: 4290 - DNA, 18 bp, synthetic construct
  source 1..18: mol_type = other DNA
taaaacgactcagaatag

SEQ ID NO: 4291 - DNA, 18 bp, synthetic construct
  source 1..18: mol_type = other DNA
ttatacgactcactaatg

SEQ ID NO: 4292 - DNA, 18 bp, synthetic construct
  source 1..18: mol_type = other DNA
taatacgactcacgtttg

SEQ ID NO: 4293 - DNA, 18 bp, synthetic construct
  source 1..18: mol_type = other DNA
taatacgactcagcaaag

SEQ ID NO: 4294 - DNA, 18 bp, synthetic construct
  source 1..18: mol_type = other DNA
taatatgacgcactattg

SEQ ID NO: 4295 - DNA, 18 bp, synthetic construct
  source 1..18: mol_type = other DNA
taattcgaatcacgatag

SEQ ID NO: 4296 - DNA, 18 bp, synthetic construct
  source 1..18: mol_type = other DNA
tcataggactcaccatag

SEQ ID NO: 4297 - DNA, 18 bp, synthetic construct
  source 1..18: mol_type = other DNA
ttataccacccactatag

SEQ ID NO: 4298 - DNA, 18 bp, synthetic construct
  source 1..18: mol_type = other DNA
taatacaacttacaatag

SEQ ID NO: 4299 - DNA, 18 bp, synthetic construct
  source 1..18: mol_type = other DNA
aaatacgactcactttgg

SEQ ID NO: 4300 - DNA, 18 bp, synthetic construct
  source 1..18: mol_type = other DNA
taatacgtaccactatag

SEQ ID NO: 4301 - DNA, 18 bp, synthetic construct
  source 1..18: mol_type = other DNA
taataagactcacttaag

SEQ ID NO: 4302 - DNA, 18 bp, synthetic construct
  source 1..18: mol_type = other DNA
taatagaactcactattg

SEQ ID NO: 4303 - DNA, 18 bp, synthetic construct
  source 1..18: mol_type = other DNA
tattgcaactcactatag

SEQ ID NO: 4304 - DNA, 18 bp, synthetic construct
  source 1..18: mol_type = other DNA
tattgcgactcattatag

SEQ ID NO: 4305 - DNA, 18 bp, synthetic construct
  source 1..18: mol_type = other DNA
acatccgactcactatag

SEQ ID NO: 4306 - DNA, 18 bp, synthetic construct
  source 1..18: mol_type = other DNA
cagtacgtctcactatag

SEQ ID NO: 4307 - DNA, 18 bp, synthetic construct
  source 1..18: mol_type = other DNA
gaatacgactctcgatag

SEQ ID NO: 4308 - DNA, 18 bp, synthetic construct
  source 1..18: mol_type = other DNA
taatacggctctccatag

SEQ ID NO: 4309 - DNA, 18 bp, synthetic construct
  source 1..18: mol_type = other DNA
tagtacgactcacttcag

SEQ ID NO: 4310 - DNA, 18 bp, synthetic construct
  source 1..18: mol_type = other DNA
tattacgactcggtatag

SEQ ID NO: 4311 - DNA, 18 bp, synthetic construct
  source 1..18: mol_type = other DNA
tcacccgactcactatag

SEQ ID NO: 4312 - DNA, 18 bp, synthetic construct
  source 1..18: mol_type = other DNA
ttatacgactaagtatag

SEQ ID NO: 4313 - DNA, 18 bp, synthetic construct
  source 1..18: mol_type = other DNA
tataacgactcactattg

SEQ ID NO: 4314 - DNA, 18 bp, synthetic construct
  source 1..18: mol_type = other DNA
ttatacgactctctatcg

SEQ ID NO: 4315 - DNA, 18 bp, synthetic construct
  source 1..18: mol_type = other DNA
taatacaactcaatgtag

SEQ ID NO: 4316 - DNA, 18 bp, synthetic construct
  source 1..18: mol_type = other DNA
taatacgtctcacgttag

SEQ ID NO: 4317 - DNA, 18 bp, synthetic construct
  source 1..18: mol_type = other DNA
taaaacgactcactcaag

SEQ ID NO: 4318 - DNA, 18 bp, synthetic construct
  source 1..18: mol_type = other DNA
taatacgcctcaccattg

SEQ ID NO: 4319 - DNA, 18 bp, synthetic construct
  source 1..18: mol_type = other DNA
taatatgactcactccag

SEQ ID NO: 4320 - DNA, 18 bp, synthetic construct
  source 1..18: mol_type = other DNA
ttaaacgactcactattg

SEQ ID NO: 4321 - DNA, 18 bp, synthetic construct
  source 1..18: mol_type = other DNA
taattcgaatcaatatag

SEQ ID NO: 4322 - DNA, 18 bp, synthetic construct
  source 1..18: mol_type = other DNA
taaaacgactccctaaag

SEQ ID NO: 4323 - DNA, 18 bp, synthetic construct
  source 1..18: mol_type = other DNA
tattaggactcactattg

SEQ ID NO: 4324 - DNA, 18 bp, synthetic construct
  source 1..18: mol_type = other DNA
tcaaacaactcactatag

SEQ ID NO: 4325 - DNA, 18 bp, synthetic construct
  source 1..18: mol_type = other DNA
aaaagcgactcactatag

SEQ ID NO: 4326 - DNA, 18 bp, synthetic construct
  source 1..18: mol_type = other DNA
aaatgcgtctcactatag

SEQ ID NO: 4327 - DNA, 18 bp, synthetic construct
  source 1..18: mol_type = other DNA
taagacgactaactattg

SEQ ID NO: 4328 - DNA, 18 bp, synthetic construct
  source 1..18: mol_type = other DNA
taatacagcacactatag

SEQ ID NO: 4329 - DNA, 18 bp, synthetic construct
  source 1..18: mol_type = other DNA
taatacgacccactttcg

SEQ ID NO: 4330 - DNA, 18 bp, synthetic construct
  source 1..18: mol_type = other DNA
ttgtaagactcactatag

SEQ ID NO: 4331 - DNA, 18 bp, synthetic construct
  source 1..18: mol_type = other DNA
aaatacgactccttatag

SEQ ID NO: 4332 - DNA, 18 bp, synthetic construct
  source 1..18: mol_type = other DNA
aaatacggctcactatcg

SEQ ID NO: 4333 - DNA, 18 bp, synthetic construct
  source 1..18: mol_type = other DNA
aagtccgactcactatag

SEQ ID NO: 4334 - DNA, 18 bp, synthetic construct
  source 1..18: mol_type = other DNA
caatacggcacactatag

SEQ ID NO: 4335 - DNA, 18 bp, synthetic construct
  source 1..18: mol_type = other DNA
caatacggctcacgatag

SEQ ID NO: 4336 - DNA, 18 bp, synthetic construct
  source 1..18: mol_type = other DNA
gactacgtctcactatag

SEQ ID NO: 4337 - DNA, 18 bp, synthetic construct
  source 1..18: mol_type = other DNA
taaaacgacccactatgg

SEQ ID NO: 4338 - DNA, 18 bp, synthetic construct
  source 1..18: mol_type = other DNA
taacacgagtcactattg

SEQ ID NO: 4339 - DNA, 18 bp, synthetic construct
  source 1..18: mol_type = other DNA
taacacgccacactatag

SEQ ID NO: 4340 - DNA, 18 bp, synthetic construct
  source 1..18: mol_type = other DNA
taacaggactcactctag

SEQ ID NO: 4341 - DNA, 18 bp, synthetic construct
  source 1..18: mol_type = other DNA
taagacaactcattatag

SEQ ID NO: 4342 - DNA, 18 bp, synthetic construct
  source 1..18: mol_type = other DNA
taagacgactatctatag

SEQ ID NO: 4343 - DNA, 18 bp, synthetic construct
  source 1..18: mol_type = other DNA
taagacgactcacactag

SEQ ID NO: 4344 - DNA, 18 bp, synthetic construct
  source 1..18: mol_type = other DNA
taataacactcagtatag

SEQ ID NO: 4345 - DNA, 18 bp, synthetic construct
  source 1..18: mol_type = other DNA
taataagaatcagtatag

SEQ ID NO: 4346 - DNA, 18 bp, synthetic construct
  source 1..18: mol_type = other DNA
taataagactccctctag

SEQ ID NO: 4347 - DNA, 18 bp, synthetic construct
  source 1..18: mol_type = other DNA
taatacgacacgccatag

SEQ ID NO: 4348 - DNA, 18 bp, synthetic construct
  source 1..18: mol_type = other DNA
taatacgactaagtatcg

SEQ ID NO: 4349 - DNA, 18 bp, synthetic construct
  source 1..18: mol_type = other DNA
taatacgactccccatgg

SEQ ID NO: 4350 - DNA, 18 bp, synthetic construct
  source 1..18: mol_type = other DNA
taatacggatgactatag

SEQ ID NO: 4351 - DNA, 18 bp, synthetic construct
  source 1..18: mol_type = other DNA
taatactactcactaccg

SEQ ID NO: 4352 - DNA, 18 bp, synthetic construct
  source 1..18: mol_type = other DNA
taatatgacacagtatag

SEQ ID NO: 4353 - DNA, 18 bp, synthetic construct
  source 1..18: mol_type = other DNA
taatatgactccctacag

SEQ ID NO: 4354 - DNA, 18 bp, synthetic construct
  source 1..18: mol_type = other DNA
taatgagactccctatag

SEQ ID NO: 4355 - DNA, 18 bp, synthetic construct
  source 1..18: mol_type = other DNA
taatgcgactcactgcag

SEQ ID NO: 4356 - DNA, 18 bp, synthetic construct
  source 1..18: mol_type = other DNA
tactacgactcgctatcg

SEQ ID NO: 4357 - DNA, 18 bp, synthetic construct
  source 1..18: mol_type = other DNA
tactccgactccctatag

SEQ ID NO: 4358 - DNA, 18 bp, synthetic construct
  source 1..18: mol_type = other DNA
tagtacggctcactctag

SEQ ID NO: 4359 - DNA, 18 bp, synthetic construct
  source 1..18: mol_type = other DNA
tcatacaactcactctag

SEQ ID NO: 4360 - DNA, 18 bp, synthetic construct
  source 1..18: mol_type = other DNA
tcatacgagtcactctag

SEQ ID NO: 4361 - DNA, 18 bp, synthetic construct
  source 1..18: mol_type = other DNA
tgatccgactcactatgg

SEQ ID NO: 4362 - DNA, 18 bp, synthetic construct
  source 1..18: mol_type = other DNA
taatacgactcaccaatg

SEQ ID NO: 4363 - DNA, 18 bp, synthetic construct
  source 1..18: mol_type = other DNA
caatacgaatctctatag

SEQ ID NO: 4364 - DNA, 18 bp, synthetic construct
  source 1..18: mol_type = other DNA
ttatacgtctcactttag

SEQ ID NO: 4365 - DNA, 18 bp, synthetic construct
  source 1..18: mol_type = other DNA
tcttacgactcactaaag

SEQ ID NO: 4366 - DNA, 18 bp, synthetic construct
  source 1..18: mol_type = other DNA
taatacaacttactacag

SEQ ID NO: 4367 - DNA, 18 bp, synthetic construct
  source 1..18: mol_type = other DNA
taataggactctctctag

SEQ ID NO: 4368 - DNA, 18 bp, synthetic construct
  source 1..18: mol_type = other DNA
aaatacgactcactgttg

SEQ ID NO: 4369 - DNA, 18 bp, synthetic construct
  source 1..18: mol_type = other DNA
ttatacgtctcactctag

SEQ ID NO: 4370 - DNA, 18 bp, synthetic construct
  source 1..18: mol_type = other DNA
taataagactcagtattg

SEQ ID NO: 4371 - DNA, 18 bp, synthetic construct
  source 1..18: mol_type = other DNA
taatacgactcacttgtg

SEQ ID NO: 4372 - DNA, 18 bp, synthetic construct
  source 1..18: mol_type = other DNA
taatgtgtctcactatag

SEQ ID NO: 4373 - DNA, 18 bp, synthetic construct
  source 1..18: mol_type = other DNA
ttataagacccactatag

SEQ ID NO: 4374 - DNA, 18 bp, synthetic construct
  source 1..18: mol_type = other DNA
ttatccaactcactatag

SEQ ID NO: 4375 - DNA, 18 bp, synthetic construct
  source 1..18: mol_type = other DNA
caacacgactcacaatag

SEQ ID NO: 4376 - DNA, 18 bp, synthetic construct
  source 1..18: mol_type = other DNA
gtatacaactcactatag

SEQ ID NO: 4377 - DNA, 18 bp, synthetic construct
  source 1..18: mol_type = other DNA
taaaacaactcactagag

SEQ ID NO: 4378 - DNA, 18 bp, synthetic construct
  source 1..18: mol_type = other DNA
taaaacgactcgctctag

SEQ ID NO: 4379 - DNA, 18 bp, synthetic construct
  source 1..18: mol_type = other DNA
taataagactcacttgag

SEQ ID NO: 4380 - DNA, 18 bp, synthetic construct
  source 1..18: mol_type = other DNA
taatacaactcagtacag

SEQ ID NO: 4381 - DNA, 18 bp, synthetic construct
  source 1..18: mol_type = other DNA
taatacaactcgctatgg

SEQ ID NO: 4382 - DNA, 18 bp, synthetic construct
  source 1..18: mol_type = other DNA
taatacgactcaaagtag

SEQ ID NO: 4383 - DNA, 18 bp, synthetic construct
  source 1..18: mol_type = other DNA
tcataccacttactatag

SEQ ID NO: 4384 - DNA, 18 bp, synthetic construct
  source 1..18: mol_type = other DNA
tattacaactcactacag

SEQ ID NO: 4385 - DNA, 18 bp, synthetic construct
  source 1..18: mol_type = other DNA
taataggactcacaattg

SEQ ID NO: 4386 - DNA, 18 bp, synthetic construct
  source 1..18: mol_type = other DNA
taatacgactctctccag

SEQ ID NO: 4387 - DNA, 18 bp, synthetic construct
  source 1..18: mol_type = other DNA
taatatgactctctaaag

SEQ ID NO: 4388 - DNA, 18 bp, synthetic construct
  source 1..18: mol_type = other DNA
aaatacgacacgctatag

SEQ ID NO: 4389 - DNA, 18 bp, synthetic construct
  source 1..18: mol_type = other DNA
taatatgactcaatgtag

SEQ ID NO: 4390 - DNA, 18 bp, synthetic construct
  source 1..18: mol_type = other DNA
taatatgactcactggag

SEQ ID NO: 4391 - DNA, 18 bp, synthetic construct
  source 1..18: mol_type = other DNA
taatgcgacacactgtag

SEQ ID NO: 4392 - DNA, 18 bp, synthetic construct
  source 1..18: mol_type = other DNA
tattacgcctcaccatag

SEQ ID NO: 4393 - DNA, 18 bp, synthetic construct
  source 1..18: mol_type = other DNA
ttatacgactcactttgg

SEQ ID NO: 4394 - DNA, 18 bp, synthetic construct
  source 1..18: mol_type = other DNA
aaatatgactcacgatag

SEQ ID NO: 4395 - DNA, 18 bp, synthetic construct
  source 1..18: mol_type = other DNA
gaatacgactctctattg

SEQ ID NO: 4396 - DNA, 18 bp, synthetic construct
  source 1..18: mol_type = other DNA
taatacaactcaatatcg

SEQ ID NO: 4397 - DNA, 18 bp, synthetic construct
  source 1..18: mol_type = other DNA
tattagcactcactatag

SEQ ID NO: 4398 - DNA, 18 bp, synthetic construct
  source 1..18: mol_type = other DNA
tgttacgactcagtatag

SEQ ID NO: 4399 - DNA, 18 bp, synthetic construct
  source 1..18: mol_type = other DNA
taattcgactcaccttag

SEQ ID NO: 4400 - DNA, 18 bp, synthetic construct
  source 1..18: mol_type = other DNA
taattcgactaactatcg

SEQ ID NO: 4401 - DNA, 18 bp, synthetic construct
  source 1..18: mol_type = other DNA
tatttcgactcacgatag

SEQ ID NO: 4402 - DNA, 18 bp, synthetic construct
  source 1..18: mol_type = other DNA
aaatacgactctcaatag

SEQ ID NO: 4403 - DNA, 18 bp, synthetic construct
  source 1..18: mol_type = other DNA
agatacgactcactaaag

SEQ ID NO: 4404 - DNA, 18 bp, synthetic construct
  source 1..18: mol_type = other DNA
taatacgattatctatag

SEQ ID NO: 4405 - DNA, 18 bp, synthetic construct
  source 1..18: mol_type = other DNA
tactatgactctctatag

SEQ ID NO: 4406 - DNA, 18 bp, synthetic construct
  source 1..18: mol_type = other DNA
ttatacgactcagtaaag

SEQ ID NO: 4407 - DNA, 18 bp, synthetic construct
  source 1..18: mol_type = other DNA
tgatacgactcaatattg

SEQ ID NO: 4408 - DNA, 18 bp, synthetic construct
  source 1..18: mol_type = other DNA
aaatacgactcccaatag

SEQ ID NO: 4409 - DNA, 18 bp, synthetic construct
  source 1..18: mol_type = other DNA
aaatacgactgactattg

SEQ ID NO: 4410 - DNA, 18 bp, synthetic construct
  source 1..18: mol_type = other DNA
taacatgtctcactatag

SEQ ID NO: 4411 - DNA, 18 bp, synthetic construct
  source 1..18: mol_type = other DNA
taatacgacgcacttttg

SEQ ID NO: 4412 - DNA, 18 bp, synthetic construct
  source 1..18: mol_type = other DNA
taatacgattcaagatag

SEQ ID NO: 4413 - DNA, 18 bp, synthetic construct
  source 1..18: mol_type = other DNA
aaatacgactcactcgag

SEQ ID NO: 4414 - DNA, 18 bp, synthetic construct
  source 1..18: mol_type = other DNA
taacgcgactcaatatag

SEQ ID NO: 4415 - DNA, 18 bp, synthetic construct
  source 1..18: mol_type = other DNA
taatacaactcactgttg

SEQ ID NO: 4416 - DNA, 18 bp, synthetic construct
  source 1..18: mol_type = other DNA
taatacgactccgtaaag

SEQ ID NO: 4417 - DNA, 18 bp, synthetic construct
  source 1..18: mol_type = other DNA
taatacgacttaatatgg

SEQ ID NO: 4418 - DNA, 18 bp, synthetic construct
  source 1..18: mol_type = other DNA
taatacgtgtcactctag

SEQ ID NO: 4419 - DNA, 18 bp, synthetic construct
  source 1..18: mol_type = other DNA
taatactacccactgtag

SEQ ID NO: 4420 - DNA, 18 bp, synthetic construct
  source 1..18: mol_type = other DNA
taatataactccctatag

SEQ ID NO: 4421 - DNA, 18 bp, synthetic construct
  source 1..18: mol_type = other DNA
tgacacgactctctatag

SEQ ID NO: 4422 - DNA, 18 bp, synthetic construct
  source 1..18: mol_type = other DNA
tgatacgccttactatag

SEQ ID NO: 4423 - DNA, 18 bp, synthetic construct
  source 1..18: mol_type = other DNA
ttatgcgactcacgatag

SEQ ID NO: 4424 - DNA, 18 bp, synthetic construct
  source 1..18: mol_type = other DNA
aattacgacgcactatag

SEQ ID NO: 4425 - DNA, 18 bp, synthetic construct
  source 1..18: mol_type = other DNA
caatacgacaccctatag

SEQ ID NO: 4426 - DNA, 18 bp, synthetic construct
  source 1..18: mol_type = other DNA
caatatgactcactctag

SEQ ID NO: 4427 - DNA, 18 bp, synthetic construct
  source 1..18: mol_type = other DNA
caatcccactcactatag

SEQ ID NO: 4428 - DNA, 18 bp, synthetic construct
  source 1..18: mol_type = other DNA
gaattcgactgactatag

SEQ ID NO: 4429 - DNA, 18 bp, synthetic construct
  source 1..18: mol_type = other DNA
taacacgactcactgtcg

SEQ ID NO: 4430 - DNA, 18 bp, synthetic construct
  source 1..18: mol_type = other DNA
taacacgagtcaatatag

SEQ ID NO: 4431 - DNA, 18 bp, synthetic construct
  source 1..18: mol_type = other DNA
taagaagaatcactatag

SEQ ID NO: 4432 - DNA, 18 bp, synthetic construct
  source 1..18: mol_type = other DNA
taataagactcacgattg

SEQ ID NO: 4433 - DNA, 18 bp, synthetic construct
  source 1..18: mol_type = other DNA
taataagactcgttatag

SEQ ID NO: 4434 - DNA, 18 bp, synthetic construct
  source 1..18: mol_type = other DNA
taataagattcacgatag

SEQ ID NO: 4435 - DNA, 18 bp, synthetic construct
  source 1..18: mol_type = other DNA
taatacgaatcagtgtag

SEQ ID NO: 4436 - DNA, 18 bp, synthetic construct
  source 1..18: mol_type = other DNA
taatacgactcagcttag

SEQ ID NO: 4437 - DNA, 18 bp, synthetic construct
  source 1..18: mol_type = other DNA
taatacgactcgcttcag

SEQ ID NO: 4438 - DNA, 18 bp, synthetic construct
  source 1..18: mol_type = other DNA
taatacgactctccgtag

SEQ ID NO: 4439 - DNA, 18 bp, synthetic construct
  source 1..18: mol_type = other DNA
taatacgcgtctctatag

SEQ ID NO: 4440 - DNA, 18 bp, synthetic construct
  source 1..18: mol_type = other DNA
taatacgtctcaatagag

SEQ ID NO: 4441 - DNA, 18 bp, synthetic construct
  source 1..18: mol_type = other DNA
taatactacccagtatag

SEQ ID NO: 4442 - DNA, 18 bp, synthetic construct
  source 1..18: mol_type = other DNA
taatagcactcgctatag

SEQ ID NO: 4443 - DNA, 18 bp, synthetic construct
  source 1..18: mol_type = other DNA
taatccgactcgctttag

SEQ ID NO: 4444 - DNA, 18 bp, synthetic construct
  source 1..18: mol_type = other DNA
taatgcgactcatcatag

SEQ ID NO: 4445 - DNA, 18 bp, synthetic construct
  source 1..18: mol_type = other DNA
taatgcgactccctaaag

SEQ ID NO: 4446 - DNA, 18 bp, synthetic construct
  source 1..18: mol_type = other DNA
taattccactcactacag

SEQ ID NO: 4447 - DNA, 18 bp, synthetic construct
  source 1..18: mol_type = other DNA
taccacgactcactatgg

SEQ ID NO: 4448 - DNA, 18 bp, synthetic construct
  source 1..18: mol_type = other DNA
tactacgacctactatag

SEQ ID NO: 4449 - DNA, 18 bp, synthetic construct
  source 1..18: mol_type = other DNA
tactccgactctctatag

SEQ ID NO: 4450 - DNA, 18 bp, synthetic construct
  source 1..18: mol_type = other DNA
tcatacgacccacaatag

SEQ ID NO: 4451 - DNA, 18 bp, synthetic construct
  source 1..18: mol_type = other DNA
tcataggattcactatag

SEQ ID NO: 4452 - DNA, 18 bp, synthetic construct
  source 1..18: mol_type = other DNA
tgctacgactcactttag

SEQ ID NO: 4453 - DNA, 18 bp, synthetic construct
  source 1..18: mol_type = other DNA
caatacgactccccatag

SEQ ID NO: 4454 - DNA, 18 bp, synthetic construct
  source 1..18: mol_type = other DNA
caatacgccccactatag

SEQ ID NO: 4455 - DNA, 18 bp, synthetic construct
  source 1..18: mol_type = other DNA
caatacggcccactatag

SEQ ID NO: 4456 - DNA, 18 bp, synthetic construct
  source 1..18: mol_type = other DNA
gaatacgactcacaatcg

SEQ ID NO: 4457 - DNA, 18 bp, synthetic construct
  source 1..18: mol_type = other DNA
gaatacgactcattttag

SEQ ID NO: 4458 - DNA, 18 bp, synthetic construct
  source 1..18: mol_type = other DNA
gaatacgacttcctatag

SEQ ID NO: 4459 - DNA, 18 bp, synthetic construct
  source 1..18: mol_type = other DNA
gaatacgagtctctatag

SEQ ID NO: 4460 - DNA, 18 bp, synthetic construct
  source 1..18: mol_type = other DNA
gaatacgtctcgctatag

SEQ ID NO: 4461 - DNA, 18 bp, synthetic construct
  source 1..18: mol_type = other DNA
gaatactacccactatag

SEQ ID NO: 4462 - DNA, 18 bp, synthetic construct
  source 1..18: mol_type = other DNA
gaatatgactcagtatag

SEQ ID NO: 4463 - DNA, 18 bp, synthetic construct
  source 1..18: mol_type = other DNA
gaattcgacccactatag

SEQ ID NO: 4464 - DNA, 18 bp, synthetic construct
  source 1..18: mol_type = other DNA
gaattcgactccctatag

SEQ ID NO: 4465 - DNA, 18 bp, synthetic construct
  source 1..18: mol_type = other DNA
ggatacgaatcactatag

SEQ ID NO: 4466 - DNA, 18 bp, synthetic construct
  source 1..18: mol_type = other DNA
taaaacgactcacgatcg

SEQ ID NO: 4467 - DNA, 18 bp, synthetic construct
  source 1..18: mol_type = other DNA
taacccgactcgctatag

SEQ ID NO: 4468 - DNA, 18 bp, synthetic construct
  source 1..18: mol_type = other DNA
taagacgcctcgctatag

SEQ ID NO: 4469 - DNA, 18 bp, synthetic construct
  source 1..18: mol_type = other DNA
taagccgactcactaaag

SEQ ID NO: 4470 - DNA, 18 bp, synthetic construct
  source 1..18: mol_type = other DNA
taataagactcattataa

SEQ ID NO: 4471 - DNA, 18 bp, synthetic construct
  source 1..18: mol_type = other DNA
taataagactccctgtag

SEQ ID NO: 4472 - DNA, 18 bp, synthetic construct
  source 1..18: mol_type = other DNA
taatacaagtcagtatag

SEQ ID NO: 4473 - DNA, 18 bp, synthetic construct
  source 1..18: mol_type = other DNA
taataccactcactatta

SEQ ID NO: 4474 - DNA, 18 bp, synthetic construct
  source 1..18: mol_type = other DNA
taatacgaaacactagag

SEQ ID NO: 4475 - DNA, 18 bp, synthetic construct
  source 1..18: mol_type = other DNA
taatacgaatctctataa

SEQ ID NO: 4476 - DNA, 18 bp, synthetic construct
  source 1..18: mol_type = other DNA
taatacgacccaccgtag

SEQ ID NO: 4477 - DNA, 18 bp, synthetic construct
  source 1..18: mol_type = other DNA
taatacgactaagtgtag

SEQ ID NO: 4478 - DNA, 18 bp, synthetic construct
  source 1..18: mol_type = other DNA
taatacgactaattacag

SEQ ID NO: 4479 - DNA, 18 bp, synthetic construct
  source 1..18: mol_type = other DNA
taatacgactcaatggag

SEQ ID NO: 4480 - DNA, 18 bp, synthetic construct
  source 1..18: mol_type = other DNA
taatacgactccgtacag

SEQ ID NO: 4481 - DNA, 18 bp, synthetic construct
  source 1..18: mol_type = other DNA
taatacgactcggtctag

SEQ ID NO: 4482 - DNA, 18 bp, synthetic construct
  source 1..18: mol_type = other DNA
taatacgacttgctatgg

SEQ ID NO: 4483 - DNA, 18 bp, synthetic construct
  source 1..18: mol_type = other DNA
taatacgagtacctatag

SEQ ID NO: 4484 - DNA, 18 bp, synthetic construct
  source 1..18: mol_type = other DNA
taatacgagttcctatag

SEQ ID NO: 4485 - DNA, 18 bp, synthetic construct
  source 1..18: mol_type = other DNA
taatacgattcacggtag

SEQ ID NO: 4486 - DNA, 18 bp, synthetic construct
  source 1..18: mol_type = other DNA
taatacgattcactatta

SEQ ID NO: 4487 - DNA, 18 bp, synthetic construct
  source 1..18: mol_type = other DNA
taatacgattccctacag

SEQ ID NO: 4488 - DNA, 18 bp, synthetic construct
  source 1..18: mol_type = other DNA
taatacgcctaactgtag

SEQ ID NO: 4489 - DNA, 18 bp, synthetic construct
  source 1..18: mol_type = other DNA
taatacgcctgactacag

SEQ ID NO: 4490 - DNA, 18 bp, synthetic construct
  source 1..18: mol_type = other DNA
taatacggctctctgtag

SEQ ID NO: 4491 - DNA, 18 bp, synthetic construct
  source 1..18: mol_type = other DNA
taatacgtctcgcgatag

SEQ ID NO: 4492 - DNA, 18 bp, synthetic construct
  source 1..18: mol_type = other DNA
taataggactaacgatag

SEQ ID NO: 4493 - DNA, 18 bp, synthetic construct
  source 1..18: mol_type = other DNA
taataggagtcactatcg

SEQ ID NO: 4494 - DNA, 18 bp, synthetic construct
  source 1..18: mol_type = other DNA
taatagtactcaatatag

SEQ ID NO: 4495 - DNA, 18 bp, synthetic construct
  source 1..18: mol_type = other DNA
taatagtacttactatag

SEQ ID NO: 4496 - DNA, 18 bp, synthetic construct
  source 1..18: mol_type = other DNA
taatatgactcaagatag

SEQ ID NO: 4497 - DNA, 18 bp, synthetic construct
  source 1..18: mol_type = other DNA
taatatgactcagtgtag

SEQ ID NO: 4498 - DNA, 18 bp, synthetic construct
  source 1..18: mol_type = other DNA
taatccgactcaatctag

SEQ ID NO: 4499 - DNA, 18 bp, synthetic construct
  source 1..18: mol_type = other DNA
taatccgactcagtacag

SEQ ID NO: 4500 - DNA, 18 bp, synthetic construct
  source 1..18: mol_type = other DNA
taatgcgactcgatatag

SEQ ID NO: 4501 - DNA, 18 bp, synthetic construct
  source 1..18: mol_type = other DNA
taattcgactaacgatag

SEQ ID NO: 4502 - DNA, 18 bp, synthetic construct
  source 1..18: mol_type = other DNA
taccaggactcactatag

SEQ ID NO: 4503 - DNA, 18 bp, synthetic construct
  source 1..18: mol_type = other DNA
tacgaggactcactatag

SEQ ID NO: 4504 - DNA, 18 bp, synthetic construct
  source 1..18: mol_type = other DNA
tactaaaactcactatag

SEQ ID NO: 4505 - DNA, 18 bp, synthetic construct
  source 1..18: mol_type = other DNA
tactacgaatcactctag

SEQ ID NO: 4506 - DNA, 18 bp, synthetic construct
  source 1..18: mol_type = other DNA
tactacgactgattatag

SEQ ID NO: 4507 - DNA, 18 bp, synthetic construct
  source 1..18: mol_type = other DNA
tactactcctcactatag

SEQ ID NO: 4508 - DNA, 18 bp, synthetic construct
  source 1..18: mol_type = other DNA
tatgaagactcactatag

SEQ ID NO: 4509 - DNA, 18 bp, synthetic construct
  source 1..18: mol_type = other DNA
tattacggctcactagag

SEQ ID NO: 4510 - DNA, 18 bp, synthetic construct
  source 1..18: mol_type = other DNA
tcacacgagtcactatag

SEQ ID NO: 4511 - DNA, 18 bp, synthetic construct
  source 1..18: mol_type = other DNA
tcataccaatcactatag

SEQ ID NO: 4512 - DNA, 18 bp, synthetic construct
  source 1..18: mol_type = other DNA
tcatacgactcactcgag

SEQ ID NO: 4513 - DNA, 18 bp, synthetic construct
  source 1..18: mol_type = other DNA
tcatacgactccatatag

SEQ ID NO: 4514 - DNA, 18 bp, synthetic construct
  source 1..18: mol_type = other DNA
tcatacgactcgatatag

SEQ ID NO: 4515 - DNA, 18 bp, synthetic construct
  source 1..18: mol_type = other DNA
tcataggacccactatag

SEQ ID NO: 4516 - DNA, 18 bp, synthetic construct
  source 1..18: mol_type = other DNA
tcatgcgactcaccatag

SEQ ID NO: 4517 - DNA, 18 bp, synthetic construct
  source 1..18: mol_type = other DNA
tcatgcgactcactgtag

SEQ ID NO: 4518 - DNA, 18 bp, synthetic construct
  source 1..18: mol_type = other DNA
tcttacgactcacgatag

SEQ ID NO: 4519 - DNA, 18 bp, synthetic construct
  source 1..18: mol_type = other DNA
tgacacgactgactatag

SEQ ID NO: 4520 - DNA, 18 bp, synthetic construct
  source 1..18: mol_type = other DNA
tgatacgactaactagag

SEQ ID NO: 4521 - DNA, 18 bp, synthetic construct
  source 1..18: mol_type = other DNA
tgatacgcctcactctag

SEQ ID NO: 4522 - DNA, 18 bp, synthetic construct
  source 1..18: mol_type = other DNA
ttataggactcacgatag

SEQ ID NO: 4523 - DNA, 18 bp, synthetic construct
  source 1..18: mol_type = other DNA
atataagactcactatag

SEQ ID NO: 4524 - DNA, 18 bp, synthetic construct
  source 1..18: mol_type = other DNA
aaatacgtctccctatag

SEQ ID NO: 4525 - DNA, 18 bp, synthetic construct
  source 1..18: mol_type = other DNA
agttacgactcactatag

SEQ ID NO: 4526 - DNA, 18 bp, synthetic construct
  source 1..18: mol_type = other DNA
taatacttctcactatcg

SEQ ID NO: 4527 - DNA, 18 bp, synthetic construct
  source 1..18: mol_type = other DNA
aaaaacgactcactattg

SEQ ID NO: 4528 - DNA, 18 bp, synthetic construct
  source 1..18: mol_type = other DNA
taatacgactcacagaag

SEQ ID NO: 4529 - DNA, 18 bp, synthetic construct
  source 1..18: mol_type = other DNA
taatacgtgtcactttag

SEQ ID NO: 4530 - DNA, 18 bp, synthetic construct
  source 1..18: mol_type = other DNA
taatgcgactctctaaag

SEQ ID NO: 4531 - DNA, 18 bp, synthetic construct
  source 1..18: mol_type = other DNA
taatacgactcacaactg

SEQ ID NO: 4532 - DNA, 18 bp, synthetic construct
  source 1..18: mol_type = other DNA
caaaatgactcactatag

SEQ ID NO: 4533 - DNA, 18 bp, synthetic construct
  source 1..18: mol_type = other DNA
taatacgtctgactatcg

SEQ ID NO: 4534 - DNA, 18 bp, synthetic construct
  source 1..18: mol_type = other DNA
taatcagactcactacag

SEQ ID NO: 4535 - DNA, 18 bp, synthetic construct
  source 1..18: mol_type = other DNA
taatgcgactcaataaag

SEQ ID NO: 4536 - DNA, 18 bp, synthetic construct
  source 1..18: mol_type = other DNA
ttatataactcactatag

SEQ ID NO: 4537 - DNA, 18 bp, synthetic construct
  source 1..18: mol_type = other DNA
taattcgactccctattg

SEQ ID NO: 4538 - DNA, 18 bp, synthetic construct
  source 1..18: mol_type = other DNA
aattacgactcactagag

SEQ ID NO: 4539 - DNA, 18 bp, synthetic construct
  source 1..18: mol_type = other DNA
caatacgactcaccttag

SEQ ID NO: 4540 - DNA, 18 bp, synthetic construct
  source 1..18: mol_type = other DNA
taactcgactcactatcg

SEQ ID NO: 4541 - DNA, 18 bp, synthetic construct
  source 1..18: mol_type = other DNA
taatacgacccaatacag

SEQ ID NO: 4542 - DNA, 18 bp, synthetic construct
  source 1..18: mol_type = other DNA
taaaaagactcactattg

SEQ ID NO: 4543 - DNA, 18 bp, synthetic construct
  source 1..18: mol_type = other DNA
taatacgtctcactaacg

SEQ ID NO: 4544 - DNA, 18 bp, synthetic construct
  source 1..18: mol_type = other DNA
taatatgactcagtttag

SEQ ID NO: 4545 - DNA, 18 bp, synthetic construct
  source 1..18: mol_type = other DNA
taattccaatcactatag

SEQ ID NO: 4546 - DNA, 18 bp, synthetic construct
  source 1..18: mol_type = other DNA
tgttacgactcaccatag

SEQ ID NO: 4547 - DNA, 18 bp, synthetic construct
  source 1..18: mol_type = other DNA
caatacgcgtcactatag

SEQ ID NO: 4548 - DNA, 18 bp, synthetic construct
  source 1..18: mol_type = other DNA
taacacaattcactatag

SEQ ID NO: 4549 - DNA, 18 bp, synthetic construct
  source 1..18: mol_type = other DNA
taatactcctcaatatag

SEQ ID NO: 4550 - DNA, 18 bp, synthetic construct
  source 1..18: mol_type = other DNA
taatgggactctctatag

SEQ ID NO: 4551 - DNA, 18 bp, synthetic construct
  source 1..18: mol_type = other DNA
taattcgacccaccatag

SEQ ID NO: 4552 - DNA, 18 bp, synthetic construct
  source 1..18: mol_type = other DNA
taattcgactgactctag

SEQ ID NO: 4553 - DNA, 18 bp, synthetic construct
  source 1..18: mol_type = other DNA
taattcgagtcaatatag

SEQ ID NO: 4554 - DNA, 18 bp, synthetic construct
  source 1..18: mol_type = other DNA
tattacgcctcactgtag

SEQ ID NO: 4555 - DNA, 18 bp, synthetic construct
  source 1..18: mol_type = other DNA
tgatacgactcgctaaag

SEQ ID NO: 4556 - DNA, 18 bp, synthetic construct
  source 1..18: mol_type = other DNA
ttttacgactcactaaag

SEQ ID NO: 4557 - DNA, 18 bp, synthetic construct
  source 1..18: mol_type = other DNA
tgaaacgactcactaaag

SEQ ID NO: 4558 - DNA, 18 bp, synthetic construct
  source 1..18: mol_type = other DNA
ttatgcgacacactatag

SEQ ID NO: 4559 - DNA, 18 bp, synthetic construct
  source 1..18: mol_type = other DNA
taatacgacacacaagag

SEQ ID NO: 4560 - DNA, 18 bp, synthetic construct
  source 1..18: mol_type = other DNA
taatacgactcgctttgg

SEQ ID NO: 4561 - DNA, 18 bp, synthetic construct
  source 1..18: mol_type = other DNA
tagtactactcaatatag

SEQ ID NO: 4562 - DNA, 18 bp, synthetic construct
  source 1..18: mol_type = other DNA
tgatacgtctcactatcg

SEQ ID NO: 4563 - DNA, 18 bp, synthetic construct
  source 1..18: mol_type = other DNA
tcatgcgactcactattg

SEQ ID NO: 4564 - DNA, 18 bp, synthetic construct
  source 1..18: mol_type = other DNA
ttataggactctctatag

SEQ ID NO: 4565 - DNA, 18 bp, synthetic construct
  source 1..18: mol_type = other DNA
taatccgtctcactctag

SEQ ID NO: 4566 - DNA, 18 bp, synthetic construct
  source 1..18: mol_type = other DNA
caattcgactcacaatag

SEQ ID NO: 4567 - DNA, 18 bp, synthetic construct
  source 1..18: mol_type = other DNA
tgttacgactcactaaag

SEQ ID NO: 4568 - DNA, 18 bp, synthetic construct
  source 1..18: mol_type = other DNA
taactcgactcactaaag

SEQ ID NO: 4569 - DNA, 18 bp, synthetic construct
  source 1..18: mol_type = other DNA
taatacgattcaacatag

SEQ ID NO: 4570 - DNA, 18 bp, synthetic construct
  source 1..18: mol_type = other DNA
taatatgactcgctttag

SEQ ID NO: 4571 - DNA, 18 bp, synthetic construct
  source 1..18: mol_type = other DNA
tagtacgactcacaattg

SEQ ID NO: 4572 - DNA, 18 bp, synthetic construct
  source 1..18: mol_type = other DNA
taaaacgactgcctatag

SEQ ID NO: 4573 - DNA, 18 bp, synthetic construct
  source 1..18: mol_type = other DNA
taatacgactcacagtcg

SEQ ID NO: 4574 - DNA, 18 bp, synthetic construct
  source 1..18: mol_type = other DNA
taataggtctcactttag

SEQ ID NO: 4575 - DNA, 18 bp, synthetic construct
  source 1..18: mol_type = other DNA
taatccgactctctatcg

SEQ ID NO: 4576 - DNA, 18 bp, synthetic construct
  source 1..18: mol_type = other DNA
tactacgactcaccattg

SEQ ID NO: 4577 - DNA, 18 bp, synthetic construct
  source 1..18: mol_type = other DNA
tagaactactcactatag

SEQ ID NO: 4578 - DNA, 18 bp, synthetic construct
  source 1..18: mol_type = other DNA
tcatacgcctctctatag

SEQ ID NO: 4579 - DNA, 18 bp, synthetic construct
  source 1..18: mol_type = other DNA
tgatacaactccctatag

SEQ ID NO: 4580 - DNA, 18 bp, synthetic construct
  source 1..18: mol_type = other DNA
caatacgactcactagtg

SEQ ID NO: 4581 - DNA, 18 bp, synthetic construct
  source 1..18: mol_type = other DNA
caatacgattcactctag

SEQ ID NO: 4582 - DNA, 18 bp, synthetic construct
  source 1..18: mol_type = other DNA
taaaacgactcagtacag

SEQ ID NO: 4583 - DNA, 18 bp, synthetic construct
  source 1..18: mol_type = other DNA
taacacgagtaactatag

SEQ ID NO: 4584 - DNA, 18 bp, synthetic construct
  source 1..18: mol_type = other DNA
taataagacccaatatag

SEQ ID NO: 4585 - DNA, 18 bp, synthetic construct
  source 1..18: mol_type = other DNA
taatacgaccaagtatag

SEQ ID NO: 4586 - DNA, 18 bp, synthetic construct
  source 1..18: mol_type = other DNA
taatacgacgctctatgg

SEQ ID NO: 4587 - DNA, 18 bp, synthetic construct
  source 1..18: mol_type = other DNA
taatacgactccctgaag

SEQ ID NO: 4588 - DNA, 18 bp, synthetic construct
  source 1..18: mol_type = other DNA
taatacgactcgttatgg

SEQ ID NO: 4589 - DNA, 18 bp, synthetic construct
  source 1..18: mol_type = other DNA
taatacgtgtcactatcg

SEQ ID NO: 4590 - DNA, 18 bp, synthetic construct
  source 1..18: mol_type = other DNA
taatactactcgctacag

SEQ ID NO: 4591 - DNA, 18 bp, synthetic construct
  source 1..18: mol_type = other DNA
taatagcacgcactatag

SEQ ID NO: 4592 - DNA, 18 bp, synthetic construct
  source 1..18: mol_type = other DNA
taatagggctcactctag

SEQ ID NO: 4593 - DNA, 18 bp, synthetic construct
  source 1..18: mol_type = other DNA
taatatagctcactatag

SEQ ID NO: 4594 - DNA, 18 bp, synthetic construct
  source 1..18: mol_type = other DNA
taatattactcactagag

SEQ ID NO: 4595 - DNA, 18 bp, synthetic construct
  source 1..18: mol_type = other DNA
taatccgactcaccacag

SEQ ID NO: 4596 - DNA, 18 bp, synthetic construct
  source 1..18: mol_type = other DNA
taatccgattcagtatag

SEQ ID NO: 4597 - DNA, 18 bp, synthetic construct
  source 1..18: mol_type = other DNA
taatgtgactcactatcg

SEQ ID NO: 4598 - DNA, 18 bp, synthetic construct
  source 1..18: mol_type = other DNA
tactacaactcactgtag

SEQ ID NO: 4599 - DNA, 18 bp, synthetic construct
  source 1..18: mol_type = other DNA
tactactactccctatag

SEQ ID NO: 4600 - DNA, 18 bp, synthetic construct
  source 1..18: mol_type = other DNA
tagtgcgactcacaatag

SEQ ID NO: 4601 - DNA, 18 bp, synthetic construct
  source 1..18: mol_type = other DNA
tatgactactcactatag

SEQ ID NO: 4602 - DNA, 18 bp, synthetic construct
  source 1..18: mol_type = other DNA
tcataccactcactatgg

SEQ ID NO: 4603 - DNA, 18 bp, synthetic construct
  source 1..18: mol_type = other DNA
tcatacgacttagtatag

SEQ ID NO: 4604 - DNA, 18 bp, synthetic construct
  source 1..18: mol_type = other DNA
tgataccactcagtatag

SEQ ID NO: 4605 - DNA, 18 bp, synthetic construct
  source 1..18: mol_type = other DNA
tgataggtctcactatag

SEQ ID NO: 4606 - DNA, 18 bp, synthetic construct
  source 1..18: mol_type = other DNA
cattacgactcactaaag

SEQ ID NO: 4607 - DNA, 18 bp, synthetic construct
  source 1..18: mol_type = other DNA
taatacgactctataaag

SEQ ID NO: 4608 - DNA, 18 bp, synthetic construct
  source 1..18: mol_type = other DNA
taatttgtctcactatag

SEQ ID NO: 4609 - DNA, 18 bp, synthetic construct
  source 1..18: mol_type = other DNA
taattggactctctatag

SEQ ID NO: 4610 - DNA, 18 bp, synthetic construct
  source 1..18: mol_type = other DNA
gcatacgactcactattg

SEQ ID NO: 4611 - DNA, 18 bp, synthetic construct
  source 1..18: mol_type = other DNA
taatccgacacactattg

SEQ ID NO: 4612 - DNA, 18 bp, synthetic construct
  source 1..18: mol_type = other DNA
caatacaactcactttag

SEQ ID NO: 4613 - DNA, 18 bp, synthetic construct
  source 1..18: mol_type = other DNA
aaatacgtctcactttag

SEQ ID NO: 4614 - DNA, 18 bp, synthetic construct
  source 1..18: mol_type = other DNA
ttacaagactcactatag

SEQ ID NO: 4615 - DNA, 18 bp, synthetic construct
  source 1..18: mol_type = other DNA
ttatccgactcactttag

SEQ ID NO: 4616 - DNA, 18 bp, synthetic construct
  source 1..18: mol_type = other DNA
aaatacaactcaatatag

SEQ ID NO: 4617 - DNA, 18 bp, synthetic construct
  source 1..18: mol_type = other DNA
caatacaactcactatcg

SEQ ID NO: 4618 - DNA, 18 bp, synthetic construct
  source 1..18: mol_type = other DNA
caatacgacctactatag

SEQ ID NO: 4619 - DNA, 18 bp, synthetic construct
  source 1..18: mol_type = other DNA
taacacgtctcactctag

SEQ ID NO: 4620 - DNA, 18 bp, synthetic construct
  source 1..18: mol_type = other DNA
taatacgactcagaacag

SEQ ID NO: 4621 - DNA, 18 bp, synthetic construct
  source 1..18: mol_type = other DNA
taatacgtcgcactattg

SEQ ID NO: 4622 - DNA, 18 bp, synthetic construct
  source 1..18: mol_type = other DNA
taatactactcaccacag

SEQ ID NO: 4623 - DNA, 18 bp, synthetic construct
  source 1..18: mol_type = other DNA
taatactagtcactacag

SEQ ID NO: 4624 - DNA, 18 bp, synthetic construct
  source 1..18: mol_type = other DNA
taatactattccctatag

SEQ ID NO: 4625 - DNA, 18 bp, synthetic construct
  source 1..18: mol_type = other DNA
taatatgacttcctatag

SEQ ID NO: 4626 - DNA, 18 bp, synthetic construct
  source 1..18: mol_type = other DNA
taattcgactcactgtgg

SEQ ID NO: 4627 - DNA, 18 bp, synthetic construct
  source 1..18: mol_type = other DNA
tacaacgactcactacag

SEQ ID NO: 4628 - DNA, 18 bp, synthetic construct
  source 1..18: mol_type = other DNA
tacttcggctcactatag

SEQ ID NO: 4629 - DNA, 18 bp, synthetic construct
  source 1..18: mol_type = other DNA
tagtccaactcactatag

SEQ ID NO: 4630 - DNA, 18 bp, synthetic construct
  source 1..18: mol_type = other DNA
ttacgcgactcactatag

SEQ ID NO: 4631 - DNA, 18 bp, synthetic construct
  source 1..18: mol_type = other DNA
taaaacgtctcaccatag

SEQ ID NO: 4632 - DNA, 18 bp, synthetic construct
  source 1..18: mol_type = other DNA
ttatacaactcactgtag

SEQ ID NO: 4633 - DNA, 18 bp, synthetic construct
  source 1..18: mol_type = other DNA
taattcgactcactttcg

SEQ ID NO: 4634 - DNA, 18 bp, synthetic construct
  source 1..18: mol_type = other DNA
taatacgactctctaagg

SEQ ID NO: 4635 - DNA, 18 bp, synthetic construct
  source 1..18: mol_type = other DNA
aaatacgactcactgaag

SEQ ID NO: 4636 - DNA, 18 bp, synthetic construct
  source 1..18: mol_type = other DNA
taatacgactcacccttg

SEQ ID NO: 4637 - DNA, 18 bp, synthetic construct
  source 1..18: mol_type = other DNA
taatacggccctctatag

SEQ ID NO: 4638 - DNA, 18 bp, synthetic construct
  source 1..18: mol_type = other DNA
taatatgcctcaatatag

SEQ ID NO: 4639 - DNA, 18 bp, synthetic construct
  source 1..18: mol_type = other DNA
taattcgacttactatgg

SEQ ID NO: 4640 - DNA, 18 bp, synthetic construct
  source 1..18: mol_type = other DNA
tattccgactcacgatag

SEQ ID NO: 4641 - DNA, 18 bp, synthetic construct
  source 1..18: mol_type = other DNA
ttatacgtctcaccatag

SEQ ID NO: 4642 - DNA, 18 bp, synthetic construct
  source 1..18: mol_type = other DNA
aaatacaactcactatcg

SEQ ID NO: 4643 - DNA, 18 bp, synthetic construct
  source 1..18: mol_type = other DNA
caatacgacttcctatag

SEQ ID NO: 4644 - DNA, 18 bp, synthetic construct
  source 1..18: mol_type = other DNA
taatactactcactctcg

SEQ ID NO: 4645 - DNA, 18 bp, synthetic construct
  source 1..18: mol_type = other DNA
taataggactatctatag

SEQ ID NO: 4646 - DNA, 18 bp, synthetic construct
  source 1..18: mol_type = other DNA
taatgcgactctctacag

SEQ ID NO: 4647 - DNA, 18 bp, synthetic construct
  source 1..18: mol_type = other DNA
taatccgactctctaaag

SEQ ID NO: 4648 - DNA, 18 bp, synthetic construct
  source 1..18: mol_type = other DNA
tattacgtctcactacag

SEQ ID NO: 4649 - DNA, 18 bp, synthetic construct
  source 1..18: mol_type = other DNA
tgatacgactcacttttg

SEQ ID NO: 4650 - DNA, 18 bp, synthetic construct
  source 1..18: mol_type = other DNA
ttataagactcactaaag

SEQ ID NO: 4651 - DNA, 18 bp, synthetic construct
  source 1..18: mol_type = other DNA
aaatacgtctcgctatag

SEQ ID NO: 4652 - DNA, 18 bp, synthetic construct
  source 1..18: mol_type = other DNA
tattacgtctcactattg

SEQ ID NO: 4653 - DNA, 18 bp, synthetic construct
  source 1..18: mol_type = other DNA
taatacgactcacacttg

SEQ ID NO: 4654 - DNA, 18 bp, synthetic construct
  source 1..18: mol_type = other DNA
ttatacgactcacaacag

SEQ ID NO: 4655 - DNA, 18 bp, synthetic construct
  source 1..18: mol_type = other DNA
caattcgactcactttag

SEQ ID NO: 4656 - DNA, 18 bp, synthetic construct
  source 1..18: mol_type = other DNA
ttaaacgactcaccatag

SEQ ID NO: 4657 - DNA, 18 bp, synthetic construct
  source 1..18: mol_type = other DNA
taatatgattcactatcg

SEQ ID NO: 4658 - DNA, 18 bp, synthetic construct
  source 1..18: mol_type = other DNA
taatccgactcacaatcg

SEQ ID NO: 4659 - DNA, 18 bp, synthetic construct
  source 1..18: mol_type = other DNA
aaatgccactcactatag

SEQ ID NO: 4660 - DNA, 18 bp, synthetic construct
  source 1..18: mol_type = other DNA
caacatgactcactatag

SEQ ID NO: 4661 - DNA, 18 bp, synthetic construct
  source 1..18: mol_type = other DNA
caatacgactaactatcg

SEQ ID NO: 4662 - DNA, 18 bp, synthetic construct
  source 1..18: mol_type = other DNA
taaaacgcctcactctag

SEQ ID NO: 4663 - DNA, 18 bp, synthetic construct
  source 1..18: mol_type = other DNA
taatacgaatcactccag

SEQ ID NO: 4664 - DNA, 18 bp, synthetic construct
  source 1..18: mol_type = other DNA
taatacgacttactaagg

SEQ ID NO: 4665 - DNA, 18 bp, synthetic construct
  source 1..18: mol_type = other DNA
taatacgacttactaccg

SEQ ID NO: 4666 - DNA, 18 bp, synthetic construct
  source 1..18: mol_type = other DNA
taatatgactccccatag

SEQ ID NO: 4667 - DNA, 18 bp, synthetic construct
  source 1..18: mol_type = other DNA
tactacgtcccactatag

SEQ ID NO: 4668 - DNA, 18 bp, synthetic construct
  source 1..18: mol_type = other DNA
tagtacgacttactctag

SEQ ID NO: 4669 - DNA, 18 bp, synthetic construct
  source 1..18: mol_type = other DNA
tcatacgatccactatag

SEQ ID NO: 4670 - DNA, 18 bp, synthetic construct
  source 1..18: mol_type = other DNA
ttacacgacccactatag

SEQ ID NO: 4671 - DNA, 18 bp, synthetic construct
  source 1..18: mol_type = other DNA
taaaacgtctcagtatag

SEQ ID NO: 4672 - DNA, 18 bp, synthetic construct
  source 1..18: mol_type = other DNA
tattaagactcaatatag

SEQ ID NO: 4673 - DNA, 18 bp, synthetic construct
  source 1..18: mol_type = other DNA
tattaggactcacaatag

SEQ ID NO: 4674 - DNA, 18 bp, synthetic construct
  source 1..18: mol_type = other DNA
tgaaacgtctcactatag

SEQ ID NO: 4675 - DNA, 18 bp, synthetic construct
  source 1..18: mol_type = other DNA
tcattagactcactatag

SEQ ID NO: 4676 - DNA, 18 bp, synthetic construct
  source 1..18: mol_type = other DNA
ttatatgactcgctatag

SEQ ID NO: 4677 - DNA, 18 bp, synthetic construct
  source 1..18: mol_type = other DNA
taatacaacttactctag

SEQ ID NO: 4678 - DNA, 18 bp, synthetic construct
  source 1..18: mol_type = other DNA
taatacaagacactatag

SEQ ID NO: 4679 - DNA, 18 bp, synthetic construct
  source 1..18: mol_type = other DNA
taatacggctcactgttg

SEQ ID NO: 4680 - DNA, 18 bp, synthetic construct
  source 1..18: mol_type = other DNA
taatgcgtctaactatag

SEQ ID NO: 4681 - DNA, 18 bp, synthetic construct
  source 1..18: mol_type = other DNA
ttatactactcactagag

SEQ ID NO: 4682 - DNA, 18 bp, synthetic construct
  source 1..18: mol_type = other DNA
aaataccactcaatatag

SEQ ID NO: 4683 - DNA, 18 bp, synthetic construct
  source 1..18: mol_type = other DNA
caatacaactcactgtag

SEQ ID NO: 4684 - DNA, 18 bp, synthetic construct
  source 1..18: mol_type = other DNA
taatactacttaccatag

SEQ ID NO: 4685 - DNA, 18 bp, synthetic construct
  source 1..18: mol_type = other DNA
taataggactctctagag

SEQ ID NO: 4686 - DNA, 18 bp, synthetic construct
  source 1..18: mol_type = other DNA
taatcagactcaatatag

SEQ ID NO: 4687 - DNA, 18 bp, synthetic construct
  source 1..18: mol_type = other DNA
aaatacgaatcactagag

SEQ ID NO: 4688 - DNA, 18 bp, synthetic construct
  source 1..18: mol_type = other DNA
caaaacgactcaccatag

SEQ ID NO: 4689 - DNA, 18 bp, synthetic construct
  source 1..18: mol_type = other DNA
gaatacaactcactaaag

SEQ ID NO: 4690 - DNA, 18 bp, synthetic construct
  source 1..18: mol_type = other DNA
taacccgaatcactatag

SEQ ID NO: 4691 - DNA, 18 bp, synthetic construct
  source 1..18: mol_type = other DNA
taagaagactcactttag

SEQ ID NO: 4692 - DNA, 18 bp, synthetic construct
  source 1..18: mol_type = other DNA
taatacgaatcaacatag

SEQ ID NO: 4693 - DNA, 18 bp, synthetic construct
  source 1..18: mol_type = other DNA
taatacgactcacagtgg

SEQ ID NO: 4694 - DNA, 18 bp, synthetic construct
  source 1..18: mol_type = other DNA
taatacgactcagtcaag

SEQ ID NO: 4695 - DNA, 18 bp, synthetic construct
  source 1..18: mol_type = other DNA
taatacgactccttctag

SEQ ID NO: 4696 - DNA, 18 bp, synthetic construct
  source 1..18: mol_type = other DNA
taatacgccccacaatag

SEQ ID NO: 4697 - DNA, 18 bp, synthetic construct
  source 1..18: mol_type = other DNA
taatacggctcacaatgg

SEQ ID NO: 4698 - DNA, 18 bp, synthetic construct
  source 1..18: mol_type = other DNA
taatacggcttagtatag

SEQ ID NO: 4699 - DNA, 18 bp, synthetic construct
  source 1..18: mol_type = other DNA
taatactaatcacgatag

SEQ ID NO: 4700 - DNA, 18 bp, synthetic construct
  source 1..18: mol_type = other DNA
taataggtctcactagag

SEQ ID NO: 4701 - DNA, 18 bp, synthetic construct
  source 1..18: mol_type = other DNA
taatccgacccactgtag

SEQ ID NO: 4702 - DNA, 18 bp, synthetic construct
  source 1..18: mol_type = other DNA
taatccgactgcctatag

SEQ ID NO: 4703 - DNA, 18 bp, synthetic construct
  source 1..18: mol_type = other DNA
taatccgatgcactatag

SEQ ID NO: 4704 - DNA, 18 bp, synthetic construct
  source 1..18: mol_type = other DNA
taatgcgactcagtattg

SEQ ID NO: 4705 - DNA, 18 bp, synthetic construct
  source 1..18: mol_type = other DNA
tacaacgagtcactatag

SEQ ID NO: 4706 - DNA, 18 bp, synthetic construct
  source 1..18: mol_type = other DNA
tactacgactcgctctag

SEQ ID NO: 4707 - DNA, 18 bp, synthetic construct
  source 1..18: mol_type = other DNA
tattactacgcactatag

SEQ ID NO: 4708 - DNA, 18 bp, synthetic construct
  source 1..18: mol_type = other DNA
tcacatgactcactatag

SEQ ID NO: 4709 - DNA, 18 bp, synthetic construct
  source 1..18: mol_type = other DNA
tcatacgactccctgtag

SEQ ID NO: 4710 - DNA, 18 bp, synthetic construct
  source 1..18: mol_type = other DNA
ttacacgacgcactatag

SEQ ID NO: 4711 - DNA, 18 bp, synthetic construct
  source 1..18: mol_type = other DNA
ttatatgactcacgatag

SEQ ID NO: 4712 - DNA, 18 bp, synthetic construct
  source 1..18: mol_type = other DNA
aaatgggactcactatag

SEQ ID NO: 4713 - DNA, 18 bp, synthetic construct
  source 1..18: mol_type = other DNA
aactacgagtcactatag

SEQ ID NO: 4714 - DNA, 18 bp, synthetic construct
  source 1..18: mol_type = other DNA
aactaggactcactatag

SEQ ID NO: 4715 - DNA, 18 bp, synthetic construct
  source 1..18: mol_type = other DNA
caatacgactcacgttag

SEQ ID NO: 4716 - DNA, 18 bp, synthetic construct
  source 1..18: mol_type = other DNA
caatacgactgactgtag

SEQ ID NO: 4717 - DNA, 18 bp, synthetic construct
  source 1..18: mol_type = other DNA
caatacgacttactatcg

SEQ ID NO: 4718 - DNA, 18 bp, synthetic construct
  source 1..18: mol_type = other DNA
caatacgcctcactacag

SEQ ID NO: 4719 - DNA, 18 bp, synthetic construct
  source 1..18: mol_type = other DNA
caatccgcctcactatag

SEQ ID NO: 4720 - DNA, 18 bp, synthetic construct
  source 1..18: mol_type = other DNA
cagtaagactcactatag

SEQ ID NO: 4721 - DNA, 18 bp, synthetic construct
  source 1..18: mol_type = other DNA
gaagaagactcactatag

SEQ ID NO: 4722 - DNA, 18 bp, synthetic construct
  source 1..18: mol_type = other DNA
gaataaaactcactatag

SEQ ID NO: 4723 - DNA, 18 bp, synthetic construct
  source 1..18: mol_type = other DNA
gaatacgactcacaacag

SEQ ID NO: 4724 - DNA, 18 bp, synthetic construct
  source 1..18: mol_type = other DNA
gaatacgactcattacag

SEQ ID NO: 4725 - DNA, 18 bp, synthetic construct
  source 1..18: mol_type = other DNA
gaatatgacttactatag

SEQ ID NO: 4726 - DNA, 18 bp, synthetic construct
  source 1..18: mol_type = other DNA
gactacgaatcactatag

SEQ ID NO: 4727 - DNA, 18 bp, synthetic construct
  source 1..18: mol_type = other DNA
gagtacgacgcactatag

SEQ ID NO: 4728 - DNA, 18 bp, synthetic construct
  source 1..18: mol_type = other DNA
gtatacgactcactatgg

SEQ ID NO: 4729 - DNA, 18 bp, synthetic construct
  source 1..18: mol_type = other DNA
taaaacgagtcactatcg

SEQ ID NO: 4730 - DNA, 18 bp, synthetic construct
  source 1..18: mol_type = other DNA
taaatcgactcactagag

SEQ ID NO: 4731 - DNA, 18 bp, synthetic construct
  source 1..18: mol_type = other DNA
taacacgacgaactatag

SEQ ID NO: 4732 - DNA, 18 bp, synthetic construct
  source 1..18: mol_type = other DNA
taacacgccgcactatag

SEQ ID NO: 4733 - DNA, 18 bp, synthetic construct
  source 1..18: mol_type = other DNA
taacaggactcactgtag

SEQ ID NO: 4734 - DNA, 18 bp, synthetic construct
  source 1..18: mol_type = other DNA
taacaggagtcactatag

SEQ ID NO: 4735 - DNA, 18 bp, synthetic construct
  source 1..18: mol_type = other DNA
taacatgactcactatcg

SEQ ID NO: 4736 - DNA, 18 bp, synthetic construct
  source 1..18: mol_type = other DNA
taagacgactctctatcg

SEQ ID NO: 4737 - DNA, 18 bp, synthetic construct
  source 1..18: mol_type = other DNA
taataagactcactagcg

SEQ ID NO: 4738 - DNA, 18 bp, synthetic construct
  source 1..18: mol_type = other DNA
taataagactgactagag

SEQ ID NO: 4739 - DNA, 18 bp, synthetic construct
  source 1..18: mol_type = other DNA
taataagactgagtatag

SEQ ID NO: 4740 - DNA, 18 bp, synthetic construct
  source 1..18: mol_type = other DNA
taatacaacggactatag

SEQ ID NO: 4741 - DNA, 18 bp, synthetic construct
  source 1..18: mol_type = other DNA
taatacaactcacgacag

SEQ ID NO: 4742 - DNA, 18 bp, synthetic construct
  source 1..18: mol_type = other DNA
taatacaactgagtatag

SEQ ID NO: 4743 - DNA, 18 bp, synthetic construct
  source 1..18: mol_type = other DNA
taataccactcgctacag

SEQ ID NO: 4744 - DNA, 18 bp, synthetic construct
  source 1..18: mol_type = other DNA
taataccacttagtatag

SEQ ID NO: 4745 - DNA, 18 bp, synthetic construct
  source 1..18: mol_type = other DNA
taatacgaatcactagcg

SEQ ID NO: 4746 - DNA, 18 bp, synthetic construct
  source 1..18: mol_type = other DNA
taatacgaatccctgtag

SEQ ID NO: 4747 - DNA, 18 bp, synthetic construct
  source 1..18: mol_type = other DNA
taatacgacactctataa

SEQ ID NO: 4748 - DNA, 18 bp, synthetic construct
  source 1..18: mol_type = other DNA
taatacgacgcaacatag

SEQ ID NO: 4749 - DNA, 18 bp, synthetic construct
  source 1..18: mol_type = other DNA
taatacgacgcacgattg

SEQ ID NO: 4750 - DNA, 18 bp, synthetic construct
  source 1..18: mol_type = other DNA
taatacgactcagtaggg

SEQ ID NO: 4751 - DNA, 18 bp, synthetic construct
  source 1..18: mol_type = other DNA
taatacgactcccttcag

SEQ ID NO: 4752 - DNA, 18 bp, synthetic construct
  source 1..18: mol_type = other DNA
taatacgactctgtgtag

SEQ ID NO: 4753 - DNA, 18 bp, synthetic construct
  source 1..18: mol_type = other DNA
taatacgactgactcttg

SEQ ID NO: 4754 - DNA, 18 bp, synthetic construct
  source 1..18: mol_type = other DNA
taatacgactgattagag

SEQ ID NO: 4755 - DNA, 18 bp, synthetic construct
  source 1..18: mol_type = other DNA
taatacgacttactaggg

SEQ ID NO: 4756 - DNA, 18 bp, synthetic construct
  source 1..18: mol_type = other DNA
taatacgagccgctatag

SEQ ID NO: 4757 - DNA, 18 bp, synthetic construct
  source 1..18: mol_type = other DNA
taatacgagtcagtatgg

SEQ ID NO: 4758 - DNA, 18 bp, synthetic construct
  source 1..18: mol_type = other DNA
taatacgcctccctacag

SEQ ID NO: 4759 - DNA, 18 bp, synthetic construct
  source 1..18: mol_type = other DNA
taatacggcccactatcg

SEQ ID NO: 4760 - DNA, 18 bp, synthetic construct
  source 1..18: mol_type = other DNA
taatacggctcacaagag

SEQ ID NO: 4761 - DNA, 18 bp, synthetic construct
  source 1..18: mol_type = other DNA
taatacggctcagtattg

SEQ ID NO: 4762 - DNA, 18 bp, synthetic construct
  source 1..18: mol_type = other DNA
taatacggctgactatgg

SEQ ID NO: 4763 - DNA, 18 bp, synthetic construct
  source 1..18: mol_type = other DNA
taatactactcactgtac

SEQ ID NO: 4764 - DNA, 18 bp, synthetic construct
  source 1..18: mol_type = other DNA
taatactcctcactagag

SEQ ID NO: 4765 - DNA, 18 bp, synthetic construct
  source 1..18: mol_type = other DNA
taatagtactcactagag

SEQ ID NO: 4766 - DNA, 18 bp, synthetic construct
  source 1..18: mol_type = other DNA
taatatgactcacgacag

SEQ ID NO: 4767 - DNA, 18 bp, synthetic construct
  source 1..18: mol_type = other DNA
taatccgacgcactatcg

SEQ ID NO: 4768 - DNA, 18 bp, synthetic construct
  source 1..18: mol_type = other DNA
taatccgactcactaggg

SEQ ID NO: 4769 - DNA, 18 bp, synthetic construct
  source 1..18: mol_type = other DNA
taatccgtctcactagag

SEQ ID NO: 4770 - DNA, 18 bp, synthetic construct
  source 1..18: mol_type = other DNA
taatgagactcacgatag

SEQ ID NO: 4771 - DNA, 18 bp, synthetic construct
  source 1..18: mol_type = other DNA
tactacgcctcactgtag

SEQ ID NO: 4772 - DNA, 18 bp, synthetic construct
  source 1..18: mol_type = other DNA
tactacgccttactatag

SEQ ID NO: 4773 - DNA, 18 bp, synthetic construct
  source 1..18: mol_type = other DNA
tactacggctccctatag

SEQ ID NO: 4774 - DNA, 18 bp, synthetic construct
  source 1..18: mol_type = other DNA
tactagtactcactatag

SEQ ID NO: 4775 - DNA, 18 bp, synthetic construct
  source 1..18: mol_type = other DNA
tagcacgactcaccatag

SEQ ID NO: 4776 - DNA, 18 bp, synthetic construct
  source 1..18: mol_type = other DNA
tagtacgacacactagag

SEQ ID NO: 4777 - DNA, 18 bp, synthetic construct
  source 1..18: mol_type = other DNA
tagtacgcctcactatgg

SEQ ID NO: 4778 - DNA, 18 bp, synthetic construct
  source 1..18: mol_type = other DNA
tagtaggactccctatag

SEQ ID NO: 4779 - DNA, 18 bp, synthetic construct
  source 1..18: mol_type = other DNA
tagttcgactcactagag

SEQ ID NO: 4780 - DNA, 18 bp, synthetic construct
  source 1..18: mol_type = other DNA
tattacgactcagtacag

SEQ ID NO: 4781 - DNA, 18 bp, synthetic construct
  source 1..18: mol_type = other DNA
tattacgactcgctagag

SEQ ID NO: 4782 - DNA, 18 bp, synthetic construct
  source 1..18: mol_type = other DNA
tcagacgactcactgtag

SEQ ID NO: 4783 - DNA, 18 bp, synthetic construct
  source 1..18: mol_type = other DNA
tcatacgactcaccatcg

SEQ ID NO: 4784 - DNA, 18 bp, synthetic construct
  source 1..18: mol_type = other DNA
tcatacgactcacgattg

SEQ ID NO: 4785 - DNA, 18 bp, synthetic construct
  source 1..18: mol_type = other DNA
tcatacgactgattatag

SEQ ID NO: 4786 - DNA, 18 bp, synthetic construct
  source 1..18: mol_type = other DNA
tcatccgactcactagag

SEQ ID NO: 4787 - DNA, 18 bp, synthetic construct
  source 1..18: mol_type = other DNA
tcatccggctcactatag

SEQ ID NO: 4788 - DNA, 18 bp, synthetic construct
  source 1..18: mol_type = other DNA
tcctacgactcactacag

SEQ ID NO: 4789 - DNA, 18 bp, synthetic construct
  source 1..18: mol_type = other DNA
tcctacgactcactagag

SEQ ID NO: 4790 - DNA, 18 bp, synthetic construct
  source 1..18: mol_type = other DNA
tcggacgactcactatag

SEQ ID NO: 4791 - DNA, 18 bp, synthetic construct
  source 1..18: mol_type = other DNA
tcgtacgactcagtatag

SEQ ID NO: 4792 - DNA, 18 bp, synthetic construct
  source 1..18: mol_type = other DNA
tgatacgacccacaatag

SEQ ID NO: 4793 - DNA, 18 bp, synthetic construct
  source 1..18: mol_type = other DNA
tgatacgactcaatacag

SEQ ID NO: 4794 - DNA, 18 bp, synthetic construct
  source 1..18: mol_type = other DNA
tgatacgactgactctag

SEQ ID NO: 4795 - DNA, 18 bp, synthetic construct
  source 1..18: mol_type = other DNA
tgatacgatccactatag

SEQ ID NO: 4796 - DNA, 18 bp, synthetic construct
  source 1..18: mol_type = other DNA
tgatccgacacactatag

SEQ ID NO: 4797 - DNA, 18 bp, synthetic construct
  source 1..18: mol_type = other DNA
tgatgcgacttactatag

SEQ ID NO: 4798 - DNA, 18 bp, synthetic construct
  source 1..18: mol_type = other DNA
tgctacgactcactaaag

SEQ ID NO: 4799 - DNA, 18 bp, synthetic construct
  source 1..18: mol_type = other DNA
tggtacgactcactagag

SEQ ID NO: 4800 - DNA, 18 bp, synthetic construct
  source 1..18: mol_type = other DNA
taatacgacactctattg

SEQ ID NO: 4801 - DNA, 18 bp, synthetic construct
  source 1..18: mol_type = other DNA
atatacgactcactattg

SEQ ID NO: 4802 - DNA, 18 bp, synthetic construct
  source 1..18: mol_type = other DNA
caatacgactctctattg

SEQ ID NO: 4803 - DNA, 18 bp, synthetic construct
  source 1..18: mol_type = other DNA
taatacgcctcacattag

SEQ ID NO: 4804 - DNA, 18 bp, synthetic construct
  source 1..18: mol_type = other DNA
tattacgactcactaatg

SEQ ID NO: 4805 - DNA, 18 bp, synthetic construct
  source 1..18: mol_type = other DNA
aaatacgtctcactatcg

SEQ ID NO: 4806 - DNA, 18 bp, synthetic construct
  source 1..18: mol_type = other DNA
aaatacgtctcactgtag

SEQ ID NO: 4807 - DNA, 18 bp, synthetic construct
  source 1..18: mol_type = other DNA
taatacaactcgctttag

SEQ ID NO: 4808 - DNA, 18 bp, synthetic construct
  source 1..18: mol_type = other DNA
tattacgactcacttttg

SEQ ID NO: 4809 - DNA, 18 bp, synthetic construct
  source 1..18: mol_type = other DNA
ttatatgactcactctag

SEQ ID NO: 4810 - DNA, 18 bp, synthetic construct
  source 1..18: mol_type = other DNA
taattctacccactatag

SEQ ID NO: 4811 - DNA, 18 bp, synthetic construct
  source 1..18: mol_type = other DNA
aaatacgactcacttttg

SEQ ID NO: 4812 - DNA, 18 bp, synthetic construct
  source 1..18: mol_type = other DNA
tatttcgactcaccatag

SEQ ID NO: 4813 - DNA, 18 bp, synthetic construct
  source 1..18: mol_type = other DNA
taatacgactctctgttg

SEQ ID NO: 4814 - DNA, 18 bp, synthetic construct
  source 1..18: mol_type = other DNA
aaatacaactcactgtag

SEQ ID NO: 4815 - DNA, 18 bp, synthetic construct
  source 1..18: mol_type = other DNA
taatactactcacttttg

SEQ ID NO: 4816 - DNA, 18 bp, synthetic construct
  source 1..18: mol_type = other DNA
taatacgactcccttaag

SEQ ID NO: 4817 - DNA, 18 bp, synthetic construct
  source 1..18: mol_type = other DNA
aaatacgtctcagtatag

SEQ ID NO: 4818 - DNA, 18 bp, synthetic construct
  source 1..18: mol_type = other DNA
taaatccactcactatag

SEQ ID NO: 4819 - DNA, 18 bp, synthetic construct
  source 1..18: mol_type = other DNA
taataagactcaccaaag

SEQ ID NO: 4820 - DNA, 18 bp, synthetic construct
  source 1..18: mol_type = other DNA
taatacgactcactttta

SEQ ID NO: 4821 - DNA, 18 bp, synthetic construct
  source 1..18: mol_type = other DNA
taataggactcactgttg

SEQ ID NO: 4822 - DNA, 18 bp, synthetic construct
  source 1..18: mol_type = other DNA
taatatgactcgctaaag

SEQ ID NO: 4823 - DNA, 18 bp, synthetic construct
  source 1..18: mol_type = other DNA
tcatacgactgactattg

SEQ ID NO: 4824 - DNA, 18 bp, synthetic construct
  source 1..18: mol_type = other DNA
ttgtacgactcactgtag

SEQ ID NO: 4825 - DNA, 18 bp, synthetic construct
  source 1..18: mol_type = other DNA
tcttacgactcactttag

SEQ ID NO: 4826 - DNA, 18 bp, synthetic construct
  source 1..18: mol_type = other DNA
aaattggactcactatag

SEQ ID NO: 4827 - DNA, 18 bp, synthetic construct
  source 1..18: mol_type = other DNA
taataataatcactatag

SEQ ID NO: 4828 - DNA, 18 bp, synthetic construct
  source 1..18: mol_type = other DNA
taatacgtctcaatacag

SEQ ID NO: 4829 - DNA, 18 bp, synthetic construct
  source 1..18: mol_type = other DNA
acatacgactcactaaag

SEQ ID NO: 4830 - DNA, 18 bp, synthetic construct
  source 1..18: mol_type = other DNA
taataggactcacaaaag

SEQ ID NO: 4831 - DNA, 18 bp, synthetic construct
  source 1..18: mol_type = other DNA
taatatgacttactgtag

SEQ ID NO: 4832 - DNA, 18 bp, synthetic construct
  source 1..18: mol_type = other DNA
tactacatctcactatag

SEQ ID NO: 4833 - DNA, 18 bp, synthetic construct
  source 1..18: mol_type = other DNA
aaatacggctcagtatag

SEQ ID NO: 4834 - DNA, 18 bp, synthetic construct
  source 1..18: mol_type = other DNA
aactacgactcacaatag

SEQ ID NO: 4835 - DNA, 18 bp, synthetic construct
  source 1..18: mol_type = other DNA
cattacgagtcactatag

SEQ ID NO: 4836 - DNA, 18 bp, synthetic construct
  source 1..18: mol_type = other DNA
taacacgacacattatag

SEQ ID NO: 4837 - DNA, 18 bp, synthetic construct
  source 1..18: mol_type = other DNA
taatacaattcgctatag

SEQ ID NO: 4838 - DNA, 18 bp, synthetic construct
  source 1..18: mol_type = other DNA
taataccactcactcttg

SEQ ID NO: 4839 - DNA, 18 bp, synthetic construct
  source 1..18: mol_type = other DNA
taatacggctcattatcg

SEQ ID NO: 4840 - DNA, 18 bp, synthetic construct
  source 1..18: mol_type = other DNA
tactacgactctttatag

SEQ ID NO: 4841 - DNA, 18 bp, synthetic construct
  source 1..18: mol_type = other DNA
tactactaatcactatag

SEQ ID NO: 4842 - DNA, 18 bp, synthetic construct
  source 1..18: mol_type = other DNA
tattgcggctcactatag

SEQ ID NO: 4843 - DNA, 18 bp, synthetic construct
  source 1..18: mol_type = other DNA
taaagcgacacactatag

SEQ ID NO: 4844 - DNA, 18 bp, synthetic construct
  source 1..18: mol_type = other DNA
taattcgactctctatcg

SEQ ID NO: 4845 - DNA, 18 bp, synthetic construct
  source 1..18: mol_type = other DNA
tagtacgtctcacaatag

SEQ ID NO: 4846 - DNA, 18 bp, synthetic construct
  source 1..18: mol_type = other DNA
caatacgactcagtaaag

SEQ ID NO: 4847 - DNA, 18 bp, synthetic construct
  source 1..18: mol_type = other DNA
taatacgactcaacattg

SEQ ID NO: 4848 - DNA, 18 bp, synthetic construct
  source 1..18: mol_type = other DNA
taatacgtctcactgtcg

SEQ ID NO: 4849 - DNA, 18 bp, synthetic construct
  source 1..18: mol_type = other DNA
ttttacgactcactatgg

SEQ ID NO: 4850 - DNA, 18 bp, synthetic construct
  source 1..18: mol_type = other DNA
ttatacgactctctaaag

SEQ ID NO: 4851 - DNA, 18 bp, synthetic construct
  source 1..18: mol_type = other DNA
tattacgactcgctttag

SEQ ID NO: 4852 - DNA, 18 bp, synthetic construct
  source 1..18: mol_type = other DNA
aaatacgacgcactgtag

SEQ ID NO: 4853 - DNA, 18 bp, synthetic construct
  source 1..18: mol_type = other DNA
taatgcgacttactaaag

SEQ ID NO: 4854 - DNA, 18 bp, synthetic construct
  source 1..18: mol_type = other DNA
tgatacgactcattattg

SEQ ID NO: 4855 - DNA, 18 bp, synthetic construct
  source 1..18: mol_type = other DNA
ttataccactcactctag

SEQ ID NO: 4856 - DNA, 18 bp, synthetic construct
  source 1..18: mol_type = other DNA
ttatgcgactaactatag

SEQ ID NO: 4857 - DNA, 18 bp, synthetic construct
  source 1..18: mol_type = other DNA
aaatacgactcaccctag

SEQ ID NO: 4858 - DNA, 18 bp, synthetic construct
  source 1..18: mol_type = other DNA
aaatacgcctaactatag

SEQ ID NO: 4859 - DNA, 18 bp, synthetic construct
  source 1..18: mol_type = other DNA
aaatatgactccctatag

SEQ ID NO: 4860 - DNA, 18 bp, synthetic construct
  source 1..18: mol_type = other DNA
aaatccgactaactatag

SEQ ID NO: 4861 - DNA, 18 bp, synthetic construct
  source 1..18: mol_type = other DNA
caacacgactccctatag

SEQ ID NO: 4862 - DNA, 18 bp, synthetic construct
  source 1..18: mol_type = other DNA
caatacgactcactttgg

SEQ ID NO: 4863 - DNA, 18 bp, synthetic construct
  source 1..18: mol_type = other DNA
gaatacgactcgctttag

SEQ ID NO: 4864 - DNA, 18 bp, synthetic construct
  source 1..18: mol_type = other DNA
gaatacgtctcaatatag

SEQ ID NO: 4865 - DNA, 18 bp, synthetic construct
  source 1..18: mol_type = other DNA
taacacccctcactatag

SEQ ID NO: 4866 - DNA, 18 bp, synthetic construct
  source 1..18: mol_type = other DNA
taagacgattcacaatag

SEQ ID NO: 4867 - DNA, 18 bp, synthetic construct
  source 1..18: mol_type = other DNA
taatacaactaactatgg

SEQ ID NO: 4868 - DNA, 18 bp, synthetic construct
  source 1..18: mol_type = other DNA
taatacaactcgctgtag

SEQ ID NO: 4869 - DNA, 18 bp, synthetic construct
  source 1..18: mol_type = other DNA
taatacaactgactacag

SEQ ID NO: 4870 - DNA, 18 bp, synthetic construct
  source 1..18: mol_type = other DNA
taataccgctcaccatag

SEQ ID NO: 4871 - DNA, 18 bp, synthetic construct
  source 1..18: mol_type = other DNA
taatacgactcttgatag

SEQ ID NO: 4872 - DNA, 18 bp, synthetic construct
  source 1..18: mol_type = other DNA
taatacgactgcatatag

SEQ ID NO: 4873 - DNA, 18 bp, synthetic construct
  source 1..18: mol_type = other DNA
taatactacccactacag

SEQ ID NO: 4874 - DNA, 18 bp, synthetic construct
  source 1..18: mol_type = other DNA
taatactcctcactgtag

SEQ ID NO: 4875 - DNA, 18 bp, synthetic construct
  source 1..18: mol_type = other DNA
taataggaatcactctag

SEQ ID NO: 4876 - DNA, 18 bp, synthetic construct
  source 1..18: mol_type = other DNA
taatcagactcactatcg

SEQ ID NO: 4877 - DNA, 18 bp, synthetic construct
  source 1..18: mol_type = other DNA
taatccgactaaatatag

SEQ ID NO: 4878 - DNA, 18 bp, synthetic construct
  source 1..18: mol_type = other DNA
taatccgactgactttag

SEQ ID NO: 4879 - DNA, 18 bp, synthetic construct
  source 1..18: mol_type = other DNA
taatgagactcagtatag

SEQ ID NO: 4880 - DNA, 18 bp, synthetic construct
  source 1..18: mol_type = other DNA
tagtacgactcggtatag

SEQ ID NO: 4881 - DNA, 18 bp, synthetic construct
  source 1..18: mol_type = other DNA
ttaggcgactcactatag

SEQ ID NO: 4882 - DNA, 18 bp, synthetic construct
  source 1..18: mol_type = other DNA
tatttcgactcactaaag

SEQ ID NO: 4883 - DNA, 18 bp, synthetic construct
  source 1..18: mol_type = other DNA
taatacaactctctacag

SEQ ID NO: 4884 - DNA, 18 bp, synthetic construct
  source 1..18: mol_type = other DNA
ttatacgcctcacaatag

SEQ ID NO: 4885 - DNA, 18 bp, synthetic construct
  source 1..18: mol_type = other DNA
taattcgactcagtacag

SEQ ID NO: 4886 - DNA, 18 bp, synthetic construct
  source 1..18: mol_type = other DNA
tcatacgactaaccatag

SEQ ID NO: 4887 - DNA, 18 bp, synthetic construct
  source 1..18: mol_type = other DNA
taattcgtctcactgtag

SEQ ID NO: 4888 - DNA, 18 bp, synthetic construct
  source 1..18: mol_type = other DNA
ttatacgactctctattg

SEQ ID NO: 4889 - DNA, 18 bp, synthetic construct
  source 1..18: mol_type = other DNA
ttttacgactcactattg

SEQ ID NO: 4890 - DNA, 18 bp, synthetic construct
  source 1..18: mol_type = other DNA
taacacaactcactattg

SEQ ID NO: 4891 - DNA, 18 bp, synthetic construct
  source 1..18: mol_type = other DNA
taatacgagactctatag

SEQ ID NO: 4892 - DNA, 18 bp, synthetic construct
  source 1..18: mol_type = other DNA
caacacaactcactatag

SEQ ID NO: 4893 - DNA, 18 bp, synthetic construct
  source 1..18: mol_type = other DNA
taacacgactcaatatcg

SEQ ID NO: 4894 - DNA, 18 bp, synthetic construct
  source 1..18: mol_type = other DNA
taacatgactcattatag

SEQ ID NO: 4895 - DNA, 18 bp, synthetic construct
  source 1..18: mol_type = other DNA
taataagaatcactctag

SEQ ID NO: 4896 - DNA, 18 bp, synthetic construct
  source 1..18: mol_type = other DNA
taatacgattaactatcg

SEQ ID NO: 4897 - DNA, 18 bp, synthetic construct
  source 1..18: mol_type = other DNA
taatagaaatcactatag

SEQ ID NO: 4898 - DNA, 18 bp, synthetic construct
  source 1..18: mol_type = other DNA
taatatgactcgccatag

SEQ ID NO: 4899 - DNA, 18 bp, synthetic construct
  source 1..18: mol_type = other DNA
taatatgcatcactatag

SEQ ID NO: 4900 - DNA, 18 bp, synthetic construct
  source 1..18: mol_type = other DNA
taatatgcctcactatcg

SEQ ID NO: 4901 - DNA, 18 bp, synthetic construct
  source 1..18: mol_type = other DNA
tagtacgacacaatatag

SEQ ID NO: 4902 - DNA, 18 bp, synthetic construct
  source 1..18: mol_type = other DNA
tagtacgactctctatgg

SEQ ID NO: 4903 - DNA, 18 bp, synthetic construct
  source 1..18: mol_type = other DNA
tgattggactcactatag

SEQ ID NO: 4904 - DNA, 18 bp, synthetic construct
  source 1..18: mol_type = other DNA
aaatacgactaactttag

SEQ ID NO: 4905 - DNA, 18 bp, synthetic construct
  source 1..18: mol_type = other DNA
ttaaacgactcagtatag

SEQ ID NO: 4906 - DNA, 18 bp, synthetic construct
  source 1..18: mol_type = other DNA
taactcgtctcactatag

SEQ ID NO: 4907 - DNA, 18 bp, synthetic construct
  source 1..18: mol_type = other DNA
taatacgtatctctatag

SEQ ID NO: 4908 - DNA, 18 bp, synthetic construct
  source 1..18: mol_type = other DNA
aaatacgacttactctag

SEQ ID NO: 4909 - DNA, 18 bp, synthetic construct
  source 1..18: mol_type = other DNA
aattccgactcactatag

SEQ ID NO: 4910 - DNA, 18 bp, synthetic construct
  source 1..18: mol_type = other DNA
caataagactcacaatag

SEQ ID NO: 4911 - DNA, 18 bp, synthetic construct
  source 1..18: mol_type = other DNA
taataagactcactcaag

SEQ ID NO: 4912 - DNA, 18 bp, synthetic construct
  source 1..18: mol_type = other DNA
taatacgacccactttgg

SEQ ID NO: 4913 - DNA, 18 bp, synthetic construct
  source 1..18: mol_type = other DNA
taatacgtctcgctgtag

SEQ ID NO: 4914 - DNA, 18 bp, synthetic construct
  source 1..18: mol_type = other DNA
tattacgactcacttaag

SEQ ID NO: 4915 - DNA, 18 bp, synthetic construct
  source 1..18: mol_type = other DNA
aaataagactcactatcg

SEQ ID NO: 4916 - DNA, 18 bp, synthetic construct
  source 1..18: mol_type = other DNA
taaaacgactcgatatag

SEQ ID NO: 4917 - DNA, 18 bp, synthetic construct
  source 1..18: mol_type = other DNA
taatacgactcagcattg

SEQ ID NO: 4918 - DNA, 18 bp, synthetic construct
  source 1..18: mol_type = other DNA
taattcgacacactatcg

SEQ ID NO: 4919 - DNA, 18 bp, synthetic construct
  source 1..18: mol_type = other DNA
taattccattcactatag

SEQ ID NO: 4920 - DNA, 18 bp, synthetic construct
  source 1..18: mol_type = other DNA
taatacgacagactattg

SEQ ID NO: 4921 - DNA, 18 bp, synthetic construct
  source 1..18: mol_type = other DNA
taaaaggtctcactatag

SEQ ID NO: 4922 - DNA, 18 bp, synthetic construct
  source 1..18: mol_type = other DNA
taatccaactcactttag

SEQ ID NO: 4923 - DNA, 18 bp, synthetic construct
  source 1..18: mol_type = other DNA
tgatacgactcactaatg

SEQ ID NO: 4924 - DNA, 18 bp, synthetic construct
  source 1..18: mol_type = other DNA
taatacaactctctttag

SEQ ID NO: 4925 - DNA, 18 bp, synthetic construct
  source 1..18: mol_type = other DNA
taatatgactcactcaag

SEQ ID NO: 4926 - DNA, 18 bp, synthetic construct
  source 1..18: mol_type = other DNA
taatacgactgtctattg

SEQ ID NO: 4927 - DNA, 18 bp, synthetic construct
  source 1..18: mol_type = other DNA
tcatacgactcaccattg

SEQ ID NO: 4928 - DNA, 18 bp, synthetic construct
  source 1..18: mol_type = other DNA
taatacgacacaacatag

SEQ ID NO: 4929 - DNA, 18 bp, synthetic construct
  source 1..18: mol_type = other DNA
taatagagctcactatag

SEQ ID NO: 4930 - DNA, 18 bp, synthetic construct
  source 1..18: mol_type = other DNA
taatatgactcactttgg

SEQ ID NO: 4931 - DNA, 18 bp, synthetic construct
  source 1..18: mol_type = other DNA
caatacgatgcactatag

SEQ ID NO: 4932 - DNA, 18 bp, synthetic construct
  source 1..18: mol_type = other DNA
taaaacgactcactctcg

SEQ ID NO: 4933 - DNA, 18 bp, synthetic construct
  source 1..18: mol_type = other DNA
taatacaactgactaaag

SEQ ID NO: 4934 - DNA, 18 bp, synthetic construct
  source 1..18: mol_type = other DNA
taatacgacacactgtcg

SEQ ID NO: 4935 - DNA, 18 bp, synthetic construct
  source 1..18: mol_type = other DNA
taatacgtctccctacag

SEQ ID NO: 4936 - DNA, 18 bp, synthetic construct
  source 1..18: mol_type = other DNA
taatataactcactatcg

SEQ ID NO: 4937 - DNA, 18 bp, synthetic construct
  source 1..18: mol_type = other DNA
taattcgacacgctatag

SEQ ID NO: 4938 - DNA, 18 bp, synthetic construct
  source 1..18: mol_type = other DNA
taattcgactcaccagag

SEQ ID NO: 4939 - DNA, 18 bp, synthetic construct
  source 1..18: mol_type = other DNA
taattcgactccctgtag

SEQ ID NO: 4940 - DNA, 18 bp, synthetic construct
  source 1..18: mol_type = other DNA
tattacgagtcactatcg

SEQ ID NO: 4941 - DNA, 18 bp, synthetic construct
  source 1..18: mol_type = other DNA
tgataccactcattatag

SEQ ID NO: 4942 - DNA, 18 bp, synthetic construct
  source 1..18: mol_type = other DNA
tgtcacgactcactatag

SEQ ID NO: 4943 - DNA, 18 bp, synthetic construct
  source 1..18: mol_type = other DNA
ttatatgactcactagag

SEQ ID NO: 4944 - DNA, 18 bp, synthetic construct
  source 1..18: mol_type = other DNA
taatacgtctcactgtgg

SEQ ID NO: 4945 - DNA, 18 bp, synthetic construct
  source 1..18: mol_type = other DNA
taattcgactggctatag

SEQ ID NO: 4946 - DNA, 18 bp, synthetic construct
  source 1..18: mol_type = other DNA
tactgcgactctctatag

SEQ ID NO: 4947 - DNA, 18 bp, synthetic construct
  source 1..18: mol_type = other DNA
tagtacgagtcacaatag

SEQ ID NO: 4948 - DNA, 18 bp, synthetic construct
  source 1..18: mol_type = other DNA
aaatacgagtcattatag

SEQ ID NO: 4949 - DNA, 18 bp, synthetic construct
  source 1..18: mol_type = other DNA
aaataggactcagtatag

SEQ ID NO: 4950 - DNA, 18 bp, synthetic construct
  source 1..18: mol_type = other DNA
cgaaacgactcactatag

SEQ ID NO: 4951 - DNA, 18 bp, synthetic construct
  source 1..18: mol_type = other DNA
gaaaacgacacactatag

SEQ ID NO: 4952 - DNA, 18 bp, synthetic construct
  source 1..18: mol_type = other DNA
gaatatgactctctatag

SEQ ID NO: 4953 - DNA, 18 bp, synthetic construct
  source 1..18: mol_type = other DNA
gattatgactcactatag

SEQ ID NO: 4954 - DNA, 18 bp, synthetic construct
  source 1..18: mol_type = other DNA
taaaacgactcactgtcg

SEQ ID NO: 4955 - DNA, 18 bp, synthetic construct
  source 1..18: mol_type = other DNA
taaaacgactcagtatgg

SEQ ID NO: 4956 - DNA, 18 bp, synthetic construct
  source 1..18: mol_type = other DNA
taaaacggctcactacag

SEQ ID NO: 4957 - DNA, 18 bp, synthetic construct
  source 1..18: mol_type = other DNA
taataagacccactatcg

SEQ ID NO: 4958 - DNA, 18 bp, synthetic construct
  source 1..18: mol_type = other DNA
taatacgacagattatag

SEQ ID NO: 4959 - DNA, 18 bp, synthetic construct
  source 1..18: mol_type = other DNA
taatacgatgcattatag

SEQ ID NO: 4960 - DNA, 18 bp, synthetic construct
  source 1..18: mol_type = other DNA
taatacgattcgctacag

SEQ ID NO: 4961 - DNA, 18 bp, synthetic construct
  source 1..18: mol_type = other DNA
taatacggctcgcaatag

SEQ ID NO: 4962 - DNA, 18 bp, synthetic construct
  source 1..18: mol_type = other DNA
taatacgtctaacgatag

SEQ ID NO: 4963 - DNA, 18 bp, synthetic construct
  source 1..18: mol_type = other DNA
taataggactcaatttag

SEQ ID NO: 4964 - DNA, 18 bp, synthetic construct
  source 1..18: mol_type = other DNA
taataggcctcactttag

SEQ ID NO: 4965 - DNA, 18 bp, synthetic construct
  source 1..18: mol_type = other DNA
taatccgactcagtctag

SEQ ID NO: 4966 - DNA, 18 bp, synthetic construct
  source 1..18: mol_type = other DNA
taatgcgactcataatag

SEQ ID NO: 4967 - DNA, 18 bp, synthetic construct
  source 1..18: mol_type = other DNA
taatgcgacttaccatag

SEQ ID NO: 4968 - DNA, 18 bp, synthetic construct
  source 1..18: mol_type = other DNA
taatgcgccacactatag

SEQ ID NO: 4969 - DNA, 18 bp, synthetic construct
  source 1..18: mol_type = other DNA
tactacgagtcactattg

SEQ ID NO: 4970 - DNA, 18 bp, synthetic construct
  source 1..18: mol_type = other DNA
tactacgtctcactagag

SEQ ID NO: 4971 - DNA, 18 bp, synthetic construct
  source 1..18: mol_type = other DNA
tagtatgactcactatgg

SEQ ID NO: 4972 - DNA, 18 bp, synthetic construct
  source 1..18: mol_type = other DNA
tattatgactcacgatag

SEQ ID NO: 4973 - DNA, 18 bp, synthetic construct
  source 1..18: mol_type = other DNA
tcacacgacacactatag

SEQ ID NO: 4974 - DNA, 18 bp, synthetic construct
  source 1..18: mol_type = other DNA
tcatacgactgactacag

SEQ ID NO: 4975 - DNA, 18 bp, synthetic construct
  source 1..18: mol_type = other DNA
tcctacgacacactatag

SEQ ID NO: 4976 - DNA, 18 bp, synthetic construct
  source 1..18: mol_type = other DNA
tctgacgactcactatag

SEQ ID NO: 4977 - DNA, 18 bp, synthetic construct
  source 1..18: mol_type = other DNA
aaatacgaatcactatgg

SEQ ID NO: 4978 - DNA, 18 bp, synthetic construct
  source 1..18: mol_type = other DNA
aaatccgactccctatag

SEQ ID NO: 4979 - DNA, 18 bp, synthetic construct
  source 1..18: mol_type = other DNA
aagtacgactcactatcg

SEQ ID NO: 4980 - DNA, 18 bp, synthetic construct
  source 1..18: mol_type = other DNA
agatacgactcactctag

SEQ ID NO: 4981 - DNA, 18 bp, synthetic construct
  source 1..18: mol_type = other DNA
caagacgactcactctag

SEQ ID NO: 4982 - DNA, 18 bp, synthetic construct
  source 1..18: mol_type = other DNA
caataccactcactagag

SEQ ID NO: 4983 - DNA, 18 bp, synthetic construct
  source 1..18: mol_type = other DNA
caatacgaatcactctag

SEQ ID NO: 4984 - DNA, 18 bp, synthetic construct
  source 1..18: mol_type = other DNA
caatacgactcaatatgg

SEQ ID NO: 4985 - DNA, 18 bp, synthetic construct
  source 1..18: mol_type = other DNA
caatacgactcacttgag

SEQ ID NO: 4986 - DNA, 18 bp, synthetic construct
  source 1..18: mol_type = other DNA
caatatgactcactgtag

SEQ ID NO: 4987 - DNA, 18 bp, synthetic construct
  source 1..18: mol_type = other DNA
gaatacgaaacactatag

SEQ ID NO: 4988 - DNA, 18 bp, synthetic construct
  source 1..18: mol_type = other DNA
gaatacggctcactttag

SEQ ID NO: 4989 - DNA, 18 bp, synthetic construct
  source 1..18: mol_type = other DNA
gactacgactaactatag

SEQ ID NO: 4990 - DNA, 18 bp, synthetic construct
  source 1..18: mol_type = other DNA
taaaacgacccactagag

SEQ ID NO: 4991 - DNA, 18 bp, synthetic construct
  source 1..18: mol_type = other DNA
taaaacgactcactcgag

SEQ ID NO: 4992 - DNA, 18 bp, synthetic construct
  source 1..18: mol_type = other DNA
taacacgactccctacag

SEQ ID NO: 4993 - DNA, 18 bp, synthetic construct
  source 1..18: mol_type = other DNA
taacacgactccctgtag

SEQ ID NO: 4994 - DNA, 18 bp, synthetic construct
  source 1..18: mol_type = other DNA
taagacaactcaccatag

SEQ ID NO: 4995 - DNA, 18 bp, synthetic construct
  source 1..18: mol_type = other DNA
taagacgacatactatag

SEQ ID NO: 4996 - DNA, 18 bp, synthetic construct
  source 1..18: mol_type = other DNA
taagacgactaaatatag

SEQ ID NO: 4997 - DNA, 18 bp, synthetic construct
  source 1..18: mol_type = other DNA
taataagacgcattatag

SEQ ID NO: 4998 - DNA, 18 bp, synthetic construct
  source 1..18: mol_type = other DNA
taataagactcagtatcg

SEQ ID NO: 4999 - DNA, 18 bp, synthetic construct
  source 1..18: mol_type = other DNA
taataaggctgactatag

SEQ ID NO: 5000 - DNA, 18 bp, synthetic construct
  source 1..18: mol_type = other DNA
taataagtctcactataa

SEQ ID NO: 5001 - DNA, 18 bp, synthetic construct
  source 1..18: mol_type = other DNA
taatacaagtcactagag

SEQ ID NO: 5002 - DNA, 18 bp, synthetic construct
  source 1..18: mol_type = other DNA
taatacacgtcactatag

SEQ ID NO: 5003 - DNA, 18 bp, synthetic construct
  source 1..18: mol_type = other DNA
taataccactcacgatgg

SEQ ID NO: 5004 - DNA, 18 bp, synthetic construct
  source 1..18: mol_type = other DNA
taataccactcgctctag

SEQ ID NO: 5005 - DNA, 18 bp, synthetic construct
  source 1..18: mol_type = other DNA
taataccagtcactatgg

SEQ ID NO: 5006 - DNA, 18 bp, synthetic construct
  source 1..18: mol_type = other DNA
taataccgcgcactatag

SEQ ID NO: 5007 - DNA, 18 bp, synthetic construct
  source 1..18: mol_type = other DNA
taataccgctcactctag

SEQ ID NO: 5008 - DNA, 18 bp, synthetic construct
  source 1..18: mol_type = other DNA
taataccggtcactatag

SEQ ID NO: 5009 - DNA, 18 bp, synthetic construct
  source 1..18: mol_type = other DNA
taatacgaatcacgatcg

SEQ ID NO: 5010 - DNA, 18 bp, synthetic construct
  source 1..18: mol_type = other DNA
taatacgaattacgatag

SEQ ID NO: 5011 - DNA, 18 bp, synthetic construct
  source 1..18: mol_type = other DNA
taatacgacacactatta

SEQ ID NO: 5012 - DNA, 18 bp, synthetic construct
  source 1..18: mol_type = other DNA
taatacgacatactataa

SEQ ID NO: 5013 - DNA, 18 bp, synthetic construct
  source 1..18: mol_type = other DNA
taatacgacccaatatgg

SEQ ID NO: 5014 - DNA, 18 bp, synthetic construct
  source 1..18: mol_type = other DNA
taatacgactcaattgag

SEQ ID NO: 5015 - DNA, 18 bp, synthetic construct
  source 1..18: mol_type = other DNA
taatacgactgactgaag

SEQ ID NO: 5016 - DNA, 18 bp, synthetic construct
  source 1..18: mol_type = other DNA
taatacgacttggtatag

SEQ ID NO: 5017 - DNA, 18 bp, synthetic construct
  source 1..18: mol_type = other DNA
taatacgaggcgctatag

SEQ ID NO: 5018 - DNA, 18 bp, synthetic construct
  source 1..18: mol_type = other DNA
taatacgagtcagtacag

SEQ ID NO: 5019 - DNA, 18 bp, synthetic construct
  source 1..18: mol_type = other DNA
taatacgagtcgatatag

SEQ ID NO: 5020 - DNA, 18 bp, synthetic construct
  source 1..18: mol_type = other DNA
taatacgcatcgctatag

SEQ ID NO: 5021 - DNA, 18 bp, synthetic construct
  source 1..18: mol_type = other DNA
taatacgcctcattatgg

SEQ ID NO: 5022 - DNA, 18 bp, synthetic construct
  source 1..18: mol_type = other DNA
taatacgcctcgctagag

SEQ ID NO: 5023 - DNA, 18 bp, synthetic construct
  source 1..18: mol_type = other DNA
taatacggttcactagag

SEQ ID NO: 5024 - DNA, 18 bp, synthetic construct
  source 1..18: mol_type = other DNA
taatacggttccctatag

SEQ ID NO: 5025 - DNA, 18 bp, synthetic construct
  source 1..18: mol_type = other DNA
taatacgtctaactagag

SEQ ID NO: 5026 - DNA, 18 bp, synthetic construct
  source 1..18: mol_type = other DNA
taatactacgccctatag

SEQ ID NO: 5027 - DNA, 18 bp, synthetic construct
  source 1..18: mol_type = other DNA
taatactactcactaggg

SEQ ID NO: 5028 - DNA, 18 bp, synthetic construct
  source 1..18: mol_type = other DNA
taatactccccactatag

SEQ ID NO: 5029 - DNA, 18 bp, synthetic construct
  source 1..18: mol_type = other DNA
taataggacccgctatag

SEQ ID NO: 5030 - DNA, 18 bp, synthetic construct
  source 1..18: mol_type = other DNA
taataggactcactacgg

SEQ ID NO: 5031 - DNA, 18 bp, synthetic construct
  source 1..18: mol_type = other DNA
taataggactcactgcag

SEQ ID NO: 5032 - DNA, 18 bp, synthetic construct
  source 1..18: mol_type = other DNA
taataggactcattctag

SEQ ID NO: 5033 - DNA, 18 bp, synthetic construct
  source 1..18: mol_type = other DNA
taatataactgactatag

SEQ ID NO: 5034 - DNA, 18 bp, synthetic construct
  source 1..18: mol_type = other DNA
taatatcactcactagag

SEQ ID NO: 5035 - DNA, 18 bp, synthetic construct
  source 1..18: mol_type = other DNA
taatatgcctgactatag

SEQ ID NO: 5036 - DNA, 18 bp, synthetic construct
  source 1..18: mol_type = other DNA
taatcgtactcactatag

SEQ ID NO: 5037 - DNA, 18 bp, synthetic construct
  source 1..18: mol_type = other DNA
taatgccactcgctatag

SEQ ID NO: 5038 - DNA, 18 bp, synthetic construct
  source 1..18: mol_type = other DNA
taatgcgacgcactaaag

SEQ ID NO: 5039 - DNA, 18 bp, synthetic construct
  source 1..18: mol_type = other DNA
taatgcgactaactatgg

SEQ ID NO: 5040 - DNA, 18 bp, synthetic construct
  source 1..18: mol_type = other DNA
taatgtggctcactatag

SEQ ID NO: 5041 - DNA, 18 bp, synthetic construct
  source 1..18: mol_type = other DNA
tacaacgactcactatgg

SEQ ID NO: 5042 - DNA, 18 bp, synthetic construct
  source 1..18: mol_type = other DNA
tacgacgattcactatag

SEQ ID NO: 5043 - DNA, 18 bp, synthetic construct
  source 1..18: mol_type = other DNA
tactacgaatcactgtag

SEQ ID NO: 5044 - DNA, 18 bp, synthetic construct
  source 1..18: mol_type = other DNA
tactacgactctgtatag

SEQ ID NO: 5045 - DNA, 18 bp, synthetic construct
  source 1..18: mol_type = other DNA
tactacggttcactatag

SEQ ID NO: 5046 - DNA, 18 bp, synthetic construct
  source 1..18: mol_type = other DNA
tagtaccactcactagag

SEQ ID NO: 5047 - DNA, 18 bp, synthetic construct
  source 1..18: mol_type = other DNA
tagtacgactctctagag

SEQ ID NO: 5048 - DNA, 18 bp, synthetic construct
  source 1..18: mol_type = other DNA
tagtacgactgacgatag

SEQ ID NO: 5049 - DNA, 18 bp, synthetic construct
  source 1..18: mol_type = other DNA
tagtacggctgactatag

SEQ ID NO: 5050 - DNA, 18 bp, synthetic construct
  source 1..18: mol_type = other DNA
tagtaggactcaatatag

SEQ ID NO: 5051 - DNA, 18 bp, synthetic construct
  source 1..18: mol_type = other DNA
tagttcgactcaccatag

SEQ ID NO: 5052 - DNA, 18 bp, synthetic construct
  source 1..18: mol_type = other DNA
tcataagaatcactatag

SEQ ID NO: 5053 - DNA, 18 bp, synthetic construct
  source 1..18: mol_type = other DNA
tcatacgacacaccatag

SEQ ID NO: 5054 - DNA, 18 bp, synthetic construct
  source 1..18: mol_type = other DNA
tcatacgactcagtctag

SEQ ID NO: 5055 - DNA, 18 bp, synthetic construct
  source 1..18: mol_type = other DNA
tcatacgcctcgctatag

SEQ ID NO: 5056 - DNA, 18 bp, synthetic construct
  source 1..18: mol_type = other DNA
tcctactactcactatag

SEQ ID NO: 5057 - DNA, 18 bp, synthetic construct
  source 1..18: mol_type = other DNA
tgacacggctcactatag

SEQ ID NO: 5058 - DNA, 18 bp, synthetic construct
  source 1..18: mol_type = other DNA
tgataccactcactctag

SEQ ID NO: 5059 - DNA, 18 bp, synthetic construct
  source 1..18: mol_type = other DNA
tgatacgaatcgctatag

SEQ ID NO: 5060 - DNA, 18 bp, synthetic construct
  source 1..18: mol_type = other DNA
tgatacgactcaccattg

SEQ ID NO: 5061 - DNA, 18 bp, synthetic construct
  source 1..18: mol_type = other DNA
tgatacgcctcactacag

SEQ ID NO: 5062 - DNA, 18 bp, synthetic construct
  source 1..18: mol_type = other DNA
tgatagcactcactatag

SEQ ID NO: 5063 - DNA, 18 bp, synthetic construct
  source 1..18: mol_type = other DNA
caatacgacacactattg

SEQ ID NO: 5064 - DNA, 18 bp, synthetic construct
  source 1..18: mol_type = other DNA
aaataagactcactttag

SEQ ID NO: 5065 - DNA, 18 bp, synthetic construct
  source 1..18: mol_type = other DNA
taatacatctcactacag

SEQ ID NO: 5066 - DNA, 18 bp, synthetic construct
  source 1..18: mol_type = other DNA
caaaacaactcactatag

SEQ ID NO: 5067 - DNA, 18 bp, synthetic construct
  source 1..18: mol_type = other DNA
taatgcgactcaatttag

SEQ ID NO: 5068 - DNA, 18 bp, synthetic construct
  source 1..18: mol_type = other DNA
taatacgactcagttaag

SEQ ID NO: 5069 - DNA, 18 bp, synthetic construct
  source 1..18: mol_type = other DNA
taatacgacccatcatag

SEQ ID NO: 5070 - DNA, 18 bp, synthetic construct
  source 1..18: mol_type = other DNA
taaaacggctcactttag

SEQ ID NO: 5071 - DNA, 18 bp, synthetic construct
  source 1..18: mol_type = other DNA
caatacgactcaccattg

SEQ ID NO: 5072 - DNA, 18 bp, synthetic construct
  source 1..18: mol_type = other DNA
gaatacgactcactaatg

SEQ ID NO: 5073 - DNA, 18 bp, synthetic construct
  source 1..18: mol_type = other DNA
taatatgactcactgaag

SEQ ID NO: 5074 - DNA, 18 bp, synthetic construct
  source 1..18: mol_type = other DNA
taatccaactcactctag

SEQ ID NO: 5075 - DNA, 18 bp, synthetic construct
  source 1..18: mol_type = other DNA
tagttcgattcactatag

SEQ ID NO: 5076 - DNA, 18 bp, synthetic construct
  source 1..18: mol_type = other DNA
tcatacgtctcactatcg

SEQ ID NO: 5077 - DNA, 18 bp, synthetic construct
  source 1..18: mol_type = other DNA
tgaaacgactcactttag

SEQ ID NO: 5078 - DNA, 18 bp, synthetic construct
  source 1..18: mol_type = other DNA
caatacgtctcactattg

SEQ ID NO: 5079 - DNA, 18 bp, synthetic construct
  source 1..18: mol_type = other DNA
ttatacggctcactaaag

SEQ ID NO: 5080 - DNA, 18 bp, synthetic construct
  source 1..18: mol_type = other DNA
taacacgactcacaattg

SEQ ID NO: 5081 - DNA, 18 bp, synthetic construct
  source 1..18: mol_type = other DNA
caatacgcctcactctag

SEQ ID NO: 5082 - DNA, 18 bp, synthetic construct
  source 1..18: mol_type = other DNA
cattacgactcactatgg

SEQ ID NO: 5083 - DNA, 18 bp, synthetic construct
  source 1..18: mol_type = other DNA
taataccactacctatag

SEQ ID NO: 5084 - DNA, 18 bp, synthetic construct
  source 1..18: mol_type = other DNA
taattcgaatcactagag

SEQ ID NO: 5085 - DNA, 18 bp, synthetic construct
  source 1..18: mol_type = other DNA
tactacgattcactctag

SEQ ID NO: 5086 - DNA, 18 bp, synthetic construct
  source 1..18: mol_type = other DNA
tcctaggactcactatag

SEQ ID NO: 5087 - DNA, 18 bp, synthetic construct
  source 1..18: mol_type = other DNA
tgattcggctcactatag

SEQ ID NO: 5088 - DNA, 18 bp, synthetic construct
  source 1..18: mol_type = other DNA
ttatacgccccactatag

SEQ ID NO: 5089 - DNA, 18 bp, synthetic construct
  source 1..18: mol_type = other DNA
tattacgtctcaccatag

SEQ ID NO: 5090 - DNA, 18 bp, synthetic construct
  source 1..18: mol_type = other DNA
ttctacgacttactatag

SEQ ID NO: 5091 - DNA, 18 bp, synthetic construct
  source 1..18: mol_type = other DNA
taacacgactcactttgg

SEQ ID NO: 5092 - DNA, 18 bp, synthetic construct
  source 1..18: mol_type = other DNA
taataccactcacttcag

SEQ ID NO: 5093 - DNA, 18 bp, synthetic construct
  source 1..18: mol_type = other DNA
taatacgattcgctttag

SEQ ID NO: 5094 - DNA, 18 bp, synthetic construct
  source 1..18: mol_type = other DNA
taatacgaatcactttgg

SEQ ID NO: 5095 - DNA, 18 bp, synthetic construct
  source 1..18: mol_type = other DNA
taatacgactctctcttg

SEQ ID NO: 5096 - DNA, 18 bp, synthetic construct
  source 1..18: mol_type = other DNA
taatccgtcttactatag

SEQ ID NO: 5097 - DNA, 18 bp, synthetic construct
  source 1..18: mol_type = other DNA
ttatacgacacgctatag

SEQ ID NO: 5098 - DNA, 18 bp, synthetic construct
  source 1..18: mol_type = other DNA
taatacaactcacaatcg

SEQ ID NO: 5099 - DNA, 18 bp, synthetic construct
  source 1..18: mol_type = other DNA
taatacatctcgctatag

SEQ ID NO: 5100 - DNA, 18 bp, synthetic construct
  source 1..18: mol_type = other DNA
taatgcgactctctttag

SEQ ID NO: 5101 - DNA, 18 bp, synthetic construct
  source 1..18: mol_type = other DNA
aaatgcgaatcactatag

SEQ ID NO: 5102 - DNA, 18 bp, synthetic construct
  source 1..18: mol_type = other DNA
taaaaagcctcactatag

SEQ ID NO: 5103 - DNA, 18 bp, synthetic construct
  source 1..18: mol_type = other DNA
taaaacggctcactattg

SEQ ID NO: 5104 - DNA, 18 bp, synthetic construct
  source 1..18: mol_type = other DNA
taatacagctcactacag

SEQ ID NO: 5105 - DNA, 18 bp, synthetic construct
  source 1..18: mol_type = other DNA
taatacgactaactgttg

SEQ ID NO: 5106 - DNA, 18 bp, synthetic construct
  source 1..18: mol_type = other DNA
taatacgactcacttccg

SEQ ID NO: 5107 - DNA, 18 bp, synthetic construct
  source 1..18: mol_type = other DNA
taatacgacttacactag

SEQ ID NO: 5108 - DNA, 18 bp, synthetic construct
  source 1..18: mol_type = other DNA
taatatgccacactatag

SEQ ID NO: 5109 - DNA, 18 bp, synthetic construct
  source 1..18: mol_type = other DNA
taatcagattcactatag

SEQ ID NO: 5110 - DNA, 18 bp, synthetic construct
  source 1..18: mol_type = other DNA
taatgcgactaactaaag

SEQ ID NO: 5111 - DNA, 18 bp, synthetic construct
  source 1..18: mol_type = other DNA
aaatcccactcactatag

SEQ ID NO: 5112 - DNA, 18 bp, synthetic construct
  source 1..18: mol_type = other DNA
aaatgcgagtcactatag

SEQ ID NO: 5113 - DNA, 18 bp, synthetic construct
  source 1..18: mol_type = other DNA
acatacgactcactacag

SEQ ID NO: 5114 - DNA, 18 bp, synthetic construct
  source 1..18: mol_type = other DNA
caatccgacacactatag

SEQ ID NO: 5115 - DNA, 18 bp, synthetic construct
  source 1..18: mol_type = other DNA
ccatacgactcaatatag

SEQ ID NO: 5116 - DNA, 18 bp, synthetic construct
  source 1..18: mol_type = other DNA
taaaacgactccgtatag

SEQ ID NO: 5117 - DNA, 18 bp, synthetic construct
  source 1..18: mol_type = other DNA
taaaacgactggctatag

SEQ ID NO: 5118 - DNA, 18 bp, synthetic construct
  source 1..18: mol_type = other DNA
taacaggactcactttag

SEQ ID NO: 5119 - DNA, 18 bp, synthetic construct
  source 1..18: mol_type = other DNA
taagacgcctcactttag

SEQ ID NO: 5120 - DNA, 18 bp, synthetic construct
  source 1..18: mol_type = other DNA
taagacttctcactatag

SEQ ID NO: 5121 - DNA, 18 bp, synthetic construct
  source 1..18: mol_type = other DNA
taataccacacactatcg

SEQ ID NO: 5122 - DNA, 18 bp, synthetic construct
  source 1..18: mol_type = other DNA
taatacgaatcacgttag

SEQ ID NO: 5123 - DNA, 18 bp, synthetic construct
  source 1..18: mol_type = other DNA
taatacgactcaagattg

SEQ ID NO: 5124 - DNA, 18 bp, synthetic construct
  source 1..18: mol_type = other DNA
taatacgacttactgtcg

SEQ ID NO: 5125 - DNA, 18 bp, synthetic construct
  source 1..18: mol_type = other DNA
taatacgagtcacaatcg

SEQ ID NO: 5126 - DNA, 18 bp, synthetic construct
  source 1..18: mol_type = other DNA
taatacgatcgactatag

SEQ ID NO: 5127 - DNA, 18 bp, synthetic construct
  source 1..18: mol_type = other DNA
taatacgcctcaatctag

SEQ ID NO: 5128 - DNA, 18 bp, synthetic construct
  source 1..18: mol_type = other DNA
taatacgcctcacttgag

SEQ ID NO: 5129 - DNA, 18 bp, synthetic construct
  source 1..18: mol_type = other DNA
taatacgtctcacgacag

SEQ ID NO: 5130 - DNA, 18 bp, synthetic construct
  source 1..18: mol_type = other DNA
taatacgtctcagtgtag

SEQ ID NO: 5131 - DNA, 18 bp, synthetic construct
  source 1..18: mol_type = other DNA
taatactaatcactagag

SEQ ID NO: 5132 - DNA, 18 bp, synthetic construct
  source 1..18: mol_type = other DNA
taatatgactcaccgtag

SEQ ID NO: 5133 - DNA, 18 bp, synthetic construct
  source 1..18: mol_type = other DNA
taatatgactcattacag

SEQ ID NO: 5134 - DNA, 18 bp, synthetic construct
  source 1..18: mol_type = other DNA
taatgtgacacactatag

SEQ ID NO: 5135 - DNA, 18 bp, synthetic construct
  source 1..18: mol_type = other DNA
taattcccctcactatag

SEQ ID NO: 5136 - DNA, 18 bp, synthetic construct
  source 1..18: mol_type = other DNA
tactacaactcactatcg

SEQ ID NO: 5137 - DNA, 18 bp, synthetic construct
  source 1..18: mol_type = other DNA
tagtacgactcattctag

SEQ ID NO: 5138 - DNA, 18 bp, synthetic construct
  source 1..18: mol_type = other DNA
tagttcgacgcactatag

SEQ ID NO: 5139 - DNA, 18 bp, synthetic construct
  source 1..18: mol_type = other DNA
tcacacgactcagtatag

SEQ ID NO: 5140 - DNA, 18 bp, synthetic construct
  source 1..18: mol_type = other DNA
tcattcgactcagtatag

SEQ ID NO: 5141 - DNA, 18 bp, synthetic construct
  source 1..18: mol_type = other DNA
taatacgactcacgaatg

SEQ ID NO: 5142 - DNA, 18 bp, synthetic construct
  source 1..18: mol_type = other DNA
taattcggctcacaatag

SEQ ID NO: 5143 - DNA, 18 bp, synthetic construct
  source 1..18: mol_type = other DNA
taatacgattctctattg

SEQ ID NO: 5144 - DNA, 18 bp, synthetic construct
  source 1..18: mol_type = other DNA
ctatatgactcactatag

SEQ ID NO: 5145 - DNA, 18 bp, synthetic construct
  source 1..18: mol_type = other DNA
tattccgactcactacag

SEQ ID NO: 5146 - DNA, 18 bp, synthetic construct
  source 1..18: mol_type = other DNA
caacacgattcactatag

SEQ ID NO: 5147 - DNA, 18 bp, synthetic construct
  source 1..18: mol_type = other DNA
taaaacacctcactatag

SEQ ID NO: 5148 - DNA, 18 bp, synthetic construct
  source 1..18: mol_type = other DNA
taataagactctctatcg

SEQ ID NO: 5149 - DNA, 18 bp, synthetic construct
  source 1..18: mol_type = other DNA
taatacaaatcactacag

SEQ ID NO: 5150 - DNA, 18 bp, synthetic construct
  source 1..18: mol_type = other DNA
taatacaactctctagag

SEQ ID NO: 5151 - DNA, 18 bp, synthetic construct
  source 1..18: mol_type = other DNA
taatacgactcgcgattg

SEQ ID NO: 5152 - DNA, 18 bp, synthetic construct
  source 1..18: mol_type = other DNA
taatacgactctctacgg

SEQ ID NO: 5153 - DNA, 18 bp, synthetic construct
  source 1..18: mol_type = other DNA
taatacgattcacttgag

SEQ ID NO: 5154 - DNA, 18 bp, synthetic construct
  source 1..18: mol_type = other DNA
taatccgactcattaaag

SEQ ID NO: 5155 - DNA, 18 bp, synthetic construct
  source 1..18: mol_type = other DNA
taatccgtctcaccatag

SEQ ID NO: 5156 - DNA, 18 bp, synthetic construct
  source 1..18: mol_type = other DNA
taattcgactcagtatcg

SEQ ID NO: 5157 - DNA, 18 bp, synthetic construct
  source 1..18: mol_type = other DNA
tcatacggctcactattg

SEQ ID NO: 5158 - DNA, 18 bp, synthetic construct
  source 1..18: mol_type = other DNA
ttatacgactaactatcg

SEQ ID NO: 5159 - DNA, 18 bp, synthetic construct
  source 1..18: mol_type = other DNA
ttatacgactcaatctag

SEQ ID NO: 5160 - DNA, 18 bp, synthetic construct
  source 1..18: mol_type = other DNA
ttataagactcactatcg

SEQ ID NO: 5161 - DNA, 18 bp, synthetic construct
  source 1..18: mol_type = other DNA
aagtacgactcactctag

SEQ ID NO: 5162 - DNA, 18 bp, synthetic construct
  source 1..18: mol_type = other DNA
taatacaagtcactctag

SEQ ID NO: 5163 - DNA, 18 bp, synthetic construct
  source 1..18: mol_type = other DNA
taatgtgactcactattg

SEQ ID NO: 5164 - DNA, 18 bp, synthetic construct
  source 1..18: mol_type = other DNA
taaaacgactcactgaag

SEQ ID NO: 5165 - DNA, 18 bp, synthetic construct
  source 1..18: mol_type = other DNA
taatacaactcaccattg

SEQ ID NO: 5166 - DNA, 18 bp, synthetic construct
  source 1..18: mol_type = other DNA
taatacgccacacaatag

SEQ ID NO: 5167 - DNA, 18 bp, synthetic construct
  source 1..18: mol_type = other DNA
tattacgactcactaacg

SEQ ID NO: 5168 - DNA, 18 bp, synthetic construct
  source 1..18: mol_type = other DNA
taaaacgcctcacaatag

SEQ ID NO: 5169 - DNA, 18 bp, synthetic construct
  source 1..18: mol_type = other DNA
taatacacctcactattg

SEQ ID NO: 5170 - DNA, 18 bp, synthetic construct
  source 1..18: mol_type = other DNA
taatacgacaaactatgg

SEQ ID NO: 5171 - DNA, 18 bp, synthetic construct
  source 1..18: mol_type = other DNA
taattcgcctctctatag

SEQ ID NO: 5172 - DNA, 18 bp, synthetic construct
  source 1..18: mol_type = other DNA
taattggactcattatag

SEQ ID NO: 5173 - DNA, 18 bp, synthetic construct
  source 1..18: mol_type = other DNA
tattacaactcacaatag

SEQ ID NO: 5174 - DNA, 18 bp, synthetic construct
  source 1..18: mol_type = other DNA
taattagactcattatag

SEQ ID NO: 5175 - DNA, 18 bp, synthetic construct
  source 1..18: mol_type = other DNA
ttatacgccacactatag

SEQ ID NO: 5176 - DNA, 18 bp, synthetic construct
  source 1..18: mol_type = other DNA
taatacgcatcacaatag

SEQ ID NO: 5177 - DNA, 18 bp, synthetic construct
  source 1..18: mol_type = other DNA
taatacgtctcacttttg

SEQ ID NO: 5178 - DNA, 18 bp, synthetic construct
  source 1..18: mol_type = other DNA
caatacgactcacaattg

SEQ ID NO: 5179 - DNA, 18 bp, synthetic construct
  source 1..18: mol_type = other DNA
tcatactactcactaaag

SEQ ID NO: 5180 - DNA, 18 bp, synthetic construct
  source 1..18: mol_type = other DNA
taatacgccactctatag

SEQ ID NO: 5181 - DNA, 18 bp, synthetic construct
  source 1..18: mol_type = other DNA
taatacgagtcaccaaag

SEQ ID NO: 5182 - DNA, 18 bp, synthetic construct
  source 1..18: mol_type = other DNA
taatacgtatcgctatag

SEQ ID NO: 5183 - DNA, 18 bp, synthetic construct
  source 1..18: mol_type = other DNA
taatactacacactatcg

SEQ ID NO: 5184 - DNA, 18 bp, synthetic construct
  source 1..18: mol_type = other DNA
ttatgctactcactatag

SEQ ID NO: 5185 - DNA, 18 bp, synthetic construct
  source 1..18: mol_type = other DNA
aaataagcctcactatag

SEQ ID NO: 5186 - DNA, 18 bp, synthetic construct
  source 1..18: mol_type = other DNA
taatactactcaatgtag

SEQ ID NO: 5187 - DNA, 18 bp, synthetic construct
  source 1..18: mol_type = other DNA
taatgtgactcattatag

SEQ ID NO: 5188 - DNA, 18 bp, synthetic construct
  source 1..18: mol_type = other DNA
tattacgacgcactgtag

SEQ ID NO: 5189 - DNA, 18 bp, synthetic construct
  source 1..18: mol_type = other DNA
tgatacgactcacttcag

SEQ ID NO: 5190 - DNA, 18 bp, synthetic construct
  source 1..18: mol_type = other DNA
ttatacaacgcactatag

SEQ ID NO: 5191 - DNA, 18 bp, synthetic construct
  source 1..18: mol_type = other DNA
aaatacgactcatgatag

SEQ ID NO: 5192 - DNA, 18 bp, synthetic construct
  source 1..18: mol_type = other DNA
caaaacgactcacgatag

SEQ ID NO: 5193 - DNA, 18 bp, synthetic construct
  source 1..18: mol_type = other DNA
caatacgactccttatag

SEQ ID NO: 5194 - DNA, 18 bp, synthetic construct
  source 1..18: mol_type = other DNA
cagtacgactcactaaag

SEQ ID NO: 5195 - DNA, 18 bp, synthetic construct
  source 1..18: mol_type = other DNA
gaataccactaactatag

SEQ ID NO: 5196 - DNA, 18 bp, synthetic construct
  source 1..18: mol_type = other DNA
taaaacgactccccatag

SEQ ID NO: 5197 - DNA, 18 bp, synthetic construct
  source 1..18: mol_type = other DNA
taaaccgcctcactatag

SEQ ID NO: 5198 - DNA, 18 bp, synthetic construct
  source 1..18: mol_type = other DNA
taaagcgactcagtatag

SEQ ID NO: 5199 - DNA, 18 bp, synthetic construct
  source 1..18: mol_type = other DNA
taacacgactaactgtag

SEQ ID NO: 5200 - DNA, 18 bp, synthetic construct
  source 1..18: mol_type = other DNA
taataagattcactctag

SEQ ID NO: 5201 - DNA, 18 bp, synthetic construct
  source 1..18: mol_type = other DNA
taatacaactaactgtag

SEQ ID NO: 5202 - DNA, 18 bp, synthetic construct
  source 1..18: mol_type = other DNA
taatacgacacactacgg

SEQ ID NO: 5203 - DNA, 18 bp, synthetic construct
  source 1..18: mol_type = other DNA
taatacgacgcgctaaag

SEQ ID NO: 5204 - DNA, 18 bp, synthetic construct
  source 1..18: mol_type = other DNA
taatacgactaacaagag

SEQ ID NO: 5205 - DNA, 18 bp, synthetic construct
  source 1..18: mol_type = other DNA
taatacgactcattggag

SEQ ID NO: 5206 - DNA, 18 bp, synthetic construct
  source 1..18: mol_type = other DNA
taatacgcctctctatcg

SEQ ID NO: 5207 - DNA, 18 bp, synthetic construct
  source 1..18: mol_type = other DNA
taatacgtctcaggatag

SEQ ID NO: 5208 - DNA, 18 bp, synthetic construct
  source 1..18: mol_type = other DNA
taatacgtgccactatag

SEQ ID NO: 5209 - DNA, 18 bp, synthetic construct
  source 1..18: mol_type = other DNA
taataggactcgcaatag

SEQ ID NO: 5210 - DNA, 18 bp, synthetic construct
  source 1..18: mol_type = other DNA
taatatgactaactgtag

SEQ ID NO: 5211 - DNA, 18 bp, synthetic construct
  source 1..18: mol_type = other DNA
taatccgacccactacag

SEQ ID NO: 5212 - DNA, 18 bp, synthetic construct
  source 1..18: mol_type = other DNA
taatccgactcaatacag

SEQ ID NO: 5213 - DNA, 18 bp, synthetic construct
  source 1..18: mol_type = other DNA
taatctgactcgctatag

SEQ ID NO: 5214 - DNA, 18 bp, synthetic construct
  source 1..18: mol_type = other DNA
taatgcgactcagcatag

SEQ ID NO: 5215 - DNA, 18 bp, synthetic construct
  source 1..18: mol_type = other DNA
taatgcgagtgactatag

SEQ ID NO: 5216 - DNA, 18 bp, synthetic construct
  source 1..18: mol_type = other DNA
taatgtgcctcactatag

SEQ ID NO: 5217 - DNA, 18 bp, synthetic construct
  source 1..18: mol_type = other DNA
taattcgacgcactttag

SEQ ID NO: 5218 - DNA, 18 bp, synthetic construct
  source 1..18: mol_type = other DNA
taattcgcctcacgatag

SEQ ID NO: 5219 - DNA, 18 bp, synthetic construct
  source 1..18: mol_type = other DNA
tagcacgactctctatag

SEQ ID NO: 5220 - DNA, 18 bp, synthetic construct
  source 1..18: mol_type = other DNA
tagtacgacccaatatag

SEQ ID NO: 5221 - DNA, 18 bp, synthetic construct
  source 1..18: mol_type = other DNA
tcatacaactcagtatag

SEQ ID NO: 5222 - DNA, 18 bp, synthetic construct
  source 1..18: mol_type = other DNA
tcatacgactctctagag

SEQ ID NO: 5223 - DNA, 18 bp, synthetic construct
  source 1..18: mol_type = other DNA
tcgtacgacacactatag

SEQ ID NO: 5224 - DNA, 18 bp, synthetic construct
  source 1..18: mol_type = other DNA
tgaaacgactcagtatag

SEQ ID NO: 5225 - DNA, 18 bp, synthetic construct
  source 1..18: mol_type = other DNA
tgataagaatcactatag

SEQ ID NO: 5226 - DNA, 18 bp, synthetic construct
  source 1..18: mol_type = other DNA
tgatacgactctctagag

SEQ ID NO: 5227 - DNA, 18 bp, synthetic construct
  source 1..18: mol_type = other DNA
tgattcgagtcactatag

SEQ ID NO: 5228 - DNA, 18 bp, synthetic construct
  source 1..18: mol_type = other DNA
ttagacgactcactaaag

SEQ ID NO: 5229 - DNA, 18 bp, synthetic construct
  source 1..18: mol_type = other DNA
ttatacgactcgctgtag

SEQ ID NO: 5230 - DNA, 18 bp, synthetic construct
  source 1..18: mol_type = other DNA
aaatacgactccctagag

SEQ ID NO: 5231 - DNA, 18 bp, synthetic construct
  source 1..18: mol_type = other DNA
aaatacgagtcactatcg

SEQ ID NO: 5232 - DNA, 18 bp, synthetic construct
  source 1..18: mol_type = other DNA
aaataggactcactatgg

SEQ ID NO: 5233 - DNA, 18 bp, synthetic construct
  source 1..18: mol_type = other DNA
aaataggactccctatag

SEQ ID NO: 5234 - DNA, 18 bp, synthetic construct
  source 1..18: mol_type = other DNA
caatacgacacactatcg

SEQ ID NO: 5235 - DNA, 18 bp, synthetic construct
  source 1..18: mol_type = other DNA
caatacgacccactctag

SEQ ID NO: 5236 - DNA, 18 bp, synthetic construct
  source 1..18: mol_type = other DNA
caatacgacgcaccatag

SEQ ID NO: 5237 - DNA, 18 bp, synthetic construct
  source 1..18: mol_type = other DNA
caatacgagtcactatcg

SEQ ID NO: 5238 - DNA, 18 bp, synthetic construct
  source 1..18: mol_type = other DNA
caatacgattcactatcg

SEQ ID NO: 5239 - DNA, 18 bp, synthetic construct
  source 1..18: mol_type = other DNA
cagtacgactcagtatag

SEQ ID NO: 5240 - DNA, 18 bp, synthetic construct
  source 1..18: mol_type = other DNA
cgataagactcactatag

SEQ ID NO: 5241 - DNA, 18 bp, synthetic construct
  source 1..18: mol_type = other DNA
gaaaacgactcattatag

SEQ ID NO: 5242 - DNA, 18 bp, synthetic construct
  source 1..18: mol_type = other DNA
gaataccattcactatag

SEQ ID NO: 5243 - DNA, 18 bp, synthetic construct
  source 1..18: mol_type = other DNA
gaatacgattcactctag

SEQ ID NO: 5244 - DNA, 18 bp, synthetic construct
  source 1..18: mol_type = other DNA
gaatacgtctaactatag

SEQ ID NO: 5245 - DNA, 18 bp, synthetic construct
  source 1..18: mol_type = other DNA
gaatactcctcactatag

SEQ ID NO: 5246 - DNA, 18 bp, synthetic construct
  source 1..18: mol_type = other DNA
gaatatgactcaccatag

SEQ ID NO: 5247 - DNA, 18 bp, synthetic construct
  source 1..18: mol_type = other DNA
taaaaagactcacgatag

SEQ ID NO: 5248 - DNA, 18 bp, synthetic construct
  source 1..18: mol_type = other DNA
taaaaccactcagtatag

SEQ ID NO: 5249 - DNA, 18 bp, synthetic construct
  source 1..18: mol_type = other DNA
taaaaggactgactatag

SEQ ID NO: 5250 - DNA, 18 bp, synthetic construct
  source 1..18: mol_type = other DNA
taaaatgactcactagag

SEQ ID NO: 5251 - DNA, 18 bp, synthetic construct
  source 1..18: mol_type = other DNA
taacacaactcactatgg

SEQ ID NO: 5252 - DNA, 18 bp, synthetic construct
  source 1..18: mol_type = other DNA
taacaccacgcactatag

SEQ ID NO: 5253 - DNA, 18 bp, synthetic construct
  source 1..18: mol_type = other DNA
taacacgactcgctatgg

SEQ ID NO: 5254 - DNA, 18 bp, synthetic construct
  source 1..18: mol_type = other DNA
taacaggaatcactatag

SEQ ID NO: 5255 - DNA, 18 bp, synthetic construct
  source 1..18: mol_type = other DNA
taacaggactcactatgg

SEQ ID NO: 5256 - DNA, 18 bp, synthetic construct
  source 1..18: mol_type = other DNA
taacgggactcactatag

SEQ ID NO: 5257 - DNA, 18 bp, synthetic construct
  source 1..18: mol_type = other DNA
taactggactcactatag

SEQ ID NO: 5258 - DNA, 18 bp, synthetic construct
  source 1..18: mol_type = other DNA
taagacgactcaccaaag

SEQ ID NO: 5259 - DNA, 18 bp, synthetic construct
  source 1..18: mol_type = other DNA
taagacgactcatcatag

SEQ ID NO: 5260 - DNA, 18 bp, synthetic construct
  source 1..18: mol_type = other DNA
taagacgactccatatag

SEQ ID NO: 5261 - DNA, 18 bp, synthetic construct
  source 1..18: mol_type = other DNA
taagactgctcactatag

SEQ ID NO: 5262 - DNA, 18 bp, synthetic construct
  source 1..18: mol_type = other DNA
taagaggactcattatag

SEQ ID NO: 5263 - DNA, 18 bp, synthetic construct
  source 1..18: mol_type = other DNA
taatacaacccaccatag

SEQ ID NO: 5264 - DNA, 18 bp, synthetic construct
  source 1..18: mol_type = other DNA
taatacaacgcacaatag

SEQ ID NO: 5265 - DNA, 18 bp, synthetic construct
  source 1..18: mol_type = other DNA
taatacagcccactatag

SEQ ID NO: 5266 - DNA, 18 bp, synthetic construct
  source 1..18: mol_type = other DNA
taatacagctgactatag

SEQ ID NO: 5267 - DNA, 18 bp, synthetic construct
  source 1..18: mol_type = other DNA
taataccactcagtgtag

SEQ ID NO: 5268 - DNA, 18 bp, synthetic construct
  source 1..18: mol_type = other DNA
taatacgaaccagtatag

SEQ ID NO: 5269 - DNA, 18 bp, synthetic construct
  source 1..18: mol_type = other DNA
taatacgaccccccatag

SEQ ID NO: 5270 - DNA, 18 bp, synthetic construct
  source 1..18: mol_type = other DNA
taatacgactcaataggg

SEQ ID NO: 5271 - DNA, 18 bp, synthetic construct
  source 1..18: mol_type = other DNA
taatacgactcacaatcc

SEQ ID NO: 5272 - DNA, 18 bp, synthetic construct
  source 1..18: mol_type = other DNA
taatacgactcgatagag

SEQ ID NO: 5273 - DNA, 18 bp, synthetic construct
  source 1..18: mol_type = other DNA
taatacgactgactaagg

SEQ ID NO: 5274 - DNA, 18 bp, synthetic construct
  source 1..18: mol_type = other DNA
taatacgactgcctacag

SEQ ID NO: 5275 - DNA, 18 bp, synthetic construct
  source 1..18: mol_type = other DNA
taatacgacttaagatag

SEQ ID NO: 5276 - DNA, 18 bp, synthetic construct
  source 1..18: mol_type = other DNA
taatacgacttaccctag

SEQ ID NO: 5277 - DNA, 18 bp, synthetic construct
  source 1..18: mol_type = other DNA
taatacgagtaactatcg

SEQ ID NO: 5278 - DNA, 18 bp, synthetic construct
  source 1..18: mol_type = other DNA
taatacgagtcaatatgg

SEQ ID NO: 5279 - DNA, 18 bp, synthetic construct
  source 1..18: mol_type = other DNA
taatacgagtcacagtag

SEQ ID NO: 5280 - DNA, 18 bp, synthetic construct
  source 1..18: mol_type = other DNA
taatacgagtgactgtag

SEQ ID NO: 5281 - DNA, 18 bp, synthetic construct
  source 1..18: mol_type = other DNA
taatacgagttgctatag

SEQ ID NO: 5282 - DNA, 18 bp, synthetic construct
  source 1..18: mol_type = other DNA
taatacggctacctatag

SEQ ID NO: 5283 - DNA, 18 bp, synthetic construct
  source 1..18: mol_type = other DNA
taatacgtctcacgatcg

SEQ ID NO: 5284 - DNA, 18 bp, synthetic construct
  source 1..18: mol_type = other DNA
taatactagttactatag

SEQ ID NO: 5285 - DNA, 18 bp, synthetic construct
  source 1..18: mol_type = other DNA
taataggaatcagtatag

SEQ ID NO: 5286 - DNA, 18 bp, synthetic construct
  source 1..18: mol_type = other DNA
taataggagttactatag

SEQ ID NO: 5287 - DNA, 18 bp, synthetic construct
  source 1..18: mol_type = other DNA
taatatccctcactatag

SEQ ID NO: 5288 - DNA, 18 bp, synthetic construct
  source 1..18: mol_type = other DNA
taatccgactgactatgg

SEQ ID NO: 5289 - DNA, 18 bp, synthetic construct
  source 1..18: mol_type = other DNA
taatcggactcactgtag

SEQ ID NO: 5290 - DNA, 18 bp, synthetic construct
  source 1..18: mol_type = other DNA
taatgcgacccactaaag

SEQ ID NO: 5291 - DNA, 18 bp, synthetic construct
  source 1..18: mol_type = other DNA
taatgcgacgcactattg

SEQ ID NO: 5292 - DNA, 18 bp, synthetic construct
  source 1..18: mol_type = other DNA
taatgcgactagctatag

SEQ ID NO: 5293 - DNA, 18 bp, synthetic construct
  source 1..18: mol_type = other DNA
taatgcgagtcactctag

SEQ ID NO: 5294 - DNA, 18 bp, synthetic construct
  source 1..18: mol_type = other DNA
taatgcgcctcattatag

SEQ ID NO: 5295 - DNA, 18 bp, synthetic construct
  source 1..18: mol_type = other DNA
taatgtgactcaccatag

SEQ ID NO: 5296 - DNA, 18 bp, synthetic construct
  source 1..18: mol_type = other DNA
taattcgactccctatgg

SEQ ID NO: 5297 - DNA, 18 bp, synthetic construct
  source 1..18: mol_type = other DNA
tactacgacttactatcg

SEQ ID NO: 5298 - DNA, 18 bp, synthetic construct
  source 1..18: mol_type = other DNA
tactacgagtcacaatag

SEQ ID NO: 5299 - DNA, 18 bp, synthetic construct
  source 1..18: mol_type = other DNA
tactactactcactacag

SEQ ID NO: 5300 - DNA, 18 bp, synthetic construct
  source 1..18: mol_type = other DNA
tactccgactcactattg

SEQ ID NO: 5301 - DNA, 18 bp, synthetic construct
  source 1..18: mol_type = other DNA
taggacgactcaccatag

SEQ ID NO: 5302 - DNA, 18 bp, synthetic construct
  source 1..18: mol_type = other DNA
taggacgacttactatag

SEQ ID NO: 5303 - DNA, 18 bp, synthetic construct
  source 1..18: mol_type = other DNA
tagggcgactcactatag

SEQ ID NO: 5304 - DNA, 18 bp, synthetic construct
  source 1..18: mol_type = other DNA
tagtagggctcactatag

SEQ ID NO: 5305 - DNA, 18 bp, synthetic construct
  source 1..18: mol_type = other DNA
tatgacgactcaatatag

SEQ ID NO: 5306 - DNA, 18 bp, synthetic construct
  source 1..18: mol_type = other DNA
tcatgcgactcactctag

SEQ ID NO: 5307 - DNA, 18 bp, synthetic construct
  source 1..18: mol_type = other DNA
tgatacgactaactatcg

SEQ ID NO: 5308 - DNA, 18 bp, synthetic construct
  source 1..18: mol_type = other DNA
tgatacgactcgctctag

SEQ ID NO: 5309 - DNA, 18 bp, synthetic construct
  source 1..18: mol_type = other DNA
tgatacgattcactatgg

SEQ ID NO: 5310 - DNA, 18 bp, synthetic construct
  source 1..18: mol_type = other DNA
tgatacgcatcactatag

SEQ ID NO: 5311 - DNA, 18 bp, synthetic construct
  source 1..18: mol_type = other DNA
tgatccgactcaatatag

SEQ ID NO: 5312 - DNA, 18 bp, synthetic construct
  source 1..18: mol_type = other DNA
tgctaccactcactatag

SEQ ID NO: 5313 - DNA, 18 bp, synthetic construct
  source 1..18: mol_type = other DNA
ttacacgactcagtatag

SEQ ID NO: 5314 - DNA, 18 bp, synthetic construct
  source 1..18: mol_type = other DNA
ttatacgacgcactacag

SEQ ID NO: 5315 - DNA, 18 bp, synthetic construct
  source 1..18: mol_type = other DNA
gattacgacacactatag

SEQ ID NO: 5316 - DNA, 18 bp, synthetic construct
  source 1..18: mol_type = other DNA
taaaaccactccctatag

SEQ ID NO: 5317 - DNA, 18 bp, synthetic construct
  source 1..18: mol_type = other DNA
taaaacgactcgctagag

SEQ ID NO: 5318 - DNA, 18 bp, synthetic construct
  source 1..18: mol_type = other DNA
taagacgactctctaaag

SEQ ID NO: 5319 - DNA, 18 bp, synthetic construct
  source 1..18: mol_type = other DNA
taatacgaaacaatatag

SEQ ID NO: 5320 - DNA, 18 bp, synthetic construct
  source 1..18: mol_type = other DNA
taatacgcctcacaatcg

SEQ ID NO: 5321 - DNA, 18 bp, synthetic construct
  source 1..18: mol_type = other DNA
taatactactcccaatag

SEQ ID NO: 5322 - DNA, 18 bp, synthetic construct
  source 1..18: mol_type = other DNA
taataggactaactattg

SEQ ID NO: 5323 - DNA, 18 bp, synthetic construct
  source 1..18: mol_type = other DNA
taataggactcacactag

SEQ ID NO: 5324 - DNA, 18 bp, synthetic construct
  source 1..18: mol_type = other DNA
tactacgtctgactatag

SEQ ID NO: 5325 - DNA, 18 bp, synthetic construct
  source 1..18: mol_type = other DNA
tattacgccttactatag

SEQ ID NO: 5326 - DNA, 18 bp, synthetic construct
  source 1..18: mol_type = other DNA
tgatacgactcagtattg

SEQ ID NO: 5327 - DNA, 18 bp, synthetic construct
  source 1..18: mol_type = other DNA
ttgtacgactcgctatag

SEQ ID NO: 5328 - DNA, 18 bp, synthetic construct
  source 1..18: mol_type = other DNA
aattacgactcactttag

SEQ ID NO: 5329 - DNA, 18 bp, synthetic construct
  source 1..18: mol_type = other DNA
aaatacgaataactatag

SEQ ID NO: 5330 - DNA, 18 bp, synthetic construct
  source 1..18: mol_type = other DNA
tattacgactcactagtg

SEQ ID NO: 5331 - DNA, 18 bp, synthetic construct
  source 1..18: mol_type = other DNA
agaaacgactcactatag

SEQ ID NO: 5332 - DNA, 18 bp, synthetic construct
  source 1..18: mol_type = other DNA
taataagactcacactag

SEQ ID NO: 5333 - DNA, 18 bp, synthetic construct
  source 1..18: mol_type = other DNA
taatcctacacactatag

SEQ ID NO: 5334 - DNA, 18 bp, synthetic construct
  source 1..18: mol_type = other DNA
atatacgactcactaaag

SEQ ID NO: 5335 - DNA, 18 bp, synthetic construct
  source 1..18: mol_type = other DNA
aaataagactcactaaag

SEQ ID NO: 5336 - DNA, 18 bp, synthetic construct
  source 1..18: mol_type = other DNA
tcatacgtctcactaaag

SEQ ID NO: 5337 - DNA, 18 bp, synthetic construct
  source 1..18: mol_type = other DNA
aaatacgactcgcaatag

SEQ ID NO: 5338 - DNA, 18 bp, synthetic construct
  source 1..18: mol_type = other DNA
taataagactctgtatag

SEQ ID NO: 5339 - DNA, 18 bp, synthetic construct
  source 1..18: mol_type = other DNA
tattaagactcactttag

SEQ ID NO: 5340 - DNA, 18 bp, synthetic construct
  source 1..18: mol_type = other DNA
taatacaacctactatag

SEQ ID NO: 5341 - DNA, 18 bp, synthetic construct
  source 1..18: mol_type = other DNA
taatgtgactcactacag

SEQ ID NO: 5342 - DNA, 18 bp, synthetic construct
  source 1..18: mol_type = other DNA
tgatccgactcactattg

SEQ ID NO: 5343 - DNA, 18 bp, synthetic construct
  source 1..18: mol_type = other DNA
aaatacgtctcactaaag

SEQ ID NO: 5344 - DNA, 18 bp, synthetic construct
  source 1..18: mol_type = other DNA
taatacgactcacatttg

SEQ ID NO: 5345 - DNA, 18 bp, synthetic construct
  source 1..18: mol_type = other DNA
tattaagactcactattg

SEQ ID NO: 5346 - DNA, 18 bp, synthetic construct
  source 1..18: mol_type = other DNA
taatacatctcactctag

SEQ ID NO: 5347 - DNA, 18 bp, synthetic construct
  source 1..18: mol_type = other DNA
taataggactcaatattg

SEQ ID NO: 5348 - DNA, 18 bp, synthetic construct
  source 1..18: mol_type = other DNA
aaataccacttactatag

SEQ ID NO: 5349 - DNA, 18 bp, synthetic construct
  source 1..18: mol_type = other DNA
taacaccactcacaatag

SEQ ID NO: 5350 - DNA, 18 bp, synthetic construct
  source 1..18: mol_type = other DNA
taatacggctcattattg

SEQ ID NO: 5351 - DNA, 18 bp, synthetic construct
  source 1..18: mol_type = other DNA
taatacggctctgtatag

SEQ ID NO: 5352 - DNA, 18 bp, synthetic construct
  source 1..18: mol_type = other DNA
taatatgactcacaagag

SEQ ID NO: 5353 - DNA, 18 bp, synthetic construct
  source 1..18: mol_type = other DNA
tacaacgactgactatag

SEQ ID NO: 5354 - DNA, 18 bp, synthetic construct
  source 1..18: mol_type = other DNA
tcatacgtctcactacag

SEQ ID NO: 5355 - DNA, 18 bp, synthetic construct
  source 1..18: mol_type = other DNA
tcatatgactaactatag

SEQ ID NO: 5356 - DNA, 18 bp, synthetic construct
  source 1..18: mol_type = other DNA
ttataccactgactatag

SEQ ID NO: 5357 - DNA, 18 bp, synthetic construct
  source 1..18: mol_type = other DNA
taatttgactctctatag

SEQ ID NO: 5358 - DNA, 18 bp, synthetic construct
  source 1..18: mol_type = other DNA
taatacgactcatcattg

SEQ ID NO: 5359 - DNA, 18 bp, synthetic construct
  source 1..18: mol_type = other DNA
tgatacgtctctctatag

SEQ ID NO: 5360 - DNA, 18 bp, synthetic construct
  source 1..18: mol_type = other DNA
tattacgactctctaaag

SEQ ID NO: 5361 - DNA, 18 bp, synthetic construct
  source 1..18: mol_type = other DNA
aattacgactcactacag

SEQ ID NO: 5362 - DNA, 18 bp, synthetic construct
  source 1..18: mol_type = other DNA
atatacgactcgctatag

SEQ ID NO: 5363 - DNA, 18 bp, synthetic construct
  source 1..18: mol_type = other DNA
caatactactaactatag

SEQ ID NO: 5364 - DNA, 18 bp, synthetic construct
  source 1..18: mol_type = other DNA
taatacgacgcacattag

SEQ ID NO: 5365 - DNA, 18 bp, synthetic construct
  source 1..18: mol_type = other DNA
taatacgacttattacag

SEQ ID NO: 5366 - DNA, 18 bp, synthetic construct
  source 1..18: mol_type = other DNA
taatatgcctcactttag

SEQ ID NO: 5367 - DNA, 18 bp, synthetic construct
  source 1..18: mol_type = other DNA
taattcgactacctatag

SEQ ID NO: 5368 - DNA, 18 bp, synthetic construct
  source 1..18: mol_type = other DNA
tattacgaatcactatcg

SEQ ID NO: 5369 - DNA, 18 bp, synthetic construct
  source 1..18: mol_type = other DNA
ttatacgactgactacag

SEQ ID NO: 5370 - DNA, 18 bp, synthetic construct
  source 1..18: mol_type = other DNA
ttatgcgactcaatatag

SEQ ID NO: 5371 - DNA, 18 bp, synthetic construct
  source 1..18: mol_type = other DNA
agatgcgactcactatag

SEQ ID NO: 5372 - DNA, 18 bp, synthetic construct
  source 1..18: mol_type = other DNA
taagacgactccctattg

SEQ ID NO: 5373 - DNA, 18 bp, synthetic construct
  source 1..18: mol_type = other DNA
taataagaatcgctatag

SEQ ID NO: 5374 - DNA, 18 bp, synthetic construct
  source 1..18: mol_type = other DNA
taataagactgattatag

SEQ ID NO: 5375 - DNA, 18 bp, synthetic construct
  source 1..18: mol_type = other DNA
taatacaactcaagatag

SEQ ID NO: 5376 - DNA, 18 bp, synthetic construct
  source 1..18: mol_type = other DNA
taataccacacactgtag

SEQ ID NO: 5377 - DNA, 18 bp, synthetic construct
  source 1..18: mol_type = other DNA
taatacgactaaagatag

SEQ ID NO: 5378 - DNA, 18 bp, synthetic construct
  source 1..18: mol_type = other DNA
taatacgactcaatatta

SEQ ID NO: 5379 - DNA, 18 bp, synthetic construct
  source 1..18: mol_type = other DNA
taatacgattcaccctag

SEQ ID NO: 5380 - DNA, 18 bp, synthetic construct
  source 1..18: mol_type = other DNA
taatacgcctcactgaag

SEQ ID NO: 5381 - DNA, 18 bp, synthetic construct
  source 1..18: mol_type = other DNA
taatacgcctcagtttag

SEQ ID NO: 5382 - DNA, 18 bp, synthetic construct
  source 1..18: mol_type = other DNA
taatacgtatgactatag

SEQ ID NO: 5383 - DNA, 18 bp, synthetic construct
  source 1..18: mol_type = other DNA
taatacgtctcaccctag

SEQ ID NO: 5384 - DNA, 18 bp, synthetic construct
  source 1..18: mol_type = other DNA
taatactactaactatgg

SEQ ID NO: 5385 - DNA, 18 bp, synthetic construct
  source 1..18: mol_type = other DNA
taatactcctcactctag

SEQ ID NO: 5386 - DNA, 18 bp, synthetic construct
  source 1..18: mol_type = other DNA
taataggactcacaatgg

SEQ ID NO: 5387 - DNA, 18 bp, synthetic construct
  source 1..18: mol_type = other DNA
taatatgagtcactaaag

SEQ ID NO: 5388 - DNA, 18 bp, synthetic construct
  source 1..18: mol_type = other DNA
taatccgactaactatcg

SEQ ID NO: 5389 - DNA, 18 bp, synthetic construct
  source 1..18: mol_type = other DNA
taatccgattcactgtag

SEQ ID NO: 5390 - DNA, 18 bp, synthetic construct
  source 1..18: mol_type = other DNA
taatccgtctcactatgg

SEQ ID NO: 5391 - DNA, 18 bp, synthetic construct
  source 1..18: mol_type = other DNA
taatgagactcactagag

SEQ ID NO: 5392 - DNA, 18 bp, synthetic construct
  source 1..18: mol_type = other DNA
tactacgactcattatcg

SEQ ID NO: 5393 - DNA, 18 bp, synthetic construct
  source 1..18: mol_type = other DNA
tactacgagtcactaaag

SEQ ID NO: 5394 - DNA, 18 bp, synthetic construct
  source 1..18: mol_type = other DNA
tagtacgacccaccatag

SEQ ID NO: 5395 - DNA, 18 bp, synthetic construct
  source 1..18: mol_type = other DNA
tagtacgattcaccatag

SEQ ID NO: 5396 - DNA, 18 bp, synthetic construct
  source 1..18: mol_type = other DNA
tcatgcgactcacaatag

SEQ ID NO: 5397 - DNA, 18 bp, synthetic construct
  source 1..18: mol_type = other DNA
tgacacgactcactatcg

SEQ ID NO: 5398 - DNA, 18 bp, synthetic construct
  source 1..18: mol_type = other DNA
tgacacgactcactattg

SEQ ID NO: 5399 - DNA, 18 bp, synthetic construct
  source 1..18: mol_type = other DNA
tgatacgactaagtatag

SEQ ID NO: 5400 - DNA, 18 bp, synthetic construct
  source 1..18: mol_type = other DNA
ttatacgactcactggag

SEQ ID NO: 5401 - DNA, 18 bp, synthetic construct
  source 1..18: mol_type = other DNA
taataagactcactaatg

SEQ ID NO: 5402 - DNA, 18 bp, synthetic construct
  source 1..18: mol_type = other DNA
ttacacgattcactatag

SEQ ID NO: 5403 - DNA, 18 bp, synthetic construct
  source 1..18: mol_type = other DNA
caattcgtctcactatag

SEQ ID NO: 5404 - DNA, 18 bp, synthetic construct
  source 1..18: mol_type = other DNA
taataccactctttatag

SEQ ID NO: 5405 - DNA, 18 bp, synthetic construct
  source 1..18: mol_type = other DNA
ctatacgactcactaaag

SEQ ID NO: 5406 - DNA, 18 bp, synthetic construct
  source 1..18: mol_type = other DNA
taatacgacttacaacag

SEQ ID NO: 5407 - DNA, 18 bp, synthetic construct
  source 1..18: mol_type = other DNA
aaatactactccctatag

SEQ ID NO: 5408 - DNA, 18 bp, synthetic construct
  source 1..18: mol_type = other DNA
caataagtctcactatag

SEQ ID NO: 5409 - DNA, 18 bp, synthetic construct
  source 1..18: mol_type = other DNA
ctatacgaatcactatag

SEQ ID NO: 5410 - DNA, 18 bp, synthetic construct
  source 1..18: mol_type = other DNA
taaaacgacgctctatag

SEQ ID NO: 5411 - DNA, 18 bp, synthetic construct
  source 1..18: mol_type = other DNA
taaaagaactcactatag

SEQ ID NO: 5412 - DNA, 18 bp, synthetic construct
  source 1..18: mol_type = other DNA
taactcgactcattatag

SEQ ID NO: 5413 - DNA, 18 bp, synthetic construct
  source 1..18: mol_type = other DNA
taatacaacgcactattg

SEQ ID NO: 5414 - DNA, 18 bp, synthetic construct
  source 1..18: mol_type = other DNA
taatacaactcaatatgg

SEQ ID NO: 5415 - DNA, 18 bp, synthetic construct
  source 1..18: mol_type = other DNA
taatacgaatcacagtag

SEQ ID NO: 5416 - DNA, 18 bp, synthetic construct
  source 1..18: mol_type = other DNA
taatacgacagactctag

SEQ ID NO: 5417 - DNA, 18 bp, synthetic construct
  source 1..18: mol_type = other DNA
taatacgactcaatagtg

SEQ ID NO: 5418 - DNA, 18 bp, synthetic construct
  source 1..18: mol_type = other DNA
taatacgactgactaccg

SEQ ID NO: 5419 - DNA, 18 bp, synthetic construct
  source 1..18: mol_type = other DNA
taatacggctcgctttag

SEQ ID NO: 5420 - DNA, 18 bp, synthetic construct
  source 1..18: mol_type = other DNA
taatacgtgtcaatatag

SEQ ID NO: 5421 - DNA, 18 bp, synthetic construct
  source 1..18: mol_type = other DNA
taatgagactcaccatag

SEQ ID NO: 5422 - DNA, 18 bp, synthetic construct
  source 1..18: mol_type = other DNA
tgataccactcacaatag

SEQ ID NO: 5423 - DNA, 18 bp, synthetic construct
  source 1..18: mol_type = other DNA
tgatacgactcattctag

SEQ ID NO: 5424 - DNA, 18 bp, synthetic construct
  source 1..18: mol_type = other DNA
ttatacgactaactacag

SEQ ID NO: 5425 - DNA, 18 bp, synthetic construct
  source 1..18: mol_type = other DNA
taaatcgactcactattg

SEQ ID NO: 5426 - DNA, 18 bp, synthetic construct
  source 1..18: mol_type = other DNA
taataagactaactttag

SEQ ID NO: 5427 - DNA, 18 bp, synthetic construct
  source 1..18: mol_type = other DNA
taatccgacacactttag

SEQ ID NO: 5428 - DNA, 18 bp, synthetic construct
  source 1..18: mol_type = other DNA
tcatacaactctctatag

SEQ ID NO: 5429 - DNA, 18 bp, synthetic construct
  source 1..18: mol_type = other DNA
taatacgaatcactcaag

SEQ ID NO: 5430 - DNA, 18 bp, synthetic construct
  source 1..18: mol_type = other DNA
taatacgcttcactaaag

SEQ ID NO: 5431 - DNA, 18 bp, synthetic construct
  source 1..18: mol_type = other DNA
taatatgactcaaaatag

SEQ ID NO: 5432 - DNA, 18 bp, synthetic construct
  source 1..18: mol_type = other DNA
tagtacgtcttactatag

SEQ ID NO: 5433 - DNA, 18 bp, synthetic construct
  source 1..18: mol_type = other DNA
tattacgaatcgctatag

SEQ ID NO: 5434 - DNA, 18 bp, synthetic construct
  source 1..18: mol_type = other DNA
tgttacgactaactatag

SEQ ID NO: 5435 - DNA, 18 bp, synthetic construct
  source 1..18: mol_type = other DNA
aaataccactcactattg

SEQ ID NO: 5436 - DNA, 18 bp, synthetic construct
  source 1..18: mol_type = other DNA
taaaaggactcactttag

SEQ ID NO: 5437 - DNA, 18 bp, synthetic construct
  source 1..18: mol_type = other DNA
taatacaactcagtttag

SEQ ID NO: 5438 - DNA, 18 bp, synthetic construct
  source 1..18: mol_type = other DNA
taatactactacctatag

SEQ ID NO: 5439 - DNA, 18 bp, synthetic construct
  source 1..18: mol_type = other DNA
taatccgactcaatattg

SEQ ID NO: 5440 - DNA, 18 bp, synthetic construct
  source 1..18: mol_type = other DNA
tatcaagactcactatag

SEQ ID NO: 5441 - DNA, 18 bp, synthetic construct
  source 1..18: mol_type = other DNA
tattgcgaatcactatag

SEQ ID NO: 5442 - DNA, 18 bp, synthetic construct
  source 1..18: mol_type = other DNA
taatacgcctaactattg

SEQ ID NO: 5443 - DNA, 18 bp, synthetic construct
  source 1..18: mol_type = other DNA
taattcgacacaccatag

SEQ ID NO: 5444 - DNA, 18 bp, synthetic construct
  source 1..18: mol_type = other DNA
taattcgactcattacag

SEQ ID NO: 5445 - DNA, 18 bp, synthetic construct
  source 1..18: mol_type = other DNA
taattcgactgactaaag

SEQ ID NO: 5446 - DNA, 18 bp, synthetic construct
  source 1..18: mol_type = other DNA
taatgcaactcacaatag

SEQ ID NO: 5447 - DNA, 18 bp, synthetic construct
  source 1..18: mol_type = other DNA
ttatacaactcaatatag

SEQ ID NO: 5448 - DNA, 18 bp, synthetic construct
  source 1..18: mol_type = other DNA
taattcaactcactaaag

SEQ ID NO: 5449 - DNA, 18 bp, synthetic construct
  source 1..18: mol_type = other DNA
tattacgactcaccattg

SEQ ID NO: 5450 - DNA, 18 bp, synthetic construct
  source 1..18: mol_type = other DNA
taatacgtttcactttag

SEQ ID NO: 5451 - DNA, 18 bp, synthetic construct
  source 1..18: mol_type = other DNA
tactacgacactctatag

SEQ ID NO: 5452 - DNA, 18 bp, synthetic construct
  source 1..18: mol_type = other DNA
taatacgacgctctattg

SEQ ID NO: 5453 - DNA, 18 bp, synthetic construct
  source 1..18: mol_type = other DNA
taaagctactcactatag

SEQ ID NO: 5454 - DNA, 18 bp, synthetic construct
  source 1..18: mol_type = other DNA
tacttcgtctcactatag

SEQ ID NO: 5455 - DNA, 18 bp, synthetic construct
  source 1..18: mol_type = other DNA
taatacgactctccctag

SEQ ID NO: 5456 - DNA, 18 bp, synthetic construct
  source 1..18: mol_type = other DNA
taatacgagtcaatttag

SEQ ID NO: 5457 - DNA, 18 bp, synthetic construct
  source 1..18: mol_type = other DNA
taatacgcatctctatag

SEQ ID NO: 5458 - DNA, 18 bp, synthetic construct
  source 1..18: mol_type = other DNA
taatccaactctctatag

SEQ ID NO: 5459 - DNA, 18 bp, synthetic construct
  source 1..18: mol_type = other DNA
tattacgactctgtatag

SEQ ID NO: 5460 - DNA, 18 bp, synthetic construct
  source 1..18: mol_type = other DNA
aaatccgtctcactatag

SEQ ID NO: 5461 - DNA, 18 bp, synthetic construct
  source 1..18: mol_type = other DNA
caataagactcattatag

SEQ ID NO: 5462 - DNA, 18 bp, synthetic construct
  source 1..18: mol_type = other DNA
taatgtgacttactatag

SEQ ID NO: 5463 - DNA, 18 bp, synthetic construct
  source 1..18: mol_type = other DNA
tattacgactaactctag

SEQ ID NO: 5464 - DNA, 18 bp, synthetic construct
  source 1..18: mol_type = other DNA
tattacgacttactctag

SEQ ID NO: 5465 - DNA, 18 bp, synthetic construct
  source 1..18: mol_type = other DNA
tattacgacttagtatag

SEQ ID NO: 5466 - DNA, 18 bp, synthetic construct
  source 1..18: mol_type = other DNA
tgatacgacacaatatag

SEQ ID NO: 5467 - DNA, 18 bp, synthetic construct
  source 1..18: mol_type = other DNA
tgatacgactcaatttag

SEQ ID NO: 5468 - DNA, 18 bp, synthetic construct
  source 1..18: mol_type = other DNA
acatacgactaactatag

SEQ ID NO: 5469 - DNA, 18 bp, synthetic construct
  source 1..18: mol_type = other DNA
taataccaatcattatag

SEQ ID NO: 5470 - DNA, 18 bp, synthetic construct
  source 1..18: mol_type = other DNA
taatacgaatcactaacg

SEQ ID NO: 5471 - DNA, 18 bp, synthetic construct
  source 1..18: mol_type = other DNA
taatacgacccaccatgg

SEQ ID NO: 5472 - DNA, 18 bp, synthetic construct
  source 1..18: mol_type = other DNA
taatatcattcactatag

SEQ ID NO: 5473 - DNA, 18 bp, synthetic construct
  source 1..18: mol_type = other DNA
taatatgacccactattg

SEQ ID NO: 5474 - DNA, 18 bp, synthetic construct
  source 1..18: mol_type = other DNA
taatatgcctcacaatag

SEQ ID NO: 5475 - DNA, 18 bp, synthetic construct
  source 1..18: mol_type = other DNA
taatgcgactgactattg

SEQ ID NO: 5476 - DNA, 18 bp, synthetic construct
  source 1..18: mol_type = other DNA
taattcgactccctacag

SEQ ID NO: 5477 - DNA, 18 bp, synthetic construct
  source 1..18: mol_type = other DNA
taattcgactctcgatag

SEQ ID NO: 5478 - DNA, 18 bp, synthetic construct
  source 1..18: mol_type = other DNA
tactacgactcaataaag

SEQ ID NO: 5479 - DNA, 18 bp, synthetic construct
  source 1..18: mol_type = other DNA
tactacgattcactaaag

SEQ ID NO: 5480 - DNA, 18 bp, synthetic construct
  source 1..18: mol_type = other DNA
tagtacgactaactattg

SEQ ID NO: 5481 - DNA, 18 bp, synthetic construct
  source 1..18: mol_type = other DNA
tcatacgacccactaaag

SEQ ID NO: 5482 - DNA, 18 bp, synthetic construct
  source 1..18: mol_type = other DNA
aaagacgactcactattg

SEQ ID NO: 5483 - DNA, 18 bp, synthetic construct
  source 1..18: mol_type = other DNA
gtatacgactctctatag

SEQ ID NO: 5484 - DNA, 18 bp, synthetic construct
  source 1..18: mol_type = other DNA
taaaaccagtcactatag

SEQ ID NO: 5485 - DNA, 18 bp, synthetic construct
  source 1..18: mol_type = other DNA
taaaacgacccactgtag

SEQ ID NO: 5486 - DNA, 18 bp, synthetic construct
  source 1..18: mol_type = other DNA
taaaacgactgactgtag

SEQ ID NO: 5487 - DNA, 18 bp, synthetic construct
  source 1..18: mol_type = other DNA
taaaacgcctcagtatag

SEQ ID NO: 5488 - DNA, 18 bp, synthetic construct
  source 1..18: mol_type = other DNA
taaaaggactcactatgg

SEQ ID NO: 5489 - DNA, 18 bp, synthetic construct
  source 1..18: mol_type = other DNA
taacacggctcactattg

SEQ ID NO: 5490 - DNA, 18 bp, synthetic construct
  source 1..18: mol_type = other DNA
taatacaacttcctatag

SEQ ID NO: 5491 - DNA, 18 bp, synthetic construct
  source 1..18: mol_type = other DNA
taataccactcactaccg

SEQ ID NO: 5492 - DNA, 18 bp, synthetic construct
  source 1..18: mol_type = other DNA
taatacgactaaatacag

SEQ ID NO: 5493 - DNA, 18 bp, synthetic construct
  source 1..18: mol_type = other DNA
taatacgagacactgtag

SEQ ID NO: 5494 - DNA, 18 bp, synthetic construct
  source 1..18: mol_type = other DNA
taatacgagccaccatag

SEQ ID NO: 5495 - DNA, 18 bp, synthetic construct
  source 1..18: mol_type = other DNA
taatacgagtaactatgg

SEQ ID NO: 5496 - DNA, 18 bp, synthetic construct
  source 1..18: mol_type = other DNA
taatacgccttactacag

SEQ ID NO: 5497 - DNA, 18 bp, synthetic construct
  source 1..18: mol_type = other DNA
taatactagtcactatgg

SEQ ID NO: 5498 - DNA, 18 bp, synthetic construct
  source 1..18: mol_type = other DNA
taatagcactcactgtag

SEQ ID NO: 5499 - DNA, 18 bp, synthetic construct
  source 1..18: mol_type = other DNA
taataggactgactttag

SEQ ID NO: 5500 - DNA, 18 bp, synthetic construct
  source 1..18: mol_type = other DNA
taatagtactcaccatag

SEQ ID NO: 5501 - DNA, 18 bp, synthetic construct
  source 1..18: mol_type = other DNA
taatatgactaactagag

SEQ ID NO: 5502 - DNA, 18 bp, synthetic construct
  source 1..18: mol_type = other DNA
taatccgaatcactacag

SEQ ID NO: 5503 - DNA, 18 bp, synthetic construct
  source 1..18: mol_type = other DNA
taatgccactcattatag

SEQ ID NO: 5504 - DNA, 18 bp, synthetic construct
  source 1..18: mol_type = other DNA
taatgcgtctccctatag

SEQ ID NO: 5505 - DNA, 18 bp, synthetic construct
  source 1..18: mol_type = other DNA
taattcgacccactctag

SEQ ID NO: 5506 - DNA, 18 bp, synthetic construct
  source 1..18: mol_type = other DNA
tactaccaatcactatag

SEQ ID NO: 5507 - DNA, 18 bp, synthetic construct
  source 1..18: mol_type = other DNA
tactaccactcgctatag

SEQ ID NO: 5508 - DNA, 18 bp, synthetic construct
  source 1..18: mol_type = other DNA
tagtacgactcataatag

SEQ ID NO: 5509 - DNA, 18 bp, synthetic construct
  source 1..18: mol_type = other DNA
tagtacgtctcactatgg

SEQ ID NO: 5510 - DNA, 18 bp, synthetic construct
  source 1..18: mol_type = other DNA
tattacgactcacgttag

SEQ ID NO: 5511 - DNA, 18 bp, synthetic construct
  source 1..18: mol_type = other DNA
tcatatgactcactctag

SEQ ID NO: 5512 - DNA, 18 bp, synthetic construct
  source 1..18: mol_type = other DNA
tgatacgactcgctacag

SEQ ID NO: 5513 - DNA, 18 bp, synthetic construct
  source 1..18: mol_type = other DNA
tgatacgtctgactatag

SEQ ID NO: 5514 - DNA, 18 bp, synthetic construct
  source 1..18: mol_type = other DNA
ttagactactcactatag

SEQ ID NO: 5515 - DNA, 18 bp, synthetic construct
  source 1..18: mol_type = other DNA
ttatacgacccagtatag

SEQ ID NO: 5516 - DNA, 18 bp, synthetic construct
  source 1..18: mol_type = other DNA
ttgtacgactgactatag

SEQ ID NO: 5517 - DNA, 18 bp, synthetic construct
  source 1..18: mol_type = other DNA
aaataccactcactacag

SEQ ID NO: 5518 - DNA, 18 bp, synthetic construct
  source 1..18: mol_type = other DNA
aaatacgactctctataa

SEQ ID NO: 5519 - DNA, 18 bp, synthetic construct
  source 1..18: mol_type = other DNA
aaatccgactcagtatag

SEQ ID NO: 5520 - DNA, 18 bp, synthetic construct
  source 1..18: mol_type = other DNA
caataagactgactatag

SEQ ID NO: 5521 - DNA, 18 bp, synthetic construct
  source 1..18: mol_type = other DNA
caatacgacgcaatatag

SEQ ID NO: 5522 - DNA, 18 bp, synthetic construct
  source 1..18: mol_type = other DNA
caatacgactgaatatag

SEQ ID NO: 5523 - DNA, 18 bp, synthetic construct
  source 1..18: mol_type = other DNA
caatacggctcagtatag

SEQ ID NO: 5524 - DNA, 18 bp, synthetic construct
  source 1..18: mol_type = other DNA
cactacgactcactagag

SEQ ID NO: 5525 - DNA, 18 bp, synthetic construct
  source 1..18: mol_type = other DNA
cactacgacttactatag

SEQ ID NO: 5526 - DNA, 18 bp, synthetic construct
  source 1..18: mol_type = other DNA
cactacgcctcactatag

SEQ ID NO: 5527 - DNA, 18 bp, synthetic construct
  source 1..18: mol_type = other DNA
cattacgactcaccatag

SEQ ID NO: 5528 - DNA, 18 bp, synthetic construct
  source 1..18: mol_type = other DNA
ccatatgactcactatag

SEQ ID NO: 5529 - DNA, 18 bp, synthetic construct
  source 1..18: mol_type = other DNA
gaaaacgactcgctatag

SEQ ID NO: 5530 - DNA, 18 bp, synthetic construct
  source 1..18: mol_type = other DNA
gaataccactccctatag

SEQ ID NO: 5531 - DNA, 18 bp, synthetic construct
  source 1..18: mol_type = other DNA
gaatacgaatcacaatag

SEQ ID NO: 5532 - DNA, 18 bp, synthetic construct
  source 1..18: mol_type = other DNA
gaatacgactaattatag

SEQ ID NO: 5533 - DNA, 18 bp, synthetic construct
  source 1..18: mol_type = other DNA
gaatacgactttctatag

SEQ ID NO: 5534 - DNA, 18 bp, synthetic construct
  source 1..18: mol_type = other DNA
gaatcagactcactatag

SEQ ID NO: 5535 - DNA, 18 bp, synthetic construct
  source 1..18: mol_type = other DNA
gaattcgagtcactatag

SEQ ID NO: 5536 - DNA, 18 bp, synthetic construct
  source 1..18: mol_type = other DNA
taaaacgactcaatagag

SEQ ID NO: 5537 - DNA, 18 bp, synthetic construct
  source 1..18: mol_type = other DNA
taaaacgactccctacag

SEQ ID NO: 5538 - DNA, 18 bp, synthetic construct
  source 1..18: mol_type = other DNA
taacaagactcactatcg

SEQ ID NO: 5539 - DNA, 18 bp, synthetic construct
  source 1..18: mol_type = other DNA
taacacaagtcactatag

SEQ ID NO: 5540 - DNA, 18 bp, synthetic construct
  source 1..18: mol_type = other DNA
taacacgactaactacag

SEQ ID NO: 5541 - DNA, 18 bp, synthetic construct
  source 1..18: mol_type = other DNA
taacacgactcactagtg

SEQ ID NO: 5542 - DNA, 18 bp, synthetic construct
  source 1..18: mol_type = other DNA
taacacgcctcaccatag

SEQ ID NO: 5543 - DNA, 18 bp, synthetic construct
  source 1..18: mol_type = other DNA
taagaccactaactatag

SEQ ID NO: 5544 - DNA, 18 bp, synthetic construct
  source 1..18: mol_type = other DNA
taagacgattccctatag

SEQ ID NO: 5545 - DNA, 18 bp, synthetic construct
  source 1..18: mol_type = other DNA
taataacactcactatgg

SEQ ID NO: 5546 - DNA, 18 bp, synthetic construct
  source 1..18: mol_type = other DNA
taataagaatcaccatag

SEQ ID NO: 5547 - DNA, 18 bp, synthetic construct
  source 1..18: mol_type = other DNA
taataccacgcactaaag

SEQ ID NO: 5548 - DNA, 18 bp, synthetic construct
  source 1..18: mol_type = other DNA
taataccactcagcatag

SEQ ID NO: 5549 - DNA, 18 bp, synthetic construct
  source 1..18: mol_type = other DNA
taataccgctcactagag

SEQ ID NO: 5550 - DNA, 18 bp, synthetic construct
  source 1..18: mol_type = other DNA
taatacgaaccgctatag

SEQ ID NO: 5551 - DNA, 18 bp, synthetic construct
  source 1..18: mol_type = other DNA
taatacgaatcattgtag

SEQ ID NO: 5552 - DNA, 18 bp, synthetic construct
  source 1..18: mol_type = other DNA
taatacgacccacactag

SEQ ID NO: 5553 - DNA, 18 bp, synthetic construct
  source 1..18: mol_type = other DNA
taatacgacgaactatcg

SEQ ID NO: 5554 - DNA, 18 bp, synthetic construct
  source 1..18: mol_type = other DNA
taatacgacgcacgttag

SEQ ID NO: 5555 - DNA, 18 bp, synthetic construct
  source 1..18: mol_type = other DNA
taatacgacgcgcaatag

SEQ ID NO: 5556 - DNA, 18 bp, synthetic construct
  source 1..18: mol_type = other DNA
taatacgactaagtacag

SEQ ID NO: 5557 - DNA, 18 bp, synthetic construct
  source 1..18: mol_type = other DNA
taatacgactcagtgtcg

SEQ ID NO: 5558 - DNA, 18 bp, synthetic construct
  source 1..18: mol_type = other DNA
taatacgacttacgatcg

SEQ ID NO: 5559 - DNA, 18 bp, synthetic construct
  source 1..18: mol_type = other DNA
taatacgatccaatatag

SEQ ID NO: 5560 - DNA, 18 bp, synthetic construct
  source 1..18: mol_type = other DNA
taatacgatgccctatag

SEQ ID NO: 5561 - DNA, 18 bp, synthetic construct
  source 1..18: mol_type = other DNA
taatacgatgtactatag

SEQ ID NO: 5562 - DNA, 18 bp, synthetic construct
  source 1..18: mol_type = other DNA
taatacgcctcaccctag

SEQ ID NO: 5563 - DNA, 18 bp, synthetic construct
  source 1..18: mol_type = other DNA
taatacgcctcattacag

SEQ ID NO: 5564 - DNA, 18 bp, synthetic construct
  source 1..18: mol_type = other DNA
taatacgcgtcactatgg

SEQ ID NO: 5565 - DNA, 18 bp, synthetic construct
  source 1..18: mol_type = other DNA
taatacggatcactgtag

SEQ ID NO: 5566 - DNA, 18 bp, synthetic construct
  source 1..18: mol_type = other DNA
taatacggcgcactttag

SEQ ID NO: 5567 - DNA, 18 bp, synthetic construct
  source 1..18: mol_type = other DNA
taatacggctgactatcg

SEQ ID NO: 5568 - DNA, 18 bp, synthetic construct
  source 1..18: mol_type = other DNA
taatacgtcccactgtag

SEQ ID NO: 5569 - DNA, 18 bp, synthetic construct
  source 1..18: mol_type = other DNA
taatacgtctcactagcg

SEQ ID NO: 5570 - DNA, 18 bp, synthetic construct
  source 1..18: mol_type = other DNA
taatactacacacgatag

SEQ ID NO: 5571 - DNA, 18 bp, synthetic construct
  source 1..18: mol_type = other DNA
taataggacgcactttag

SEQ ID NO: 5572 - DNA, 18 bp, synthetic construct
  source 1..18: mol_type = other DNA
taataggacttattatag

SEQ ID NO: 5573 - DNA, 18 bp, synthetic construct
  source 1..18: mol_type = other DNA
taataggcctcaatatag

SEQ ID NO: 5574 - DNA, 18 bp, synthetic construct
  source 1..18: mol_type = other DNA
taatatgactcgctatgg

SEQ ID NO: 5575 - DNA, 18 bp, synthetic construct
  source 1..18: mol_type = other DNA
taatatgcctcactaaag

SEQ ID NO: 5576 - DNA, 18 bp, synthetic construct
  source 1..18: mol_type = other DNA
taatcccactcagtatag

SEQ ID NO: 5577 - DNA, 18 bp, synthetic construct
  source 1..18: mol_type = other DNA
taatcggacgcactatag

SEQ ID NO: 5578 - DNA, 18 bp, synthetic construct
  source 1..18: mol_type = other DNA
taatgcgactccttatag

SEQ ID NO: 5579 - DNA, 18 bp, synthetic construct
  source 1..18: mol_type = other DNA
taatgcgactgaatatag

SEQ ID NO: 5580 - DNA, 18 bp, synthetic construct
  source 1..18: mol_type = other DNA
taatgcggcttactatag

SEQ ID NO: 5581 - DNA, 18 bp, synthetic construct
  source 1..18: mol_type = other DNA
tactactacccactatag

SEQ ID NO: 5582 - DNA, 18 bp, synthetic construct
  source 1..18: mol_type = other DNA
tagcacgcctcactatag

SEQ ID NO: 5583 - DNA, 18 bp, synthetic construct
  source 1..18: mol_type = other DNA
tagtacgacgcacaatag

SEQ ID NO: 5584 - DNA, 18 bp, synthetic construct
  source 1..18: mol_type = other DNA
tagtaggacgcactatag

SEQ ID NO: 5585 - DNA, 18 bp, synthetic construct
  source 1..18: mol_type = other DNA
tagtccgacgcactatag

SEQ ID NO: 5586 - DNA, 18 bp, synthetic construct
  source 1..18: mol_type = other DNA
tagtccgactcactaaag

SEQ ID NO: 5587 - DNA, 18 bp, synthetic construct
  source 1..18: mol_type = other DNA
tattccgactcactgtag

SEQ ID NO: 5588 - DNA, 18 bp, synthetic construct
  source 1..18: mol_type = other DNA
tcatacaacccactatag

SEQ ID NO: 5589 - DNA, 18 bp, synthetic construct
  source 1..18: mol_type = other DNA
tcatacgaatcaatatag

SEQ ID NO: 5590 - DNA, 18 bp, synthetic construct
  source 1..18: mol_type = other DNA
tcatacgactcactatta

SEQ ID NO: 5591 - DNA, 18 bp, synthetic construct
  source 1..18: mol_type = other DNA
tcatacggctctctatag

SEQ ID NO: 5592 - DNA, 18 bp, synthetic construct
  source 1..18: mol_type = other DNA
tcatccgaatcactatag

SEQ ID NO: 5593 - DNA, 18 bp, synthetic construct
  source 1..18: mol_type = other DNA
tcctacgacttactatag

SEQ ID NO: 5594 - DNA, 18 bp, synthetic construct
  source 1..18: mol_type = other DNA
tgatacaactcactatgg

SEQ ID NO: 5595 - DNA, 18 bp, synthetic construct
  source 1..18: mol_type = other DNA
tgatacgactcattatcg

SEQ ID NO: 5596 - DNA, 18 bp, synthetic construct
  source 1..18: mol_type = other DNA
tgatgcggctcactatag

SEQ ID NO: 5597 - DNA, 18 bp, synthetic construct
  source 1..18: mol_type = other DNA
ttagacgactcagtatag

SEQ ID NO: 5598 - DNA, 18 bp, synthetic construct
  source 1..18: mol_type = other DNA
aaattcgaatcactatag

SEQ ID NO: 5599 - DNA, 18 bp, synthetic construct
  source 1..18: mol_type = other DNA
ttatgcgattcactatag

SEQ ID NO: 5600 - DNA, 18 bp, synthetic construct
  source 1..18: mol_type = other DNA
ttatacaactctctatag

SEQ ID NO: 5601 - DNA, 18 bp, synthetic construct
  source 1..18: mol_type = other DNA
aaatacgtctctctatag

SEQ ID NO: 5602 - DNA, 18 bp, synthetic construct
  source 1..18: mol_type = other DNA
tgatacgtctcactattg

SEQ ID NO: 5603 - DNA, 18 bp, synthetic construct
  source 1..18: mol_type = other DNA
aagtacgactcacaatag

SEQ ID NO: 5604 - DNA, 18 bp, synthetic construct
  source 1..18: mol_type = other DNA
taaaacgactccctttag

SEQ ID NO: 5605 - DNA, 18 bp, synthetic construct
  source 1..18: mol_type = other DNA
taatacgtctcaatatcg

SEQ ID NO: 5606 - DNA, 18 bp, synthetic construct
  source 1..18: mol_type = other DNA
tattacgactcacttgag

SEQ ID NO: 5607 - DNA, 18 bp, synthetic construct
  source 1..18: mol_type = other DNA
agattcgactcactatag

SEQ ID NO: 5608 - DNA, 18 bp, synthetic construct
  source 1..18: mol_type = other DNA
taaaacgagtcacaatag

SEQ ID NO: 5609 - DNA, 18 bp, synthetic construct
  source 1..18: mol_type = other DNA
taagtctactcactatag

SEQ ID NO: 5610 - DNA, 18 bp, synthetic construct
  source 1..18: mol_type = other DNA
taatacgaatcactactg

SEQ ID NO: 5611 - DNA, 18 bp, synthetic construct
  source 1..18: mol_type = other DNA
taatacgactctgcatag

SEQ ID NO: 5612 - DNA, 18 bp, synthetic construct
  source 1..18: mol_type = other DNA
taattagaatcactatag

SEQ ID NO: 5613 - DNA, 18 bp, synthetic construct
  source 1..18: mol_type = other DNA
taattcgactcgcaatag

SEQ ID NO: 5614 - DNA, 18 bp, synthetic construct
  source 1..18: mol_type = other DNA
taatacgtcacactgtag

SEQ ID NO: 5615 - DNA, 18 bp, synthetic construct
  source 1..18: mol_type = other DNA
tactacgactctctaaag

SEQ ID NO: 5616 - DNA, 18 bp, synthetic construct
  source 1..18: mol_type = other DNA
aaatacgattcactatcg

SEQ ID NO: 5617 - DNA, 18 bp, synthetic construct
  source 1..18: mol_type = other DNA
taatccgaaacactatag

SEQ ID NO: 5618 - DNA, 18 bp, synthetic construct
  source 1..18: mol_type = other DNA
taatgcgacttaatatag

SEQ ID NO: 5619 - DNA, 18 bp, synthetic construct
  source 1..18: mol_type = other DNA
taatgcgtctcactacag

SEQ ID NO: 5620 - DNA, 18 bp, synthetic construct
  source 1..18: mol_type = other DNA
tcatacgattctctatag

SEQ ID NO: 5621 - DNA, 18 bp, synthetic construct
  source 1..18: mol_type = other DNA
ttacacaactcactatag

SEQ ID NO: 5622 - DNA, 18 bp, synthetic construct
  source 1..18: mol_type = other DNA
aaatatgactcacaatag

SEQ ID NO: 5623 - DNA, 18 bp, synthetic construct
  source 1..18: mol_type = other DNA
taataccactcactaatg

SEQ ID NO: 5624 - DNA, 18 bp, synthetic construct
  source 1..18: mol_type = other DNA
taatgcgactctctattg

SEQ ID NO: 5625 - DNA, 18 bp, synthetic construct
  source 1..18: mol_type = other DNA
aaatatgactcaatatag

SEQ ID NO: 5626 - DNA, 18 bp, synthetic construct
  source 1..18: mol_type = other DNA
taaaacgacaccctatag

SEQ ID NO: 5627 - DNA, 18 bp, synthetic construct
  source 1..18: mol_type = other DNA
taatacgaaccactttag

SEQ ID NO: 5628 - DNA, 18 bp, synthetic construct
  source 1..18: mol_type = other DNA
taatacgactcagtactg

SEQ ID NO: 5629 - DNA, 18 bp, synthetic construct
  source 1..18: mol_type = other DNA
taatactattcactgtag

SEQ ID NO: 5630 - DNA, 18 bp, synthetic construct
  source 1..18: mol_type = other DNA
tactacgcctcactttag

SEQ ID NO: 5631 - DNA, 18 bp, synthetic construct
  source 1..18: mol_type = other DNA
tattaagactgactatag

SEQ ID NO: 5632 - DNA, 18 bp, synthetic construct
  source 1..18: mol_type = other DNA
tattacgactcactaccg

SEQ ID NO: 5633 - DNA, 18 bp, synthetic construct
  source 1..18: mol_type = other DNA
tattgcgactaactatag

SEQ ID NO: 5634 - DNA, 18 bp, synthetic construct
  source 1..18: mol_type = other DNA
tcttacgactcattatag

SEQ ID NO: 5635 - DNA, 18 bp, synthetic construct
  source 1..18: mol_type = other DNA
ttatacgactccctatgg

SEQ ID NO: 5636 - DNA, 18 bp, synthetic construct
  source 1..18: mol_type = other DNA
taaaacaactcactaaag

SEQ ID NO: 5637 - DNA, 18 bp, synthetic construct
  source 1..18: mol_type = other DNA
taatataactcactttag

SEQ ID NO: 5638 - DNA, 18 bp, synthetic construct
  source 1..18: mol_type = other DNA
atatacgactcagtatag

SEQ ID NO: 5639 - DNA, 18 bp, synthetic construct
  source 1..18: mol_type = other DNA
taatatgcctctctatag

SEQ ID NO: 5640 - DNA, 18 bp, synthetic construct
  source 1..18: mol_type = other DNA
tattacgactcaatgtag

SEQ ID NO: 5641 - DNA, 18 bp, synthetic construct
  source 1..18: mol_type = other DNA
ttatacgactcgatatag

SEQ ID NO: 5642 - DNA, 18 bp, synthetic construct
  source 1..18: mol_type = other DNA
ttatacgactgacaatag

SEQ ID NO: 5643 - DNA, 18 bp, synthetic construct
  source 1..18: mol_type = other DNA
taaaacgactcacttcag

SEQ ID NO: 5644 - DNA, 18 bp, synthetic construct
  source 1..18: mol_type = other DNA
taatacgtttcaccatag

SEQ ID NO: 5645 - DNA, 18 bp, synthetic construct
  source 1..18: mol_type = other DNA
taatacatctcaatatag

SEQ ID NO: 5646 - DNA, 18 bp, synthetic construct
  source 1..18: mol_type = other DNA
taatccgtctcactaaag

SEQ ID NO: 5647 - DNA, 18 bp, synthetic construct
  source 1..18: mol_type = other DNA
taatacgactcacattcg

SEQ ID NO: 5648 - DNA, 18 bp, synthetic construct
  source 1..18: mol_type = other DNA
taataagactcagtaaag

SEQ ID NO: 5649 - DNA, 18 bp, synthetic construct
  source 1..18: mol_type = other DNA
taatactactcacgttag

SEQ ID NO: 5650 - DNA, 18 bp, synthetic construct
  source 1..18: mol_type = other DNA
taatatgtctcactacag

SEQ ID NO: 5651 - DNA, 18 bp, synthetic construct
  source 1..18: mol_type = other DNA
tactacgactcactcttg

SEQ ID NO: 5652 - DNA, 18 bp, synthetic construct
  source 1..18: mol_type = other DNA
tgatacgacttactacag

SEQ ID NO: 5653 - DNA, 18 bp, synthetic construct
  source 1..18: mol_type = other DNA
ttatccgactcactatcg

SEQ ID NO: 5654 - DNA, 18 bp, synthetic construct
  source 1..18: mol_type = other DNA
ttgtacgactcactatcg

SEQ ID NO: 5655 - DNA, 18 bp, synthetic construct
  source 1..18: mol_type = other DNA
aaatacgcctcaccatag

SEQ ID NO: 5656 - DNA, 18 bp, synthetic construct
  source 1..18: mol_type = other DNA
aaataggactcactacag

SEQ ID NO: 5657 - DNA, 18 bp, synthetic construct
  source 1..18: mol_type = other DNA
caatacgacccagtatag

SEQ ID NO: 5658 - DNA, 18 bp, synthetic construct
  source 1..18: mol_type = other DNA
caatacggctcattatag

SEQ ID NO: 5659 - DNA, 18 bp, synthetic construct
  source 1..18: mol_type = other DNA
caatactactcaatatag

SEQ ID NO: 5660 - DNA, 18 bp, synthetic construct
  source 1..18: mol_type = other DNA
cactacaactcactatag

SEQ ID NO: 5661 - DNA, 18 bp, synthetic construct
  source 1..18: mol_type = other DNA
gaatacgtctcactaaag

SEQ ID NO: 5662 - DNA, 18 bp, synthetic construct
  source 1..18: mol_type = other DNA
taagttgactcactatag

SEQ ID NO: 5663 - DNA, 18 bp, synthetic construct
  source 1..18: mol_type = other DNA
taatacaactccctatcg

SEQ ID NO: 5664 - DNA, 18 bp, synthetic construct
  source 1..18: mol_type = other DNA
taataccactgactttag

SEQ ID NO: 5665 - DNA, 18 bp, synthetic construct
  source 1..18: mol_type = other DNA
taatacgacacaatgtag

SEQ ID NO: 5666 - DNA, 18 bp, synthetic construct
  source 1..18: mol_type = other DNA
taatacgactaattctag

SEQ ID NO: 5667 - DNA, 18 bp, synthetic construct
  source 1..18: mol_type = other DNA
taatacgactcattgtgg

SEQ ID NO: 5668 - DNA, 18 bp, synthetic construct
  source 1..18: mol_type = other DNA
taatacgagacaccatag

SEQ ID NO: 5669 - DNA, 18 bp, synthetic construct
  source 1..18: mol_type = other DNA
taatacgattcactcgag

SEQ ID NO: 5670 - DNA, 18 bp, synthetic construct
  source 1..18: mol_type = other DNA
taatattacgcactatag

SEQ ID NO: 5671 - DNA, 18 bp, synthetic construct
  source 1..18: mol_type = other DNA
taatccgactctctacag

SEQ ID NO: 5672 - DNA, 18 bp, synthetic construct
  source 1..18: mol_type = other DNA
taatccgacttactacag

SEQ ID NO: 5673 - DNA, 18 bp, synthetic construct
  source 1..18: mol_type = other DNA
taatgagagtcactatag

SEQ ID NO: 5674 - DNA, 18 bp, synthetic construct
  source 1..18: mol_type = other DNA
taatgcgactacctatag

SEQ ID NO: 5675 - DNA, 18 bp, synthetic construct
  source 1..18: mol_type = other DNA
taattggagtcactatag

SEQ ID NO: 5676 - DNA, 18 bp, synthetic construct
  source 1..18: mol_type = other DNA
tactatggctcactatag

SEQ ID NO: 5677 - DNA, 18 bp, synthetic construct
  source 1..18: mol_type = other DNA
tagtacaactccctatag

SEQ ID NO: 5678 - DNA, 18 bp, synthetic construct
  source 1..18: mol_type = other DNA
tagtacgacttactagag

SEQ ID NO: 5679 - DNA, 18 bp, synthetic construct
  source 1..18: mol_type = other DNA
tattccggctcactatag

SEQ ID NO: 5680 - DNA, 18 bp, synthetic construct
  source 1..18: mol_type = other DNA
tcatacaactcactatgg

SEQ ID NO: 5681 - DNA, 18 bp, synthetic construct
  source 1..18: mol_type = other DNA
tcctacgactcagtatag

SEQ ID NO: 5682 - DNA, 18 bp, synthetic construct
  source 1..18: mol_type = other DNA
tcttaggactcactatag

SEQ ID NO: 5683 - DNA, 18 bp, synthetic construct
  source 1..18: mol_type = other DNA
tgatacgaatcattatag

SEQ ID NO: 5684 - DNA, 18 bp, synthetic construct
  source 1..18: mol_type = other DNA
tgatacgactcagcatag

SEQ ID NO: 5685 - DNA, 18 bp, synthetic construct
  source 1..18: mol_type = other DNA
tgatacgattcagtatag

SEQ ID NO: 5686 - DNA, 18 bp, synthetic construct
  source 1..18: mol_type = other DNA
tgatgcgactcaatatag

SEQ ID NO: 5687 - DNA, 18 bp, synthetic construct
  source 1..18: mol_type = other DNA
taatacgactacctattg

SEQ ID NO: 5688 - DNA, 18 bp, synthetic construct
  source 1..18: mol_type = other DNA
tcatacaacacactatag

SEQ ID NO: 5689 - DNA, 18 bp, synthetic construct
  source 1..18: mol_type = other DNA
ttatgtgactcactatag

SEQ ID NO: 5690 - DNA, 18 bp, synthetic construct
  source 1..18: mol_type = other DNA
aaatacaactcactattg

SEQ ID NO: 5691 - DNA, 18 bp, synthetic construct
  source 1..18: mol_type = other DNA
ttatccgactcactattg

SEQ ID NO: 5692 - DNA, 18 bp, synthetic construct
  source 1..18: mol_type = other DNA
aaatacgtctcactacag

SEQ ID NO: 5693 - DNA, 18 bp, synthetic construct
  source 1..18: mol_type = other DNA
taaaaagactcacaatag

SEQ ID NO: 5694 - DNA, 18 bp, synthetic construct
  source 1..18: mol_type = other DNA
tattacgtctcactatcg

SEQ ID NO: 5695 - DNA, 18 bp, synthetic construct
  source 1..18: mol_type = other DNA
aaatacgactcattatcg

SEQ ID NO: 5696 - DNA, 18 bp, synthetic construct
  source 1..18: mol_type = other DNA
atgtacgactcactatag

SEQ ID NO: 5697 - DNA, 18 bp, synthetic construct
  source 1..18: mol_type = other DNA
taatatgactcactcttg

SEQ ID NO: 5698 - DNA, 18 bp, synthetic construct
  source 1..18: mol_type = other DNA
aattaagactcactatag

SEQ ID NO: 5699 - DNA, 18 bp, synthetic construct
  source 1..18: mol_type = other DNA
taatgctactcactattg

SEQ ID NO: 5700 - DNA, 18 bp, synthetic construct
  source 1..18: mol_type = other DNA
taaaactactcactacag

SEQ ID NO: 5701 - DNA, 18 bp, synthetic construct
  source 1..18: mol_type = other DNA
tgataagactcactattg

SEQ ID NO: 5702 - DNA, 18 bp, synthetic construct
  source 1..18: mol_type = other DNA
ttttacggctcactatag

SEQ ID NO: 5703 - DNA, 18 bp, synthetic construct
  source 1..18: mol_type = other DNA
aaatacgcctcacaatag

SEQ ID NO: 5704 - DNA, 18 bp, synthetic construct
  source 1..18: mol_type = other DNA
taaaacgcctcactgtag

SEQ ID NO: 5705 - DNA, 18 bp, synthetic construct
  source 1..18: mol_type = other DNA
taacacgactgtctatag

SEQ ID NO: 5706 - DNA, 18 bp, synthetic construct
  source 1..18: mol_type = other DNA
taataccactcaatattg

SEQ ID NO: 5707 - DNA, 18 bp, synthetic construct
  source 1..18: mol_type = other DNA
taatacgacaaactatcg

SEQ ID NO: 5708 - DNA, 18 bp, synthetic construct
  source 1..18: mol_type = other DNA
taatacgactcaaaatgg

SEQ ID NO: 5709 - DNA, 18 bp, synthetic construct
  source 1..18: mol_type = other DNA
taatacgattcgctatcg

SEQ ID NO: 5710 - DNA, 18 bp, synthetic construct
  source 1..18: mol_type = other DNA
taattcgactcaatatgg

SEQ ID NO: 5711 - DNA, 18 bp, synthetic construct
  source 1..18: mol_type = other DNA
taattcgactcactagcg

SEQ ID NO: 5712 - DNA, 18 bp, synthetic construct
  source 1..18: mol_type = other DNA
tattacgaaccactatag

SEQ ID NO: 5713 - DNA, 18 bp, synthetic construct
  source 1..18: mol_type = other DNA
tattgccactcactatag

SEQ ID NO: 5714 - DNA, 18 bp, synthetic construct
  source 1..18: mol_type = other DNA
tcatactactcattatag

SEQ ID NO: 5715 - DNA, 18 bp, synthetic construct
  source 1..18: mol_type = other DNA
tattaaaactcactatag

SEQ ID NO: 5716 - DNA, 18 bp, synthetic construct
  source 1..18: mol_type = other DNA
taatacgacaaactctag

SEQ ID NO: 5717 - DNA, 18 bp, synthetic construct
  source 1..18: mol_type = other DNA
tgatatgactcactattg

SEQ ID NO: 5718 - DNA, 18 bp, synthetic construct
  source 1..18: mol_type = other DNA
cattacgactcactacag

SEQ ID NO: 5719 - DNA, 18 bp, synthetic construct
  source 1..18: mol_type = other DNA
taaaaccactcattatag

SEQ ID NO: 5720 - DNA, 18 bp, synthetic construct
  source 1..18: mol_type = other DNA
taaagcgactcaatatag

SEQ ID NO: 5721 - DNA, 18 bp, synthetic construct
  source 1..18: mol_type = other DNA
taatacgactcacactcg

SEQ ID NO: 5722 - DNA, 18 bp, synthetic construct
  source 1..18: mol_type = other DNA
taatacgtctcactgttg

SEQ ID NO: 5723 - DNA, 18 bp, synthetic construct
  source 1..18: mol_type = other DNA
taatataactaactatag

SEQ ID NO: 5724 - DNA, 18 bp, synthetic construct
  source 1..18: mol_type = other DNA
taatgcgattcactttag

SEQ ID NO: 5725 - DNA, 18 bp, synthetic construct
  source 1..18: mol_type = other DNA
taatacgtctcaataaag

SEQ ID NO: 5726 - DNA, 18 bp, synthetic construct
  source 1..18: mol_type = other DNA
taaaccgactcactattg

SEQ ID NO: 5727 - DNA, 18 bp, synthetic construct
  source 1..18: mol_type = other DNA
taatattacttactatag

SEQ ID NO: 5728 - DNA, 18 bp, synthetic construct
  source 1..18: mol_type = other DNA
taacacaactcactaaag

SEQ ID NO: 5729 - DNA, 18 bp, synthetic construct
  source 1..18: mol_type = other DNA
ttataaaactcactatag

SEQ ID NO: 5730 - DNA, 18 bp, synthetic construct
  source 1..18: mol_type = other DNA
ttatactacttactatag

SEQ ID NO: 5731 - DNA, 18 bp, synthetic construct
  source 1..18: mol_type = other DNA
ttatacaactcactaaag

SEQ ID NO: 5732 - DNA, 18 bp, synthetic construct
  source 1..18: mol_type = other DNA
taataggactctctttag

SEQ ID NO: 5733 - DNA, 18 bp, synthetic construct
  source 1..18: mol_type = other DNA
taaaacgactctccatag

SEQ ID NO: 5734 - DNA, 18 bp, synthetic construct
  source 1..18: mol_type = other DNA
taatacaattcactacag

SEQ ID NO: 5735 - DNA, 18 bp, synthetic construct
  source 1..18: mol_type = other DNA
taatacggctttctatag

SEQ ID NO: 5736 - DNA, 18 bp, synthetic construct
  source 1..18: mol_type = other DNA
taattcgactctctctag

SEQ ID NO: 5737 - DNA, 18 bp, synthetic construct
  source 1..18: mol_type = other DNA
caatacgacacactaaag

SEQ ID NO: 5738 - DNA, 18 bp, synthetic construct
  source 1..18: mol_type = other DNA
taaatcgactcactatcg

SEQ ID NO: 5739 - DNA, 18 bp, synthetic construct
  source 1..18: mol_type = other DNA
taatgccactcactattg

SEQ ID NO: 5740 - DNA, 18 bp, synthetic construct
  source 1..18: mol_type = other DNA
taattcgactcactagtg

SEQ ID NO: 5741 - DNA, 18 bp, synthetic construct
  source 1..18: mol_type = other DNA
taccacgactctctatag

SEQ ID NO: 5742 - DNA, 18 bp, synthetic construct
  source 1..18: mol_type = other DNA
aactacgactcactctag

SEQ ID NO: 5743 - DNA, 18 bp, synthetic construct
  source 1..18: mol_type = other DNA
ctatacgactcaccatag

SEQ ID NO: 5744 - DNA, 18 bp, synthetic construct
  source 1..18: mol_type = other DNA
taaaacgaatcactagag

SEQ ID NO: 5745 - DNA, 18 bp, synthetic construct
  source 1..18: mol_type = other DNA
taattcaacgcactatag

SEQ ID NO: 5746 - DNA, 18 bp, synthetic construct
  source 1..18: mol_type = other DNA
tattatgactcagtatag

SEQ ID NO: 5747 - DNA, 18 bp, synthetic construct
  source 1..18: mol_type = other DNA
ttatacgactcgttatag

SEQ ID NO: 5748 - DNA, 18 bp, synthetic construct
  source 1..18: mol_type = other DNA
ttatccgactcagtatag

SEQ ID NO: 5749 - DNA, 18 bp, synthetic construct
  source 1..18: mol_type = other DNA
ttctacgactcactatcg

SEQ ID NO: 5750 - DNA, 18 bp, synthetic construct
  source 1..18: mol_type = other DNA
aaatacgacttactagag

SEQ ID NO: 5751 - DNA, 18 bp, synthetic construct
  source 1..18: mol_type = other DNA
agatacgactcaccatag

SEQ ID NO: 5752 - DNA, 18 bp, synthetic construct
  source 1..18: mol_type = other DNA
caatacgaatcactagag

SEQ ID NO: 5753 - DNA, 18 bp, synthetic construct
  source 1..18: mol_type = other DNA
caatactcctcactatag

SEQ ID NO: 5754 - DNA, 18 bp, synthetic construct
  source 1..18: mol_type = other DNA
ccatacgactcactttag

SEQ ID NO: 5755 - DNA, 18 bp, synthetic construct
  source 1..18: mol_type = other DNA
gattacgactcattatag

SEQ ID NO: 5756 - DNA, 18 bp, synthetic construct
  source 1..18: mol_type = other DNA
gtatacgaatcactatag

SEQ ID NO: 5757 - DNA, 18 bp, synthetic construct
  source 1..18: mol_type = other DNA
taaaacgactcactggag

SEQ ID NO: 5758 - DNA, 18 bp, synthetic construct
  source 1..18: mol_type = other DNA
taaaacgcctcgctatag

SEQ ID NO: 5759 - DNA, 18 bp, synthetic construct
  source 1..18: mol_type = other DNA
taaagcgactccctatag

SEQ ID NO: 5760 - DNA, 18 bp, synthetic construct
  source 1..18: mol_type = other DNA
taacacgcctaactatag

SEQ ID NO: 5761 - DNA, 18 bp, synthetic construct
  source 1..18: mol_type = other DNA
taagacgaatcactacag

SEQ ID NO: 5762 - DNA, 18 bp, synthetic construct
  source 1..18: mol_type = other DNA
taagacgactcactgaag

SEQ ID NO: 5763 - DNA, 18 bp, synthetic construct
  source 1..18: mol_type = other DNA
taataagactcaatctag

SEQ ID NO: 5764 - DNA, 18 bp, synthetic construct
  source 1..18: mol_type = other DNA
taatacaaatcactatcg

SEQ ID NO: 5765 - DNA, 18 bp, synthetic construct
  source 1..18: mol_type = other DNA
taatacgaatccttatag

SEQ ID NO: 5766 - DNA, 18 bp, synthetic construct
  source 1..18: mol_type = other DNA
taatacgaatgacaatag

SEQ ID NO: 5767 - DNA, 18 bp, synthetic construct
  source 1..18: mol_type = other DNA
taatacgactgactctcg

SEQ ID NO: 5768 - DNA, 18 bp, synthetic construct
  source 1..18: mol_type = other DNA
taatacgattgcctatag

SEQ ID NO: 5769 - DNA, 18 bp, synthetic construct
  source 1..18: mol_type = other DNA
taatacgcatccctatag

SEQ ID NO: 5770 - DNA, 18 bp, synthetic construct
  source 1..18: mol_type = other DNA
taatacgcctaactatgg

SEQ ID NO: 5771 - DNA, 18 bp, synthetic construct
  source 1..18: mol_type = other DNA
taatacgcctcagtattg

SEQ ID NO: 5772 - DNA, 18 bp, synthetic construct
  source 1..18: mol_type = other DNA
taatactacttgctatag

SEQ ID NO: 5773 - DNA, 18 bp, synthetic construct
  source 1..18: mol_type = other DNA
taatatgactcacggtag

SEQ ID NO: 5774 - DNA, 18 bp, synthetic construct
  source 1..18: mol_type = other DNA
taatatggctcaatatag

SEQ ID NO: 5775 - DNA, 18 bp, synthetic construct
  source 1..18: mol_type = other DNA
taatccgactcacgattg

SEQ ID NO: 5776 - DNA, 18 bp, synthetic construct
  source 1..18: mol_type = other DNA
taatctgactaactatag

SEQ ID NO: 5777 - DNA, 18 bp, synthetic construct
  source 1..18: mol_type = other DNA
taatgcgactcattagag

SEQ ID NO: 5778 - DNA, 18 bp, synthetic construct
  source 1..18: mol_type = other DNA
tactacgacaccctatag

SEQ ID NO: 5779 - DNA, 18 bp, synthetic construct
  source 1..18: mol_type = other DNA
tactacgtctcgctatag

SEQ ID NO: 5780 - DNA, 18 bp, synthetic construct
  source 1..18: mol_type = other DNA
tactactactcactctag

SEQ ID NO: 5781 - DNA, 18 bp, synthetic construct
  source 1..18: mol_type = other DNA
tactatgactcactatcg

SEQ ID NO: 5782 - DNA, 18 bp, synthetic construct
  source 1..18: mol_type = other DNA
tagtataactcactatag

SEQ ID NO: 5783 - DNA, 18 bp, synthetic construct
  source 1..18: mol_type = other DNA
tagttccactcactatag

SEQ ID NO: 5784 - DNA, 18 bp, synthetic construct
  source 1..18: mol_type = other DNA
tagttcgactcactatcg

SEQ ID NO: 5785 - DNA, 18 bp, synthetic construct
  source 1..18: mol_type = other DNA
tattacgacccactagag

SEQ ID NO: 5786 - DNA, 18 bp, synthetic construct
  source 1..18: mol_type = other DNA
tcaaacgaatcactatag

SEQ ID NO: 5787 - DNA, 18 bp, synthetic construct
  source 1..18: mol_type = other DNA
tcataagactaactatag

SEQ ID NO: 5788 - DNA, 18 bp, synthetic construct
  source 1..18: mol_type = other DNA
tcatgtgactcactatag

SEQ ID NO: 5789 - DNA, 18 bp, synthetic construct
  source 1..18: mol_type = other DNA
tgatacgaatccctatag

SEQ ID NO: 5790 - DNA, 18 bp, synthetic construct
  source 1..18: mol_type = other DNA
tgatacgactgactacag

SEQ ID NO: 5791 - DNA, 18 bp, synthetic construct
  source 1..18: mol_type = other DNA
tgatatgactcaatatag

SEQ ID NO: 5792 - DNA, 18 bp, synthetic construct
  source 1..18: mol_type = other DNA
tgatatgattcactatag

SEQ ID NO: 5793 - DNA, 18 bp, synthetic construct
  source 1..18: mol_type = other DNA
ttatacgactgagtatag

SEQ ID NO: 5794 - DNA, 18 bp, synthetic construct
  source 1..18: mol_type = other DNA
ttatacgagtcacgatag

SEQ ID NO: 5795 - DNA, 18 bp, synthetic construct
  source 1..18: mol_type = other DNA
ttattcgacgcactatag

SEQ ID NO: 5796 - DNA, 18 bp, synthetic construct
  source 1..18: mol_type = other DNA
aaatacgactcactatcc

SEQ ID NO: 5797 - DNA, 18 bp, synthetic construct
  source 1..18: mol_type = other DNA
aaatacggctcaccatag

SEQ ID NO: 5798 - DNA, 18 bp, synthetic construct
  source 1..18: mol_type = other DNA
aaatacggctccctatag

SEQ ID NO: 5799 - DNA, 18 bp, synthetic construct
  source 1..18: mol_type = other DNA
caaaacgactcactatcg

SEQ ID NO: 5800 - DNA, 18 bp, synthetic construct
  source 1..18: mol_type = other DNA
caatacgacttagtatag

SEQ ID NO: 5801 - DNA, 18 bp, synthetic construct
  source 1..18: mol_type = other DNA
caatactactcgctatag

SEQ ID NO: 5802 - DNA, 18 bp, synthetic construct
  source 1..18: mol_type = other DNA
caatactactgactatag

SEQ ID NO: 5803 - DNA, 18 bp, synthetic construct
  source 1..18: mol_type = other DNA
cagtacgactaactatag

SEQ ID NO: 5804 - DNA, 18 bp, synthetic construct
  source 1..18: mol_type = other DNA
gaataccactcactttag

SEQ ID NO: 5805 - DNA, 18 bp, synthetic construct
  source 1..18: mol_type = other DNA
gaatactactcaccatag

SEQ ID NO: 5806 - DNA, 18 bp, synthetic construct
  source 1..18: mol_type = other DNA
gaataggactcactattg

SEQ ID NO: 5807 - DNA, 18 bp, synthetic construct
  source 1..18: mol_type = other DNA
gagtacgtctcactatag

SEQ ID NO: 5808 - DNA, 18 bp, synthetic construct
  source 1..18: mol_type = other DNA
taaaaagacgcactatag

SEQ ID NO: 5809 - DNA, 18 bp, synthetic construct
  source 1..18: mol_type = other DNA
taaaacgactccctagag

SEQ ID NO: 5810 - DNA, 18 bp, synthetic construct
  source 1..18: mol_type = other DNA
taaaacgacttagtatag

SEQ ID NO: 5811 - DNA, 18 bp, synthetic construct
  source 1..18: mol_type = other DNA
taaaacgagtcactctag

SEQ ID NO: 5812 - DNA, 18 bp, synthetic construct
  source 1..18: mol_type = other DNA
taaaacggctcacgatag

SEQ ID NO: 5813 - DNA, 18 bp, synthetic construct
  source 1..18: mol_type = other DNA
taacaccactcactacag

SEQ ID NO: 5814 - DNA, 18 bp, synthetic construct
  source 1..18: mol_type = other DNA
taacacgactcagaatag

SEQ ID NO: 5815 - DNA, 18 bp, synthetic construct
  source 1..18: mol_type = other DNA
taacccgactcaatatag

SEQ ID NO: 5816 - DNA, 18 bp, synthetic construct
  source 1..18: mol_type = other DNA
taacgcgactaactatag

SEQ ID NO: 5817 - DNA, 18 bp, synthetic construct
  source 1..18: mol_type = other DNA
taagacgactcacaatgg

SEQ ID NO: 5818 - DNA, 18 bp, synthetic construct
  source 1..18: mol_type = other DNA
taagtcgacccactatag

SEQ ID NO: 5819 - DNA, 18 bp, synthetic construct
  source 1..18: mol_type = other DNA
taataacacgcactatag

SEQ ID NO: 5820 - DNA, 18 bp, synthetic construct
  source 1..18: mol_type = other DNA
taataagactcactgtac

SEQ ID NO: 5821 - DNA, 18 bp, synthetic construct
  source 1..18: mol_type = other DNA
taataagactgacgatag

SEQ ID NO: 5822 - DNA, 18 bp, synthetic construct
  source 1..18: mol_type = other DNA
taatacaacccactctag

SEQ ID NO: 5823 - DNA, 18 bp, synthetic construct
  source 1..18: mol_type = other DNA
taatacaactcacgatcg

SEQ ID NO: 5824 - DNA, 18 bp, synthetic construct
  source 1..18: mol_type = other DNA
taatacagctcactagag

SEQ ID NO: 5825 - DNA, 18 bp, synthetic construct
  source 1..18: mol_type = other DNA
taataccaatgactatag

SEQ ID NO: 5826 - DNA, 18 bp, synthetic construct
  source 1..18: mol_type = other DNA
taataccactcacgttag

SEQ ID NO: 5827 - DNA, 18 bp, synthetic construct
  source 1..18: mol_type = other DNA
taataccactccctatcg

SEQ ID NO: 5828 - DNA, 18 bp, synthetic construct
  source 1..18: mol_type = other DNA
taatacccctcactttag

SEQ ID NO: 5829 - DNA, 18 bp, synthetic construct
  source 1..18: mol_type = other DNA
taatacgaaacactatgg

SEQ ID NO: 5830 - DNA, 18 bp, synthetic construct
  source 1..18: mol_type = other DNA
taatacgaagcactctag

SEQ ID NO: 5831 - DNA, 18 bp, synthetic construct
  source 1..18: mol_type = other DNA
taatacgacccattctag

SEQ ID NO: 5832 - DNA, 18 bp, synthetic construct
  source 1..18: mol_type = other DNA
taatacgactcaccgtcg

SEQ ID NO: 5833 - DNA, 18 bp, synthetic construct
  source 1..18: mol_type = other DNA
taatacgactcatcatgg

SEQ ID NO: 5834 - DNA, 18 bp, synthetic construct
  source 1..18: mol_type = other DNA
taatacgactccccctag

SEQ ID NO: 5835 - DNA, 18 bp, synthetic construct
  source 1..18: mol_type = other DNA
taatacgactcggtttag

SEQ ID NO: 5836 - DNA, 18 bp, synthetic construct
  source 1..18: mol_type = other DNA
taatacgactctctgtgg

SEQ ID NO: 5837 - DNA, 18 bp, synthetic construct
  source 1..18: mol_type = other DNA
taatacgactgaatagag

SEQ ID NO: 5838 - DNA, 18 bp, synthetic construct
  source 1..18: mol_type = other DNA
taatacgactgactactg

SEQ ID NO: 5839 - DNA, 18 bp, synthetic construct
  source 1..18: mol_type = other DNA
taatacgagtgactttag

SEQ ID NO: 5840 - DNA, 18 bp, synthetic construct
  source 1..18: mol_type = other DNA
taatacgcatcactacag

SEQ ID NO: 5841 - DNA, 18 bp, synthetic construct
  source 1..18: mol_type = other DNA
taatacggctcacactag

SEQ ID NO: 5842 - DNA, 18 bp, synthetic construct
  source 1..18: mol_type = other DNA
taatacgtcccacgatag

SEQ ID NO: 5843 - DNA, 18 bp, synthetic construct
  source 1..18: mol_type = other DNA
taatacgtctcagtagag

SEQ ID NO: 5844 - DNA, 18 bp, synthetic construct
  source 1..18: mol_type = other DNA
taatacgtctgcctatag

SEQ ID NO: 5845 - DNA, 18 bp, synthetic construct
  source 1..18: mol_type = other DNA
taatactactcaagatag

SEQ ID NO: 5846 - DNA, 18 bp, synthetic construct
  source 1..18: mol_type = other DNA
taataggacccaccatag

SEQ ID NO: 5847 - DNA, 18 bp, synthetic construct
  source 1..18: mol_type = other DNA
taataggacgcacaatag

SEQ ID NO: 5848 - DNA, 18 bp, synthetic construct
  source 1..18: mol_type = other DNA
taatatcaatcactatag

SEQ ID NO: 5849 - DNA, 18 bp, synthetic construct
  source 1..18: mol_type = other DNA
taatatgacccattatag

SEQ ID NO: 5850 - DNA, 18 bp, synthetic construct
  source 1..18: mol_type = other DNA
taatccgaatcaccatag

SEQ ID NO: 5851 - DNA, 18 bp, synthetic construct
  source 1..18: mol_type = other DNA
taatccgaatcagtatag

SEQ ID NO: 5852 - DNA, 18 bp, synthetic construct
  source 1..18: mol_type = other DNA
taatccgacttactagag

SEQ ID NO: 5853 - DNA, 18 bp, synthetic construct
  source 1..18: mol_type = other DNA
taatgcgacccactatcg

SEQ ID NO: 5854 - DNA, 18 bp, synthetic construct
  source 1..18: mol_type = other DNA
tactagggctcactatag

SEQ ID NO: 5855 - DNA, 18 bp, synthetic construct
  source 1..18: mol_type = other DNA
taggaagactcactatag

SEQ ID NO: 5856 - DNA, 18 bp, synthetic construct
  source 1..18: mol_type = other DNA
tagtaagactcacgatag

SEQ ID NO: 5857 - DNA, 18 bp, synthetic construct
  source 1..18: mol_type = other DNA
tattacgacgcactacag

SEQ ID NO: 5858 - DNA, 18 bp, synthetic construct
  source 1..18: mol_type = other DNA
tattacgagccactatag

SEQ ID NO: 5859 - DNA, 18 bp, synthetic construct
  source 1..18: mol_type = other DNA
tattaggacgcactatag

SEQ ID NO: 5860 - DNA, 18 bp, synthetic construct
  source 1..18: mol_type = other DNA
tcacaggactcactatag

SEQ ID NO: 5861 - DNA, 18 bp, synthetic construct
  source 1..18: mol_type = other DNA
tcatacgactcagaatag

SEQ ID NO: 5862 - DNA, 18 bp, synthetic construct
  source 1..18: mol_type = other DNA
tcatactactcacgatag

SEQ ID NO: 5863 - DNA, 18 bp, synthetic construct
  source 1..18: mol_type = other DNA
tcatcagactcactatag

SEQ ID NO: 5864 - DNA, 18 bp, synthetic construct
  source 1..18: mol_type = other DNA
tgatacgacgcactatcg

SEQ ID NO: 5865 - DNA, 18 bp, synthetic construct
  source 1..18: mol_type = other DNA
tgatacgcttcactatag

SEQ ID NO: 5866 - DNA, 18 bp, synthetic construct
  source 1..18: mol_type = other DNA
tgataggagtcactatag

SEQ ID NO: 5867 - DNA, 18 bp, synthetic construct
  source 1..18: mol_type = other DNA
tggtacgactccctatag

SEQ ID NO: 5868 - DNA, 18 bp, synthetic construct
  source 1..18: mol_type = other DNA
ttatacgactcactatcc

SEQ ID NO: 5869 - DNA, 18 bp, synthetic construct
  source 1..18: mol_type = other DNA
ttatacgactcactgtac

SEQ ID NO: 5870 - DNA, 18 bp, synthetic construct
  source 1..18: mol_type = other DNA
ttatacgactctctataa

SEQ ID NO: 5871 - DNA, 18 bp, synthetic construct
  source 1..18: mol_type = other DNA
ttatacggctcaccatag

SEQ ID NO: 5872 - DNA, 18 bp, synthetic construct
  source 1..18: mol_type = other DNA
tattacgtctcactttag

SEQ ID NO: 5873 - DNA, 18 bp, synthetic construct
  source 1..18: mol_type = other DNA
taaaacgactcaataaag

SEQ ID NO: 5874 - DNA, 18 bp, synthetic construct
  source 1..18: mol_type = other DNA
taataagtctcactctag

SEQ ID NO: 5875 - DNA, 18 bp, synthetic construct
  source 1..18: mol_type = other DNA
tattacgcctcactttag

SEQ ID NO: 5876 - DNA, 18 bp, synthetic construct
  source 1..18: mol_type = other DNA
ttatactcctcactatag

SEQ ID NO: 5877 - DNA, 18 bp, synthetic construct
  source 1..18: mol_type = other DNA
aaatacaactctctatag

SEQ ID NO: 5878 - DNA, 18 bp, synthetic construct
  source 1..18: mol_type = other DNA
taattcgtctaactatag

SEQ ID NO: 5879 - DNA, 18 bp, synthetic construct
  source 1..18: mol_type = other DNA
aaacacgacacactatag

SEQ ID NO: 5880 - DNA, 18 bp, synthetic construct
  source 1..18: mol_type = other DNA
aaatacgactcacagtag

SEQ ID NO: 5881 - DNA, 18 bp, synthetic construct
  source 1..18: mol_type = other DNA
aaatatgactcactacag

SEQ ID NO: 5882 - DNA, 18 bp, synthetic construct
  source 1..18: mol_type = other DNA
aaattcgactcactacag

SEQ ID NO: 5883 - DNA, 18 bp, synthetic construct
  source 1..18: mol_type = other DNA
taataccactcaccattg

SEQ ID NO: 5884 - DNA, 18 bp, synthetic construct
  source 1..18: mol_type = other DNA
taatacgtttcactatgg

SEQ ID NO: 5885 - DNA, 18 bp, synthetic construct
  source 1..18: mol_type = other DNA
taatatgtctcagtatag

SEQ ID NO: 5886 - DNA, 18 bp, synthetic construct
  source 1..18: mol_type = other DNA
tagtttgactcactatag

SEQ ID NO: 5887 - DNA, 18 bp, synthetic construct
  source 1..18: mol_type = other DNA
tataaagactcactatag

SEQ ID NO: 5888 - DNA, 18 bp, synthetic construct
  source 1..18: mol_type = other DNA
aaatacgactcacaaaag

SEQ ID NO: 5889 - DNA, 18 bp, synthetic construct
  source 1..18: mol_type = other DNA
taacacgactatctatag

SEQ ID NO: 5890 - DNA, 18 bp, synthetic construct
  source 1..18: mol_type = other DNA
taatacgacacgcaatag

SEQ ID NO: 5891 - DNA, 18 bp, synthetic construct
  source 1..18: mol_type = other DNA
caatacgactcaccacag

SEQ ID NO: 5892 - DNA, 18 bp, synthetic construct
  source 1..18: mol_type = other DNA
taataccactcaatgtag

SEQ ID NO: 5893 - DNA, 18 bp, synthetic construct
  source 1..18: mol_type = other DNA
taatccaattcactatag

SEQ ID NO: 5894 - DNA, 18 bp, synthetic construct
  source 1..18: mol_type = other DNA
taattcgcctaactatag

SEQ ID NO: 5895 - DNA, 18 bp, synthetic construct
  source 1..18: mol_type = other DNA
tattacgacgcactattg

SEQ ID NO: 5896 - DNA, 18 bp, synthetic construct
  source 1..18: mol_type = other DNA
tattacgactacctatag

SEQ ID NO: 5897 - DNA, 18 bp, synthetic construct
  source 1..18: mol_type = other DNA
tcatacgacacaatatag

SEQ ID NO: 5898 - DNA, 18 bp, synthetic construct
  source 1..18: mol_type = other DNA
tttgacgactcactatag

SEQ ID NO: 5899 - DNA, 18 bp, synthetic construct
  source 1..18: mol_type = other DNA
taataagactctccatag

SEQ ID NO: 5900 - DNA, 18 bp, synthetic construct
  source 1..18: mol_type = other DNA
aaatacgaccaactatag

SEQ ID NO: 5901 - DNA, 18 bp, synthetic construct
  source 1..18: mol_type = other DNA
caataccactcactttag

SEQ ID NO: 5902 - DNA, 18 bp, synthetic construct
  source 1..18: mol_type = other DNA
caatacgactgacaatag

SEQ ID NO: 5903 - DNA, 18 bp, synthetic construct
  source 1..18: mol_type = other DNA
taatacgatacactgtag

SEQ ID NO: 5904 - DNA, 18 bp, synthetic construct
  source 1..18: mol_type = other DNA
taatactactccctaaag

SEQ ID NO: 5905 - DNA, 18 bp, synthetic construct
  source 1..18: mol_type = other DNA
taatgcaactctctatag

SEQ ID NO: 5906 - DNA, 18 bp, synthetic construct
  source 1..18: mol_type = other DNA
tagtacaactaactatag

SEQ ID NO: 5907 - DNA, 18 bp, synthetic construct
  source 1..18: mol_type = other DNA
tagtacgactctatatag

SEQ ID NO: 5908 - DNA, 18 bp, synthetic construct
  source 1..18: mol_type = other DNA
tgatccgtctcactatag

SEQ ID NO: 5909 - DNA, 18 bp, synthetic construct
  source 1..18: mol_type = other DNA
taatacgtctcaaaatag

SEQ ID NO: 5910 - DNA, 18 bp, synthetic construct
  source 1..18: mol_type = other DNA
aaatacgactaaccatag

SEQ ID NO: 5911 - DNA, 18 bp, synthetic construct
  source 1..18: mol_type = other DNA
tcatacgacttactaaag

SEQ ID NO: 5912 - DNA, 18 bp, synthetic construct
  source 1..18: mol_type = other DNA
ttatccgactcaatatag

SEQ ID NO: 5913 - DNA, 18 bp, synthetic construct
  source 1..18: mol_type = other DNA
tatcacgactcactattg

SEQ ID NO: 5914 - DNA, 18 bp, synthetic construct
  source 1..18: mol_type = other DNA
taatacgttacactatag

SEQ ID NO: 5915 - DNA, 18 bp, synthetic construct
  source 1..18: mol_type = other DNA
aaaatcgactcactatag

SEQ ID NO: 5916 - DNA, 18 bp, synthetic construct
  source 1..18: mol_type = other DNA
caaaacgactcactattg

SEQ ID NO: 5917 - DNA, 18 bp, synthetic construct
  source 1..18: mol_type = other DNA
taaaacaactcactatcg

SEQ ID NO: 5918 - DNA, 18 bp, synthetic construct
  source 1..18: mol_type = other DNA
taatatgagtcactttag

SEQ ID NO: 5919 - DNA, 18 bp, synthetic construct
  source 1..18: mol_type = other DNA
tattacgactcactaagg

SEQ ID NO: 5920 - DNA, 18 bp, synthetic construct
  source 1..18: mol_type = other DNA
tcatacgtctccctatag

SEQ ID NO: 5921 - DNA, 18 bp, synthetic construct
  source 1..18: mol_type = other DNA
ttatacgcctcaatatag

SEQ ID NO: 5922 - DNA, 18 bp, synthetic construct
  source 1..18: mol_type = other DNA
aaatgagactcactatag

SEQ ID NO: 5923 - DNA, 18 bp, synthetic construct
  source 1..18: mol_type = other DNA
agatacggctcactatag

SEQ ID NO: 5924 - DNA, 18 bp, synthetic construct
  source 1..18: mol_type = other DNA
caatacgactcaatctag

SEQ ID NO: 5925 - DNA, 18 bp, synthetic construct
  source 1..18: mol_type = other DNA
caatacgactcactccag

SEQ ID NO: 5926 - DNA, 18 bp, synthetic construct
  source 1..18: mol_type = other DNA
caatacgactcagtatgg

SEQ ID NO: 5927 - DNA, 18 bp, synthetic construct
  source 1..18: mol_type = other DNA
gaatacaactcacaatag

SEQ ID NO: 5928 - DNA, 18 bp, synthetic construct
  source 1..18: mol_type = other DNA
gtatactactcactatag

SEQ ID NO: 5929 - DNA, 18 bp, synthetic construct
  source 1..18: mol_type = other DNA
taaaacgactcacgacag

SEQ ID NO: 5930 - DNA, 18 bp, synthetic construct
  source 1..18: mol_type = other DNA
taacacggcttactatag

SEQ ID NO: 5931 - DNA, 18 bp, synthetic construct
  source 1..18: mol_type = other DNA
taacactactcgctatag

SEQ ID NO: 5932 - DNA, 18 bp, synthetic construct
  source 1..18: mol_type = other DNA
taacgcgaatcactatag

SEQ ID NO: 5933 - DNA, 18 bp, synthetic construct
  source 1..18: mol_type = other DNA
taataaaactcagtatag

SEQ ID NO: 5934 - DNA, 18 bp, synthetic construct
  source 1..18: mol_type = other DNA
taataagacccactacag

SEQ ID NO: 5935 - DNA, 18 bp, synthetic construct
  source 1..18: mol_type = other DNA
taatacgacccacagtag

SEQ ID NO: 5936 - DNA, 18 bp, synthetic construct
  source 1..18: mol_type = other DNA
taatacgaccccctttag

SEQ ID NO: 5937 - DNA, 18 bp, synthetic construct
  source 1..18: mol_type = other DNA
taatacgactaaatctag

SEQ ID NO: 5938 - DNA, 18 bp, synthetic construct
  source 1..18: mol_type = other DNA
taatacgactcaatctcg

SEQ ID NO: 5939 - DNA, 18 bp, synthetic construct
  source 1..18: mol_type = other DNA
taatacgactcattagcg

SEQ ID NO: 5940 - DNA, 18 bp, synthetic construct
  source 1..18: mol_type = other DNA
taatacgactcgctgaag

SEQ ID NO: 5941 - DNA, 18 bp, synthetic construct
  source 1..18: mol_type = other DNA
taatacgattcactaggg

SEQ ID NO: 5942 - DNA, 18 bp, synthetic construct
  source 1..18: mol_type = other DNA
taatacggttcaccatag

SEQ ID NO: 5943 - DNA, 18 bp, synthetic construct
  source 1..18: mol_type = other DNA
taatacgtctcactctgg

SEQ ID NO: 5944 - DNA, 18 bp, synthetic construct
  source 1..18: mol_type = other DNA
taatactacgcgctatag

SEQ ID NO: 5945 - DNA, 18 bp, synthetic construct
  source 1..18: mol_type = other DNA
taatactattcagtatag

SEQ ID NO: 5946 - DNA, 18 bp, synthetic construct
  source 1..18: mol_type = other DNA
taataggactcgctttag

SEQ ID NO: 5947 - DNA, 18 bp, synthetic construct
  source 1..18: mol_type = other DNA
taatatgactacctatag

SEQ ID NO: 5948 - DNA, 18 bp, synthetic construct
  source 1..18: mol_type = other DNA
taatccgactcatcatag

SEQ ID NO: 5949 - DNA, 18 bp, synthetic construct
  source 1..18: mol_type = other DNA
taatccgactgattatag

SEQ ID NO: 5950 - DNA, 18 bp, synthetic construct
  source 1..18: mol_type = other DNA
taatgcgacttacgatag

SEQ ID NO: 5951 - DNA, 18 bp, synthetic construct
  source 1..18: mol_type = other DNA
taattagagtcactatag

SEQ ID NO: 5952 - DNA, 18 bp, synthetic construct
  source 1..18: mol_type = other DNA
tagtacgactcaacatag

SEQ ID NO: 5953 - DNA, 18 bp, synthetic construct
  source 1..18: mol_type = other DNA
tagtacgcctcactgtag

SEQ ID NO: 5954 - DNA, 18 bp, synthetic construct
  source 1..18: mol_type = other DNA
tcatacgaatcactctag

SEQ ID NO: 5955 - DNA, 18 bp, synthetic construct
  source 1..18: mol_type = other DNA
tgatacgactcactgtcg

SEQ ID NO: 5956 - DNA, 18 bp, synthetic construct
  source 1..18: mol_type = other DNA
tattacgtctcgctatag

SEQ ID NO: 5957 - DNA, 18 bp, synthetic construct
  source 1..18: mol_type = other DNA
tattacgactatctatag

SEQ ID NO: 5958 - DNA, 18 bp, synthetic construct
  source 1..18: mol_type = other DNA
taatgcgtcttactatag

SEQ ID NO: 5959 - DNA, 18 bp, synthetic construct
  source 1..18: mol_type = other DNA
taattcgagtcactttag

SEQ ID NO: 5960 - DNA, 18 bp, synthetic construct
  source 1..18: mol_type = other DNA
atctacgactcactatag

SEQ ID NO: 5961 - DNA, 18 bp, synthetic construct
  source 1..18: mol_type = other DNA
aaatacggttcactatag

SEQ ID NO: 5962 - DNA, 18 bp, synthetic construct
  source 1..18: mol_type = other DNA
caaaacgactcactatgg

SEQ ID NO: 5963 - DNA, 18 bp, synthetic construct
  source 1..18: mol_type = other DNA
taaaacgactaactgtag

SEQ ID NO: 5964 - DNA, 18 bp, synthetic construct
  source 1..18: mol_type = other DNA
taacacgaatcacaatag

SEQ ID NO: 5965 - DNA, 18 bp, synthetic construct
  source 1..18: mol_type = other DNA
taatacgacttgatatag

SEQ ID NO: 5966 - DNA, 18 bp, synthetic construct
  source 1..18: mol_type = other DNA
taatacgattcaatatcg

SEQ ID NO: 5967 - DNA, 18 bp, synthetic construct
  source 1..18: mol_type = other DNA
taatactactcgccatag

SEQ ID NO: 5968 - DNA, 18 bp, synthetic construct
  source 1..18: mol_type = other DNA
tactatgagtcactatag

SEQ ID NO: 5969 - DNA, 18 bp, synthetic construct
  source 1..18: mol_type = other DNA
tagtgcgactcactatcg

SEQ ID NO: 5970 - DNA, 18 bp, synthetic construct
  source 1..18: mol_type = other DNA
tattaccagtcactatag

SEQ ID NO: 5971 - DNA, 18 bp, synthetic construct
  source 1..18: mol_type = other DNA
tcatacgatacactatag

SEQ ID NO: 5972 - DNA, 18 bp, synthetic construct
  source 1..18: mol_type = other DNA
tcatatgactcacaatag

SEQ ID NO: 5973 - DNA, 18 bp, synthetic construct
  source 1..18: mol_type = other DNA
aaatacgactcaccattg

SEQ ID NO: 5974 - DNA, 18 bp, synthetic construct
  source 1..18: mol_type = other DNA
aaattcgactcagtatag

SEQ ID NO: 5975 - DNA, 18 bp, synthetic construct
  source 1..18: mol_type = other DNA
taatactactcactagtg

SEQ ID NO: 5976 - DNA, 18 bp, synthetic construct
  source 1..18: mol_type = other DNA
taataggtatcactatag

SEQ ID NO: 5977 - DNA, 18 bp, synthetic construct
  source 1..18: mol_type = other DNA
taattcgactgacaatag

SEQ ID NO: 5978 - DNA, 18 bp, synthetic construct
  source 1..18: mol_type = other DNA
tcttacgtctcactatag

SEQ ID NO: 5979 - DNA, 18 bp, synthetic construct
  source 1..18: mol_type = other DNA
taaacctactcactatag

SEQ ID NO: 5980 - DNA, 18 bp, synthetic construct
  source 1..18: mol_type = other DNA
taacacaactcactttag

SEQ ID NO: 5981 - DNA, 18 bp, synthetic construct
  source 1..18: mol_type = other DNA
taataccatacactatag

SEQ ID NO: 5982 - DNA, 18 bp, synthetic construct
  source 1..18: mol_type = other DNA
taatactgctctctatag

SEQ ID NO: 5983 - DNA, 18 bp, synthetic construct
  source 1..18: mol_type = other DNA
taattccactcacaatag

SEQ ID NO: 5984 - DNA, 18 bp, synthetic construct
  source 1..18: mol_type = other DNA
tattacgactctctatcg

SEQ ID NO: 5985 - DNA, 18 bp, synthetic construct
  source 1..18: mol_type = other DNA
aaaaatgactcactatag

SEQ ID NO: 5986 - DNA, 18 bp, synthetic construct
  source 1..18: mol_type = other DNA
tattatcactcactatag

SEQ ID NO: 5987 - DNA, 18 bp, synthetic construct
  source 1..18: mol_type = other DNA
ttatactactcactatgg

SEQ ID NO: 5988 - DNA, 18 bp, synthetic construct
  source 1..18: mol_type = other DNA
ttttacgagtcactatag

SEQ ID NO: 5989 - DNA, 18 bp, synthetic construct
  source 1..18: mol_type = other DNA
ttattcgaatcactatag

SEQ ID NO: 5990 - DNA, 18 bp, synthetic construct
  source 1..18: mol_type = other DNA
aaacacgactcactttag

SEQ ID NO: 5991 - DNA, 18 bp, synthetic construct
  source 1..18: mol_type = other DNA
tattacgactctctatgg

SEQ ID NO: 5992 - DNA, 18 bp, synthetic construct
  source 1..18: mol_type = other DNA
taatacaactctctatcg

SEQ ID NO: 5993 - DNA, 18 bp, synthetic construct
  source 1..18: mol_type = other DNA
aaatacgtctcactattg

SEQ ID NO: 5994 - DNA, 18 bp, synthetic construct
  source 1..18: mol_type = other DNA
tatttcgactcattatag

SEQ ID NO: 5995 - DNA, 18 bp, synthetic construct
  source 1..18: mol_type = other DNA
taataggactctctattg

SEQ ID NO: 5996 - DNA, 18 bp, synthetic construct
  source 1..18: mol_type = other DNA
taatccgactctctattg

SEQ ID NO: 5997 - DNA, 18 bp, synthetic construct
  source 1..18: mol_type = other DNA
taatccgtcacactatag

SEQ ID NO: 5998 - DNA, 18 bp, synthetic construct
  source 1..18: mol_type = other DNA
tactacgaatcactattg

SEQ ID NO: 5999 - DNA, 18 bp, synthetic construct
  source 1..18: mol_type = other DNA
ttctacgactcattatag

SEQ ID NO: 6000 - DNA, 18 bp, synthetic construct
  source 1..18: mol_type = other DNA
taatagaactctctatag

SEQ ID NO: 6001 - DNA, 18 bp, synthetic construct
  source 1..18: mol_type = other DNA
taataaggctcactttag

SEQ ID NO: 6002 - DNA, 18 bp, synthetic construct
  source 1..18: mol_type = other DNA
taatacaactcactgaag

SEQ ID NO: 6003 - DNA, 18 bp, synthetic construct
  source 1..18: mol_type = other DNA
taatatgacccactttag

SEQ ID NO: 6004 - DNA, 18 bp, synthetic construct
  source 1..18: mol_type = other DNA
taattcgacccaatatag

SEQ ID NO: 6005 - DNA, 18 bp, synthetic construct
  source 1..18: mol_type = other DNA
tcacaagactcactatag

SEQ ID NO: 6006 - DNA, 18 bp, synthetic construct
  source 1..18: mol_type = other DNA
tcatgcgactcactaaag

SEQ ID NO: 6007 - DNA, 18 bp, synthetic construct
  source 1..18: mol_type = other DNA
ttataccactcactagag

SEQ ID NO: 6008 - DNA, 18 bp, synthetic construct
  source 1..18: mol_type = other DNA
taataagactcacaatcg

SEQ ID NO: 6009 - DNA, 18 bp, synthetic construct
  source 1..18: mol_type = other DNA
taatacgactcgcattag

SEQ ID NO: 6010 - DNA, 18 bp, synthetic construct
  source 1..18: mol_type = other DNA
ttctacgactcactattg

SEQ ID NO: 6011 - DNA, 18 bp, synthetic construct
  source 1..18: mol_type = other DNA
aaatacgagccactatag

SEQ ID NO: 6012 - DNA, 18 bp, synthetic construct
  source 1..18: mol_type = other DNA
acataggactcactatag

SEQ ID NO: 6013 - DNA, 18 bp, synthetic construct
  source 1..18: mol_type = other DNA
cagtacgactcattatag

SEQ ID NO: 6014 - DNA, 18 bp, synthetic construct
  source 1..18: mol_type = other DNA
taacacgactcacaatcg

SEQ ID NO: 6015 - DNA, 18 bp, synthetic construct
  source 1..18: mol_type = other DNA
taagaatactcactatag

SEQ ID NO: 6016 - DNA, 18 bp, synthetic construct
  source 1..18: mol_type = other DNA
taataacacacactatag

SEQ ID NO: 6017 - DNA, 18 bp, synthetic construct
  source 1..18: mol_type = other DNA
taataagactcactaagg

SEQ ID NO: 6018 - DNA, 18 bp, synthetic construct
  source 1..18: mol_type = other DNA
taataagactcactctgg

SEQ ID NO: 6019 - DNA, 18 bp, synthetic construct
  source 1..18: mol_type = other DNA
taataagtctcacgatag

SEQ ID NO: 6020 - DNA, 18 bp, synthetic construct
  source 1..18: mol_type = other DNA
taatacgacaaaccatag

SEQ ID NO: 6021 - DNA, 18 bp, synthetic construct
  source 1..18: mol_type = other DNA
taatacgactcaaaatcg

SEQ ID NO: 6022 - DNA, 18 bp, synthetic construct
  source 1..18: mol_type = other DNA
taatacgactgataatag

SEQ ID NO: 6023 - DNA, 18 bp, synthetic construct
  source 1..18: mol_type = other DNA
taatacgagacactctag

SEQ ID NO: 6024 - DNA, 18 bp, synthetic construct
  source 1..18: mol_type = other DNA
taatacgagtcactttgg

SEQ ID NO: 6025 - DNA, 18 bp, synthetic construct
  source 1..18: mol_type = other DNA
taataggactccctattg

SEQ ID NO: 6026 - DNA, 18 bp, synthetic construct
  source 1..18: mol_type = other DNA
taatatgactaaatatag

SEQ ID NO: 6027 - DNA, 18 bp, synthetic construct
  source 1..18: mol_type = other DNA
taatatgactcatcatag

SEQ ID NO: 6028 - DNA, 18 bp, synthetic construct
  source 1..18: mol_type = other DNA
taatccgactcactaagg

SEQ ID NO: 6029 - DNA, 18 bp, synthetic construct
  source 1..18: mol_type = other DNA
taatgagactctctatag

SEQ ID NO: 6030 - DNA, 18 bp, synthetic construct
  source 1..18: mol_type = other DNA
taatgcgactcagaatag

SEQ ID NO: 6031 - DNA, 18 bp, synthetic construct
  source 1..18: mol_type = other DNA
taattcgactcattatgg

SEQ ID NO: 6032 - DNA, 18 bp, synthetic construct
  source 1..18: mol_type = other DNA
tagtacgactcattgtag

SEQ ID NO: 6033 - DNA, 18 bp, synthetic construct
  source 1..18: mol_type = other DNA
tcacgcgactcactatag

SEQ ID NO: 6034 - DNA, 18 bp, synthetic construct
  source 1..18: mol_type = other DNA
tcatacaactcaccatag

SEQ ID NO: 6035 - DNA, 18 bp, synthetic construct
  source 1..18: mol_type = other DNA
tgataccactcgctatag

SEQ ID NO: 6036 - DNA, 18 bp, synthetic construct
  source 1..18: mol_type = other DNA
tgatacgactctccatag

SEQ ID NO: 6037 - DNA, 18 bp, synthetic construct
  source 1..18: mol_type = other DNA
ttatacgactctcgatag

SEQ ID NO: 6038 - DNA, 18 bp, synthetic construct
  source 1..18: mol_type = other DNA
aaatacgactcagcatag

SEQ ID NO: 6039 - DNA, 18 bp, synthetic construct
  source 1..18: mol_type = other DNA
aaatacgactcgctgtag

SEQ ID NO: 6040 - DNA, 18 bp, synthetic construct
  source 1..18: mol_type = other DNA
caatacgacttactctag

SEQ ID NO: 6041 - DNA, 18 bp, synthetic construct
  source 1..18: mol_type = other DNA
caatatgactcaatatag

SEQ ID NO: 6042 - DNA, 18 bp, synthetic construct
  source 1..18: mol_type = other DNA
cactacgactcaccatag

SEQ ID NO: 6043 - DNA, 18 bp, synthetic construct
  source 1..18: mol_type = other DNA
ccatacgactcactctag

SEQ ID NO: 6044 - DNA, 18 bp, synthetic construct
  source 1..18: mol_type = other DNA
gaacactactcactatag

SEQ ID NO: 6045 - DNA, 18 bp, synthetic construct
  source 1..18: mol_type = other DNA
gaatacgccacactatag

SEQ ID NO: 6046 - DNA, 18 bp, synthetic construct
  source 1..18: mol_type = other DNA
gaatacgtcccactatag

SEQ ID NO: 6047 - DNA, 18 bp, synthetic construct
  source 1..18: mol_type = other DNA
gaattcgactcaatatag

SEQ ID NO: 6048 - DNA, 18 bp, synthetic construct
  source 1..18: mol_type = other DNA
taaaacgactcagcatag

SEQ ID NO: 6049 - DNA, 18 bp, synthetic construct
  source 1..18: mol_type = other DNA
taacaccactcaccatag

SEQ ID NO: 6050 - DNA, 18 bp, synthetic construct
  source 1..18: mol_type = other DNA
taacacgacacactgtag

SEQ ID NO: 6051 - DNA, 18 bp, synthetic construct
  source 1..18: mol_type = other DNA
taacacgactgactattg

SEQ ID NO: 6052 - DNA, 18 bp, synthetic construct
  source 1..18: mol_type = other DNA
taacgcgactcgctatag

SEQ ID NO: 6053 - DNA, 18 bp, synthetic construct
  source 1..18: mol_type = other DNA
taagaccaatcactatag

SEQ ID NO: 6054 - DNA, 18 bp, synthetic construct
  source 1..18: mol_type = other DNA
taagacgacgcactttag

SEQ ID NO: 6055 - DNA, 18 bp, synthetic construct
  source 1..18: mol_type = other DNA
taagacgactaactatcg

SEQ ID NO: 6056 - DNA, 18 bp, synthetic construct
  source 1..18: mol_type = other DNA
taaggcaactcactatag

SEQ ID NO: 6057 - DNA, 18 bp, synthetic construct
  source 1..18: mol_type = other DNA
taatacaactcaccgtag

SEQ ID NO: 6058 - DNA, 18 bp, synthetic construct
  source 1..18: mol_type = other DNA
taatacaactggctatag

SEQ ID NO: 6059 - DNA, 18 bp, synthetic construct
  source 1..18: mol_type = other DNA
taatacaacttactagag

SEQ ID NO: 6060 - DNA, 18 bp, synthetic construct
  source 1..18: mol_type = other DNA
taatacaattcacgatag

SEQ ID NO: 6061 - DNA, 18 bp, synthetic construct
  source 1..18: mol_type = other DNA
taataccacccattatag

SEQ ID NO: 6062 - DNA, 18 bp, synthetic construct
  source 1..18: mol_type = other DNA
taataccacctactatag

SEQ ID NO: 6063 - DNA, 18 bp, synthetic construct
  source 1..18: mol_type = other DNA
taataccagtgactatag

SEQ ID NO: 6064 - DNA, 18 bp, synthetic construct
  source 1..18: mol_type = other DNA
taatacccctcaccatag

SEQ ID NO: 6065 - DNA, 18 bp, synthetic construct
  source 1..18: mol_type = other DNA
taatacgacacacgatcg

SEQ ID NO: 6066 - DNA, 18 bp, synthetic construct
  source 1..18: mol_type = other DNA
taatacgacaccgtatag

SEQ ID NO: 6067 - DNA, 18 bp, synthetic construct
  source 1..18: mol_type = other DNA
taatacgacccattagag

SEQ ID NO: 6068 - DNA, 18 bp, synthetic construct
  source 1..18: mol_type = other DNA
taatacgactaacgctag

SEQ ID NO: 6069 - DNA, 18 bp, synthetic construct
  source 1..18: mol_type = other DNA
taatacgactccacatag

SEQ ID NO: 6070 - DNA, 18 bp, synthetic construct
  source 1..18: mol_type = other DNA
taatacgactcccgttag

SEQ ID NO: 6071 - DNA, 18 bp, synthetic construct
  source 1..18: mol_type = other DNA
taatacgactgaatatgg

SEQ ID NO: 6072 - DNA, 18 bp, synthetic construct
  source 1..18: mol_type = other DNA
taatacgattgactatcg

SEQ ID NO: 6073 - DNA, 18 bp, synthetic construct
  source 1..18: mol_type = other DNA
taatacgatttactagag

SEQ ID NO: 6074 - DNA, 18 bp, synthetic construct
  source 1..18: mol_type = other DNA
taatacgcatcacgatag

SEQ ID NO: 6075 - DNA, 18 bp, synthetic construct
  source 1..18: mol_type = other DNA
taatacgccacactagag

SEQ ID NO: 6076 - DNA, 18 bp, synthetic construct
  source 1..18: mol_type = other DNA
taatacgccccgctatag

SEQ ID NO: 6077 - DNA, 18 bp, synthetic construct
  source 1..18: mol_type = other DNA
taatacggatcgctatag

SEQ ID NO: 6078 - DNA, 18 bp, synthetic construct
  source 1..18: mol_type = other DNA
taatacggctcaacatag

SEQ ID NO: 6079 - DNA, 18 bp, synthetic construct
  source 1..18: mol_type = other DNA
taatacggctcaccatcg

SEQ ID NO: 6080 - DNA, 18 bp, synthetic construct
  source 1..18: mol_type = other DNA
taatacggctgacgatag

SEQ ID NO: 6081 - DNA, 18 bp, synthetic construct
  source 1..18: mol_type = other DNA
taatactagtgactatag

SEQ ID NO: 6082 - DNA, 18 bp, synthetic construct
  source 1..18: mol_type = other DNA
taatagcactcactagag

SEQ ID NO: 6083 - DNA, 18 bp, synthetic construct
  source 1..18: mol_type = other DNA
taataggcctcagtatag

SEQ ID NO: 6084 - DNA, 18 bp, synthetic construct
  source 1..18: mol_type = other DNA
taatatgactccctatgg

SEQ ID NO: 6085 - DNA, 18 bp, synthetic construct
  source 1..18: mol_type = other DNA
taatccacctcactatag

SEQ ID NO: 6086 - DNA, 18 bp, synthetic construct
  source 1..18: mol_type = other DNA
taatccgactcaatgtag

SEQ ID NO: 6087 - DNA, 18 bp, synthetic construct
  source 1..18: mol_type = other DNA
taatccgagtcactaaag

SEQ ID NO: 6088 - DNA, 18 bp, synthetic construct
  source 1..18: mol_type = other DNA
taatgcggctcaatatag

SEQ ID NO: 6089 - DNA, 18 bp, synthetic construct
  source 1..18: mol_type = other DNA
taattcgacgcactagag

SEQ ID NO: 6090 - DNA, 18 bp, synthetic construct
  source 1..18: mol_type = other DNA
taattgcactcactatag

SEQ ID NO: 6091 - DNA, 18 bp, synthetic construct
  source 1..18: mol_type = other DNA
tacgacgactcactttag

SEQ ID NO: 6092 - DNA, 18 bp, synthetic construct
  source 1..18: mol_type = other DNA
tactacgaccgactatag

SEQ ID NO: 6093 - DNA, 18 bp, synthetic construct
  source 1..18: mol_type = other DNA
tactacggatcactatag

SEQ ID NO: 6094 - DNA, 18 bp, synthetic construct
  source 1..18: mol_type = other DNA
tagtacgactcgctttag

SEQ ID NO: 6095 - DNA, 18 bp, synthetic construct
  source 1..18: mol_type = other DNA
tagttcgacccactatag

SEQ ID NO: 6096 - DNA, 18 bp, synthetic construct
  source 1..18: mol_type = other DNA
tataacgactcactataa

SEQ ID NO: 6097 - DNA, 18 bp, synthetic construct
  source 1..18: mol_type = other DNA
tattaccactcagtatag

SEQ ID NO: 6098 - DNA, 18 bp, synthetic construct
  source 1..18: mol_type = other DNA
tattacgactcgctatgg

SEQ ID NO: 6099 - DNA, 18 bp, synthetic construct
  source 1..18: mol_type = other DNA
tcatacgactcaccatgg

SEQ ID NO: 6100 - DNA, 18 bp, synthetic construct
  source 1..18: mol_type = other DNA
tcatacgactgactttag

SEQ ID NO: 6101 - DNA, 18 bp, synthetic construct
  source 1..18: mol_type = other DNA
tcatactactcactctag

SEQ ID NO: 6102 - DNA, 18 bp, synthetic construct
  source 1..18: mol_type = other DNA
tcatccgactcactctag

SEQ ID NO: 6103 - DNA, 18 bp, synthetic construct
  source 1..18: mol_type = other DNA
tcatccgactcgctatag

SEQ ID NO: 6104 - DNA, 18 bp, synthetic construct
  source 1..18: mol_type = other DNA
tgatacgacttattatag

SEQ ID NO: 6105 - DNA, 18 bp, synthetic construct
  source 1..18: mol_type = other DNA
tgatacgcctcacaatag

SEQ ID NO: 6106 - DNA, 18 bp, synthetic construct
  source 1..18: mol_type = other DNA
tgatgcgactcagtatag

SEQ ID NO: 6107 - DNA, 18 bp, synthetic construct
  source 1..18: mol_type = other DNA
tggtccgactcactatag

SEQ ID NO: 6108 - DNA, 18 bp, synthetic construct
  source 1..18: mol_type = other DNA
ttatacgactcaccgtag

SEQ ID NO: 6109 - DNA, 18 bp, synthetic construct
  source 1..18: mol_type = other DNA
ttatacgactcactagcg

SEQ ID NO: 6110 - DNA, 18 bp, synthetic construct
  source 1..18: mol_type = other DNA
ttatacgactcactttaa

SEQ ID NO: 6111 - DNA, 18 bp, synthetic construct
  source 1..18: mol_type = other DNA
taatacgactctatattg

SEQ ID NO: 6112 - DNA, 18 bp, synthetic construct
  source 1..18: mol_type = other DNA
ttatacgactcaccttag

SEQ ID NO: 6113 - DNA, 18 bp, synthetic construct
  source 1..18: mol_type = other DNA
tagatcgactcactatag

SEQ ID NO: 6114 - DNA, 18 bp, synthetic construct
  source 1..18: mol_type = other DNA
tgattcgactcactttag

SEQ ID NO: 6115 - DNA, 18 bp, synthetic construct
  source 1..18: mol_type = other DNA
ttataagactcattatag

SEQ ID NO: 6116 - DNA, 18 bp, synthetic construct
  source 1..18: mol_type = other DNA
tactacgactcacttttg

SEQ ID NO: 6117 - DNA, 18 bp, synthetic construct
  source 1..18: mol_type = other DNA
taatactactctctgtag

SEQ ID NO: 6118 - DNA, 18 bp, synthetic construct
  source 1..18: mol_type = other DNA
taatgcgtatcactatag

SEQ ID NO: 6119 - DNA, 18 bp, synthetic construct
  source 1..18: mol_type = other DNA
taattcgtcccactatag

SEQ ID NO: 6120 - DNA, 18 bp, synthetic construct
  source 1..18: mol_type = other DNA
tgataagtctcactatag

SEQ ID NO: 6121 - DNA, 18 bp, synthetic construct
  source 1..18: mol_type = other DNA
taatccgactcacttttg

SEQ ID NO: 6122 - DNA, 18 bp, synthetic construct
  source 1..18: mol_type = other DNA
caatacaactcattatag

SEQ ID NO: 6123 - DNA, 18 bp, synthetic construct
  source 1..18: mol_type = other DNA
taatacgagtcattttag

SEQ ID NO: 6124 - DNA, 18 bp, synthetic construct
  source 1..18: mol_type = other DNA
taatacgagttactattg

SEQ ID NO: 6125 - DNA, 18 bp, synthetic construct
  source 1..18: mol_type = other DNA
taatagatctcactatag

SEQ ID NO: 6126 - DNA, 18 bp, synthetic construct
  source 1..18: mol_type = other DNA
taatgcgactcaatattg

SEQ ID NO: 6127 - DNA, 18 bp, synthetic construct
  source 1..18: mol_type = other DNA
taatgcgactcacaattg

SEQ ID NO: 6128 - DNA, 18 bp, synthetic construct
  source 1..18: mol_type = other DNA
tattacgacttactatgg

SEQ ID NO: 6129 - DNA, 18 bp, synthetic construct
  source 1..18: mol_type = other DNA
taatacgactcaattttg

SEQ ID NO: 6130 - DNA, 18 bp, synthetic construct
  source 1..18: mol_type = other DNA
taatacgacacccaatag

SEQ ID NO: 6131 - DNA, 18 bp, synthetic construct
  source 1..18: mol_type = other DNA
taatacgactcgcaattg

SEQ ID NO: 6132 - DNA, 18 bp, synthetic construct
  source 1..18: mol_type = other DNA
tattatgaatcactatag

SEQ ID NO: 6133 - DNA, 18 bp, synthetic construct
  source 1..18: mol_type = other DNA
cattacgactctctatag

SEQ ID NO: 6134 - DNA, 18 bp, synthetic construct
  source 1..18: mol_type = other DNA
taacacgacacactattg

SEQ ID NO: 6135 - DNA, 18 bp, synthetic construct
  source 1..18: mol_type = other DNA
aaatacgattcaccatag

SEQ ID NO: 6136 - DNA, 18 bp, synthetic construct
  source 1..18: mol_type = other DNA
cattccgactcactatag

SEQ ID NO: 6137 - DNA, 18 bp, synthetic construct
  source 1..18: mol_type = other DNA
taacacgactctatatag

SEQ ID NO: 6138 - DNA, 18 bp, synthetic construct
  source 1..18: mol_type = other DNA
taataagacacagtatag

SEQ ID NO: 6139 - DNA, 18 bp, synthetic construct
  source 1..18: mol_type = other DNA
taatacgactcactcagg

SEQ ID NO: 6140 - DNA, 18 bp, synthetic construct
  source 1..18: mol_type = other DNA
taatatgcctcactattg

SEQ ID NO: 6141 - DNA, 18 bp, synthetic construct
  source 1..18: mol_type = other DNA
tcacacgactcgctatag

SEQ ID NO: 6142 - DNA, 18 bp, synthetic construct
  source 1..18: mol_type = other DNA
tgatacgattcacaatag

SEQ ID NO: 6143 - DNA, 18 bp, synthetic construct
  source 1..18: mol_type = other DNA
ttatacgactgactatcg

SEQ ID NO: 6144 - DNA, 18 bp, synthetic construct
  source 1..18: mol_type = other DNA
taatttgactcactattg

SEQ ID NO: 6145 - DNA, 18 bp, synthetic construct
  source 1..18: mol_type = other DNA
ttttacgactcacaatag

SEQ ID NO: 6146 - DNA, 18 bp, synthetic construct
  source 1..18: mol_type = other DNA
taataccactctctattg

SEQ ID NO: 6147 - DNA, 18 bp, synthetic construct
  source 1..18: mol_type = other DNA
aaatactgctcactatag

SEQ ID NO: 6148 - DNA, 18 bp, synthetic construct
  source 1..18: mol_type = other DNA
aaataggtctcactatag

SEQ ID NO: 6149 - DNA, 18 bp, synthetic construct
  source 1..18: mol_type = other DNA
tataccgactcactatag

SEQ ID NO: 6150 - DNA, 18 bp, synthetic construct
  source 1..18: mol_type = other DNA
taacacgactctctttag

SEQ ID NO: 6151 - DNA, 18 bp, synthetic construct
  source 1..18: mol_type = other DNA
taatacgtttcactgtag

SEQ ID NO: 6152 - DNA, 18 bp, synthetic construct
  source 1..18: mol_type = other DNA
taattcgactcacattag

SEQ ID NO: 6153 - DNA, 18 bp, synthetic construct
  source 1..18: mol_type = other DNA
tacaacgtctcactatag

SEQ ID NO: 6154 - DNA, 18 bp, synthetic construct
  source 1..18: mol_type = other DNA
taataagattcactattg

SEQ ID NO: 6155 - DNA, 18 bp, synthetic construct
  source 1..18: mol_type = other DNA
taatacgactctctttcg

SEQ ID NO: 6156 - DNA, 18 bp, synthetic construct
  source 1..18: mol_type = other DNA
taatacgagtcacttttg

SEQ ID NO: 6157 - DNA, 18 bp, synthetic construct
  source 1..18: mol_type = other DNA
taattctactcactatcg

SEQ ID NO: 6158 - DNA, 18 bp, synthetic construct
  source 1..18: mol_type = other DNA
tacatcgactcactatag

SEQ ID NO: 6159 - DNA, 18 bp, synthetic construct
  source 1..18: mol_type = other DNA
tattgcgactctctatag

SEQ ID NO: 6160 - DNA, 18 bp, synthetic construct
  source 1..18: mol_type = other DNA
taacacgacaaactatag

SEQ ID NO: 6161 - DNA, 18 bp, synthetic construct
  source 1..18: mol_type = other DNA
taataggactaactaaag

SEQ ID NO: 6162 - DNA, 18 bp, synthetic construct
  source 1..18: mol_type = other DNA
taattcgactccctaaag

SEQ ID NO: 6163 - DNA, 18 bp, synthetic construct
  source 1..18: mol_type = other DNA
tgatactactcactaaag

SEQ ID NO: 6164 - DNA, 18 bp, synthetic construct
  source 1..18: mol_type = other DNA
ttatatggctcactatag

SEQ ID NO: 6165 - DNA, 18 bp, synthetic construct
  source 1..18: mol_type = other DNA
aaataagactgactatag

SEQ ID NO: 6166 - DNA, 18 bp, synthetic construct
  source 1..18: mol_type = other DNA
acatacgagtcactatag

SEQ ID NO: 6167 - DNA, 18 bp, synthetic construct
  source 1..18: mol_type = other DNA
cactacgactcactaaag

SEQ ID NO: 6168 - DNA, 18 bp, synthetic construct
  source 1..18: mol_type = other DNA
ctatacgactcactatcg

SEQ ID NO: 6169 - DNA, 18 bp, synthetic construct
  source 1..18: mol_type = other DNA
taaaacgactcaatatgg

SEQ ID NO: 6170 - DNA, 18 bp, synthetic construct
  source 1..18: mol_type = other DNA
taacacaacttactatag

SEQ ID NO: 6171 - DNA, 18 bp, synthetic construct
  source 1..18: mol_type = other DNA
taagacgattcactaaag

SEQ ID NO: 6172 - DNA, 18 bp, synthetic construct
  source 1..18: mol_type = other DNA
taataccacttactatcg

SEQ ID NO: 6173 - DNA, 18 bp, synthetic construct
  source 1..18: mol_type = other DNA
taatacgaataagtatag

SEQ ID NO: 6174 - DNA, 18 bp, synthetic construct
  source 1..18: mol_type = other DNA
taatacgcctcattctag

SEQ ID NO: 6175 - DNA, 18 bp, synthetic construct
  source 1..18: mol_type = other DNA
taatacggctcattttag

SEQ ID NO: 6176 - DNA, 18 bp, synthetic construct
  source 1..18: mol_type = other DNA
taatacgtgtcagtatag

SEQ ID NO: 6177 - DNA, 18 bp, synthetic construct
  source 1..18: mol_type = other DNA
taatactactcattacag

SEQ ID NO: 6178 - DNA, 18 bp, synthetic construct
  source 1..18: mol_type = other DNA
taatactactcgttatag

SEQ ID NO: 6179 - DNA, 18 bp, synthetic construct
  source 1..18: mol_type = other DNA
taatatgtctcactatgg

SEQ ID NO: 6180 - DNA, 18 bp, synthetic construct
  source 1..18: mol_type = other DNA
taatccgactcactctcg

SEQ ID NO: 6181 - DNA, 18 bp, synthetic construct
  source 1..18: mol_type = other DNA
taattcgactccctctag

SEQ ID NO: 6182 - DNA, 18 bp, synthetic construct
  source 1..18: mol_type = other DNA
tagtaagactcattatag

SEQ ID NO: 6183 - DNA, 18 bp, synthetic construct
  source 1..18: mol_type = other DNA
tagtacgattcactacag

SEQ ID NO: 6184 - DNA, 18 bp, synthetic construct
  source 1..18: mol_type = other DNA
tcagacgattcactatag

SEQ ID NO: 6185 - DNA, 18 bp, synthetic construct
  source 1..18: mol_type = other DNA
tgatacggctcactttag

SEQ ID NO: 6186 - DNA, 18 bp, synthetic construct
  source 1..18: mol_type = other DNA
tgattcgactcagtatag

SEQ ID NO: 6187 - DNA, 18 bp, synthetic construct
  source 1..18: mol_type = other DNA
ttataccactcagtatag

SEQ ID NO: 6188 - DNA, 18 bp, synthetic construct
  source 1..18: mol_type = other DNA
ttatacgactgaatatag

SEQ ID NO: 6189 - DNA, 18 bp, synthetic construct
  source 1..18: mol_type = other DNA
taattcttctcactatag

SEQ ID NO: 6190 - DNA, 18 bp, synthetic construct
  source 1..18: mol_type = other DNA
aaattcgactcactttag

SEQ ID NO: 6191 - DNA, 18 bp, synthetic construct
  source 1..18: mol_type = other DNA
ttacacgactaactatag

SEQ ID NO: 6192 - DNA, 18 bp, synthetic construct
  source 1..18: mol_type = other DNA
ttatccgactctctatag

SEQ ID NO: 6193 - DNA, 18 bp, synthetic construct
  source 1..18: mol_type = other DNA
tattacgactctctctag

SEQ ID NO: 6194 - DNA, 18 bp, synthetic construct
  source 1..18: mol_type = other DNA
taataagtctaactatag

SEQ ID NO: 6195 - DNA, 18 bp, synthetic construct
  source 1..18: mol_type = other DNA
ttatacgactcacaatcg

SEQ ID NO: 6196 - DNA, 18 bp, synthetic construct
  source 1..18: mol_type = other DNA
taaaaccactctctatag

SEQ ID NO: 6197 - DNA, 18 bp, synthetic construct
  source 1..18: mol_type = other DNA
taatatctctcactatag

SEQ ID NO: 6198 - DNA, 18 bp, synthetic construct
  source 1..18: mol_type = other DNA
aaataccactaactatag

SEQ ID NO: 6199 - DNA, 18 bp, synthetic construct
  source 1..18: mol_type = other DNA
aaatactacccactatag

SEQ ID NO: 6200 - DNA, 18 bp, synthetic construct
  source 1..18: mol_type = other DNA
caatgcgactaactatag

SEQ ID NO: 6201 - DNA, 18 bp, synthetic construct
  source 1..18: mol_type = other DNA
gtatacgtctcactatag

SEQ ID NO: 6202 - DNA, 18 bp, synthetic construct
  source 1..18: mol_type = other DNA
taaaatgcctcactatag

SEQ ID NO: 6203 - DNA, 18 bp, synthetic construct
  source 1..18: mol_type = other DNA
taatacgacacatgatag

SEQ ID NO: 6204 - DNA, 18 bp, synthetic construct
  source 1..18: mol_type = other DNA
taatacgataccctatag

SEQ ID NO: 6205 - DNA, 18 bp, synthetic construct
  source 1..18: mol_type = other DNA
taatactactaaatatag

SEQ ID NO: 6206 - DNA, 18 bp, synthetic construct
  source 1..18: mol_type = other DNA
taatattcctcactatag

SEQ ID NO: 6207 - DNA, 18 bp, synthetic construct
  source 1..18: mol_type = other DNA
taattcgactcaatctag

SEQ ID NO: 6208 - DNA, 18 bp, synthetic construct
  source 1..18: mol_type = other DNA
taattcgactcaatgtag

SEQ ID NO: 6209 - DNA, 18 bp, synthetic construct
  source 1..18: mol_type = other DNA
tactaccattcactatag

SEQ ID NO: 6210 - DNA, 18 bp, synthetic construct
  source 1..18: mol_type = other DNA
tgatacgactcactcaag

SEQ ID NO: 6211 - DNA, 18 bp, synthetic construct
  source 1..18: mol_type = other DNA
taatacgtctcactttcg

SEQ ID NO: 6212 - DNA, 18 bp, synthetic construct
  source 1..18: mol_type = other DNA
tattacggctcactattg

SEQ ID NO: 6213 - DNA, 18 bp, synthetic construct
  source 1..18: mol_type = other DNA
aaatacgactcacaatgg

SEQ ID NO: 6214 - DNA, 18 bp, synthetic construct
  source 1..18: mol_type = other DNA
aaatacgactccctaaag

SEQ ID NO: 6215 - DNA, 18 bp, synthetic construct
  source 1..18: mol_type = other DNA
aaattcgagtcactatag

SEQ ID NO: 6216 - DNA, 18 bp, synthetic construct
  source 1..18: mol_type = other DNA
taacactactcacaatag

SEQ ID NO: 6217 - DNA, 18 bp, synthetic construct
  source 1..18: mol_type = other DNA
taataagactccctttag

SEQ ID NO: 6218 - DNA, 18 bp, synthetic construct
  source 1..18: mol_type = other DNA
taatacaagtcactttag

SEQ ID NO: 6219 - DNA, 18 bp, synthetic construct
  source 1..18: mol_type = other DNA
taatacctatcactatag

SEQ ID NO: 6220 - DNA, 18 bp, synthetic construct
  source 1..18: mol_type = other DNA
taatacgactgattaaag

SEQ ID NO: 6221 - DNA, 18 bp, synthetic construct
  source 1..18: mol_type = other DNA
taatacgatccactaaag

SEQ ID NO: 6222 - DNA, 18 bp, synthetic construct
  source 1..18: mol_type = other DNA
taatactactcactgaag

SEQ ID NO: 6223 - DNA, 18 bp, synthetic construct
  source 1..18: mol_type = other DNA
taatactcctcactaaag

SEQ ID NO: 6224 - DNA, 18 bp, synthetic construct
  source 1..18: mol_type = other DNA
taataggaatcactattg

SEQ ID NO: 6225 - DNA, 18 bp, synthetic construct
  source 1..18: mol_type = other DNA
taatgtgactcaatatag

SEQ ID NO: 6226 - DNA, 18 bp, synthetic construct
  source 1..18: mol_type = other DNA
tagttcgtctcactatag

SEQ ID NO: 6227 - DNA, 18 bp, synthetic construct
  source 1..18: mol_type = other DNA
tgaaacgactcacaatag

SEQ ID NO: 6228 - DNA, 18 bp, synthetic construct
  source 1..18: mol_type = other DNA
taaatcgactcactaaag

SEQ ID NO: 6229 - DNA, 18 bp, synthetic construct
  source 1..18: mol_type = other DNA
ctaaacgactcactatag

SEQ ID NO: 6230 - DNA, 18 bp, synthetic construct
  source 1..18: mol_type = other DNA
taatacgacccaatattg

SEQ ID NO: 6231 - DNA, 18 bp, synthetic construct
  source 1..18: mol_type = other DNA
tattactcctcactatag

SEQ ID NO: 6232 - DNA, 18 bp, synthetic construct
  source 1..18: mol_type = other DNA
ttatacgactaactctag

SEQ ID NO: 6233 - DNA, 18 bp, synthetic construct
  source 1..18: mol_type = other DNA
caaaacgacacactatag

SEQ ID NO: 6234 - DNA, 18 bp, synthetic construct
  source 1..18: mol_type = other DNA
taaaactactcaatatag

SEQ ID NO: 6235 - DNA, 18 bp, synthetic construct
  source 1..18: mol_type = other DNA
taatacgactcaacttag

SEQ ID NO: 6236 - DNA, 18 bp, synthetic construct
  source 1..18: mol_type = other DNA
ttatacgactgactaaag

SEQ ID NO: 6237 - DNA, 18 bp, synthetic construct
  source 1..18: mol_type = other DNA
tataacgtctcactatag

SEQ ID NO: 6238 - DNA, 18 bp, synthetic construct
  source 1..18: mol_type = other DNA
taaaaatactcactatag

SEQ ID NO: 6239 - DNA, 18 bp, synthetic construct
  source 1..18: mol_type = other DNA
tattacgactcaccaaag

SEQ ID NO: 6240 - DNA, 18 bp, synthetic construct
  source 1..18: mol_type = other DNA
taattcgactctccatag

SEQ ID NO: 6241 - DNA, 18 bp, synthetic construct
  source 1..18: mol_type = other DNA
tactacaactcactttag

SEQ ID NO: 6242 - DNA, 18 bp, synthetic construct
  source 1..18: mol_type = other DNA
taatactacttactttag

SEQ ID NO: 6243 - DNA, 18 bp, synthetic construct
  source 1..18: mol_type = other DNA
tactacgtctcacaatag

SEQ ID NO: 6244 - DNA, 18 bp, synthetic construct
  source 1..18: mol_type = other DNA
tgatacgtttcactatag

SEQ ID NO: 6245 - DNA, 18 bp, synthetic construct
  source 1..18: mol_type = other DNA
taattcgacacactctag

SEQ ID NO: 6246 - DNA, 18 bp, synthetic construct
  source 1..18: mol_type = other DNA
ttatactactcactctag

SEQ ID NO: 6247 - DNA, 18 bp, synthetic construct
  source 1..18: mol_type = other DNA
taatacgtctaattatag

SEQ ID NO: 6248 - DNA, 18 bp, synthetic construct
  source 1..18: mol_type = other DNA
taatatgactcacaacag

SEQ ID NO: 6249 - DNA, 18 bp, synthetic construct
  source 1..18: mol_type = other DNA
tattacgactcacaatgg

SEQ ID NO: 6250 - DNA, 18 bp, synthetic construct
  source 1..18: mol_type = other DNA
caatacgactcattaaag

SEQ ID NO: 6251 - DNA, 18 bp, synthetic construct
  source 1..18: mol_type = other DNA
tactacgatacactatag

SEQ ID NO: 6252 - DNA, 18 bp, synthetic construct
  source 1..18: mol_type = other DNA
tattacgactgactttag

SEQ ID NO: 6253 - DNA, 18 bp, synthetic construct
  source 1..18: mol_type = other DNA
caatacctctcactatag

SEQ ID NO: 6254 - DNA, 18 bp, synthetic construct
  source 1..18: mol_type = other DNA
taataagactgactaaag

SEQ ID NO: 6255 - DNA, 18 bp, synthetic construct
  source 1..18: mol_type = other DNA
taataccactcactgaag

SEQ ID NO: 6256 - DNA, 18 bp, synthetic construct
  source 1..18: mol_type = other DNA
taataccactcgctttag

SEQ ID NO: 6257 - DNA, 18 bp, synthetic construct
  source 1..18: mol_type = other DNA
taatacgactaactagtg

SEQ ID NO: 6258 - DNA, 18 bp, synthetic construct
  source 1..18: mol_type = other DNA
taatacgactccctaacg

SEQ ID NO: 6259 - DNA, 18 bp, synthetic construct
  source 1..18: mol_type = other DNA
taatacgactctttatcg

SEQ ID NO: 6260 - DNA, 18 bp, synthetic construct
  source 1..18: mol_type = other DNA
taatactaatcactctag

SEQ ID NO: 6261 - DNA, 18 bp, synthetic construct
  source 1..18: mol_type = other DNA
tagtacgattcactttag

SEQ ID NO: 6262 - DNA, 18 bp, synthetic construct
  source 1..18: mol_type = other DNA
tcatacgattcactatcg

SEQ ID NO: 6263 - DNA, 18 bp, synthetic construct
  source 1..18: mol_type = other DNA
ttatacgactccccatag

SEQ ID NO: 6264 - DNA, 18 bp, synthetic construct
  source 1..18: mol_type = other DNA
aaataccactccctatag

SEQ ID NO: 6265 - DNA, 18 bp, synthetic construct
  source 1..18: mol_type = other DNA
aactacgtctcactatag

SEQ ID NO: 6266 - DNA, 18 bp, synthetic construct
  source 1..18: mol_type = other DNA
caaaacgacttactatag

SEQ ID NO: 6267 - DNA, 18 bp, synthetic construct
  source 1..18: mol_type = other DNA
caacacggctcactatag

SEQ ID NO: 6268 - DNA, 18 bp, synthetic construct
  source 1..18: mol_type = other DNA
caatacaactcactatgg

SEQ ID NO: 6269 - DNA, 18 bp, synthetic construct
  source 1..18: mol_type = other DNA
caatacgactcagcatag

SEQ ID NO: 6270 - DNA, 18 bp, synthetic construct
  source 1..18: mol_type = other DNA
caatatggctcactatag

SEQ ID NO: 6271 - DNA, 18 bp, synthetic construct
  source 1..18: mol_type = other DNA
taacacggctcattatag

SEQ ID NO: 6272 - DNA, 18 bp, synthetic construct
  source 1..18: mol_type = other DNA
taataatagtcactatag

SEQ ID NO: 6273 - DNA, 18 bp, synthetic construct
  source 1..18: mol_type = other DNA
taatacaactcagcatag

SEQ ID NO: 6274 - DNA, 18 bp, synthetic construct
  source 1..18: mol_type = other DNA
taatacgaataactatgg

SEQ ID NO: 6275 - DNA, 18 bp, synthetic construct
  source 1..18: mol_type = other DNA
taatacgaataactctag

SEQ ID NO: 6276 - DNA, 18 bp, synthetic construct
  source 1..18: mol_type = other DNA
taatacgacccaaaatag

SEQ ID NO: 6277 - DNA, 18 bp, synthetic construct
  source 1..18: mol_type = other DNA
taatacgacctactatgg

SEQ ID NO: 6278 - DNA, 18 bp, synthetic construct
  source 1..18: mol_type = other DNA
taatacgagatactatag

SEQ ID NO: 6279 - DNA, 18 bp, synthetic construct
  source 1..18: mol_type = other DNA
taatacgattcaatatgg

SEQ ID NO: 6280 - DNA, 18 bp, synthetic construct
  source 1..18: mol_type = other DNA
taatacgcctgactttag

SEQ ID NO: 6281 - DNA, 18 bp, synthetic construct
  source 1..18: mol_type = other DNA
taatacggctcactaacg

SEQ ID NO: 6282 - DNA, 18 bp, synthetic construct
  source 1..18: mol_type = other DNA
taatacggctccctttag

SEQ ID NO: 6283 - DNA, 18 bp, synthetic construct
  source 1..18: mol_type = other DNA
taatacggttcactttag

SEQ ID NO: 6284 - DNA, 18 bp, synthetic construct
  source 1..18: mol_type = other DNA
taatactactcacaagag

SEQ ID NO: 6285 - DNA, 18 bp, synthetic construct
  source 1..18: mol_type = other DNA
taatactactgactatgg

SEQ ID NO: 6286 - DNA, 18 bp, synthetic construct
  source 1..18: mol_type = other DNA
taatatgaatgactatag

SEQ ID NO: 6287 - DNA, 18 bp, synthetic construct
  source 1..18: mol_type = other DNA
taatccgacacaccatag

SEQ ID NO: 6288 - DNA, 18 bp, synthetic construct
  source 1..18: mol_type = other DNA
taatctggctcactatag

SEQ ID NO: 6289 - DNA, 18 bp, synthetic construct
  source 1..18: mol_type = other DNA
taatgcgagtcactaaag

SEQ ID NO: 6290 - DNA, 18 bp, synthetic construct
  source 1..18: mol_type = other DNA
taattcgactccctatcg

SEQ ID NO: 6291 - DNA, 18 bp, synthetic construct
  source 1..18: mol_type = other DNA
tactacgactcacaatcg

SEQ ID NO: 6292 - DNA, 18 bp, synthetic construct
  source 1..18: mol_type = other DNA
tattacgactaactatgg

SEQ ID NO: 6293 - DNA, 18 bp, synthetic construct
  source 1..18: mol_type = other DNA
tattacgccccactatag

SEQ ID NO: 6294 - DNA, 18 bp, synthetic construct
  source 1..18: mol_type = other DNA
tcatacgagttactatag

SEQ ID NO: 6295 - DNA, 18 bp, synthetic construct
  source 1..18: mol_type = other DNA
tcatacgattcactgtag

SEQ ID NO: 6296 - DNA, 18 bp, synthetic construct
  source 1..18: mol_type = other DNA
tcatactacgcactatag

SEQ ID NO: 6297 - DNA, 18 bp, synthetic construct
  source 1..18: mol_type = other DNA
ttatacgagacactatag

SEQ ID NO: 6298 - DNA, 18 bp, synthetic construct
  source 1..18: mol_type = other DNA
aaatacgcctcactgtag

SEQ ID NO: 6299 - DNA, 18 bp, synthetic construct
  source 1..18: mol_type = other DNA
aaatacggcccactatag

SEQ ID NO: 6300 - DNA, 18 bp, synthetic construct
  source 1..18: mol_type = other DNA
aaatacggctcactagag

SEQ ID NO: 6301 - DNA, 18 bp, synthetic construct
  source 1..18: mol_type = other DNA
agatacgactcactacag

SEQ ID NO: 6302 - DNA, 18 bp, synthetic construct
  source 1..18: mol_type = other DNA
caatacggctcactttag

SEQ ID NO: 6303 - DNA, 18 bp, synthetic construct
  source 1..18: mol_type = other DNA
caataggactcattatag

SEQ ID NO: 6304 - DNA, 18 bp, synthetic construct
  source 1..18: mol_type = other DNA
caatccgactcactatcg

SEQ ID NO: 6305 - DNA, 18 bp, synthetic construct
  source 1..18: mol_type = other DNA
gaatacgactcactccag

SEQ ID NO: 6306 - DNA, 18 bp, synthetic construct
  source 1..18: mol_type = other DNA
gaatacgacttactctag

SEQ ID NO: 6307 - DNA, 18 bp, synthetic construct
  source 1..18: mol_type = other DNA
gaatacgtatcactatag

SEQ ID NO: 6308 - DNA, 18 bp, synthetic construct
  source 1..18: mol_type = other DNA
gactatgactcactatag

SEQ ID NO: 6309 - DNA, 18 bp, synthetic construct
  source 1..18: mol_type = other DNA
gattacgattcactatag

SEQ ID NO: 6310 - DNA, 18 bp, synthetic construct
  source 1..18: mol_type = other DNA
taaaacgactcaagatag

SEQ ID NO: 6311 - DNA, 18 bp, synthetic construct
  source 1..18: mol_type = other DNA
taaaacgactcactgtgg

SEQ ID NO: 6312 - DNA, 18 bp, synthetic construct
  source 1..18: mol_type = other DNA
taaaacgagccactatag

SEQ ID NO: 6313 - DNA, 18 bp, synthetic construct
  source 1..18: mol_type = other DNA
taaaacgaggcactatag

SEQ ID NO: 6314 - DNA, 18 bp, synthetic construct
  source 1..18: mol_type = other DNA
taaaacggctcactgtag

SEQ ID NO: 6315 - DNA, 18 bp, synthetic construct
  source 1..18: mol_type = other DNA
taacaagactcactatgg

SEQ ID NO: 6316 - DNA, 18 bp, synthetic construct
  source 1..18: mol_type = other DNA
taacacgactcacgttag

SEQ ID NO: 6317 - DNA, 18 bp, synthetic construct
  source 1..18: mol_type = other DNA
taacacgactcactaggg

SEQ ID NO: 6318 - DNA, 18 bp, synthetic construct
  source 1..18: mol_type = other DNA
taacacgagtcattatag

SEQ ID NO: 6319 - DNA, 18 bp, synthetic construct
  source 1..18: mol_type = other DNA
taacagtactcactatag

SEQ ID NO: 6320 - DNA, 18 bp, synthetic construct
  source 1..18: mol_type = other DNA
taagaccactcaatatag

SEQ ID NO: 6321 - DNA, 18 bp, synthetic construct
  source 1..18: mol_type = other DNA
taataagacttagtatag

SEQ ID NO: 6322 - DNA, 18 bp, synthetic construct
  source 1..18: mol_type = other DNA
taatacaacccactatcg

SEQ ID NO: 6323 - DNA, 18 bp, synthetic construct
  source 1..18: mol_type = other DNA
taatacaacgcactatgg

SEQ ID NO: 6324 - DNA, 18 bp, synthetic construct
  source 1..18: mol_type = other DNA
taatacacctcactatcg

SEQ ID NO: 6325 - DNA, 18 bp, synthetic construct
  source 1..18: mol_type = other DNA
taataccaatcactagag

SEQ ID NO: 6326 - DNA, 18 bp, synthetic construct
  source 1..18: mol_type = other DNA
taataccactcaatacag

SEQ ID NO: 6327 - DNA, 18 bp, synthetic construct
  source 1..18: mol_type = other DNA
taatacgacccactgtgg

SEQ ID NO: 6328 - DNA, 18 bp, synthetic construct
  source 1..18: mol_type = other DNA
taatacgacgaaatatag

SEQ ID NO: 6329 - DNA, 18 bp, synthetic construct
  source 1..18: mol_type = other DNA
taatacgactagatatag

SEQ ID NO: 6330 - DNA, 18 bp, synthetic construct
  source 1..18: mol_type = other DNA
taatacgactcacttcgg

SEQ ID NO: 6331 - DNA, 18 bp, synthetic construct
  source 1..18: mol_type = other DNA
taatacgactcaggttag

SEQ ID NO: 6332 - DNA, 18 bp, synthetic construct
  source 1..18: mol_type = other DNA
taatacgactcgttagag

SEQ ID NO: 6333 - DNA, 18 bp, synthetic construct
  source 1..18: mol_type = other DNA
taatacgactgcctatcg

SEQ ID NO: 6334 - DNA, 18 bp, synthetic construct
  source 1..18: mol_type = other DNA
taatacgatccactagag

SEQ ID NO: 6335 - DNA, 18 bp, synthetic construct
  source 1..18: mol_type = other DNA
taatacgcctcaatgtag

SEQ ID NO: 6336 - DNA, 18 bp, synthetic construct
  source 1..18: mol_type = other DNA
taatacggcacagtatag

SEQ ID NO: 6337 - DNA, 18 bp, synthetic construct
  source 1..18: mol_type = other DNA
taatacggctctctatcg

SEQ ID NO: 6338 - DNA, 18 bp, synthetic construct
  source 1..18: mol_type = other DNA
taatacgggttactatag

SEQ ID NO: 6339 - DNA, 18 bp, synthetic construct
  source 1..18: mol_type = other DNA
taatacgtctcacgaaag

SEQ ID NO: 6340 - DNA, 18 bp, synthetic construct
  source 1..18: mol_type = other DNA
taatactactcaccgtag

SEQ ID NO: 6341 - DNA, 18 bp, synthetic construct
  source 1..18: mol_type = other DNA
taatactactccctctag

SEQ ID NO: 6342 - DNA, 18 bp, synthetic construct
  source 1..18: mol_type = other DNA
taatactagtcgctatag

SEQ ID NO: 6343 - DNA, 18 bp, synthetic construct
  source 1..18: mol_type = other DNA
taataggacccacaatag

SEQ ID NO: 6344 - DNA, 18 bp, synthetic construct
  source 1..18: mol_type = other DNA
taataggaccctctatag

SEQ ID NO: 6345 - DNA, 18 bp, synthetic construct
  source 1..18: mol_type = other DNA
taataggactcgctgtag

SEQ ID NO: 6346 - DNA, 18 bp, synthetic construct
  source 1..18: mol_type = other DNA
taataggtctcagtatag

SEQ ID NO: 6347 - DNA, 18 bp, synthetic construct
  source 1..18: mol_type = other DNA
taatatgaatccctatag

SEQ ID NO: 6348 - DNA, 18 bp, synthetic construct
  source 1..18: mol_type = other DNA
taatatgactaactacag

SEQ ID NO: 6349 - DNA, 18 bp, synthetic construct
  source 1..18: mol_type = other DNA
taatatgactcggtatag

SEQ ID NO: 6350 - DNA, 18 bp, synthetic construct
  source 1..18: mol_type = other DNA
taatatgacttactagag

SEQ ID NO: 6351 - DNA, 18 bp, synthetic construct
  source 1..18: mol_type = other DNA
taatatggctcactctag

SEQ ID NO: 6352 - DNA, 18 bp, synthetic construct
  source 1..18: mol_type = other DNA
taatatggctgactatag

SEQ ID NO: 6353 - DNA, 18 bp, synthetic construct
  source 1..18: mol_type = other DNA
taatccgactaactgtag

SEQ ID NO: 6354 - DNA, 18 bp, synthetic construct
  source 1..18: mol_type = other DNA
taatccgactcactatta

SEQ ID NO: 6355 - DNA, 18 bp, synthetic construct
  source 1..18: mol_type = other DNA
taatccgactcgttatag

SEQ ID NO: 6356 - DNA, 18 bp, synthetic construct
  source 1..18: mol_type = other DNA
taatgcgactcccaatag

SEQ ID NO: 6357 - DNA, 18 bp, synthetic construct
  source 1..18: mol_type = other DNA
taatgcgacttcctatag

SEQ ID NO: 6358 - DNA, 18 bp, synthetic construct
  source 1..18: mol_type = other DNA
taatgcgtctcaccatag

SEQ ID NO: 6359 - DNA, 18 bp, synthetic construct
  source 1..18: mol_type = other DNA
taatgcgtctcactatgg

SEQ ID NO: 6360 - DNA, 18 bp, synthetic construct
  source 1..18: mol_type = other DNA
taattcgactcaagatag

SEQ ID NO: 6361 - DNA, 18 bp, synthetic construct
  source 1..18: mol_type = other DNA
taccacgacccactatag

SEQ ID NO: 6362 - DNA, 18 bp, synthetic construct
  source 1..18: mol_type = other DNA
taccacgattcactatag

SEQ ID NO: 6363 - DNA, 18 bp, synthetic construct
  source 1..18: mol_type = other DNA
tactacgactcgccatag

SEQ ID NO: 6364 - DNA, 18 bp, synthetic construct
  source 1..18: mol_type = other DNA
tactacggctcactattg

SEQ ID NO: 6365 - DNA, 18 bp, synthetic construct
  source 1..18: mol_type = other DNA
tactatgactcactgtag

SEQ ID NO: 6366 - DNA, 18 bp, synthetic construct
  source 1..18: mol_type = other DNA
tagcacgactcagtatag

SEQ ID NO: 6367 - DNA, 18 bp, synthetic construct
  source 1..18: mol_type = other DNA
tagtacgactcaatgtag

SEQ ID NO: 6368 - DNA, 18 bp, synthetic construct
  source 1..18: mol_type = other DNA
tagtatgactcgctatag

SEQ ID NO: 6369 - DNA, 18 bp, synthetic construct
  source 1..18: mol_type = other DNA
tatcacgactcactataa

SEQ ID NO: 6370 - DNA, 18 bp, synthetic construct
  source 1..18: mol_type = other DNA
tattacgagtcactgtag

SEQ ID NO: 6371 - DNA, 18 bp, synthetic construct
  source 1..18: mol_type = other DNA
tattacggctcactacag

SEQ ID NO: 6372 - DNA, 18 bp, synthetic construct
  source 1..18: mol_type = other DNA
tattaggactccctatag

SEQ ID NO: 6373 - DNA, 18 bp, synthetic construct
  source 1..18: mol_type = other DNA
tattgcgacgcactatag

SEQ ID NO: 6374 - DNA, 18 bp, synthetic construct
  source 1..18: mol_type = other DNA
tcacacgcctcactatag

SEQ ID NO: 6375 - DNA, 18 bp, synthetic construct
  source 1..18: mol_type = other DNA
tcatacgaatcaccatag

SEQ ID NO: 6376 - DNA, 18 bp, synthetic construct
  source 1..18: mol_type = other DNA
tcatacgaatcactgtag

SEQ ID NO: 6377 - DNA, 18 bp, synthetic construct
  source 1..18: mol_type = other DNA
tcatacgactcacttgag

SEQ ID NO: 6378 - DNA, 18 bp, synthetic construct
  source 1..18: mol_type = other DNA
tcatacgagtcactatgg

SEQ ID NO: 6379 - DNA, 18 bp, synthetic construct
  source 1..18: mol_type = other DNA
tcatactactcgctatag

SEQ ID NO: 6380 - DNA, 18 bp, synthetic construct
  source 1..18: mol_type = other DNA
tcataggactcactctag

SEQ ID NO: 6381 - DNA, 18 bp, synthetic construct
  source 1..18: mol_type = other DNA
tcataggactcattatag

SEQ ID NO: 6382 - DNA, 18 bp, synthetic construct
  source 1..18: mol_type = other DNA
tcataggactccctatag

SEQ ID NO: 6383 - DNA, 18 bp, synthetic construct
  source 1..18: mol_type = other DNA
tgatacgactgactaaag

SEQ ID NO: 6384 - DNA, 18 bp, synthetic construct
  source 1..18: mol_type = other DNA
tgatccgacttactatag

SEQ ID NO: 6385 - DNA, 18 bp, synthetic construct
  source 1..18: mol_type = other DNA
ttatacgaatcactagag

SEQ ID NO: 6386 - DNA, 18 bp, synthetic construct
  source 1..18: mol_type = other DNA
ttatacgacgcattatag

SEQ ID NO: 6387 - DNA, 18 bp, synthetic construct
  source 1..18: mol_type = other DNA
ttatacgactcccgatag

SEQ ID NO: 6388 - DNA, 18 bp, synthetic construct
  source 1..18: mol_type = other DNA
tcatacgactcacttaag

SEQ ID NO: 6389 - DNA, 18 bp, synthetic construct
  source 1..18: mol_type = other DNA
tataacgactcactgtag

SEQ ID NO: 6390 - DNA, 18 bp, synthetic construct
  source 1..18: mol_type = other DNA
ttgtacgactcactattg

SEQ ID NO: 6391 - DNA, 18 bp, synthetic construct
  source 1..18: mol_type = other DNA
tattccgacacactatag

SEQ ID NO: 6392 - DNA, 18 bp, synthetic construct
  source 1..18: mol_type = other DNA
ttataggactcattatag

SEQ ID NO: 6393 - DNA, 18 bp, synthetic construct
  source 1..18: mol_type = other DNA
taatacgactcatttaag

SEQ ID NO: 6394 - DNA, 18 bp, synthetic construct
  source 1..18: mol_type = other DNA
taataagccacactatag

SEQ ID NO: 6395 - DNA, 18 bp, synthetic construct
  source 1..18: mol_type = other DNA
tactacgactctcaatag

SEQ ID NO: 6396 - DNA, 18 bp, synthetic construct
  source 1..18: mol_type = other DNA
ttatacgccttactatag

SEQ ID NO: 6397 - DNA, 18 bp, synthetic construct
  source 1..18: mol_type = other DNA
taattctacacactatag

SEQ ID NO: 6398 - DNA, 18 bp, synthetic construct
  source 1..18: mol_type = other DNA
taaatcgactcaatatag

SEQ ID NO: 6399 - DNA, 18 bp, synthetic construct
  source 1..18: mol_type = other DNA
tattaccactcactattg

SEQ ID NO: 6400 - DNA, 18 bp, synthetic construct
  source 1..18: mol_type = other DNA
taatacgactcgttttag

SEQ ID NO: 6401 - DNA, 18 bp, synthetic construct
  source 1..18: mol_type = other DNA
taatacgattaaatatag

SEQ ID NO: 6402 - DNA, 18 bp, synthetic construct
  source 1..18: mol_type = other DNA
taatactgctcactttag

SEQ ID NO: 6403 - DNA, 18 bp, synthetic construct
  source 1..18: mol_type = other DNA
taatgcgacaaactatag

SEQ ID NO: 6404 - DNA, 18 bp, synthetic construct
  source 1..18: mol_type = other DNA
taattcaactcagtatag

SEQ ID NO: 6405 - DNA, 18 bp, synthetic construct
  source 1..18: mol_type = other DNA
tcacacgactctctatag

SEQ ID NO: 6406 - DNA, 18 bp, synthetic construct
  source 1..18: mol_type = other DNA
taataagactctctattg

SEQ ID NO: 6407 - DNA, 18 bp, synthetic construct
  source 1..18: mol_type = other DNA
ttatacgactaactattg

SEQ ID NO: 6408 - DNA, 18 bp, synthetic construct
  source 1..18: mol_type = other DNA
caaaacgtctcactatag

SEQ ID NO: 6409 - DNA, 18 bp, synthetic construct
  source 1..18: mol_type = other DNA
ctattcgactcactatag

SEQ ID NO: 6410 - DNA, 18 bp, synthetic construct
  source 1..18: mol_type = other DNA
taattctattcactatag

SEQ ID NO: 6411 - DNA, 18 bp, synthetic construct
  source 1..18: mol_type = other DNA
tacttcgactcactattg

SEQ ID NO: 6412 - DNA, 18 bp, synthetic construct
  source 1..18: mol_type = other DNA
tattacgactcagtattg

SEQ ID NO: 6413 - DNA, 18 bp, synthetic construct
  source 1..18: mol_type = other DNA
atatatgactcactatag

SEQ ID NO: 6414 - DNA, 18 bp, synthetic construct
  source 1..18: mol_type = other DNA
caatacgactctctttag

SEQ ID NO: 6415 - DNA, 18 bp, synthetic construct
  source 1..18: mol_type = other DNA
ttatccgactcactaaag

SEQ ID NO: 6416 - DNA, 18 bp, synthetic construct
  source 1..18: mol_type = other DNA
aaagacgtctcactatag

SEQ ID NO: 6417 - DNA, 18 bp, synthetic construct
  source 1..18: mol_type = other DNA
aaatacaactccctatag

SEQ ID NO: 6418 - DNA, 18 bp, synthetic construct
  source 1..18: mol_type = other DNA
aaataccaatcactatag

SEQ ID NO: 6419 - DNA, 18 bp, synthetic construct
  source 1..18: mol_type = other DNA
taataagacttgctatag

SEQ ID NO: 6420 - DNA, 18 bp, synthetic construct
  source 1..18: mol_type = other DNA
taatacgacccaataaag

SEQ ID NO: 6421 - DNA, 18 bp, synthetic construct
  source 1..18: mol_type = other DNA
taatacgagacaatatag

SEQ ID NO: 6422 - DNA, 18 bp, synthetic construct
  source 1..18: mol_type = other DNA
taatacgattctctatgg

SEQ ID NO: 6423 - DNA, 18 bp, synthetic construct
  source 1..18: mol_type = other DNA
taatacggctcactaagg

SEQ ID NO: 6424 - DNA, 18 bp, synthetic construct
  source 1..18: mol_type = other DNA
taatacgtcgcacaatag

SEQ ID NO: 6425 - DNA, 18 bp, synthetic construct
  source 1..18: mol_type = other DNA
taatacgtctaactgtag

SEQ ID NO: 6426 - DNA, 18 bp, synthetic construct
  source 1..18: mol_type = other DNA
taatacgtgtcactgtag

SEQ ID NO: 6427 - DNA, 18 bp, synthetic construct
  source 1..18: mol_type = other DNA
tattaggactgactatag

SEQ ID NO: 6428 - DNA, 18 bp, synthetic construct
  source 1..18: mol_type = other DNA
ttatacgacttagtatag

SEQ ID NO: 6429 - DNA, 18 bp, synthetic construct
  source 1..18: mol_type = other DNA
ttatacgtcgcactatag

SEQ ID NO: 6430 - DNA, 18 bp, synthetic construct
  source 1..18: mol_type = other DNA
aaatacgactcaatattg

SEQ ID NO: 6431 - DNA, 18 bp, synthetic construct
  source 1..18: mol_type = other DNA
taatacgactctctttgg

SEQ ID NO: 6432 - DNA, 18 bp, synthetic construct
  source 1..18: mol_type = other DNA
taatgcaactcattatag

SEQ ID NO: 6433 - DNA, 18 bp, synthetic construct
  source 1..18: mol_type = other DNA
ttatgcgactcacaatag

SEQ ID NO: 6434 - DNA, 18 bp, synthetic construct
  source 1..18: mol_type = other DNA
taaaaagactcactttag

SEQ ID NO: 6435 - DNA, 18 bp, synthetic construct
  source 1..18: mol_type = other DNA
taatacgactctttaaag

SEQ ID NO: 6436 - DNA, 18 bp, synthetic construct
  source 1..18: mol_type = other DNA
taaaacgacacactgtag

SEQ ID NO: 6437 - DNA, 18 bp, synthetic construct
  source 1..18: mol_type = other DNA
taacacgactcaccattg

SEQ ID NO: 6438 - DNA, 18 bp, synthetic construct
  source 1..18: mol_type = other DNA
taatacgactatctgtag

SEQ ID NO: 6439 - DNA, 18 bp, synthetic construct
  source 1..18: mol_type = other DNA
taatacgactccccaaag

SEQ ID NO: 6440 - DNA, 18 bp, synthetic construct
  source 1..18: mol_type = other DNA
taatacggttcacaatag

SEQ ID NO: 6441 - DNA, 18 bp, synthetic construct
  source 1..18: mol_type = other DNA
tacaacgacttactatag

SEQ ID NO: 6442 - DNA, 18 bp, synthetic construct
  source 1..18: mol_type = other DNA
tactacgattcaatatag

SEQ ID NO: 6443 - DNA, 18 bp, synthetic construct
  source 1..18: mol_type = other DNA
tagttcgactcattatag

SEQ ID NO: 6444 - DNA, 18 bp, synthetic construct
  source 1..18: mol_type = other DNA
aaatacccctcactatag

SEQ ID NO: 6445 - DNA, 18 bp, synthetic construct
  source 1..18: mol_type = other DNA
aaatacgactaactctag

SEQ ID NO: 6446 - DNA, 18 bp, synthetic construct
  source 1..18: mol_type = other DNA
aactccgactcactatag

SEQ ID NO: 6447 - DNA, 18 bp, synthetic construct
  source 1..18: mol_type = other DNA
aagtaccactcactatag

SEQ ID NO: 6448 - DNA, 18 bp, synthetic construct
  source 1..18: mol_type = other DNA
aattacgactcactatgg

SEQ ID NO: 6449 - DNA, 18 bp, synthetic construct
  source 1..18: mol_type = other DNA
caatacgactaactattg

SEQ ID NO: 6450 - DNA, 18 bp, synthetic construct
  source 1..18: mol_type = other DNA
caatgcgattcactatag

SEQ ID NO: 6451 - DNA, 18 bp, synthetic construct
  source 1..18: mol_type = other DNA
taaaaaggctcactatag

SEQ ID NO: 6452 - DNA, 18 bp, synthetic construct
  source 1..18: mol_type = other DNA
taaaacgacttactgtag

SEQ ID NO: 6453 - DNA, 18 bp, synthetic construct
  source 1..18: mol_type = other DNA
taaaacgcctaactatag

SEQ ID NO: 6454 - DNA, 18 bp, synthetic construct
  source 1..18: mol_type = other DNA
taaaacgcctcactagag

SEQ ID NO: 6455 - DNA, 18 bp, synthetic construct
  source 1..18: mol_type = other DNA
taaaactactccctatag

SEQ ID NO: 6456 - DNA, 18 bp, synthetic construct
  source 1..18: mol_type = other DNA
taacacaactcactacag

SEQ ID NO: 6457 - DNA, 18 bp, synthetic construct
  source 1..18: mol_type = other DNA
taagactactcactttag

SEQ ID NO: 6458 - DNA, 18 bp, synthetic construct
  source 1..18: mol_type = other DNA
taataccactcaccttag

SEQ ID NO: 6459 - DNA, 18 bp, synthetic construct
  source 1..18: mol_type = other DNA
taatacgactcactcacg

SEQ ID NO: 6460 - DNA, 18 bp, synthetic construct
  source 1..18: mol_type = other DNA
taatacgacttgccatag

SEQ ID NO: 6461 - DNA, 18 bp, synthetic construct
  source 1..18: mol_type = other DNA
taatacgccacaatatag

SEQ ID NO: 6462 - DNA, 18 bp, synthetic construct
  source 1..18: mol_type = other DNA
taatacggctaactctag

SEQ ID NO: 6463 - DNA, 18 bp, synthetic construct
  source 1..18: mol_type = other DNA
taatacggttgactatag

SEQ ID NO: 6464 - DNA, 18 bp, synthetic construct
  source 1..18: mol_type = other DNA
taatacgtctcagtacag

SEQ ID NO: 6465 - DNA, 18 bp, synthetic construct
  source 1..18: mol_type = other DNA
taatactgcacactatag

SEQ ID NO: 6466 - DNA, 18 bp, synthetic construct
  source 1..18: mol_type = other DNA
taatccgactcaataaag

SEQ ID NO: 6467 - DNA, 18 bp, synthetic construct
  source 1..18: mol_type = other DNA
taatccgactcacaacag

SEQ ID NO: 6468 - DNA, 18 bp, synthetic construct
  source 1..18: mol_type = other DNA
taatgcgacacgctatag

SEQ ID NO: 6469 - DNA, 18 bp, synthetic construct
  source 1..18: mol_type = other DNA
tactacgtctccctatag

SEQ ID NO: 6470 - DNA, 18 bp, synthetic construct
  source 1..18: mol_type = other DNA
tagtacgagttactatag

SEQ ID NO: 6471 - DNA, 18 bp, synthetic construct
  source 1..18: mol_type = other DNA
tagtacgcctcactctag

SEQ ID NO: 6472 - DNA, 18 bp, synthetic construct
  source 1..18: mol_type = other DNA
tcatacgactcaaaatag

SEQ ID NO: 6473 - DNA, 18 bp, synthetic construct
  source 1..18: mol_type = other DNA
tgatacaactgactatag

SEQ ID NO: 6474 - DNA, 18 bp, synthetic construct
  source 1..18: mol_type = other DNA
tgatacgactcactgttg

SEQ ID NO: 6475 - DNA, 18 bp, synthetic construct
  source 1..18: mol_type = other DNA
tgatacgtctcactgtag

SEQ ID NO: 6476 - DNA, 18 bp, synthetic construct
  source 1..18: mol_type = other DNA
ttatacgagtcaccatag

SEQ ID NO: 6477 - DNA, 18 bp, synthetic construct
  source 1..18: mol_type = other DNA
ttgtaccactcactatag

SEQ ID NO: 6478 - DNA, 18 bp, synthetic construct
  source 1..18: mol_type = other DNA
atatacgactcaccatag

SEQ ID NO: 6479 - DNA, 18 bp, synthetic construct
  source 1..18: mol_type = other DNA
taataccattcactaaag

SEQ ID NO: 6480 - DNA, 18 bp, synthetic construct
  source 1..18: mol_type = other DNA
taatatgactcacagtag

SEQ ID NO: 6481 - DNA, 18 bp, synthetic construct
  source 1..18: mol_type = other DNA
ttctaagactcactatag

SEQ ID NO: 6482 - DNA, 18 bp, synthetic construct
  source 1..18: mol_type = other DNA
taaaacgatacactatag

SEQ ID NO: 6483 - DNA, 18 bp, synthetic construct
  source 1..18: mol_type = other DNA
taatactactcaccaaag

SEQ ID NO: 6484 - DNA, 18 bp, synthetic construct
  source 1..18: mol_type = other DNA
catttcgactcactatag

SEQ ID NO: 6485 - DNA, 18 bp, synthetic construct
  source 1..18: mol_type = other DNA
taatacgactctctactg

SEQ ID NO: 6486 - DNA, 18 bp, synthetic construct
  source 1..18: mol_type = other DNA
taatacgcttcactttag

SEQ ID NO: 6487 - DNA, 18 bp, synthetic construct
  source 1..18: mol_type = other DNA
taatacgagtcgctttag

SEQ ID NO: 6488 - DNA, 18 bp, synthetic construct
  source 1..18: mol_type = other DNA
taatccgacacaatatag

SEQ ID NO: 6489 - DNA, 18 bp, synthetic construct
  source 1..18: mol_type = other DNA
taatccgacttactctag

SEQ ID NO: 6490 - DNA, 18 bp, synthetic construct
  source 1..18: mol_type = other DNA
tagtacgtctcattatag

SEQ ID NO: 6491 - DNA, 18 bp, synthetic construct
  source 1..18: mol_type = other DNA
tattactactcactgtag

SEQ ID NO: 6492 - DNA, 18 bp, synthetic construct
  source 1..18: mol_type = other DNA
taattcgactcattaaag

SEQ ID NO: 6493 - DNA, 18 bp, synthetic construct
  source 1..18: mol_type = other DNA
tattacgacccactattg

SEQ ID NO: 6494 - DNA, 18 bp, synthetic construct
  source 1..18: mol_type = other DNA
atatacgactcactatgg

SEQ ID NO: 6495 - DNA, 18 bp, synthetic construct
  source 1..18: mol_type = other DNA
taaaacgactctctacag

SEQ ID NO: 6496 - DNA, 18 bp, synthetic construct
  source 1..18: mol_type = other DNA
taatacgaataacaatag

SEQ ID NO: 6497 - DNA, 18 bp, synthetic construct
  source 1..18: mol_type = other DNA
taatagttctcactatag

SEQ ID NO: 6498 - DNA, 18 bp, synthetic construct
  source 1..18: mol_type = other DNA
tattacgactcagaatag

SEQ ID NO: 6499 - DNA, 18 bp, synthetic construct
  source 1..18: mol_type = other DNA
ttatacgactcacgattg

SEQ ID NO: 6500 - DNA, 18 bp, synthetic construct
  source 1..18: mol_type = other DNA
aaacacgtctcactatag

SEQ ID NO: 6501 - DNA, 18 bp, synthetic construct
  source 1..18: mol_type = other DNA
acatacgactcactattg

SEQ ID NO: 6502 - DNA, 18 bp, synthetic construct
  source 1..18: mol_type = other DNA
taatacgccacactaaag

SEQ ID NO: 6503 - DNA, 18 bp, synthetic construct
  source 1..18: mol_type = other DNA
taatatgactgtctatag

SEQ ID NO: 6504 - DNA, 18 bp, synthetic construct
  source 1..18: mol_type = other DNA
tattatgactcactctag

SEQ ID NO: 6505 - DNA, 18 bp, synthetic construct
  source 1..18: mol_type = other DNA
ttatacgacactctatag

SEQ ID NO: 6506 - DNA, 18 bp, synthetic construct
  source 1..18: mol_type = other DNA
taataagtctccctatag

SEQ ID NO: 6507 - DNA, 18 bp, synthetic construct
  source 1..18: mol_type = other DNA
tataacgaatcactatag

SEQ ID NO: 6508 - DNA, 18 bp, synthetic construct
  source 1..18: mol_type = other DNA
taattcgactcacttaag

SEQ ID NO: 6509 - DNA, 18 bp, synthetic construct
  source 1..18: mol_type = other DNA
ttatactactcaccatag

SEQ ID NO: 6510 - DNA, 18 bp, synthetic construct
  source 1..18: mol_type = other DNA
taaaacgactcacaattg

SEQ ID NO: 6511 - DNA, 18 bp, synthetic construct
  source 1..18: mol_type = other DNA
tatttcaactcactatag

SEQ ID NO: 6512 - DNA, 18 bp, synthetic construct
  source 1..18: mol_type = other DNA
ttatacgatacactatag

SEQ ID NO: 6513 - DNA, 18 bp, synthetic construct
  source 1..18: mol_type = other DNA
aaatacaacttactatag

SEQ ID NO: 6514 - DNA, 18 bp, synthetic construct
  source 1..18: mol_type = other DNA
caattcgactctctatag

SEQ ID NO: 6515 - DNA, 18 bp, synthetic construct
  source 1..18: mol_type = other DNA
taattccacacactatag

SEQ ID NO: 6516 - DNA, 18 bp, synthetic construct
  source 1..18: mol_type = other DNA
tcatacgacacactattg

SEQ ID NO: 6517 - DNA, 18 bp, synthetic construct
  source 1..18: mol_type = other DNA
tgatacgactctctattg

SEQ ID NO: 6518 - DNA, 18 bp, synthetic construct
  source 1..18: mol_type = other DNA
caatactactcacaatag

SEQ ID NO: 6519 - DNA, 18 bp, synthetic construct
  source 1..18: mol_type = other DNA
ctatacgactaactatag

SEQ ID NO: 6520 - DNA, 18 bp, synthetic construct
  source 1..18: mol_type = other DNA
taacacgactcactcaag

SEQ ID NO: 6521 - DNA, 18 bp, synthetic construct
  source 1..18: mol_type = other DNA
taatacgaatcacgattg

SEQ ID NO: 6522 - DNA, 18 bp, synthetic construct
  source 1..18: mol_type = other DNA
taatacgagtcactcaag

SEQ ID NO: 6523 - DNA, 18 bp, synthetic construct
  source 1..18: mol_type = other DNA
taatacgattagctatag

SEQ ID NO: 6524 - DNA, 18 bp, synthetic construct
  source 1..18: mol_type = other DNA
taatgtgactcactttag

SEQ ID NO: 6525 - DNA, 18 bp, synthetic construct
  source 1..18: mol_type = other DNA
aaaaacgacttactatag

SEQ ID NO: 6526 - DNA, 18 bp, synthetic construct
  source 1..18: mol_type = other DNA
taacactcctcactatag

SEQ ID NO: 6527 - DNA, 18 bp, synthetic construct
  source 1..18: mol_type = other DNA
taacatgactcactttag

SEQ ID NO: 6528 - DNA, 18 bp, synthetic construct
  source 1..18: mol_type = other DNA
taatacgacctacaatag

SEQ ID NO: 6529 - DNA, 18 bp, synthetic construct
  source 1..18: mol_type = other DNA
tatttcgagtcactatag

SEQ ID NO: 6530 - DNA, 18 bp, synthetic construct
  source 1..18: mol_type = other DNA
aaatacgacacactgtag

SEQ ID NO: 6531 - DNA, 18 bp, synthetic construct
  source 1..18: mol_type = other DNA
caatgcgactcactattg

SEQ ID NO: 6532 - DNA, 18 bp, synthetic construct
  source 1..18: mol_type = other DNA
ccttacgactcactatag

SEQ ID NO: 6533 - DNA, 18 bp, synthetic construct
  source 1..18: mol_type = other DNA
taacacgacagactatag

SEQ ID NO: 6534 - DNA, 18 bp, synthetic construct
  source 1..18: mol_type = other DNA
taacacgactcacaatgg

SEQ ID NO: 6535 - DNA, 18 bp, synthetic construct
  source 1..18: mol_type = other DNA
taacactactcaccatag

SEQ ID NO: 6536 - DNA, 18 bp, synthetic construct
  source 1..18: mol_type = other DNA
taagacaactctctatag

SEQ ID NO: 6537 - DNA, 18 bp, synthetic construct
  source 1..18: mol_type = other DNA
taataagactcattagag

SEQ ID NO: 6538 - DNA, 18 bp, synthetic construct
  source 1..18: mol_type = other DNA
taatacacctcaccatag

SEQ ID NO: 6539 - DNA, 18 bp, synthetic construct
  source 1..18: mol_type = other DNA
taatacggattactatag

SEQ ID NO: 6540 - DNA, 18 bp, synthetic construct
  source 1..18: mol_type = other DNA
taatacggtttactatag

SEQ ID NO: 6541 - DNA, 18 bp, synthetic construct
  source 1..18: mol_type = other DNA
taataggactacctatag

SEQ ID NO: 6542 - DNA, 18 bp, synthetic construct
  source 1..18: mol_type = other DNA
taatatgacacgctatag

SEQ ID NO: 6543 - DNA, 18 bp, synthetic construct
  source 1..18: mol_type = other DNA
taatatgactcaatacag

SEQ ID NO: 6544 - DNA, 18 bp, synthetic construct
  source 1..18: mol_type = other DNA
taatccgaatgactatag

SEQ ID NO: 6545 - DNA, 18 bp, synthetic construct
  source 1..18: mol_type = other DNA
taatctgactcattatag

SEQ ID NO: 6546 - DNA, 18 bp, synthetic construct
  source 1..18: mol_type = other DNA
taatgcgactcaatatcg

SEQ ID NO: 6547 - DNA, 18 bp, synthetic construct
  source 1..18: mol_type = other DNA
tagtacgacttaatatag

SEQ ID NO: 6548 - DNA, 18 bp, synthetic construct
  source 1..18: mol_type = other DNA
tattaagactcacgatag

SEQ ID NO: 6549 - DNA, 18 bp, synthetic construct
  source 1..18: mol_type = other DNA
tgataagactcacaatag

SEQ ID NO: 6550 - DNA, 18 bp, synthetic construct
  source 1..18: mol_type = other DNA
tgatacgactctcgatag

SEQ ID NO: 6551 - DNA, 18 bp, synthetic construct
  source 1..18: mol_type = other DNA
tgatacggctcactatgg

SEQ ID NO: 6552 - DNA, 18 bp, synthetic construct
  source 1..18: mol_type = other DNA
tgatacggctcgctatag

SEQ ID NO: 6553 - DNA, 18 bp, synthetic construct
  source 1..18: mol_type = other DNA
tgatccgactcactttag

SEQ ID NO: 6554 - DNA, 18 bp, synthetic construct
  source 1..18: mol_type = other DNA
ttatacgaccaactatag

SEQ ID NO: 6555 - DNA, 18 bp, synthetic construct
  source 1..18: mol_type = other DNA
ttatacgagtcattatag

SEQ ID NO: 6556 - DNA, 18 bp, synthetic construct
  source 1..18: mol_type = other DNA
ttgtacgactcactacag

SEQ ID NO: 6557 - DNA, 18 bp, synthetic construct
  source 1..18: mol_type = other DNA
aaaaacgactcacgatag

SEQ ID NO: 6558 - DNA, 18 bp, synthetic construct
  source 1..18: mol_type = other DNA
aaatacgacgcaatatag

SEQ ID NO: 6559 - DNA, 18 bp, synthetic construct
  source 1..18: mol_type = other DNA
aaatacgacttgctatag

SEQ ID NO: 6560 - DNA, 18 bp, synthetic construct
  source 1..18: mol_type = other DNA
caataccactaactatag

SEQ ID NO: 6561 - DNA, 18 bp, synthetic construct
  source 1..18: mol_type = other DNA
caataccagtcactatag

SEQ ID NO: 6562 - DNA, 18 bp, synthetic construct
  source 1..18: mol_type = other DNA
caatacgactaactgtag

SEQ ID NO: 6563 - DNA, 18 bp, synthetic construct
  source 1..18: mol_type = other DNA
gaaaactactcactatag

SEQ ID NO: 6564 - DNA, 18 bp, synthetic construct
  source 1..18: mol_type = other DNA
gaatacgacacactacag

SEQ ID NO: 6565 - DNA, 18 bp, synthetic construct
  source 1..18: mol_type = other DNA
gaatacgactcactcttg

SEQ ID NO: 6566 - DNA, 18 bp, synthetic construct
  source 1..18: mol_type = other DNA
gaatacggctcactatcg

SEQ ID NO: 6567 - DNA, 18 bp, synthetic construct
  source 1..18: mol_type = other DNA
gcattcgactcactatag

SEQ ID NO: 6568 - DNA, 18 bp, synthetic construct
  source 1..18: mol_type = other DNA
ggatacgactcacaatag

SEQ ID NO: 6569 - DNA, 18 bp, synthetic construct
  source 1..18: mol_type = other DNA
taaaacgaccgactatag

SEQ ID NO: 6570 - DNA, 18 bp, synthetic construct
  source 1..18: mol_type = other DNA
taacaccactcactaaag

SEQ ID NO: 6571 - DNA, 18 bp, synthetic construct
  source 1..18: mol_type = other DNA
taacaccagtcactatag

SEQ ID NO: 6572 - DNA, 18 bp, synthetic construct
  source 1..18: mol_type = other DNA
taacacgattcactgtag

SEQ ID NO: 6573 - DNA, 18 bp, synthetic construct
  source 1..18: mol_type = other DNA
taagacgaatcacaatag

SEQ ID NO: 6574 - DNA, 18 bp, synthetic construct
  source 1..18: mol_type = other DNA
taagacgattcactattg

SEQ ID NO: 6575 - DNA, 18 bp, synthetic construct
  source 1..18: mol_type = other DNA
taataacagtcactatag

SEQ ID NO: 6576 - DNA, 18 bp, synthetic construct
  source 1..18: mol_type = other DNA
taataagactcactgtgg

SEQ ID NO: 6577 - DNA, 18 bp, synthetic construct
  source 1..18: mol_type = other DNA
taatacaacccgctatag

SEQ ID NO: 6578 - DNA, 18 bp, synthetic construct
  source 1..18: mol_type = other DNA
taatacaacgaactatag

SEQ ID NO: 6579 - DNA, 18 bp, synthetic construct
  source 1..18: mol_type = other DNA
taatacaactaactagag

SEQ ID NO: 6580 - DNA, 18 bp, synthetic construct
  source 1..18: mol_type = other DNA
taatacaactgactatcg

SEQ ID NO: 6581 - DNA, 18 bp, synthetic construct
  source 1..18: mol_type = other DNA
taataccaatcagtatag

SEQ ID NO: 6582 - DNA, 18 bp, synthetic construct
  source 1..18: mol_type = other DNA
taataccactcccgatag

SEQ ID NO: 6583 - DNA, 18 bp, synthetic construct
  source 1..18: mol_type = other DNA
taatacgaaccactatgg

SEQ ID NO: 6584 - DNA, 18 bp, synthetic construct
  source 1..18: mol_type = other DNA
taatacgacagactagag

SEQ ID NO: 6585 - DNA, 18 bp, synthetic construct
  source 1..18: mol_type = other DNA
taatacgacccagtattg

SEQ ID NO: 6586 - DNA, 18 bp, synthetic construct
  source 1..18: mol_type = other DNA
taatacgacccagtttag

SEQ ID NO: 6587 - DNA, 18 bp, synthetic construct
  source 1..18: mol_type = other DNA
taatacgaccgcctatag

SEQ ID NO: 6588 - DNA, 18 bp, synthetic construct
  source 1..18: mol_type = other DNA
taatacgactacctagag

SEQ ID NO: 6589 - DNA, 18 bp, synthetic construct
  source 1..18: mol_type = other DNA
taatacgactcacagtac

SEQ ID NO: 6590 - DNA, 18 bp, synthetic construct
  source 1..18: mol_type = other DNA
taatacgattcggtatag

SEQ ID NO: 6591 - DNA, 18 bp, synthetic construct
  source 1..18: mol_type = other DNA
taatacgcctcacgagag

SEQ ID NO: 6592 - DNA, 18 bp, synthetic construct
  source 1..18: mol_type = other DNA
taatacggatcactatcg

SEQ ID NO: 6593 - DNA, 18 bp, synthetic construct
  source 1..18: mol_type = other DNA
taatacggctgactttag

SEQ ID NO: 6594 - DNA, 18 bp, synthetic construct
  source 1..18: mol_type = other DNA
taatacgtcgcattatag

SEQ ID NO: 6595 - DNA, 18 bp, synthetic construct
  source 1..18: mol_type = other DNA
taatactactcacggtag

SEQ ID NO: 6596 - DNA, 18 bp, synthetic construct
  source 1..18: mol_type = other DNA
taatactactcagtagag

SEQ ID NO: 6597 - DNA, 18 bp, synthetic construct
  source 1..18: mol_type = other DNA
taatagaactaactatag

SEQ ID NO: 6598 - DNA, 18 bp, synthetic construct
  source 1..18: mol_type = other DNA
taatagcactccctatag

SEQ ID NO: 6599 - DNA, 18 bp, synthetic construct
  source 1..18: mol_type = other DNA
taatagtacccactatag

SEQ ID NO: 6600 - DNA, 18 bp, synthetic construct
  source 1..18: mol_type = other DNA
taatatcactcacgatag

SEQ ID NO: 6601 - DNA, 18 bp, synthetic construct
  source 1..18: mol_type = other DNA
taatatgaccgactatag

SEQ ID NO: 6602 - DNA, 18 bp, synthetic construct
  source 1..18: mol_type = other DNA
taatatgacgcactatgg

SEQ ID NO: 6603 - DNA, 18 bp, synthetic construct
  source 1..18: mol_type = other DNA
taatatgactcgctctag

SEQ ID NO: 6604 - DNA, 18 bp, synthetic construct
  source 1..18: mol_type = other DNA
taatccgactcgctgtag

SEQ ID NO: 6605 - DNA, 18 bp, synthetic construct
  source 1..18: mol_type = other DNA
taatccgactggctatag

SEQ ID NO: 6606 - DNA, 18 bp, synthetic construct
  source 1..18: mol_type = other DNA
taatctgactcactatcg

SEQ ID NO: 6607 - DNA, 18 bp, synthetic construct
  source 1..18: mol_type = other DNA
taatgcgatccactatag

SEQ ID NO: 6608 - DNA, 18 bp, synthetic construct
  source 1..18: mol_type = other DNA
taattagactcacgatag

SEQ ID NO: 6609 - DNA, 18 bp, synthetic construct
  source 1..18: mol_type = other DNA
tactaccactaactatag

SEQ ID NO: 6610 - DNA, 18 bp, synthetic construct
  source 1..18: mol_type = other DNA
tactaccactcactacag

SEQ ID NO: 6611 - DNA, 18 bp, synthetic construct
  source 1..18: mol_type = other DNA
tactaggactcactgtag

SEQ ID NO: 6612 - DNA, 18 bp, synthetic construct
  source 1..18: mol_type = other DNA
tagtacgacccactatgg

SEQ ID NO: 6613 - DNA, 18 bp, synthetic construct
  source 1..18: mol_type = other DNA
tagtacgactcagtacag

SEQ ID NO: 6614 - DNA, 18 bp, synthetic construct
  source 1..18: mol_type = other DNA
tagtacgtctcactctag

SEQ ID NO: 6615 - DNA, 18 bp, synthetic construct
  source 1..18: mol_type = other DNA
tagtgcgactcaccatag

SEQ ID NO: 6616 - DNA, 18 bp, synthetic construct
  source 1..18: mol_type = other DNA
tattacggctcgctatag

SEQ ID NO: 6617 - DNA, 18 bp, synthetic construct
  source 1..18: mol_type = other DNA
tcatacgacacactatcg

SEQ ID NO: 6618 - DNA, 18 bp, synthetic construct
  source 1..18: mol_type = other DNA
tcatacgactctctatcg

SEQ ID NO: 6619 - DNA, 18 bp, synthetic construct
  source 1..18: mol_type = other DNA
tcatacgacttaccatag

SEQ ID NO: 6620 - DNA, 18 bp, synthetic construct
  source 1..18: mol_type = other DNA
tcatacgcctcactatcg

SEQ ID NO: 6621 - DNA, 18 bp, synthetic construct
  source 1..18: mol_type = other DNA
tcatacggctcactttag

SEQ ID NO: 6622 - DNA, 18 bp, synthetic construct
  source 1..18: mol_type = other DNA
tgatacgactcactccag

SEQ ID NO: 6623 - DNA, 18 bp, synthetic construct
  source 1..18: mol_type = other DNA
tgatgccactcactatag

SEQ ID NO: 6624 - DNA, 18 bp, synthetic construct
  source 1..18: mol_type = other DNA
ttctacgactcgctatag

SEQ ID NO: 6625 - DNA, 18 bp, synthetic construct
  source 1..18: mol_type = other DNA
ttattcgactctctatag

SEQ ID NO: 6626 - DNA, 18 bp, synthetic construct
  source 1..18: mol_type = other DNA
taatacgactctcttttg

SEQ ID NO: 6627 - DNA, 18 bp, synthetic construct
  source 1..18: mol_type = other DNA
aattacgtctcactatag

SEQ ID NO: 6628 - DNA, 18 bp, synthetic construct
  source 1..18: mol_type = other DNA
taatacgattttctatag

SEQ ID NO: 6629 - DNA, 18 bp, synthetic construct
  source 1..18: mol_type = other DNA
taataagtctcactttag

SEQ ID NO: 6630 - DNA, 18 bp, synthetic construct
  source 1..18: mol_type = other DNA
taaaacgactcacaagag

SEQ ID NO: 6631 - DNA, 18 bp, synthetic construct
  source 1..18: mol_type = other DNA
taacatgactcactattg

SEQ ID NO: 6632 - DNA, 18 bp, synthetic construct
  source 1..18: mol_type = other DNA
taataagactcacagtag

SEQ ID NO: 6633 - DNA, 18 bp, synthetic construct
  source 1..18: mol_type = other DNA
taatactactctctatcg

SEQ ID NO: 6634 - DNA, 18 bp, synthetic construct
  source 1..18: mol_type = other DNA
taatatgactctctacag

SEQ ID NO: 6635 - DNA, 18 bp, synthetic construct
  source 1..18: mol_type = other DNA
caatacgactatctatag

SEQ ID NO: 6636 - DNA, 18 bp, synthetic construct
  source 1..18: mol_type = other DNA
caatacgattcattatag

SEQ ID NO: 6637 - DNA, 18 bp, synthetic construct
  source 1..18: mol_type = other DNA
caatactactcactattg

SEQ ID NO: 6638 - DNA, 18 bp, synthetic construct
  source 1..18: mol_type = other DNA
taacaagacttactatag

SEQ ID NO: 6639 - DNA, 18 bp, synthetic construct
  source 1..18: mol_type = other DNA
taatacgactcatagtag

SEQ ID NO: 6640 - DNA, 18 bp, synthetic construct
  source 1..18: mol_type = other DNA
taatactcatcactatag

SEQ ID NO: 6641 - DNA, 18 bp, synthetic construct
  source 1..18: mol_type = other DNA
taatacttctcgctatag

SEQ ID NO: 6642 - DNA, 18 bp, synthetic construct
  source 1..18: mol_type = other DNA
taattcaacccactatag

SEQ ID NO: 6643 - DNA, 18 bp, synthetic construct
  source 1..18: mol_type = other DNA
tagtacgactttctatag

SEQ ID NO: 6644 - DNA, 18 bp, synthetic construct
  source 1..18: mol_type = other DNA
tcataagacacactatag

SEQ ID NO: 6645 - DNA, 18 bp, synthetic construct
  source 1..18: mol_type = other DNA
tgatacgattcactttag

SEQ ID NO: 6646 - DNA, 18 bp, synthetic construct
  source 1..18: mol_type = other DNA
taatacgactctcttcag

SEQ ID NO: 6647 - DNA, 18 bp, synthetic construct
  source 1..18: mol_type = other DNA
ttatacgactcgcaatag

SEQ ID NO: 6648 - DNA, 18 bp, synthetic construct
  source 1..18: mol_type = other DNA
taataagactcaccattg

SEQ ID NO: 6649 - DNA, 18 bp, synthetic construct
  source 1..18: mol_type = other DNA
taataagcatcactatag

SEQ ID NO: 6650 - DNA, 18 bp, synthetic construct
  source 1..18: mol_type = other DNA
taatacgactctctagtg

SEQ ID NO: 6651 - DNA, 18 bp, synthetic construct
  source 1..18: mol_type = other DNA
taatacgattcagtattg

SEQ ID NO: 6652 - DNA, 18 bp, synthetic construct
  source 1..18: mol_type = other DNA
taatactacccattatag

SEQ ID NO: 6653 - DNA, 18 bp, synthetic construct
  source 1..18: mol_type = other DNA
taatactcctaactatag

SEQ ID NO: 6654 - DNA, 18 bp, synthetic construct
  source 1..18: mol_type = other DNA
taatataactcactgtag

SEQ ID NO: 6655 - DNA, 18 bp, synthetic construct
  source 1..18: mol_type = other DNA
taatccgactctccatag

SEQ ID NO: 6656 - DNA, 18 bp, synthetic construct
  source 1..18: mol_type = other DNA
ttatacgaatcagtatag

SEQ ID NO: 6657 - DNA, 18 bp, synthetic construct
  source 1..18: mol_type = other DNA
taattcgattcactatcg

SEQ ID NO: 6658 - DNA, 18 bp, synthetic construct
  source 1..18: mol_type = other DNA
tactacgactcacattag

SEQ ID NO: 6659 - DNA, 18 bp, synthetic construct
  source 1..18: mol_type = other DNA
tattacgaatcactaaag

SEQ ID NO: 6660 - DNA, 18 bp, synthetic construct
  source 1..18: mol_type = other DNA
tatttctactcactatag

SEQ ID NO: 6661 - DNA, 18 bp, synthetic construct
  source 1..18: mol_type = other DNA
taatacgactttttatag

SEQ ID NO: 6662 - DNA, 18 bp, synthetic construct
  source 1..18: mol_type = other DNA
taatttgactcactttag

SEQ ID NO: 6663 - DNA, 18 bp, synthetic construct
  source 1..18: mol_type = other DNA
ttatacgactctctctag

SEQ ID NO: 6664 - DNA, 18 bp, synthetic construct
  source 1..18: mol_type = other DNA
taataagacttactaaag

SEQ ID NO: 6665 - DNA, 18 bp, synthetic construct
  source 1..18: mol_type = other DNA
aaatatgcctcactatag

SEQ ID NO: 6666 - DNA, 18 bp, synthetic construct
  source 1..18: mol_type = other DNA
taactcgactcaccatag

SEQ ID NO: 6667 - DNA, 18 bp, synthetic construct
  source 1..18: mol_type = other DNA
taatacgtctcattagag

SEQ ID NO: 6668 - DNA, 18 bp, synthetic construct
  source 1..18: mol_type = other DNA
taattctactcactgtag

SEQ ID NO: 6669 - DNA, 18 bp, synthetic construct
  source 1..18: mol_type = other DNA
tattactactcactctag

SEQ ID NO: 6670 - DNA, 18 bp, synthetic construct
  source 1..18: mol_type = other DNA
ttatacgaatcgctatag

SEQ ID NO: 6671 - DNA, 18 bp, synthetic construct
  source 1..18: mol_type = other DNA
ttatacgactcagtttag

SEQ ID NO: 6672 - DNA, 18 bp, synthetic construct
  source 1..18: mol_type = other DNA
caacacgactcactaaag

SEQ ID NO: 6673 - DNA, 18 bp, synthetic construct
  source 1..18: mol_type = other DNA
caatacgaaccactatag

SEQ ID NO: 6674 - DNA, 18 bp, synthetic construct
  source 1..18: mol_type = other DNA
catcacgactcactatag

SEQ ID NO: 6675 - DNA, 18 bp, synthetic construct
  source 1..18: mol_type = other DNA
cgatacgactcactaaag

SEQ ID NO: 6676 - DNA, 18 bp, synthetic construct
  source 1..18: mol_type = other DNA
taaactgactcactatag

SEQ ID NO: 6677 - DNA, 18 bp, synthetic construct
  source 1..18: mol_type = other DNA
taacacgactcactaagg

SEQ ID NO: 6678 - DNA, 18 bp, synthetic construct
  source 1..18: mol_type = other DNA
taacacgcctcactttag

SEQ ID NO: 6679 - DNA, 18 bp, synthetic construct
  source 1..18: mol_type = other DNA
taataagactgactgtag

SEQ ID NO: 6680 - DNA, 18 bp, synthetic construct
  source 1..18: mol_type = other DNA
taatacgaatcgctacag

SEQ ID NO: 6681 - DNA, 18 bp, synthetic construct
  source 1..18: mol_type = other DNA
taatacgactcattgcag

SEQ ID NO: 6682 - DNA, 18 bp, synthetic construct
  source 1..18: mol_type = other DNA
taatacggctcactcttg

SEQ ID NO: 6683 - DNA, 18 bp, synthetic construct
  source 1..18: mol_type = other DNA
taatatgactcaccatcg

SEQ ID NO: 6684 - DNA, 18 bp, synthetic construct
  source 1..18: mol_type = other DNA
taatcccattcactatag

SEQ ID NO: 6685 - DNA, 18 bp, synthetic construct
  source 1..18: mol_type = other DNA
taatccggctcactttag

SEQ ID NO: 6686 - DNA, 18 bp, synthetic construct
  source 1..18: mol_type = other DNA
taatgagactcactatgg

SEQ ID NO: 6687 - DNA, 18 bp, synthetic construct
  source 1..18: mol_type = other DNA
taatgccactctctatag

SEQ ID NO: 6688 - DNA, 18 bp, synthetic construct
  source 1..18: mol_type = other DNA
taatgcgactctcgatag

SEQ ID NO: 6689 - DNA, 18 bp, synthetic construct
  source 1..18: mol_type = other DNA
taattcgactgcctatag

SEQ ID NO: 6690 - DNA, 18 bp, synthetic construct
  source 1..18: mol_type = other DNA
tactacgaattactatag

SEQ ID NO: 6691 - DNA, 18 bp, synthetic construct
  source 1..18: mol_type = other DNA
tactactgctcactatag

SEQ ID NO: 6692 - DNA, 18 bp, synthetic construct
  source 1..18: mol_type = other DNA
tattaagactcactgtag

SEQ ID NO: 6693 - DNA, 18 bp, synthetic construct
  source 1..18: mol_type = other DNA
tattacgagttactatag

SEQ ID NO: 6694 - DNA, 18 bp, synthetic construct
  source 1..18: mol_type = other DNA
tgaaacgactcattatag

SEQ ID NO: 6695 - DNA, 18 bp, synthetic construct
  source 1..18: mol_type = other DNA
ttatacaactcactatgg

SEQ ID NO: 6696 - DNA, 18 bp, synthetic construct
  source 1..18: mol_type = other DNA
ttatacgagtccctatag

SEQ ID NO: 6697 - DNA, 18 bp, synthetic construct
  source 1..18: mol_type = other DNA
ttattctactcactatag

SEQ ID NO: 6698 - DNA, 18 bp, synthetic construct
  source 1..18: mol_type = other DNA
taatatgactcacttaag

SEQ ID NO: 6699 - DNA, 18 bp, synthetic construct
  source 1..18: mol_type = other DNA
taatacctctcactttag

SEQ ID NO: 6700 - DNA, 18 bp, synthetic construct
  source 1..18: mol_type = other DNA
tactacgtctcactattg

SEQ ID NO: 6701 - DNA, 18 bp, synthetic construct
  source 1..18: mol_type = other DNA
taatacgaatcaataaag

SEQ ID NO: 6702 - DNA, 18 bp, synthetic construct
  source 1..18: mol_type = other DNA
ttctactactcactatag

SEQ ID NO: 6703 - DNA, 18 bp, synthetic construct
  source 1..18: mol_type = other DNA
taacacgactaactattg

SEQ ID NO: 6704 - DNA, 18 bp, synthetic construct
  source 1..18: mol_type = other DNA
taatacgtgtcactaaag

SEQ ID NO: 6705 - DNA, 18 bp, synthetic construct
  source 1..18: mol_type = other DNA
tagaatgactcactatag

SEQ ID NO: 6706 - DNA, 18 bp, synthetic construct
  source 1..18: mol_type = other DNA
tattacgactcccaatag

SEQ ID NO: 6707 - DNA, 18 bp, synthetic construct
  source 1..18: mol_type = other DNA
cattacgaatcactatag

SEQ ID NO: 6708 - DNA, 18 bp, synthetic construct
  source 1..18: mol_type = other DNA
cattaggactcactatag

SEQ ID NO: 6709 - DNA, 18 bp, synthetic construct
  source 1..18: mol_type = other DNA
taaaaggacttactatag

SEQ ID NO: 6710 - DNA, 18 bp, synthetic construct
  source 1..18: mol_type = other DNA
taacacgattcaatatag

SEQ ID NO: 6711 - DNA, 18 bp, synthetic construct
  source 1..18: mol_type = other DNA
taatacgactcccaatcg

SEQ ID NO: 6712 - DNA, 18 bp, synthetic construct
  source 1..18: mol_type = other DNA
taatatgacactctatag

SEQ ID NO: 6713 - DNA, 18 bp, synthetic construct
  source 1..18: mol_type = other DNA
aattacgactcaatatag

SEQ ID NO: 6714 - DNA, 18 bp, synthetic construct
  source 1..18: mol_type = other DNA
taatacgactctctaacg

SEQ ID NO: 6715 - DNA, 18 bp, synthetic construct
  source 1..18: mol_type = other DNA
aaatacgactcgctttag

SEQ ID NO: 6716 - DNA, 18 bp, synthetic construct
  source 1..18: mol_type = other DNA
taatacgattcacaagag

SEQ ID NO: 6717 - DNA, 18 bp, synthetic construct
  source 1..18: mol_type = other DNA
taatacggaacactatag

SEQ ID NO: 6718 - DNA, 18 bp, synthetic construct
  source 1..18: mol_type = other DNA
taatacgtcttactgtag

SEQ ID NO: 6719 - DNA, 18 bp, synthetic construct
  source 1..18: mol_type = other DNA
tactactactcactattg

SEQ ID NO: 6720 - DNA, 18 bp, synthetic construct
  source 1..18: mol_type = other DNA
tagcacgtctcactatag

SEQ ID NO: 6721 - DNA, 18 bp, synthetic construct
  source 1..18: mol_type = other DNA
ttataggaatcactatag

SEQ ID NO: 6722 - DNA, 18 bp, synthetic construct
  source 1..18: mol_type = other DNA
taaaacgactaactaaag

SEQ ID NO: 6723 - DNA, 18 bp, synthetic construct
  source 1..18: mol_type = other DNA
taaaacgactccctattg

SEQ ID NO: 6724 - DNA, 18 bp, synthetic construct
  source 1..18: mol_type = other DNA
taaaacgactctgtatag

SEQ ID NO: 6725 - DNA, 18 bp, synthetic construct
  source 1..18: mol_type = other DNA
taatacgtatcaatatag

SEQ ID NO: 6726 - DNA, 18 bp, synthetic construct
  source 1..18: mol_type = other DNA
taatacgactcagaaaag

SEQ ID NO: 6727 - DNA, 18 bp, synthetic construct
  source 1..18: mol_type = other DNA
ttatacgactcattaaag

SEQ ID NO: 6728 - DNA, 18 bp, synthetic construct
  source 1..18: mol_type = other DNA
taatacgactctccaaag

SEQ ID NO: 6729 - DNA, 18 bp, synthetic construct
  source 1..18: mol_type = other DNA
atatacgacttactatag

SEQ ID NO: 6730 - DNA, 18 bp, synthetic construct
  source 1..18: mol_type = other DNA
taatacgactaactaatg

SEQ ID NO: 6731 - DNA, 18 bp, synthetic construct
  source 1..18: mol_type = other DNA
atatacgactcactttag

SEQ ID NO: 6732 - DNA, 18 bp, synthetic construct
  source 1..18: mol_type = other DNA
taaaactactcacaatag

SEQ ID NO: 6733 - DNA, 18 bp, synthetic construct
  source 1..18: mol_type = other DNA
taattcgactaactttag

SEQ ID NO: 6734 - DNA, 18 bp, synthetic construct
  source 1..18: mol_type = other DNA
taataccattcacaatag

SEQ ID NO: 6735 - DNA, 18 bp, synthetic construct
  source 1..18: mol_type = other DNA
taaaacgactctctgtag

SEQ ID NO: 6736 - DNA, 18 bp, synthetic construct
  source 1..18: mol_type = other DNA
taatacgacttactactg

SEQ ID NO: 6737 - DNA, 18 bp, synthetic construct
  source 1..18: mol_type = other DNA
taatacgtctcccaatag

SEQ ID NO: 6738 - DNA, 18 bp, synthetic construct
  source 1..18: mol_type = other DNA
taatacgtgacactatag

SEQ ID NO: 6739 - DNA, 18 bp, synthetic construct
  source 1..18: mol_type = other DNA
taatcagactctctatag

SEQ ID NO: 6740 - DNA, 18 bp, synthetic construct
  source 1..18: mol_type = other DNA
tgatacgtctcactttag

SEQ ID NO: 6741 - DNA, 18 bp, synthetic construct
  source 1..18: mol_type = other DNA
aaatactactcactctag

SEQ ID NO: 6742 - DNA, 18 bp, synthetic construct
  source 1..18: mol_type = other DNA
ccattcgactcactatag

SEQ ID NO: 6743 - DNA, 18 bp, synthetic construct
  source 1..18: mol_type = other DNA
cgatacgactctctatag

SEQ ID NO: 6744 - DNA, 18 bp, synthetic construct
  source 1..18: mol_type = other DNA
taacaagactcactaaag

SEQ ID NO: 6745 - DNA, 18 bp, synthetic construct
  source 1..18: mol_type = other DNA
taacacgactcaccaaag

SEQ ID NO: 6746 - DNA, 18 bp, synthetic construct
  source 1..18: mol_type = other DNA
taacacgatttactatag

SEQ ID NO: 6747 - DNA, 18 bp, synthetic construct
  source 1..18: mol_type = other DNA
taatacaacacactctag

SEQ ID NO: 6748 - DNA, 18 bp, synthetic construct
  source 1..18: mol_type = other DNA
taatacgaccctatatag

SEQ ID NO: 6749 - DNA, 18 bp, synthetic construct
  source 1..18: mol_type = other DNA
taatgcgactcattttag

SEQ ID NO: 6750 - DNA, 18 bp, synthetic construct
  source 1..18: mol_type = other DNA
taatgcgattcactattg

SEQ ID NO: 6751 - DNA, 18 bp, synthetic construct
  source 1..18: mol_type = other DNA
tactacgtctcactatcg

SEQ ID NO: 6752 - DNA, 18 bp, synthetic construct
  source 1..18: mol_type = other DNA
tatgacgtctcactatag

SEQ ID NO: 6753 - DNA, 18 bp, synthetic construct
  source 1..18: mol_type = other DNA
tattacgactcaatatcg

SEQ ID NO: 6754 - DNA, 18 bp, synthetic construct
  source 1..18: mol_type = other DNA
tattatggctcactatag

SEQ ID NO: 6755 - DNA, 18 bp, synthetic construct
  source 1..18: mol_type = other DNA
tgataatactcactatag

SEQ ID NO: 6756 - DNA, 18 bp, synthetic construct
  source 1..18: mol_type = other DNA
ttagacgactcactattg

SEQ ID NO: 6757 - DNA, 18 bp, synthetic construct
  source 1..18: mol_type = other DNA
aaatacgatttactatag

SEQ ID NO: 6758 - DNA, 18 bp, synthetic construct
  source 1..18: mol_type = other DNA
aaataggactcattatag

SEQ ID NO: 6759 - DNA, 18 bp, synthetic construct
  source 1..18: mol_type = other DNA
atatacgacccactatag

SEQ ID NO: 6760 - DNA, 18 bp, synthetic construct
  source 1..18: mol_type = other DNA
taatacgaatcactaagg

SEQ ID NO: 6761 - DNA, 18 bp, synthetic construct
  source 1..18: mol_type = other DNA
taatccgaatcacaatag

SEQ ID NO: 6762 - DNA, 18 bp, synthetic construct
  source 1..18: mol_type = other DNA
taatcctactcactttag

SEQ ID NO: 6763 - DNA, 18 bp, synthetic construct
  source 1..18: mol_type = other DNA
tactaggtctcactatag

SEQ ID NO: 6764 - DNA, 18 bp, synthetic construct
  source 1..18: mol_type = other DNA
aaatacgcctcactattg

SEQ ID NO: 6765 - DNA, 18 bp, synthetic construct
  source 1..18: mol_type = other DNA
caatacgactcacaacag

SEQ ID NO: 6766 - DNA, 18 bp, synthetic construct
  source 1..18: mol_type = other DNA
caatccaactcactatag

SEQ ID NO: 6767 - DNA, 18 bp, synthetic construct
  source 1..18: mol_type = other DNA
caattcgactccctatag

SEQ ID NO: 6768 - DNA, 18 bp, synthetic construct
  source 1..18: mol_type = other DNA
caattcgcctcactatag

SEQ ID NO: 6769 - DNA, 18 bp, synthetic construct
  source 1..18: mol_type = other DNA
taaaacgacttactctag

SEQ ID NO: 6770 - DNA, 18 bp, synthetic construct
  source 1..18: mol_type = other DNA
taaaacggctcattatag

SEQ ID NO: 6771 - DNA, 18 bp, synthetic construct
  source 1..18: mol_type = other DNA
taataagactcaccgtag

SEQ ID NO: 6772 - DNA, 18 bp, synthetic construct
  source 1..18: mol_type = other DNA
taataagactctctgtag

SEQ ID NO: 6773 - DNA, 18 bp, synthetic construct
  source 1..18: mol_type = other DNA
taataagcctcactacag

SEQ ID NO: 6774 - DNA, 18 bp, synthetic construct
  source 1..18: mol_type = other DNA
taataccaataactatag

SEQ ID NO: 6775 - DNA, 18 bp, synthetic construct
  source 1..18: mol_type = other DNA
taatacgaattactctag

SEQ ID NO: 6776 - DNA, 18 bp, synthetic construct
  source 1..18: mol_type = other DNA
taatacgactccaaatag

SEQ ID NO: 6777 - DNA, 18 bp, synthetic construct
  source 1..18: mol_type = other DNA
taatacgactctctctgg

SEQ ID NO: 6778 - DNA, 18 bp, synthetic construct
  source 1..18: mol_type = other DNA
taatacgatacactacag

SEQ ID NO: 6779 - DNA, 18 bp, synthetic construct
  source 1..18: mol_type = other DNA
taatagtactcacaatag

SEQ ID NO: 6780 - DNA, 18 bp, synthetic construct
  source 1..18: mol_type = other DNA
taatccgcctctctatag

SEQ ID NO: 6781 - DNA, 18 bp, synthetic construct
  source 1..18: mol_type = other DNA
taatccgtttcactatag

SEQ ID NO: 6782 - DNA, 18 bp, synthetic construct
  source 1..18: mol_type = other DNA
taatgctactcgctatag

SEQ ID NO: 6783 - DNA, 18 bp, synthetic construct
  source 1..18: mol_type = other DNA
taatttggctcactatag

SEQ ID NO: 6784 - DNA, 18 bp, synthetic construct
  source 1..18: mol_type = other DNA
tagtatgactcactatcg

SEQ ID NO: 6785 - DNA, 18 bp, synthetic construct
  source 1..18: mol_type = other DNA
tcaaacgattcactatag

SEQ ID NO: 6786 - DNA, 18 bp, synthetic construct
  source 1..18: mol_type = other DNA
tcatacgactaaatatag

SEQ ID NO: 6787 - DNA, 18 bp, synthetic construct
  source 1..18: mol_type = other DNA
tgatacgaatcactattg

SEQ ID NO: 6788 - DNA, 18 bp, synthetic construct
  source 1..18: mol_type = other DNA
tgttacgactcactatcg

SEQ ID NO: 6789 - DNA, 18 bp, synthetic construct
  source 1..18: mol_type = other DNA
ttatacgagtgactatag

SEQ ID NO: 6790 - DNA, 18 bp, synthetic construct
  source 1..18: mol_type = other DNA
aaacacgacgcactatag

SEQ ID NO: 6791 - DNA, 18 bp, synthetic construct
  source 1..18: mol_type = other DNA
aaataagacgcactatag

SEQ ID NO: 6792 - DNA, 18 bp, synthetic construct
  source 1..18: mol_type = other DNA
aaatacgactcactgtgg

SEQ ID NO: 6793 - DNA, 18 bp, synthetic construct
  source 1..18: mol_type = other DNA
aaatgcggctcactatag

SEQ ID NO: 6794 - DNA, 18 bp, synthetic construct
  source 1..18: mol_type = other DNA
aactacgacgcactatag

SEQ ID NO: 6795 - DNA, 18 bp, synthetic construct
  source 1..18: mol_type = other DNA
caataagactcaatatag

SEQ ID NO: 6796 - DNA, 18 bp, synthetic construct
  source 1..18: mol_type = other DNA
caatacgactcaatacag

SEQ ID NO: 6797 - DNA, 18 bp, synthetic construct
  source 1..18: mol_type = other DNA
caatactgctcactatag

SEQ ID NO: 6798 - DNA, 18 bp, synthetic construct
  source 1..18: mol_type = other DNA
caatccgactaactatag

SEQ ID NO: 6799 - DNA, 18 bp, synthetic construct
  source 1..18: mol_type = other DNA
caattcgactcactatgg

SEQ ID NO: 6800 - DNA, 18 bp, synthetic construct
  source 1..18: mol_type = other DNA
gaatacgactcgttatag

SEQ ID NO: 6801 - DNA, 18 bp, synthetic construct
  source 1..18: mol_type = other DNA
gaatacgactgactatcg

SEQ ID NO: 6802 - DNA, 18 bp, synthetic construct
  source 1..18: mol_type = other DNA
gactacgactcactttag

SEQ ID NO: 6803 - DNA, 18 bp, synthetic construct
  source 1..18: mol_type = other DNA
ggatacgacccactatag

SEQ ID NO: 6804 - DNA, 18 bp, synthetic construct
  source 1..18: mol_type = other DNA
taaaacaacccactatag

SEQ ID NO: 6805 - DNA, 18 bp, synthetic construct
  source 1..18: mol_type = other DNA
taacacgacttactctag

SEQ ID NO: 6806 - DNA, 18 bp, synthetic construct
  source 1..18: mol_type = other DNA
taacgccactcactatag

SEQ ID NO: 6807 - DNA, 18 bp, synthetic construct
  source 1..18: mol_type = other DNA
taagactactcagtatag

SEQ ID NO: 6808 - DNA, 18 bp, synthetic construct
  source 1..18: mol_type = other DNA
taatacaacccactatgg

SEQ ID NO: 6809 - DNA, 18 bp, synthetic construct
  source 1..18: mol_type = other DNA
taatacaaccccctatag

SEQ ID NO: 6810 - DNA, 18 bp, synthetic construct
  source 1..18: mol_type = other DNA
taatacaaccgactatag

SEQ ID NO: 6811 - DNA, 18 bp, synthetic construct
  source 1..18: mol_type = other DNA
taataccaaccactatag

SEQ ID NO: 6812 - DNA, 18 bp, synthetic construct
  source 1..18: mol_type = other DNA
taatacgacacactaccg

SEQ ID NO: 6813 - DNA, 18 bp, synthetic construct
  source 1..18: mol_type = other DNA
taatacgactaggtatag

SEQ ID NO: 6814 - DNA, 18 bp, synthetic construct
  source 1..18: mol_type = other DNA
taatacgactcacaaggg

SEQ ID NO: 6815 - DNA, 18 bp, synthetic construct
  source 1..18: mol_type = other DNA
taatacgactcatggtag

SEQ ID NO: 6816 - DNA, 18 bp, synthetic construct
  source 1..18: mol_type = other DNA
taatacgactcccgacag

SEQ ID NO: 6817 - DNA, 18 bp, synthetic construct
  source 1..18: mol_type = other DNA
taatacgacttcctctag

SEQ ID NO: 6818 - DNA, 18 bp, synthetic construct
  source 1..18: mol_type = other DNA
taatacgagccacaatag

SEQ ID NO: 6819 - DNA, 18 bp, synthetic construct
  source 1..18: mol_type = other DNA
taatacgagcccctatag

SEQ ID NO: 6820 - DNA, 18 bp, synthetic construct
  source 1..18: mol_type = other DNA
taatacgattcgctatgg

SEQ ID NO: 6821 - DNA, 18 bp, synthetic construct
  source 1..18: mol_type = other DNA
taatacgattctctatcg

SEQ ID NO: 6822 - DNA, 18 bp, synthetic construct
  source 1..18: mol_type = other DNA
taatacgcctacctatag

SEQ ID NO: 6823 - DNA, 18 bp, synthetic construct
  source 1..18: mol_type = other DNA
taatacgcctagctatag

SEQ ID NO: 6824 - DNA, 18 bp, synthetic construct
  source 1..18: mol_type = other DNA
taatacgcctcaccacag

SEQ ID NO: 6825 - DNA, 18 bp, synthetic construct
  source 1..18: mol_type = other DNA
taatacgcctccctttag

SEQ ID NO: 6826 - DNA, 18 bp, synthetic construct
  source 1..18: mol_type = other DNA
taatacgcctcgctaaag

SEQ ID NO: 6827 - DNA, 18 bp, synthetic construct
  source 1..18: mol_type = other DNA
taatactaagcactatag

SEQ ID NO: 6828 - DNA, 18 bp, synthetic construct
  source 1..18: mol_type = other DNA
taataggactaaccatag

SEQ ID NO: 6829 - DNA, 18 bp, synthetic construct
  source 1..18: mol_type = other DNA
taataggactccatatag

SEQ ID NO: 6830 - DNA, 18 bp, synthetic construct
  source 1..18: mol_type = other DNA
taatatgactgaccatag

SEQ ID NO: 6831 - DNA, 18 bp, synthetic construct
  source 1..18: mol_type = other DNA
taatccgacaccctatag

SEQ ID NO: 6832 - DNA, 18 bp, synthetic construct
  source 1..18: mol_type = other DNA
taatccgactccctctag

SEQ ID NO: 6833 - DNA, 18 bp, synthetic construct
  source 1..18: mol_type = other DNA
taatccggctcaatatag

SEQ ID NO: 6834 - DNA, 18 bp, synthetic construct
  source 1..18: mol_type = other DNA
taatcctactcactatcg

SEQ ID NO: 6835 - DNA, 18 bp, synthetic construct
  source 1..18: mol_type = other DNA
taatcggactcattatag

SEQ ID NO: 6836 - DNA, 18 bp, synthetic construct
  source 1..18: mol_type = other DNA
taatgagactcactgtag

SEQ ID NO: 6837 - DNA, 18 bp, synthetic construct
  source 1..18: mol_type = other DNA
taatgaggctcactatag

SEQ ID NO: 6838 - DNA, 18 bp, synthetic construct
  source 1..18: mol_type = other DNA
taatgcgactggctatag

SEQ ID NO: 6839 - DNA, 18 bp, synthetic construct
  source 1..18: mol_type = other DNA
taatgtgactcactgtag

SEQ ID NO: 6840 - DNA, 18 bp, synthetic construct
  source 1..18: mol_type = other DNA
taattcgagtcactagag

SEQ ID NO: 6841 - DNA, 18 bp, synthetic construct
  source 1..18: mol_type = other DNA
tactacgactgacaatag

SEQ ID NO: 6842 - DNA, 18 bp, synthetic construct
  source 1..18: mol_type = other DNA
tagcactactcactatag

SEQ ID NO: 6843 - DNA, 18 bp, synthetic construct
  source 1..18: mol_type = other DNA
taggacgattcactatag

SEQ ID NO: 6844 - DNA, 18 bp, synthetic construct
  source 1..18: mol_type = other DNA
tagtacgacccattatag

SEQ ID NO: 6845 - DNA, 18 bp, synthetic construct
  source 1..18: mol_type = other DNA
tagtacgactcactagtg

SEQ ID NO: 6846 - DNA, 18 bp, synthetic construct
  source 1..18: mol_type = other DNA
tagtacggctcactttag

SEQ ID NO: 6847 - DNA, 18 bp, synthetic construct
  source 1..18: mol_type = other DNA
tagtacgtctcgctatag

SEQ ID NO: 6848 - DNA, 18 bp, synthetic construct
  source 1..18: mol_type = other DNA
tagtcagactcactatag

SEQ ID NO: 6849 - DNA, 18 bp, synthetic construct
  source 1..18: mol_type = other DNA
tatcacgacccactatag

SEQ ID NO: 6850 - DNA, 18 bp, synthetic construct
  source 1..18: mol_type = other DNA
tatgacgactcacaatag

SEQ ID NO: 6851 - DNA, 18 bp, synthetic construct
  source 1..18: mol_type = other DNA
tattacgacttacgatag

SEQ ID NO: 6852 - DNA, 18 bp, synthetic construct
  source 1..18: mol_type = other DNA
tcataagactcactacag

SEQ ID NO: 6853 - DNA, 18 bp, synthetic construct
  source 1..18: mol_type = other DNA
tcatacaactccctatag

SEQ ID NO: 6854 - DNA, 18 bp, synthetic construct
  source 1..18: mol_type = other DNA
tcatacgactctgtatag

SEQ ID NO: 6855 - DNA, 18 bp, synthetic construct
  source 1..18: mol_type = other DNA
tcatacgcctcactgtag

SEQ ID NO: 6856 - DNA, 18 bp, synthetic construct
  source 1..18: mol_type = other DNA
tcatacgtcgcactatag

SEQ ID NO: 6857 - DNA, 18 bp, synthetic construct
  source 1..18: mol_type = other DNA
tcgtacgactgactatag

SEQ ID NO: 6858 - DNA, 18 bp, synthetic construct
  source 1..18: mol_type = other DNA
tgataccactcaatatag

SEQ ID NO: 6859 - DNA, 18 bp, synthetic construct
  source 1..18: mol_type = other DNA
ttacacgactgactatag

SEQ ID NO: 6860 - DNA, 18 bp, synthetic construct
  source 1..18: mol_type = other DNA
atatacgactcacaatag

SEQ ID NO: 6861 - DNA, 18 bp, synthetic construct
  source 1..18: mol_type = other DNA
taatacaactctctattg

SEQ ID NO: 6862 - DNA, 18 bp, synthetic construct
  source 1..18: mol_type = other DNA
tattacgactcacattag

SEQ ID NO: 6863 - DNA, 18 bp, synthetic construct
  source 1..18: mol_type = other DNA
tgttacgactcacaatag

SEQ ID NO: 6864 - DNA, 18 bp, synthetic construct
  source 1..18: mol_type = other DNA
ttataatactcactatag

SEQ ID NO: 6865 - DNA, 18 bp, synthetic construct
  source 1..18: mol_type = other DNA
tataacgattcactatag

SEQ ID NO: 6866 - DNA, 18 bp, synthetic construct
  source 1..18: mol_type = other DNA
taatacgtatcactacag

SEQ ID NO: 6867 - DNA, 18 bp, synthetic construct
  source 1..18: mol_type = other DNA
taatacgacaaactattg

SEQ ID NO: 6868 - DNA, 18 bp, synthetic construct
  source 1..18: mol_type = other DNA
taatacgtcacaatatag

SEQ ID NO: 6869 - DNA, 18 bp, synthetic construct
  source 1..18: mol_type = other DNA
taatacgactctgtattg

SEQ ID NO: 6870 - DNA, 18 bp, synthetic construct
  source 1..18: mol_type = other DNA
taatacgattcattctag

SEQ ID NO: 6871 - DNA, 18 bp, synthetic construct
  source 1..18: mol_type = other DNA
caatacgtctcactaaag

SEQ ID NO: 6872 - DNA, 18 bp, synthetic construct
  source 1..18: mol_type = other DNA
taatacgtctaactaaag

SEQ ID NO: 6873 - DNA, 18 bp, synthetic construct
  source 1..18: mol_type = other DNA
aaattctactcactatag

SEQ ID NO: 6874 - DNA, 18 bp, synthetic construct
  source 1..18: mol_type = other DNA
aaacacgactcattatag

SEQ ID NO: 6875 - DNA, 18 bp, synthetic construct
  source 1..18: mol_type = other DNA
taatacatctcactatgg

SEQ ID NO: 6876 - DNA, 18 bp, synthetic construct
  source 1..18: mol_type = other DNA
taatacgactcattgaag

SEQ ID NO: 6877 - DNA, 18 bp, synthetic construct
  source 1..18: mol_type = other DNA
taatacgagttactaaag

SEQ ID NO: 6878 - DNA, 18 bp, synthetic construct
  source 1..18: mol_type = other DNA
taatgctattcactatag

SEQ ID NO: 6879 - DNA, 18 bp, synthetic construct
  source 1..18: mol_type = other DNA
tattacgacccacaatag

SEQ ID NO: 6880 - DNA, 18 bp, synthetic construct
  source 1..18: mol_type = other DNA
tattacggctcaatatag

SEQ ID NO: 6881 - DNA, 18 bp, synthetic construct
  source 1..18: mol_type = other DNA
taattagactctctatag

SEQ ID NO: 6882 - DNA, 18 bp, synthetic construct
  source 1..18: mol_type = other DNA
taattcaactcactatcg

SEQ ID NO: 6883 - DNA, 18 bp, synthetic construct
  source 1..18: mol_type = other DNA
taaaacgactgactaaag

SEQ ID NO: 6884 - DNA, 18 bp, synthetic construct
  source 1..18: mol_type = other DNA
taaaacgagtcattatag

SEQ ID NO: 6885 - DNA, 18 bp, synthetic construct
  source 1..18: mol_type = other DNA
taaaactactcgctatag

SEQ ID NO: 6886 - DNA, 18 bp, synthetic construct
  source 1..18: mol_type = other DNA
taatacaacccactattg

SEQ ID NO: 6887 - DNA, 18 bp, synthetic construct
  source 1..18: mol_type = other DNA
taatacgacacattacag

SEQ ID NO: 6888 - DNA, 18 bp, synthetic construct
  source 1..18: mol_type = other DNA
taatacgtctcagcatag

SEQ ID NO: 6889 - DNA, 18 bp, synthetic construct
  source 1..18: mol_type = other DNA
taatactactaacgatag

SEQ ID NO: 6890 - DNA, 18 bp, synthetic construct
  source 1..18: mol_type = other DNA
taatactatttactatag

SEQ ID NO: 6891 - DNA, 18 bp, synthetic construct
  source 1..18: mol_type = other DNA
taatctgactctctatag

SEQ ID NO: 6892 - DNA, 18 bp, synthetic construct
  source 1..18: mol_type = other DNA
taatgctactcactttag

SEQ ID NO: 6893 - DNA, 18 bp, synthetic construct
  source 1..18: mol_type = other DNA
tagaacgactcactttag

SEQ ID NO: 6894 - DNA, 18 bp, synthetic construct
  source 1..18: mol_type = other DNA
tattaccactcactatgg

SEQ ID NO: 6895 - DNA, 18 bp, synthetic construct
  source 1..18: mol_type = other DNA
taatacgactcccattag

SEQ ID NO: 6896 - DNA, 18 bp, synthetic construct
  source 1..18: mol_type = other DNA
taattcgacacactaaag

SEQ ID NO: 6897 - DNA, 18 bp, synthetic construct
  source 1..18: mol_type = other DNA
taatacgaatccctattg

SEQ ID NO: 6898 - DNA, 18 bp, synthetic construct
  source 1..18: mol_type = other DNA
taatacgactcatcttag

SEQ ID NO: 6899 - DNA, 18 bp, synthetic construct
  source 1..18: mol_type = other DNA
tattactactccctatag

SEQ ID NO: 6900 - DNA, 18 bp, synthetic construct
  source 1..18: mol_type = other DNA
ttatacgactccctattg

SEQ ID NO: 6901 - DNA, 18 bp, synthetic construct
  source 1..18: mol_type = other DNA
taatacgtctaactattg

SEQ ID NO: 6902 - DNA, 18 bp, synthetic construct
  source 1..18: mol_type = other DNA
ttttacgactaactatag

SEQ ID NO: 6903 - DNA, 18 bp, synthetic construct
  source 1..18: mol_type = other DNA
ttatacgactcacaaaag

SEQ ID NO: 6904 - DNA, 18 bp, synthetic construct
  source 1..18: mol_type = other DNA
caaaacgactcactaaag

SEQ ID NO: 6905 - DNA, 18 bp, synthetic construct
  source 1..18: mol_type = other DNA
taataagaatcacaatag

SEQ ID NO: 6906 - DNA, 18 bp, synthetic construct
  source 1..18: mol_type = other DNA
taataagactcaatttag

SEQ ID NO: 6907 - DNA, 18 bp, synthetic construct
  source 1..18: mol_type = other DNA
taatacgtctcacaatgg

SEQ ID NO: 6908 - DNA, 18 bp, synthetic construct
  source 1..18: mol_type = other DNA
taataagtctcactaaag

SEQ ID NO: 6909 - DNA, 18 bp, synthetic construct
  source 1..18: mol_type = other DNA
aaatacgagtcactattg

SEQ ID NO: 6910 - DNA, 18 bp, synthetic construct
  source 1..18: mol_type = other DNA
aaatacgtctcactatgg

SEQ ID NO: 6911 - DNA, 18 bp, synthetic construct
  source 1..18: mol_type = other DNA
taaaaggactctctatag

SEQ ID NO: 6912 - DNA, 18 bp, synthetic construct
  source 1..18: mol_type = other DNA
taacactactcaatatag

SEQ ID NO: 6913 - DNA, 18 bp, synthetic construct
  source 1..18: mol_type = other DNA
taataccactaacaatag

SEQ ID NO: 6914 - DNA, 18 bp, synthetic construct
  source 1..18: mol_type = other DNA
taataggactcaataaag

SEQ ID NO: 6915 - DNA, 18 bp, synthetic construct
  source 1..18: mol_type = other DNA
taattctactcgctatag

SEQ ID NO: 6916 - DNA, 18 bp, synthetic construct
  source 1..18: mol_type = other DNA
taatttgactcacgatag

SEQ ID NO: 6917 - DNA, 18 bp, synthetic construct
  source 1..18: mol_type = other DNA
tactactactcaccatag

SEQ ID NO: 6918 - DNA, 18 bp, synthetic construct
  source 1..18: mol_type = other DNA
tattacgactcagtaaag

SEQ ID NO: 6919 - DNA, 18 bp, synthetic construct
  source 1..18: mol_type = other DNA
tgatacaactctctatag

SEQ ID NO: 6920 - DNA, 18 bp, synthetic construct
  source 1..18: mol_type = other DNA
ttatacgtgtcactatag

SEQ ID NO: 6921 - DNA, 18 bp, synthetic construct
  source 1..18: mol_type = other DNA
aaatacgaatcactatcg

SEQ ID NO: 6922 - DNA, 18 bp, synthetic construct
  source 1..18: mol_type = other DNA
aaatacgacttagtatag

SEQ ID NO: 6923 - DNA, 18 bp, synthetic construct
  source 1..18: mol_type = other DNA
aaatacgattcactacag

SEQ ID NO: 6924 - DNA, 18 bp, synthetic construct
  source 1..18: mol_type = other DNA
caatccgtctcactatag

SEQ ID NO: 6925 - DNA, 18 bp, synthetic construct
  source 1..18: mol_type = other DNA
taacacgagacactatag

SEQ ID NO: 6926 - DNA, 18 bp, synthetic construct
  source 1..18: mol_type = other DNA
taacacgattccctatag

SEQ ID NO: 6927 - DNA, 18 bp, synthetic construct
  source 1..18: mol_type = other DNA
taataagactcactgcag

SEQ ID NO: 6928 - DNA, 18 bp, synthetic construct
  source 1..18: mol_type = other DNA
taataagagtctctatag

SEQ ID NO: 6929 - DNA, 18 bp, synthetic construct
  source 1..18: mol_type = other DNA
taataagagttactatag

SEQ ID NO: 6930 - DNA, 18 bp, synthetic construct
  source 1..18: mol_type = other DNA
taatacaccttactatag

SEQ ID NO: 6931 - DNA, 18 bp, synthetic construct
  source 1..18: mol_type = other DNA
taatacacttcactatag

SEQ ID NO: 6932 - DNA, 18 bp, synthetic construct
  source 1..18: mol_type = other DNA
taatacgaataaatatag

SEQ ID NO: 6933 - DNA, 18 bp, synthetic construct
  source 1..18: mol_type = other DNA
taatacgcctcactctcg

SEQ ID NO: 6934 - DNA, 18 bp, synthetic construct
  source 1..18: mol_type = other DNA
taatcccactctctatag

SEQ ID NO: 6935 - DNA, 18 bp, synthetic construct
  source 1..18: mol_type = other DNA
taatccgactcactgaag

SEQ ID NO: 6936 - DNA, 18 bp, synthetic construct
  source 1..18: mol_type = other DNA
taatccgactcagtttag

SEQ ID NO: 6937 - DNA, 18 bp, synthetic construct
  source 1..18: mol_type = other DNA
taatgagactaactatag

SEQ ID NO: 6938 - DNA, 18 bp, synthetic construct
  source 1..18: mol_type = other DNA
taatgagacttactatag

SEQ ID NO: 6939 - DNA, 18 bp, synthetic construct
  source 1..18: mol_type = other DNA
taattacactcactatag

SEQ ID NO: 6940 - DNA, 18 bp, synthetic construct
  source 1..18: mol_type = other DNA
tactactactcaatatag

SEQ ID NO: 6941 - DNA, 18 bp, synthetic construct
  source 1..18: mol_type = other DNA
tagtacgtctcagtatag

SEQ ID NO: 6942 - DNA, 18 bp, synthetic construct
  source 1..18: mol_type = other DNA
tattacgagtcactctag

SEQ ID NO: 6943 - DNA, 18 bp, synthetic construct
  source 1..18: mol_type = other DNA
tcatacgactcgctttag

SEQ ID NO: 6944 - DNA, 18 bp, synthetic construct
  source 1..18: mol_type = other DNA
ttacacgactcgctatag

SEQ ID NO: 6945 - DNA, 18 bp, synthetic construct
  source 1..18: mol_type = other DNA
taaaacgtctcaatatag

SEQ ID NO: 6946 - DNA, 18 bp, synthetic construct
  source 1..18: mol_type = other DNA
taatactcctcactattg

SEQ ID NO: 6947 - DNA, 18 bp, synthetic construct
  source 1..18: mol_type = other DNA
taatacgtcttaatatag

SEQ ID NO: 6948 - DNA, 18 bp, synthetic construct
  source 1..18: mol_type = other DNA
taataggacttactttag

SEQ ID NO: 6949 - DNA, 18 bp, synthetic construct
  source 1..18: mol_type = other DNA
aaatacgattcactgtag

SEQ ID NO: 6950 - DNA, 18 bp, synthetic construct
  source 1..18: mol_type = other DNA
caatacgactctttatag

SEQ ID NO: 6951 - DNA, 18 bp, synthetic construct
  source 1..18: mol_type = other DNA
caatactacacactatag

SEQ ID NO: 6952 - DNA, 18 bp, synthetic construct
  source 1..18: mol_type = other DNA
ccatacgactcactattg

SEQ ID NO: 6953 - DNA, 18 bp, synthetic construct
  source 1..18: mol_type = other DNA
taaaacgactctctatgg

SEQ ID NO: 6954 - DNA, 18 bp, synthetic construct
  source 1..18: mol_type = other DNA
taaaacgatccactatag

SEQ ID NO: 6955 - DNA, 18 bp, synthetic construct
  source 1..18: mol_type = other DNA
taaaccgacccactatag

SEQ ID NO: 6956 - DNA, 18 bp, synthetic construct
  source 1..18: mol_type = other DNA
taaaccgactcactttag

SEQ ID NO: 6957 - DNA, 18 bp, synthetic construct
  source 1..18: mol_type = other DNA
taagacgactcacaattg

SEQ ID NO: 6958 - DNA, 18 bp, synthetic construct
  source 1..18: mol_type = other DNA
taatacaaatcactgtag

SEQ ID NO: 6959 - DNA, 18 bp, synthetic construct
  source 1..18: mol_type = other DNA
taatacgacacactagcg

SEQ ID NO: 6960 - DNA, 18 bp, synthetic construct
  source 1..18: mol_type = other DNA
taatacgacacattgtag

SEQ ID NO: 6961 - DNA, 18 bp, synthetic construct
  source 1..18: mol_type = other DNA
taatacgacaccttatag

SEQ ID NO: 6962 - DNA, 18 bp, synthetic construct
  source 1..18: mol_type = other DNA
taatacgactatctatcg

SEQ ID NO: 6963 - DNA, 18 bp, synthetic construct
  source 1..18: mol_type = other DNA
taatacgagacactacag

SEQ ID NO: 6964 - DNA, 18 bp, synthetic construct
  source 1..18: mol_type = other DNA
tagtacgatacactatag

SEQ ID NO: 6965 - DNA, 18 bp, synthetic construct
  source 1..18: mol_type = other DNA
tattcccactcactatag

SEQ ID NO: 6966 - DNA, 18 bp, synthetic construct
  source 1..18: mol_type = other DNA
tcaaacgactcactgtag

SEQ ID NO: 6967 - DNA, 18 bp, synthetic construct
  source 1..18: mol_type = other DNA
taatacatatcactatag

SEQ ID NO: 6968 - DNA, 18 bp, synthetic construct
  source 1..18: mol_type = other DNA
taacacgtctcactttag

SEQ ID NO: 6969 - DNA, 18 bp, synthetic construct
  source 1..18: mol_type = other DNA
taataccactcacaaaag

SEQ ID NO: 6970 - DNA, 18 bp, synthetic construct
  source 1..18: mol_type = other DNA
taatacgactctaaatag

SEQ ID NO: 6971 - DNA, 18 bp, synthetic construct
  source 1..18: mol_type = other DNA
aaatacgcctcactttag

SEQ ID NO: 6972 - DNA, 18 bp, synthetic construct
  source 1..18: mol_type = other DNA
taataagacaaactatag

SEQ ID NO: 6973 - DNA, 18 bp, synthetic construct
  source 1..18: mol_type = other DNA
taatactactcattatcg

SEQ ID NO: 6974 - DNA, 18 bp, synthetic construct
  source 1..18: mol_type = other DNA
taataggactttctatag

SEQ ID NO: 6975 - DNA, 18 bp, synthetic construct
  source 1..18: mol_type = other DNA
taatgctactcactaaag

SEQ ID NO: 6976 - DNA, 18 bp, synthetic construct
  source 1..18: mol_type = other DNA
tattacgactcacgattg

SEQ ID NO: 6977 - DNA, 18 bp, synthetic construct
  source 1..18: mol_type = other DNA
ttacacgactcattatag

SEQ ID NO: 6978 - DNA, 18 bp, synthetic construct
  source 1..18: mol_type = other DNA
ttataggactcaatatag

SEQ ID NO: 6979 - DNA, 18 bp, synthetic construct
  source 1..18: mol_type = other DNA
tgatactactcactattg

SEQ ID NO: 6980 - DNA, 18 bp, synthetic construct
  source 1..18: mol_type = other DNA
tattacgattcactaaag

SEQ ID NO: 6981 - DNA, 18 bp, synthetic construct
  source 1..18: mol_type = other DNA
taatactactcactttcg

SEQ ID NO: 6982 - DNA, 18 bp, synthetic construct
  source 1..18: mol_type = other DNA
aaatacgactctccatag

SEQ ID NO: 6983 - DNA, 18 bp, synthetic construct
  source 1..18: mol_type = other DNA
taaaaggactcacaatag

SEQ ID NO: 6984 - DNA, 18 bp, synthetic construct
  source 1..18: mol_type = other DNA
taatacggctcacattag

SEQ ID NO: 6985 - DNA, 18 bp, synthetic construct
  source 1..18: mol_type = other DNA
tgattcgactcactaaag

SEQ ID NO: 6986 - DNA, 18 bp, synthetic construct
  source 1..18: mol_type = other DNA
taatacgacttaatttag

SEQ ID NO: 6987 - DNA, 18 bp, synthetic construct
  source 1..18: mol_type = other DNA
taatacgattctccatag

SEQ ID NO: 6988 - DNA, 18 bp, synthetic construct
  source 1..18: mol_type = other DNA
taattcgaatccctatag

SEQ ID NO: 6989 - DNA, 18 bp, synthetic construct
  source 1..18: mol_type = other DNA
tactacgtcacactatag

SEQ ID NO: 6990 - DNA, 18 bp, synthetic construct
  source 1..18: mol_type = other DNA
ttacacgactctctatag

SEQ ID NO: 6991 - DNA, 18 bp, synthetic construct
  source 1..18: mol_type = other DNA
caataggactctctatag

SEQ ID NO: 6992 - DNA, 18 bp, synthetic construct
  source 1..18: mol_type = other DNA
gtattcgactcactatag

SEQ ID NO: 6993 - DNA, 18 bp, synthetic construct
  source 1..18: mol_type = other DNA
taaaacgcttcactatag

SEQ ID NO: 6994 - DNA, 18 bp, synthetic construct
  source 1..18: mol_type = other DNA
taatacgacacactgtgg

SEQ ID NO: 6995 - DNA, 18 bp, synthetic construct
  source 1..18: mol_type = other DNA
taatacgatttactatgg

SEQ ID NO: 6996 - DNA, 18 bp, synthetic construct
  source 1..18: mol_type = other DNA
taatactccacactatag

SEQ ID NO: 6997 - DNA, 18 bp, synthetic construct
  source 1..18: mol_type = other DNA
taatccgactgtctatag

SEQ ID NO: 6998 - DNA, 18 bp, synthetic construct
  source 1..18: mol_type = other DNA
tagtacgactctctacag

SEQ ID NO: 6999 - DNA, 18 bp, synthetic construct
  source 1..18: mol_type = other DNA
tagttcgactaactatag

SEQ ID NO: 7000 - DNA, 18 bp, synthetic construct
  source 1..18: mol_type = other DNA
tcatactactgactatag

SEQ ID NO: 7001 - DNA, 18 bp, synthetic construct
  source 1..18: mol_type = other DNA
tgatacgactcgcaatag

SEQ ID NO: 7002 - DNA, 18 bp, synthetic construct
  source 1..18: mol_type = other DNA
ttgtaggactcactatag

SEQ ID NO: 7003 - DNA, 18 bp, synthetic construct
  source 1..18: mol_type = other DNA
aaatacggctctctatag

SEQ ID NO: 7004 - DNA, 18 bp, synthetic construct
  source 1..18: mol_type = other DNA
taaaatgagtcactatag

SEQ ID NO: 7005 - DNA, 18 bp, synthetic construct
  source 1..18: mol_type = other DNA
taatacgactcatcaaag

SEQ ID NO: 7006 - DNA, 18 bp, synthetic construct
  source 1..18: mol_type = other DNA
taatacgactgacaattg

SEQ ID NO: 7007 - DNA, 18 bp, synthetic construct
  source 1..18: mol_type = other DNA
taatatgactctgtatag

SEQ ID NO: 7008 - DNA, 18 bp, synthetic construct
  source 1..18: mol_type = other DNA
tgatacgaatcactaaag

SEQ ID NO: 7009 - DNA, 18 bp, synthetic construct
  source 1..18: mol_type = other DNA
tgttacgactcactatgg

SEQ ID NO: 7010 - DNA, 18 bp, synthetic construct
  source 1..18: mol_type = other DNA
aaatacgacgcattatag

SEQ ID NO: 7011 - DNA, 18 bp, synthetic construct
  source 1..18: mol_type = other DNA
aaatacgactcacaagag

SEQ ID NO: 7012 - DNA, 18 bp, synthetic construct
  source 1..18: mol_type = other DNA
aaatatgactcactatgg

SEQ ID NO: 7013 - DNA, 18 bp, synthetic construct
  source 1..18: mol_type = other DNA
caatacgagccactatag

SEQ ID NO: 7014 - DNA, 18 bp, synthetic construct
  source 1..18: mol_type = other DNA
gaatacgtctcactattg

SEQ ID NO: 7015 - DNA, 18 bp, synthetic construct
  source 1..18: mol_type = other DNA
taaaactacgcactatag

SEQ ID NO: 7016 - DNA, 18 bp, synthetic construct
  source 1..18: mol_type = other DNA
taaaaggactccctatag

SEQ ID NO: 7017 - DNA, 18 bp, synthetic construct
  source 1..18: mol_type = other DNA
taacacggctctctatag

SEQ ID NO: 7018 - DNA, 18 bp, synthetic construct
  source 1..18: mol_type = other DNA
taagacgactcacttaag

SEQ ID NO: 7019 - DNA, 18 bp, synthetic construct
  source 1..18: mol_type = other DNA
taatacaactacctatag

SEQ ID NO: 7020 - DNA, 18 bp, synthetic construct
  source 1..18: mol_type = other DNA
taataccacacacgatag

SEQ ID NO: 7021 - DNA, 18 bp, synthetic construct
  source 1..18: mol_type = other DNA
taatacgaaccaatatag

SEQ ID NO: 7022 - DNA, 18 bp, synthetic construct
  source 1..18: mol_type = other DNA
taatacgacaaagtatag

SEQ ID NO: 7023 - DNA, 18 bp, synthetic construct
  source 1..18: mol_type = other DNA
taatacgacctactacag

SEQ ID NO: 7024 - DNA, 18 bp, synthetic construct
  source 1..18: mol_type = other DNA
taatacgactccttttag

SEQ ID NO: 7025 - DNA, 18 bp, synthetic construct
  source 1..18: mol_type = other DNA
taatacgactcgctctcg

SEQ ID NO: 7026 - DNA, 18 bp, synthetic construct
  source 1..18: mol_type = other DNA
taatacgcctcgctttag

SEQ ID NO: 7027 - DNA, 18 bp, synthetic construct
  source 1..18: mol_type = other DNA
taatactacttactacag

SEQ ID NO: 7028 - DNA, 18 bp, synthetic construct
  source 1..18: mol_type = other DNA
taatactcctcattatag

SEQ ID NO: 7029 - DNA, 18 bp, synthetic construct
  source 1..18: mol_type = other DNA
taatacttcgcactatag

SEQ ID NO: 7030 - DNA, 18 bp, synthetic construct
  source 1..18: mol_type = other DNA
taatatgaatcactatgg

SEQ ID NO: 7031 - DNA, 18 bp, synthetic construct
  source 1..18: mol_type = other DNA
taatatgattcactgtag

SEQ ID NO: 7032 - DNA, 18 bp, synthetic construct
  source 1..18: mol_type = other DNA
taatgcaacttactatag

SEQ ID NO: 7033 - DNA, 18 bp, synthetic construct
  source 1..18: mol_type = other DNA
taatgcgactccctttag

SEQ ID NO: 7034 - DNA, 18 bp, synthetic construct
  source 1..18: mol_type = other DNA
taatgctactcaatatag

SEQ ID NO: 7035 - DNA, 18 bp, synthetic construct
  source 1..18: mol_type = other DNA
taatgggactcacaatag

SEQ ID NO: 7036 - DNA, 18 bp, synthetic construct
  source 1..18: mol_type = other DNA
taattcgactcgttatag

SEQ ID NO: 7037 - DNA, 18 bp, synthetic construct
  source 1..18: mol_type = other DNA
tactacaactcactatgg

SEQ ID NO: 7038 - DNA, 18 bp, synthetic construct
  source 1..18: mol_type = other DNA
tagcacgacccactatag

SEQ ID NO: 7039 - DNA, 18 bp, synthetic construct
  source 1..18: mol_type = other DNA
tagtacgattcactatgg

SEQ ID NO: 7040 - DNA, 18 bp, synthetic construct
  source 1..18: mol_type = other DNA
tagtacgtcccactatag

SEQ ID NO: 7041 - DNA, 18 bp, synthetic construct
  source 1..18: mol_type = other DNA
tattacgactccgtatag

SEQ ID NO: 7042 - DNA, 18 bp, synthetic construct
  source 1..18: mol_type = other DNA
tattaggactaactatag

SEQ ID NO: 7043 - DNA, 18 bp, synthetic construct
  source 1..18: mol_type = other DNA
tattccgactcagtatag

SEQ ID NO: 7044 - DNA, 18 bp, synthetic construct
  source 1..18: mol_type = other DNA
tattcggactcactatag

SEQ ID NO: 7045 - DNA, 18 bp, synthetic construct
  source 1..18: mol_type = other DNA
aactacgactcactatgg

SEQ ID NO: 7046 - DNA, 18 bp, synthetic construct
  source 1..18: mol_type = other DNA
aactacgactgactatag

SEQ ID NO: 7047 - DNA, 18 bp, synthetic construct
  source 1..18: mol_type = other DNA
aactacgcctcactatag

SEQ ID NO: 7048 - DNA, 18 bp, synthetic construct
  source 1..18: mol_type = other DNA
acatacgacccactatag

SEQ ID NO: 7049 - DNA, 18 bp, synthetic construct
  source 1..18: mol_type = other DNA
caataagactcactatcg

SEQ ID NO: 7050 - DNA, 18 bp, synthetic construct
  source 1..18: mol_type = other DNA
caatacgcctcactatgg

SEQ ID NO: 7051 - DNA, 18 bp, synthetic construct
  source 1..18: mol_type = other DNA
caatacggctaactatag

SEQ ID NO: 7052 - DNA, 18 bp, synthetic construct
  source 1..18: mol_type = other DNA
cgacacgactcactatag

SEQ ID NO: 7053 - DNA, 18 bp, synthetic construct
  source 1..18: mol_type = other DNA
gaacacgtctcactatag

SEQ ID NO: 7054 - DNA, 18 bp, synthetic construct
  source 1..18: mol_type = other DNA
gaatacaactcactctag

SEQ ID NO: 7055 - DNA, 18 bp, synthetic construct
  source 1..18: mol_type = other DNA
gaatacgaatcactaaag

SEQ ID NO: 7056 - DNA, 18 bp, synthetic construct
  source 1..18: mol_type = other DNA
gaatacgacaccctatag

SEQ ID NO: 7057 - DNA, 18 bp, synthetic construct
  source 1..18: mol_type = other DNA
gaatacgactcaatattg

SEQ ID NO: 7058 - DNA, 18 bp, synthetic construct
  source 1..18: mol_type = other DNA
gaatacgactcattaaag

SEQ ID NO: 7059 - DNA, 18 bp, synthetic construct
  source 1..18: mol_type = other DNA
gaatacgatccactatag

SEQ ID NO: 7060 - DNA, 18 bp, synthetic construct
  source 1..18: mol_type = other DNA
gaatacgatttactatag

SEQ ID NO: 7061 - DNA, 18 bp, synthetic construct
  source 1..18: mol_type = other DNA
gaatacgccccactatag

SEQ ID NO: 7062 - DNA, 18 bp, synthetic construct
  source 1..18: mol_type = other DNA
taaaacaactcacgatag

SEQ ID NO: 7063 - DNA, 18 bp, synthetic construct
  source 1..18: mol_type = other DNA
taaaacgactcgctgtag

SEQ ID NO: 7064 - DNA, 18 bp, synthetic construct
  source 1..18: mol_type = other DNA
taaaacgagtaactatag

SEQ ID NO: 7065 - DNA, 18 bp, synthetic construct
  source 1..18: mol_type = other DNA
taaaacgcctgactatag

SEQ ID NO: 7066 - DNA, 18 bp, synthetic construct
  source 1..18: mol_type = other DNA
taacaccactcactattg

SEQ ID NO: 7067 - DNA, 18 bp, synthetic construct
  source 1..18: mol_type = other DNA
taacacgacccaatatag

SEQ ID NO: 7068 - DNA, 18 bp, synthetic construct
  source 1..18: mol_type = other DNA
taacacgactcacttgag

SEQ ID NO: 7069 - DNA, 18 bp, synthetic construct
  source 1..18: mol_type = other DNA
taacacgactgactatcg

SEQ ID NO: 7070 - DNA, 18 bp, synthetic construct
  source 1..18: mol_type = other DNA
taacacgacttaatatag

SEQ ID NO: 7071 - DNA, 18 bp, synthetic construct
  source 1..18: mol_type = other DNA
taagactaatcactatag

SEQ ID NO: 7072 - DNA, 18 bp, synthetic construct
  source 1..18: mol_type = other DNA
taagatgtctcactatag

SEQ ID NO: 7073 - DNA, 18 bp, synthetic construct
  source 1..18: mol_type = other DNA
taaggcgactcaatatag

SEQ ID NO: 7074 - DNA, 18 bp, synthetic construct
  source 1..18: mol_type = other DNA
taataaaactcacgatag

SEQ ID NO: 7075 - DNA, 18 bp, synthetic construct
  source 1..18: mol_type = other DNA
taataacactcgctatag

SEQ ID NO: 7076 - DNA, 18 bp, synthetic construct
  source 1..18: mol_type = other DNA
taataagacttactagag

SEQ ID NO: 7077 - DNA, 18 bp, synthetic construct
  source 1..18: mol_type = other DNA
taatacaactcactttaa

SEQ ID NO: 7078 - DNA, 18 bp, synthetic construct
  source 1..18: mol_type = other DNA
taatacaactgactgtag

SEQ ID NO: 7079 - DNA, 18 bp, synthetic construct
  source 1..18: mol_type = other DNA
taatacagctcactctag

SEQ ID NO: 7080 - DNA, 18 bp, synthetic construct
  source 1..18: mol_type = other DNA
taataccactccatatag

SEQ ID NO: 7081 - DNA, 18 bp, synthetic construct
  source 1..18: mol_type = other DNA
taataccactcgctatgg

SEQ ID NO: 7082 - DNA, 18 bp, synthetic construct
  source 1..18: mol_type = other DNA
taatacgaatcaccgtag

SEQ ID NO: 7083 - DNA, 18 bp, synthetic construct
  source 1..18: mol_type = other DNA
taatacgaccctctatgg

SEQ ID NO: 7084 - DNA, 18 bp, synthetic construct
  source 1..18: mol_type = other DNA
taatacgacgctctatcg

SEQ ID NO: 7085 - DNA, 18 bp, synthetic construct
  source 1..18: mol_type = other DNA
taatacgactaaatatcg

SEQ ID NO: 7086 - DNA, 18 bp, synthetic construct
  source 1..18: mol_type = other DNA
taatacgactaatgatag

SEQ ID NO: 7087 - DNA, 18 bp, synthetic construct
  source 1..18: mol_type = other DNA
taatacgactcaagttag

SEQ ID NO: 7088 - DNA, 18 bp, synthetic construct
  source 1..18: mol_type = other DNA
taatacgactcactggaa

SEQ ID NO: 7089 - DNA, 18 bp, synthetic construct
  source 1..18: mol_type = other DNA
taatacgactccatctag

SEQ ID NO: 7090 - DNA, 18 bp, synthetic construct
  source 1..18: mol_type = other DNA
taatacgactccccacag

SEQ ID NO: 7091 - DNA, 18 bp, synthetic construct
  source 1..18: mol_type = other DNA
taatacgactgcctatgg

SEQ ID NO: 7092 - DNA, 18 bp, synthetic construct
  source 1..18: mol_type = other DNA
taatacgacttactcgag

SEQ ID NO: 7093 - DNA, 18 bp, synthetic construct
  source 1..18: mol_type = other DNA
taatacgagtaactctag

SEQ ID NO: 7094 - DNA, 18 bp, synthetic construct
  source 1..18: mol_type = other DNA
taatacgagtccctaaag

SEQ ID NO: 7095 - DNA, 18 bp, synthetic construct
  source 1..18: mol_type = other DNA
taatacgatccgctatag

SEQ ID NO: 7096 - DNA, 18 bp, synthetic construct
  source 1..18: mol_type = other DNA
taatacgattgactacag

SEQ ID NO: 7097 - DNA, 18 bp, synthetic construct
  source 1..18: mol_type = other DNA
taatacgccgcactctag

SEQ ID NO: 7098 - DNA, 18 bp, synthetic construct
  source 1..18: mol_type = other DNA
taatacgcttgactatag

SEQ ID NO: 7099 - DNA, 18 bp, synthetic construct
  source 1..18: mol_type = other DNA
taatacggcttcctatag

SEQ ID NO: 7100 - DNA, 18 bp, synthetic construct
  source 1..18: mol_type = other DNA
taatacgtcgcgctatag

SEQ ID NO: 7101 - DNA, 18 bp, synthetic construct
  source 1..18: mol_type = other DNA
taatagtactcactgtag

SEQ ID NO: 7102 - DNA, 18 bp, synthetic construct
  source 1..18: mol_type = other DNA
taatccgactcaatatgg

SEQ ID NO: 7103 - DNA, 18 bp, synthetic construct
  source 1..18: mol_type = other DNA
taatccgactcaccaaag

SEQ ID NO: 7104 - DNA, 18 bp, synthetic construct
  source 1..18: mol_type = other DNA
taatccgactcactgtgg

SEQ ID NO: 7105 - DNA, 18 bp, synthetic construct
  source 1..18: mol_type = other DNA
taatccgattcactatcg

SEQ ID NO: 7106 - DNA, 18 bp, synthetic construct
  source 1..18: mol_type = other DNA
taatcctactcactagag

SEQ ID NO: 7107 - DNA, 18 bp, synthetic construct
  source 1..18: mol_type = other DNA
taatgcgaatcactacag

SEQ ID NO: 7108 - DNA, 18 bp, synthetic construct
  source 1..18: mol_type = other DNA
taattcgaccccctatag

SEQ ID NO: 7109 - DNA, 18 bp, synthetic construct
  source 1..18: mol_type = other DNA
taattcgagtcagtatag

SEQ ID NO: 7110 - DNA, 18 bp, synthetic construct
  source 1..18: mol_type = other DNA
taattggactgactatag

SEQ ID NO: 7111 - DNA, 18 bp, synthetic construct
  source 1..18: mol_type = other DNA
tactacgactcactagcg

SEQ ID NO: 7112 - DNA, 18 bp, synthetic construct
  source 1..18: mol_type = other DNA
tactacgactcactgaag

SEQ ID NO: 7113 - DNA, 18 bp, synthetic construct
  source 1..18: mol_type = other DNA
tactacgattcactatcg

SEQ ID NO: 7114 - DNA, 18 bp, synthetic construct
  source 1..18: mol_type = other DNA
tactacgccgcactatag

SEQ ID NO: 7115 - DNA, 18 bp, synthetic construct
  source 1..18: mol_type = other DNA
tactacggctcactacag

SEQ ID NO: 7116 - DNA, 18 bp, synthetic construct
  source 1..18: mol_type = other DNA
tagtaagactcactgtag

SEQ ID NO: 7117 - DNA, 18 bp, synthetic construct
  source 1..18: mol_type = other DNA
tagtaccactcactaaag

SEQ ID NO: 7118 - DNA, 18 bp, synthetic construct
  source 1..18: mol_type = other DNA
tagtacgacacactctag

SEQ ID NO: 7119 - DNA, 18 bp, synthetic construct
  source 1..18: mol_type = other DNA
tagtacgacttactacag

SEQ ID NO: 7120 - DNA, 18 bp, synthetic construct
  source 1..18: mol_type = other DNA
tagtacggctcactaaag

SEQ ID NO: 7121 - DNA, 18 bp, synthetic construct
  source 1..18: mol_type = other DNA
tagtgcgagtcactatag

SEQ ID NO: 7122 - DNA, 18 bp, synthetic construct
  source 1..18: mol_type = other DNA
tcatacgactcggtatag

SEQ ID NO: 7123 - DNA, 18 bp, synthetic construct
  source 1..18: mol_type = other DNA
tcatccgactctctatag

SEQ ID NO: 7124 - DNA, 18 bp, synthetic construct
  source 1..18: mol_type = other DNA
tgacaggactcactatag

SEQ ID NO: 7125 - DNA, 18 bp, synthetic construct
  source 1..18: mol_type = other DNA
tgatacgacttaatatag

SEQ ID NO: 7126 - DNA, 18 bp, synthetic construct
  source 1..18: mol_type = other DNA
tgattcgactcacgatag

SEQ ID NO: 7127 - DNA, 18 bp, synthetic construct
  source 1..18: mol_type = other DNA
ttatacggctcactgtag

SEQ ID NO: 7128 - DNA, 18 bp, synthetic construct
  source 1..18: mol_type = other DNA
ttatgcgacccactatag

SEQ ID NO: 7129 - DNA, 18 bp, synthetic construct
  source 1..18: mol_type = other DNA
tatttcgactcactacag

SEQ ID NO: 7130 - DNA, 18 bp, synthetic construct
  source 1..18: mol_type = other DNA
taatactactcaaaatag

SEQ ID NO: 7131 - DNA, 18 bp, synthetic construct
  source 1..18: mol_type = other DNA
tactacgattcacaatag

SEQ ID NO: 7132 - DNA, 18 bp, synthetic construct
  source 1..18: mol_type = other DNA
taatacgtcagactatag

SEQ ID NO: 7133 - DNA, 18 bp, synthetic construct
  source 1..18: mol_type = other DNA
taatataactcaatatag

SEQ ID NO: 7134 - DNA, 18 bp, synthetic construct
  source 1..18: mol_type = other DNA
taattgtactcactatag

SEQ ID NO: 7135 - DNA, 18 bp, synthetic construct
  source 1..18: mol_type = other DNA
tcatactactcactattg

SEQ ID NO: 7136 - DNA, 18 bp, synthetic construct
  source 1..18: mol_type = other DNA
tcttacgactcactattg

SEQ ID NO: 7137 - DNA, 18 bp, synthetic construct
  source 1..18: mol_type = other DNA
taataagactcacaaaag

SEQ ID NO: 7138 - DNA, 18 bp, synthetic construct
  source 1..18: mol_type = other DNA
tattacgactcacactag

SEQ ID NO: 7139 - DNA, 18 bp, synthetic construct
  source 1..18: mol_type = other DNA
aattacgactcacgatag

SEQ ID NO: 7140 - DNA, 18 bp, synthetic construct
  source 1..18: mol_type = other DNA
caatacgactctctaaag

SEQ ID NO: 7141 - DNA, 18 bp, synthetic construct
  source 1..18: mol_type = other DNA
taatacgactctacatag

SEQ ID NO: 7142 - DNA, 18 bp, synthetic construct
  source 1..18: mol_type = other DNA
taatactacacaccatag

SEQ ID NO: 7143 - DNA, 18 bp, synthetic construct
  source 1..18: mol_type = other DNA
taattcgaatcactacag

SEQ ID NO: 7144 - DNA, 18 bp, synthetic construct
  source 1..18: mol_type = other DNA
taattcggctctctatag

SEQ ID NO: 7145 - DNA, 18 bp, synthetic construct
  source 1..18: mol_type = other DNA
taattctactcagtatag

SEQ ID NO: 7146 - DNA, 18 bp, synthetic construct
  source 1..18: mol_type = other DNA
tattacgactcaatacag

SEQ ID NO: 7147 - DNA, 18 bp, synthetic construct
  source 1..18: mol_type = other DNA
taattcgactccctttag

SEQ ID NO: 7148 - DNA, 18 bp, synthetic construct
  source 1..18: mol_type = other DNA
tagttcgactctctatag

SEQ ID NO: 7149 - DNA, 18 bp, synthetic construct
  source 1..18: mol_type = other DNA
taattcaactcacaatag

SEQ ID NO: 7150 - DNA, 18 bp, synthetic construct
  source 1..18: mol_type = other DNA
taattcaactcactattg

SEQ ID NO: 7151 - DNA, 18 bp, synthetic construct
  source 1..18: mol_type = other DNA
aaatacgagacactatag

SEQ ID NO: 7152 - DNA, 18 bp, synthetic construct
  source 1..18: mol_type = other DNA
aattacgacccactatag

SEQ ID NO: 7153 - DNA, 18 bp, synthetic construct
  source 1..18: mol_type = other DNA
taaaatgacccactatag

SEQ ID NO: 7154 - DNA, 18 bp, synthetic construct
  source 1..18: mol_type = other DNA
taatacgaaccacaatag

SEQ ID NO: 7155 - DNA, 18 bp, synthetic construct
  source 1..18: mol_type = other DNA
taatacgactaacaatgg

SEQ ID NO: 7156 - DNA, 18 bp, synthetic construct
  source 1..18: mol_type = other DNA
taatacgtctctgtatag

SEQ ID NO: 7157 - DNA, 18 bp, synthetic construct
  source 1..18: mol_type = other DNA
taatacgtcttagtatag

SEQ ID NO: 7158 - DNA, 18 bp, synthetic construct
  source 1..18: mol_type = other DNA
taattcgacgcattatag

SEQ ID NO: 7159 - DNA, 18 bp, synthetic construct
  source 1..18: mol_type = other DNA
tactgcgactcactttag

SEQ ID NO: 7160 - DNA, 18 bp, synthetic construct
  source 1..18: mol_type = other DNA
tagtacgaatcactattg

SEQ ID NO: 7161 - DNA, 18 bp, synthetic construct
  source 1..18: mol_type = other DNA
tattccgactcactctag

SEQ ID NO: 7162 - DNA, 18 bp, synthetic construct
  source 1..18: mol_type = other DNA
taatacgactctcttaag

SEQ ID NO: 7163 - DNA, 18 bp, synthetic construct
  source 1..18: mol_type = other DNA
taatacgtctcaatattg

SEQ ID NO: 7164 - DNA, 18 bp, synthetic construct
  source 1..18: mol_type = other DNA
taatactactctctctag

SEQ ID NO: 7165 - DNA, 18 bp, synthetic construct
  source 1..18: mol_type = other DNA
tagtacgactcacttttg

SEQ ID NO: 7166 - DNA, 18 bp, synthetic construct
  source 1..18: mol_type = other DNA
tatcacgactctctatag

SEQ ID NO: 7167 - DNA, 18 bp, synthetic construct
  source 1..18: mol_type = other DNA
caatacgacttactttag

SEQ ID NO: 7168 - DNA, 18 bp, synthetic construct
  source 1..18: mol_type = other DNA
taatacgaaactctatag

SEQ ID NO: 7169 - DNA, 18 bp, synthetic construct
  source 1..18: mol_type = other DNA
aaatatgactaactatag

SEQ ID NO: 7170 - DNA, 18 bp, synthetic construct
  source 1..18: mol_type = other DNA
taataccacaaactatag

SEQ ID NO: 7171 - DNA, 18 bp, synthetic construct
  source 1..18: mol_type = other DNA
taatacgaatcacaatgg

SEQ ID NO: 7172 - DNA, 18 bp, synthetic construct
  source 1..18: mol_type = other DNA
taataggacacattatag

SEQ ID NO: 7173 - DNA, 18 bp, synthetic construct
  source 1..18: mol_type = other DNA
aaatgcaactcactatag

SEQ ID NO: 7174 - DNA, 18 bp, synthetic construct
  source 1..18: mol_type = other DNA
taacacgactcactatta

SEQ ID NO: 7175 - DNA, 18 bp, synthetic construct
  source 1..18: mol_type = other DNA
taacacgactcgctttag

SEQ ID NO: 7176 - DNA, 18 bp, synthetic construct
  source 1..18: mol_type = other DNA
taagacgactctctattg

SEQ ID NO: 7177 - DNA, 18 bp, synthetic construct
  source 1..18: mol_type = other DNA
taataagactcacgttag

SEQ ID NO: 7178 - DNA, 18 bp, synthetic construct
  source 1..18: mol_type = other DNA
taatacaattcactgtag

SEQ ID NO: 7179 - DNA, 18 bp, synthetic construct
  source 1..18: mol_type = other DNA
taatacgacttattagag

SEQ ID NO: 7180 - DNA, 18 bp, synthetic construct
  source 1..18: mol_type = other DNA
taatacgattctctagag

SEQ ID NO: 7181 - DNA, 18 bp, synthetic construct
  source 1..18: mol_type = other DNA
taatacgccacaccatag

SEQ ID NO: 7182 - DNA, 18 bp, synthetic construct
  source 1..18: mol_type = other DNA
taatacgcctaattatag

SEQ ID NO: 7183 - DNA, 18 bp, synthetic construct
  source 1..18: mol_type = other DNA
taatacgcctcactttgg

SEQ ID NO: 7184 - DNA, 18 bp, synthetic construct
  source 1..18: mol_type = other DNA
taatacgtttcactagag

SEQ ID NO: 7185 - DNA, 18 bp, synthetic construct
  source 1..18: mol_type = other DNA
taatatgactaaccatag

SEQ ID NO: 7186 - DNA, 18 bp, synthetic construct
  source 1..18: mol_type = other DNA
taatccgactcacagtag

SEQ ID NO: 7187 - DNA, 18 bp, synthetic construct
  source 1..18: mol_type = other DNA
taatccggctcactattg

SEQ ID NO: 7188 - DNA, 18 bp, synthetic construct
  source 1..18: mol_type = other DNA
taatgcgagtcactattg

SEQ ID NO: 7189 - DNA, 18 bp, synthetic construct
  source 1..18: mol_type = other DNA
taattccactcactatcg

SEQ ID NO: 7190 - DNA, 18 bp, synthetic construct
  source 1..18: mol_type = other DNA
tactacaactcaccatag

SEQ ID NO: 7191 - DNA, 18 bp, synthetic construct
  source 1..18: mol_type = other DNA
tattacgactcacggtag

SEQ ID NO: 7192 - DNA, 18 bp, synthetic construct
  source 1..18: mol_type = other DNA
tcatacgcctaactatag

SEQ ID NO: 7193 - DNA, 18 bp, synthetic construct
  source 1..18: mol_type = other DNA
tcatgcgtctcactatag

SEQ ID NO: 7194 - DNA, 18 bp, synthetic construct
  source 1..18: mol_type = other DNA
tgatacgagtcactaaag

SEQ ID NO: 7195 - DNA, 18 bp, synthetic construct
  source 1..18: mol_type = other DNA
tgctacaactcactatag

SEQ ID NO: 7196 - DNA, 18 bp, synthetic construct
  source 1..18: mol_type = other DNA
taatacgtcacagtatag

SEQ ID NO: 7197 - DNA, 18 bp, synthetic construct
  source 1..18: mol_type = other DNA
taatacgaatcactaatg

SEQ ID NO: 7198 - DNA, 18 bp, synthetic construct
  source 1..18: mol_type = other DNA
taatacaactctctaaag

SEQ ID NO: 7199 - DNA, 18 bp, synthetic construct
  source 1..18: mol_type = other DNA
ttttacgaatcactatag

SEQ ID NO: 7200 - DNA, 18 bp, synthetic construct
  source 1..18: mol_type = other DNA
caataagactcactattg

SEQ ID NO: 7201 - DNA, 18 bp, synthetic construct
  source 1..18: mol_type = other DNA
taaaacgactaactattg

SEQ ID NO: 7202 - DNA, 18 bp, synthetic construct
  source 1..18: mol_type = other DNA
taacacgactcactaatg

SEQ ID NO: 7203 - DNA, 18 bp, synthetic construct
  source 1..18: mol_type = other DNA
tactacgactcactaatg

SEQ ID NO: 7204 - DNA, 18 bp, synthetic construct
  source 1..18: mol_type = other DNA
tattaccactcacaatag

SEQ ID NO: 7205 - DNA, 18 bp, synthetic construct
  source 1..18: mol_type = other DNA
taatacgactcacaagtg

SEQ ID NO: 7206 - DNA, 18 bp, synthetic construct
  source 1..18: mol_type = other DNA
ttatacgaatcaatatag

SEQ ID NO: 7207 - DNA, 18 bp, synthetic construct
  source 1..18: mol_type = other DNA
aagttcgactcactatag

SEQ ID NO: 7208 - DNA, 18 bp, synthetic construct
  source 1..18: mol_type = other DNA
taaaatgactcactatcg

SEQ ID NO: 7209 - DNA, 18 bp, synthetic construct
  source 1..18: mol_type = other DNA
taaaatgacttactatag

SEQ ID NO: 7210 - DNA, 18 bp, synthetic construct
  source 1..18: mol_type = other DNA
taaatcgagtcactatag

SEQ ID NO: 7211 - DNA, 18 bp, synthetic construct
  source 1..18: mol_type = other DNA
taataggtctcactgtag

SEQ ID NO: 7212 - DNA, 18 bp, synthetic construct
  source 1..18: mol_type = other DNA
taatatgacacaatatag

SEQ ID NO: 7213 - DNA, 18 bp, synthetic construct
  source 1..18: mol_type = other DNA
taatcagtctcactatag

SEQ ID NO: 7214 - DNA, 18 bp, synthetic construct
  source 1..18: mol_type = other DNA
taatcttactcactatag

SEQ ID NO: 7215 - DNA, 18 bp, synthetic construct
  source 1..18: mol_type = other DNA
taatgcgaccctctatag

SEQ ID NO: 7216 - DNA, 18 bp, synthetic construct
  source 1..18: mol_type = other DNA
tagttcgactcaatatag

SEQ ID NO: 7217 - DNA, 18 bp, synthetic construct
  source 1..18: mol_type = other DNA
tcatacaattcactatag

SEQ ID NO: 7218 - DNA, 18 bp, synthetic construct
  source 1..18: mol_type = other DNA
tgatacgacttacaatag

SEQ ID NO: 7219 - DNA, 18 bp, synthetic construct
  source 1..18: mol_type = other DNA
ttgtacgactcacaatag

SEQ ID NO: 7220 - DNA, 18 bp, synthetic construct
  source 1..18: mol_type = other DNA
aaatacgattctctatag

SEQ ID NO: 7221 - DNA, 18 bp, synthetic construct
  source 1..18: mol_type = other DNA
tattacgccacactatag

SEQ ID NO: 7222 - DNA, 18 bp, synthetic construct
  source 1..18: mol_type = other DNA
tgatacgactcacttaag

SEQ ID NO: 7223 - DNA, 18 bp, synthetic construct
  source 1..18: mol_type = other DNA
atatacgagtcactatag

SEQ ID NO: 7224 - DNA, 18 bp, synthetic construct
  source 1..18: mol_type = other DNA
taaaaagactcaatatag

SEQ ID NO: 7225 - DNA, 18 bp, synthetic construct
  source 1..18: mol_type = other DNA
taatccgtctcactacag

SEQ ID NO: 7226 - DNA, 18 bp, synthetic construct
  source 1..18: mol_type = other DNA
taatccgtctcactgtag

SEQ ID NO: 7227 - DNA, 18 bp, synthetic construct
  source 1..18: mol_type = other DNA
ttatacgaatcactatcg

SEQ ID NO: 7228 - DNA, 18 bp, synthetic construct
  source 1..18: mol_type = other DNA
taaaacgactcacttttg

SEQ ID NO: 7229 - DNA, 18 bp, synthetic construct
  source 1..18: mol_type = other DNA
taatacttctcactacag

SEQ ID NO: 7230 - DNA, 18 bp, synthetic construct
  source 1..18: mol_type = other DNA
taatatgaatcactaaag

SEQ ID NO: 7231 - DNA, 18 bp, synthetic construct
  source 1..18: mol_type = other DNA
tattacgacccactttag

SEQ ID NO: 7232 - DNA, 18 bp, synthetic construct
  source 1..18: mol_type = other DNA
taataagactcattttag

SEQ ID NO: 7233 - DNA, 18 bp, synthetic construct
  source 1..18: mol_type = other DNA
taatactcctcactttag

SEQ ID NO: 7234 - DNA, 18 bp, synthetic construct
  source 1..18: mol_type = other DNA
taattcatctcactatag

SEQ ID NO: 7235 - DNA, 18 bp, synthetic construct
  source 1..18: mol_type = other DNA
taattcgactcacaaaag

SEQ ID NO: 7236 - DNA, 18 bp, synthetic construct
  source 1..18: mol_type = other DNA
taattcgtctctctatag

SEQ ID NO: 7237 - DNA, 18 bp, synthetic construct
  source 1..18: mol_type = other DNA
taatatgacacacaatag

SEQ ID NO: 7238 - DNA, 18 bp, synthetic construct
  source 1..18: mol_type = other DNA
aaatatgaatcactatag

SEQ ID NO: 7239 - DNA, 18 bp, synthetic construct
  source 1..18: mol_type = other DNA
aaatccgactcactaaag

SEQ ID NO: 7240 - DNA, 18 bp, synthetic construct
  source 1..18: mol_type = other DNA
ttatactagtcactatag

SEQ ID NO: 7241 - DNA, 18 bp, synthetic construct
  source 1..18: mol_type = other DNA
caatacgaatcactaaag

SEQ ID NO: 7242 - DNA, 18 bp, synthetic construct
  source 1..18: mol_type = other DNA
taatacgaatcacaacag

SEQ ID NO: 7243 - DNA, 18 bp, synthetic construct
  source 1..18: mol_type = other DNA
taatacgacccacaattg

SEQ ID NO: 7244 - DNA, 18 bp, synthetic construct
  source 1..18: mol_type = other DNA
taatacgacttaaaatag

SEQ ID NO: 7245 - DNA, 18 bp, synthetic construct
  source 1..18: mol_type = other DNA
taatacgattcccaatag

SEQ ID NO: 7246 - DNA, 18 bp, synthetic construct
  source 1..18: mol_type = other DNA
taatgcgactttctatag

SEQ ID NO: 7247 - DNA, 18 bp, synthetic construct
  source 1..18: mol_type = other DNA
tattacgcctcaatatag

SEQ ID NO: 7248 - DNA, 18 bp, synthetic construct
  source 1..18: mol_type = other DNA
agatacgtctcactatag

SEQ ID NO: 7249 - DNA, 18 bp, synthetic construct
  source 1..18: mol_type = other DNA
atatacgactcactgtag

SEQ ID NO: 7250 - DNA, 18 bp, synthetic construct
  source 1..18: mol_type = other DNA
taaaacgaatcactatcg

SEQ ID NO: 7251 - DNA, 18 bp, synthetic construct
  source 1..18: mol_type = other DNA
taaaacgacacgctatag

SEQ ID NO: 7252 - DNA, 18 bp, synthetic construct
  source 1..18: mol_type = other DNA
taatacgactccatttag

SEQ ID NO: 7253 - DNA, 18 bp, synthetic construct
  source 1..18: mol_type = other DNA
taatactactcacactag

SEQ ID NO: 7254 - DNA, 18 bp, synthetic construct
  source 1..18: mol_type = other DNA
taatcctactcactaaag

SEQ ID NO: 7255 - DNA, 18 bp, synthetic construct
  source 1..18: mol_type = other DNA
taattcgaatcactgtag

SEQ ID NO: 7256 - DNA, 18 bp, synthetic construct
  source 1..18: mol_type = other DNA
taattcgattcattatag

SEQ ID NO: 7257 - DNA, 18 bp, synthetic construct
  source 1..18: mol_type = other DNA
tcacacgactcactaaag

SEQ ID NO: 7258 - DNA, 18 bp, synthetic construct
  source 1..18: mol_type = other DNA
tgatacgacacactttag

SEQ ID NO: 7259 - DNA, 18 bp, synthetic construct
  source 1..18: mol_type = other DNA
ttataccactaactatag

SEQ ID NO: 7260 - DNA, 18 bp, synthetic construct
  source 1..18: mol_type = other DNA
aaacacgactcactctag

SEQ ID NO: 7261 - DNA, 18 bp, synthetic construct
  source 1..18: mol_type = other DNA
aaatacaactcgctatag

SEQ ID NO: 7262 - DNA, 18 bp, synthetic construct
  source 1..18: mol_type = other DNA
aaatacgaatgactatag

SEQ ID NO: 7263 - DNA, 18 bp, synthetic construct
  source 1..18: mol_type = other DNA
aaatacgactcaccatgg

SEQ ID NO: 7264 - DNA, 18 bp, synthetic construct
  source 1..18: mol_type = other DNA
aaatactactcgctatag

SEQ ID NO: 7265 - DNA, 18 bp, synthetic construct
  source 1..18: mol_type = other DNA
taaaacgacccactatcg

SEQ ID NO: 7266 - DNA, 18 bp, synthetic construct
  source 1..18: mol_type = other DNA
taacacgactctctatcg

SEQ ID NO: 7267 - DNA, 18 bp, synthetic construct
  source 1..18: mol_type = other DNA
taacacgattcactatcg

SEQ ID NO: 7268 - DNA, 18 bp, synthetic construct
  source 1..18: mol_type = other DNA
taagacgtctcactttag

SEQ ID NO: 7269 - DNA, 18 bp, synthetic construct
  source 1..18: mol_type = other DNA
taataagactgactttag

SEQ ID NO: 7270 - DNA, 18 bp, synthetic construct
  source 1..18: mol_type = other DNA
taatacaaatcactagag

SEQ ID NO: 7271 - DNA, 18 bp, synthetic construct
  source 1..18: mol_type = other DNA
taatacgactcgcagtag

SEQ ID NO: 7272 - DNA, 18 bp, synthetic construct
  source 1..18: mol_type = other DNA
taatacgcctaactaaag

SEQ ID NO: 7273 - DNA, 18 bp, synthetic construct
  source 1..18: mol_type = other DNA
taatacgcctcatcatag

SEQ ID NO: 7274 - DNA, 18 bp, synthetic construct
  source 1..18: mol_type = other DNA
taatcacactcactatag

SEQ ID NO: 7275 - DNA, 18 bp, synthetic construct
  source 1..18: mol_type = other DNA
taatccgattccctatag

SEQ ID NO: 7276 - DNA, 18 bp, synthetic construct
  source 1..18: mol_type = other DNA
tactacaactccctatag

SEQ ID NO: 7277 - DNA, 18 bp, synthetic construct
  source 1..18: mol_type = other DNA
tagtaaggctcactatag

SEQ ID NO: 7278 - DNA, 18 bp, synthetic construct
  source 1..18: mol_type = other DNA
tattacgactgaccatag

SEQ ID NO: 7279 - DNA, 18 bp, synthetic construct
  source 1..18: mol_type = other DNA
tcatacaactcattatag

SEQ ID NO: 7280 - DNA, 18 bp, synthetic construct
  source 1..18: mol_type = other DNA
tcatacgactctctatgg

SEQ ID NO: 7281 - DNA, 18 bp, synthetic construct
  source 1..18: mol_type = other DNA
tcatacgattcaatatag

SEQ ID NO: 7282 - DNA, 18 bp, synthetic construct
  source 1..18: mol_type = other DNA
tcgtacgactcactattg

SEQ ID NO: 7283 - DNA, 18 bp, synthetic construct
  source 1..18: mol_type = other DNA
tgacacaactcactatag

SEQ ID NO: 7284 - DNA, 18 bp, synthetic construct
  source 1..18: mol_type = other DNA
tgatacgatttactatag

SEQ ID NO: 7285 - DNA, 18 bp, synthetic construct
  source 1..18: mol_type = other DNA
ttatacgactcacgatcg

SEQ ID NO: 7286 - DNA, 18 bp, synthetic construct
  source 1..18: mol_type = other DNA
aaatacgactaactagag

SEQ ID NO: 7287 - DNA, 18 bp, synthetic construct
  source 1..18: mol_type = other DNA
aaatacgactcgttatag

SEQ ID NO: 7288 - DNA, 18 bp, synthetic construct
  source 1..18: mol_type = other DNA
aaatacgagtcagtatag

SEQ ID NO: 7289 - DNA, 18 bp, synthetic construct
  source 1..18: mol_type = other DNA
caaaacgactccctatag

SEQ ID NO: 7290 - DNA, 18 bp, synthetic construct
  source 1..18: mol_type = other DNA
caatacgcctaactatag

SEQ ID NO: 7291 - DNA, 18 bp, synthetic construct
  source 1..18: mol_type = other DNA
gaatacgacccgctatag

SEQ ID NO: 7292 - DNA, 18 bp, synthetic construct
  source 1..18: mol_type = other DNA
gaatacgagtcactttag

SEQ ID NO: 7293 - DNA, 18 bp, synthetic construct
  source 1..18: mol_type = other DNA
gaatgcgacacactatag

SEQ ID NO: 7294 - DNA, 18 bp, synthetic construct
  source 1..18: mol_type = other DNA
gaatgcgactctctatag

SEQ ID NO: 7295 - DNA, 18 bp, synthetic construct
  source 1..18: mol_type = other DNA
taaaacgacttactagag

SEQ ID NO: 7296 - DNA, 18 bp, synthetic construct
  source 1..18: mol_type = other DNA
taacaccactccctatag

SEQ ID NO: 7297 - DNA, 18 bp, synthetic construct
  source 1..18: mol_type = other DNA
taacacgactcactaccg

SEQ ID NO: 7298 - DNA, 18 bp, synthetic construct
  source 1..18: mol_type = other DNA
taacacgactcagtatcg

SEQ ID NO: 7299 - DNA, 18 bp, synthetic construct
  source 1..18: mol_type = other DNA
taacccgcctcactatag

SEQ ID NO: 7300 - DNA, 18 bp, synthetic construct
  source 1..18: mol_type = other DNA
taagaccactctctatag

SEQ ID NO: 7301 - DNA, 18 bp, synthetic construct
  source 1..18: mol_type = other DNA
taagtccactcactatag

SEQ ID NO: 7302 - DNA, 18 bp, synthetic construct
  source 1..18: mol_type = other DNA
taatacaacccagtatag

SEQ ID NO: 7303 - DNA, 18 bp, synthetic construct
  source 1..18: mol_type = other DNA
taatacaacgcaccatag

SEQ ID NO: 7304 - DNA, 18 bp, synthetic construct
  source 1..18: mol_type = other DNA
taataccacccaccatag

SEQ ID NO: 7305 - DNA, 18 bp, synthetic construct
  source 1..18: mol_type = other DNA
taataccactcaatatgg

SEQ ID NO: 7306 - DNA, 18 bp, synthetic construct
  source 1..18: mol_type = other DNA
taatacgaaaccctatag

SEQ ID NO: 7307 - DNA, 18 bp, synthetic construct
  source 1..18: mol_type = other DNA
taatacgacctactatcg

SEQ ID NO: 7308 - DNA, 18 bp, synthetic construct
  source 1..18: mol_type = other DNA
taatacgacgcactgttg

SEQ ID NO: 7309 - DNA, 18 bp, synthetic construct
  source 1..18: mol_type = other DNA
taatacgactcatcacag

SEQ ID NO: 7310 - DNA, 18 bp, synthetic construct
  source 1..18: mol_type = other DNA
taatacgactccctttgg

SEQ ID NO: 7311 - DNA, 18 bp, synthetic construct
  source 1..18: mol_type = other DNA
taatacgactccttagag

SEQ ID NO: 7312 - DNA, 18 bp, synthetic construct
  source 1..18: mol_type = other DNA
taatacgactctctagcg

SEQ ID NO: 7313 - DNA, 18 bp, synthetic construct
  source 1..18: mol_type = other DNA
taatacgactctttataa

SEQ ID NO: 7314 - DNA, 18 bp, synthetic construct
  source 1..18: mol_type = other DNA
taatacgacttcctacag

SEQ ID NO: 7315 - DNA, 18 bp, synthetic construct
  source 1..18: mol_type = other DNA
taatacgagtctcgatag

SEQ ID NO: 7316 - DNA, 18 bp, synthetic construct
  source 1..18: mol_type = other DNA
taatacgattcaccagag

SEQ ID NO: 7317 - DNA, 18 bp, synthetic construct
  source 1..18: mol_type = other DNA
taatacgtctccgtatag

SEQ ID NO: 7318 - DNA, 18 bp, synthetic construct
  source 1..18: mol_type = other DNA
taatagaactgactatag

SEQ ID NO: 7319 - DNA, 18 bp, synthetic construct
  source 1..18: mol_type = other DNA
taataggactcattatcg

SEQ ID NO: 7320 - DNA, 18 bp, synthetic construct
  source 1..18: mol_type = other DNA
taataggactctctatcg

SEQ ID NO: 7321 - DNA, 18 bp, synthetic construct
  source 1..18: mol_type = other DNA
taatatgacccagtatag

SEQ ID NO: 7322 - DNA, 18 bp, synthetic construct
  source 1..18: mol_type = other DNA
taatatggctaactatag

SEQ ID NO: 7323 - DNA, 18 bp, synthetic construct
  source 1..18: mol_type = other DNA
taatcagactcacgatag

SEQ ID NO: 7324 - DNA, 18 bp, synthetic construct
  source 1..18: mol_type = other DNA
taatgcgactaactgtag

SEQ ID NO: 7325 - DNA, 18 bp, synthetic construct
  source 1..18: mol_type = other DNA
taatgcgactctctatgg

SEQ ID NO: 7326 - DNA, 18 bp, synthetic construct
  source 1..18: mol_type = other DNA
taatgcgactgactttag

SEQ ID NO: 7327 - DNA, 18 bp, synthetic construct
  source 1..18: mol_type = other DNA
taatggtactcactatag

SEQ ID NO: 7328 - DNA, 18 bp, synthetic construct
  source 1..18: mol_type = other DNA
tactacgacccactgtag

SEQ ID NO: 7329 - DNA, 18 bp, synthetic construct
  source 1..18: mol_type = other DNA
tactacgactcactatta

SEQ ID NO: 7330 - DNA, 18 bp, synthetic construct
  source 1..18: mol_type = other DNA
tactacgactcacttgag

SEQ ID NO: 7331 - DNA, 18 bp, synthetic construct
  source 1..18: mol_type = other DNA
tactacgactgactaaag

SEQ ID NO: 7332 - DNA, 18 bp, synthetic construct
  source 1..18: mol_type = other DNA
tactacgatccactatag

SEQ ID NO: 7333 - DNA, 18 bp, synthetic construct
  source 1..18: mol_type = other DNA
tactactactcagtatag

SEQ ID NO: 7334 - DNA, 18 bp, synthetic construct
  source 1..18: mol_type = other DNA
tactccgactaactatag

SEQ ID NO: 7335 - DNA, 18 bp, synthetic construct
  source 1..18: mol_type = other DNA
tactgcgcctcactatag

SEQ ID NO: 7336 - DNA, 18 bp, synthetic construct
  source 1..18: mol_type = other DNA
tagcgcgactcactatag

SEQ ID NO: 7337 - DNA, 18 bp, synthetic construct
  source 1..18: mol_type = other DNA
tagtacgactcaccaaag

SEQ ID NO: 7338 - DNA, 18 bp, synthetic construct
  source 1..18: mol_type = other DNA
tagtacgactcactactg

SEQ ID NO: 7339 - DNA, 18 bp, synthetic construct
  source 1..18: mol_type = other DNA
tagtacgactcattatgg

SEQ ID NO: 7340 - DNA, 18 bp, synthetic construct
  source 1..18: mol_type = other DNA
tagtacgattcagtatag

SEQ ID NO: 7341 - DNA, 18 bp, synthetic construct
  source 1..18: mol_type = other DNA
tagtgctactcactatag

SEQ ID NO: 7342 - DNA, 18 bp, synthetic construct
  source 1..18: mol_type = other DNA
tattacgactcactctgg

SEQ ID NO: 7343 - DNA, 18 bp, synthetic construct
  source 1..18: mol_type = other DNA
tattacgactcgcgatag

SEQ ID NO: 7344 - DNA, 18 bp, synthetic construct
  source 1..18: mol_type = other DNA
tcagacgactctctatag

SEQ ID NO: 7345 - DNA, 18 bp, synthetic construct
  source 1..18: mol_type = other DNA
tcatacgactcaatatgg

SEQ ID NO: 7346 - DNA, 18 bp, synthetic construct
  source 1..18: mol_type = other DNA
tcatacgcctcaatatag

SEQ ID NO: 7347 - DNA, 18 bp, synthetic construct
  source 1..18: mol_type = other DNA
tcatacggatcactatag

SEQ ID NO: 7348 - DNA, 18 bp, synthetic construct
  source 1..18: mol_type = other DNA
tcatacggctcacaatag

SEQ ID NO: 7349 - DNA, 18 bp, synthetic construct
  source 1..18: mol_type = other DNA
tcataggactcacaatag

SEQ ID NO: 7350 - DNA, 18 bp, synthetic construct
  source 1..18: mol_type = other DNA
tcatgcgaatcactatag

SEQ ID NO: 7351 - DNA, 18 bp, synthetic construct
  source 1..18: mol_type = other DNA
tcctacgactcactatcg

SEQ ID NO: 7352 - DNA, 18 bp, synthetic construct
  source 1..18: mol_type = other DNA
tcctatgactcactatag

SEQ ID NO: 7353 - DNA, 18 bp, synthetic construct
  source 1..18: mol_type = other DNA
tcgtacgactcacaatag

SEQ ID NO: 7354 - DNA, 18 bp, synthetic construct
  source 1..18: mol_type = other DNA
tgatacgaatcactacag

SEQ ID NO: 7355 - DNA, 18 bp, synthetic construct
  source 1..18: mol_type = other DNA
tgatacgattcactacag

SEQ ID NO: 7356 - DNA, 18 bp, synthetic construct
  source 1..18: mol_type = other DNA
ttatacgacgcactgtag

SEQ ID NO: 7357 - DNA, 18 bp, synthetic construct
  source 1..18: mol_type = other DNA
ttatccgactccctatag

SEQ ID NO: 7358 - DNA, 18 bp, synthetic construct
  source 1..18: mol_type = other DNA
taattcgaatcactattg

SEQ ID NO: 7359 - DNA, 18 bp, synthetic construct
  source 1..18: mol_type = other DNA
taatacgattcacaaaag

SEQ ID NO: 7360 - DNA, 18 bp, synthetic construct
  source 1..18: mol_type = other DNA
cataacgactcactatag

SEQ ID NO: 7361 - DNA, 18 bp, synthetic construct
  source 1..18: mol_type = other DNA
taatactaatcattatag

SEQ ID NO: 7362 - DNA, 18 bp, synthetic construct
  source 1..18: mol_type = other DNA
tattccaactcactatag

SEQ ID NO: 7363 - DNA, 18 bp, synthetic construct
  source 1..18: mol_type = other DNA
taatacgatacactattg

SEQ ID NO: 7364 - DNA, 18 bp, synthetic construct
  source 1..18: mol_type = other DNA
taattcgacttactattg

SEQ ID NO: 7365 - DNA, 18 bp, synthetic construct
  source 1..18: mol_type = other DNA
taatacgtctcacattag

SEQ ID NO: 7366 - DNA, 18 bp, synthetic construct
  source 1..18: mol_type = other DNA
taatacaattcactattg

SEQ ID NO: 7367 - DNA, 18 bp, synthetic construct
  source 1..18: mol_type = other DNA
cattacgacttactatag

SEQ ID NO: 7368 - DNA, 18 bp, synthetic construct
  source 1..18: mol_type = other DNA
taaaacgactcacaatgg

SEQ ID NO: 7369 - DNA, 18 bp, synthetic construct
  source 1..18: mol_type = other DNA
taaaacgattcactatcg

SEQ ID NO: 7370 - DNA, 18 bp, synthetic construct
  source 1..18: mol_type = other DNA
taatacgacactctatgg

SEQ ID NO: 7371 - DNA, 18 bp, synthetic construct
  source 1..18: mol_type = other DNA
taatacgattctctacag

SEQ ID NO: 7372 - DNA, 18 bp, synthetic construct
  source 1..18: mol_type = other DNA
taatactactaaccatag

SEQ ID NO: 7373 - DNA, 18 bp, synthetic construct
  source 1..18: mol_type = other DNA
ttatacgtctcactatgg

SEQ ID NO: 7374 - DNA, 18 bp, synthetic construct
  source 1..18: mol_type = other DNA
aaatacgactcacaattg

SEQ ID NO: 7375 - DNA, 18 bp, synthetic construct
  source 1..18: mol_type = other DNA
ttatacgactcaaaatag

SEQ ID NO: 7376 - DNA, 18 bp, synthetic construct
  source 1..18: mol_type = other DNA
tattacgactctctttag

SEQ ID NO: 7377 - DNA, 18 bp, synthetic construct
  source 1..18: mol_type = other DNA
tattactactaactatag

SEQ ID NO: 7378 - DNA, 18 bp, synthetic construct
  source 1..18: mol_type = other DNA
aaatacgactctgtatag

SEQ ID NO: 7379 - DNA, 18 bp, synthetic construct
  source 1..18: mol_type = other DNA
taacacgatacactatag

SEQ ID NO: 7380 - DNA, 18 bp, synthetic construct
  source 1..18: mol_type = other DNA
taatacgactgacttcag

SEQ ID NO: 7381 - DNA, 18 bp, synthetic construct
  source 1..18: mol_type = other DNA
taatacgacttacgattg

SEQ ID NO: 7382 - DNA, 18 bp, synthetic construct
  source 1..18: mol_type = other DNA
taatactactcagaatag

SEQ ID NO: 7383 - DNA, 18 bp, synthetic construct
  source 1..18: mol_type = other DNA
taattagactcactatcg

SEQ ID NO: 7384 - DNA, 18 bp, synthetic construct
  source 1..18: mol_type = other DNA
taattaggctcactatag

SEQ ID NO: 7385 - DNA, 18 bp, synthetic construct
  source 1..18: mol_type = other DNA
taattcaagtcactatag

SEQ ID NO: 7386 - DNA, 18 bp, synthetic construct
  source 1..18: mol_type = other DNA
taattcggatcactatag

SEQ ID NO: 7387 - DNA, 18 bp, synthetic construct
  source 1..18: mol_type = other DNA
tgatacgactcactatta

SEQ ID NO: 7388 - DNA, 18 bp, synthetic construct
  source 1..18: mol_type = other DNA
aaatacgatacactatag

SEQ ID NO: 7389 - DNA, 18 bp, synthetic construct
  source 1..18: mol_type = other DNA
taatacgcctctctaaag

SEQ ID NO: 7390 - DNA, 18 bp, synthetic construct
  source 1..18: mol_type = other DNA
tagtacgattctctatag

SEQ ID NO: 7391 - DNA, 18 bp, synthetic construct
  source 1..18: mol_type = other DNA
ttacacgactcactttag

SEQ ID NO: 7392 - DNA, 18 bp, synthetic construct
  source 1..18: mol_type = other DNA
ttatacgacagactatag

SEQ ID NO: 7393 - DNA, 18 bp, synthetic construct
  source 1..18: mol_type = other DNA
taatacttctcattatag

SEQ ID NO: 7394 - DNA, 18 bp, synthetic construct
  source 1..18: mol_type = other DNA
ttatacgacttactattg

SEQ ID NO: 7395 - DNA, 18 bp, synthetic construct
  source 1..18: mol_type = other DNA
aaatacgactcactttcg

SEQ ID NO: 7396 - DNA, 18 bp, synthetic construct
  source 1..18: mol_type = other DNA
taataagactcaatattg

SEQ ID NO: 7397 - DNA, 18 bp, synthetic construct
  source 1..18: mol_type = other DNA
taatacttatcactatag

SEQ ID NO: 7398 - DNA, 18 bp, synthetic construct
  source 1..18: mol_type = other DNA
taatacgacttcctttag

SEQ ID NO: 7399 - DNA, 18 bp, synthetic construct
  source 1..18: mol_type = other DNA
tagttcgaatcactatag

SEQ ID NO: 7400 - DNA, 18 bp, synthetic construct
  source 1..18: mol_type = other DNA
tcataccactctctatag

SEQ ID NO: 7401 - DNA, 18 bp, synthetic construct
  source 1..18: mol_type = other DNA
tgatactactcactttag

SEQ ID NO: 7402 - DNA, 18 bp, synthetic construct
  source 1..18: mol_type = other DNA
caatacgactttctatag

SEQ ID NO: 7403 - DNA, 18 bp, synthetic construct
  source 1..18: mol_type = other DNA
taaaacgagtcaatatag

SEQ ID NO: 7404 - DNA, 18 bp, synthetic construct
  source 1..18: mol_type = other DNA
taacacgattcattatag

SEQ ID NO: 7405 - DNA, 18 bp, synthetic construct
  source 1..18: mol_type = other DNA
taactcggctcactatag

SEQ ID NO: 7406 - DNA, 18 bp, synthetic construct
  source 1..18: mol_type = other DNA
taataccactcactaacg

SEQ ID NO: 7407 - DNA, 18 bp, synthetic construct
  source 1..18: mol_type = other DNA
taatacgaatcactgtcg

SEQ ID NO: 7408 - DNA, 18 bp, synthetic construct
  source 1..18: mol_type = other DNA
taatacgaatgactaaag

SEQ ID NO: 7409 - DNA, 18 bp, synthetic construct
  source 1..18: mol_type = other DNA
taatacgacacacgattg

SEQ ID NO: 7410 - DNA, 18 bp, synthetic construct
  source 1..18: mol_type = other DNA
taatacgaccgactattg

SEQ ID NO: 7411 - DNA, 18 bp, synthetic construct
  source 1..18: mol_type = other DNA
taatacgacgctttatag

SEQ ID NO: 7412 - DNA, 18 bp, synthetic construct
  source 1..18: mol_type = other DNA
taatacgactcactgttc

SEQ ID NO: 7413 - DNA, 18 bp, synthetic construct
  source 1..18: mol_type = other DNA
taatacgactctttgtag

SEQ ID NO: 7414 - DNA, 18 bp, synthetic construct
  source 1..18: mol_type = other DNA
taataggattcactatcg

SEQ ID NO: 7415 - DNA, 18 bp, synthetic construct
  source 1..18: mol_type = other DNA
taatatgtcccactatag

SEQ ID NO: 7416 - DNA, 18 bp, synthetic construct
  source 1..18: mol_type = other DNA
taatccaacacactatag

SEQ ID NO: 7417 - DNA, 18 bp, synthetic construct
  source 1..18: mol_type = other DNA
taatgcctctcactatag

SEQ ID NO: 7418 - DNA, 18 bp, synthetic construct
  source 1..18: mol_type = other DNA
taattcgactcaccgtag

SEQ ID NO: 7419 - DNA, 18 bp, synthetic construct
  source 1..18: mol_type = other DNA
tactaaggctcactatag

SEQ ID NO: 7420 - DNA, 18 bp, synthetic construct
  source 1..18: mol_type = other DNA
tactacaacacactatag

SEQ ID NO: 7421 - DNA, 18 bp, synthetic construct
  source 1..18: mol_type = other DNA
tactaccactcactatcg

SEQ ID NO: 7422 - DNA, 18 bp, synthetic construct
  source 1..18: mol_type = other DNA
tacttcgactcactgtag

SEQ ID NO: 7423 - DNA, 18 bp, synthetic construct
  source 1..18: mol_type = other DNA
tattaaggctcactatag

SEQ ID NO: 7424 - DNA, 18 bp, synthetic construct
  source 1..18: mol_type = other DNA
tcatacaaatcactatag

SEQ ID NO: 7425 - DNA, 18 bp, synthetic construct
  source 1..18: mol_type = other DNA
tcatacgactcacaatcg

SEQ ID NO: 7426 - DNA, 18 bp, synthetic construct
  source 1..18: mol_type = other DNA
tcatgcgcctcactatag

SEQ ID NO: 7427 - DNA, 18 bp, synthetic construct
  source 1..18: mol_type = other DNA
tgatacgactgacaatag

SEQ ID NO: 7428 - DNA, 18 bp, synthetic construct
  source 1..18: mol_type = other DNA
tggtaagactcactatag

SEQ ID NO: 7429 - DNA, 18 bp, synthetic construct
  source 1..18: mol_type = other DNA
tgttaagactcactatag

SEQ ID NO: 7430 - DNA, 18 bp, synthetic construct
  source 1..18: mol_type = other DNA
ttacacgactccctatag

SEQ ID NO: 7431 - DNA, 18 bp, synthetic construct
  source 1..18: mol_type = other DNA
ttatacgacgcacaatag

SEQ ID NO: 7432 - DNA, 18 bp, synthetic construct
  source 1..18: mol_type = other DNA
ttatacgactcaataaag

SEQ ID NO: 7433 - DNA, 18 bp, synthetic construct
  source 1..18: mol_type = other DNA
ttatacgacttattatag

SEQ ID NO: 7434 - DNA, 18 bp, synthetic construct
  source 1..18: mol_type = other DNA
taataggaatctctatag

SEQ ID NO: 7435 - DNA, 18 bp, synthetic construct
  source 1..18: mol_type = other DNA
tattatgactcaatatag

SEQ ID NO: 7436 - DNA, 18 bp, synthetic construct
  source 1..18: mol_type = other DNA
taattcgaatctctatag

SEQ ID NO: 7437 - DNA, 18 bp, synthetic construct
  source 1..18: mol_type = other DNA
tattacgactaactttag

SEQ ID NO: 7438 - DNA, 18 bp, synthetic construct
  source 1..18: mol_type = other DNA
tagtacgactctcaatag

SEQ ID NO: 7439 - DNA, 18 bp, synthetic construct
  source 1..18: mol_type = other DNA
aaatacgactgtctatag

SEQ ID NO: 7440 - DNA, 18 bp, synthetic construct
  source 1..18: mol_type = other DNA
taataccaatcaatatag

SEQ ID NO: 7441 - DNA, 18 bp, synthetic construct
  source 1..18: mol_type = other DNA
taataccaatcactaaag

SEQ ID NO: 7442 - DNA, 18 bp, synthetic construct
  source 1..18: mol_type = other DNA
taatacgaccaacaatag

SEQ ID NO: 7443 - DNA, 18 bp, synthetic construct
  source 1..18: mol_type = other DNA
taatacgactcattaacg

SEQ ID NO: 7444 - DNA, 18 bp, synthetic construct
  source 1..18: mol_type = other DNA
taatacttctcacgatag

SEQ ID NO: 7445 - DNA, 18 bp, synthetic construct
  source 1..18: mol_type = other DNA
taatccgactaactttag

SEQ ID NO: 7446 - DNA, 18 bp, synthetic construct
  source 1..18: mol_type = other DNA
taattccactaactatag

SEQ ID NO: 7447 - DNA, 18 bp, synthetic construct
  source 1..18: mol_type = other DNA
taattcgactctctgtag

SEQ ID NO: 7448 - DNA, 18 bp, synthetic construct
  source 1..18: mol_type = other DNA
tcaaacgactcattatag

SEQ ID NO: 7449 - DNA, 18 bp, synthetic construct
  source 1..18: mol_type = other DNA
tcatacgtctcactctag

SEQ ID NO: 7450 - DNA, 18 bp, synthetic construct
  source 1..18: mol_type = other DNA
tgttacgacttactatag

SEQ ID NO: 7451 - DNA, 18 bp, synthetic construct
  source 1..18: mol_type = other DNA
ttatacgattcactagag

SEQ ID NO: 7452 - DNA, 18 bp, synthetic construct
  source 1..18: mol_type = other DNA
atatacgactctctatag

SEQ ID NO: 7453 - DNA, 18 bp, synthetic construct
  source 1..18: mol_type = other DNA
atatacgactccctatag

SEQ ID NO: 7454 - DNA, 18 bp, synthetic construct
  source 1..18: mol_type = other DNA
taatacgtctcactaagg

SEQ ID NO: 7455 - DNA, 18 bp, synthetic construct
  source 1..18: mol_type = other DNA
aaatatgactctctatag

SEQ ID NO: 7456 - DNA, 18 bp, synthetic construct
  source 1..18: mol_type = other DNA
tacaacgactcactttag

SEQ ID NO: 7457 - DNA, 18 bp, synthetic construct
  source 1..18: mol_type = other DNA
taataagattcaatatag

SEQ ID NO: 7458 - DNA, 18 bp, synthetic construct
  source 1..18: mol_type = other DNA
taatacgacttactaacg

SEQ ID NO: 7459 - DNA, 18 bp, synthetic construct
  source 1..18: mol_type = other DNA
taatacgactttgtatag

SEQ ID NO: 7460 - DNA, 18 bp, synthetic construct
  source 1..18: mol_type = other DNA
taatacgtctcattatgg

SEQ ID NO: 7461 - DNA, 18 bp, synthetic construct
  source 1..18: mol_type = other DNA
taatatgacaaactatag

SEQ ID NO: 7462 - DNA, 18 bp, synthetic construct
  source 1..18: mol_type = other DNA
taatccgtatcactatag

SEQ ID NO: 7463 - DNA, 18 bp, synthetic construct
  source 1..18: mol_type = other DNA
tcttacgactcacaatag

SEQ ID NO: 7464 - DNA, 18 bp, synthetic construct
  source 1..18: mol_type = other DNA
taatacgactgacattag

SEQ ID NO: 7465 - DNA, 18 bp, synthetic construct
  source 1..18: mol_type = other DNA
taataggactctctaaag

SEQ ID NO: 7466 - DNA, 18 bp, synthetic construct
  source 1..18: mol_type = other DNA
caatacgtctcactttag

SEQ ID NO: 7467 - DNA, 18 bp, synthetic construct
  source 1..18: mol_type = other DNA
taatactacttactaaag

SEQ ID NO: 7468 - DNA, 18 bp, synthetic construct
  source 1..18: mol_type = other DNA
tattactacttactatag

SEQ ID NO: 7469 - DNA, 18 bp, synthetic construct
  source 1..18: mol_type = other DNA
taaaacaacacactatag

SEQ ID NO: 7470 - DNA, 18 bp, synthetic construct
  source 1..18: mol_type = other DNA
tgttacgactcactattg

SEQ ID NO: 7471 - DNA, 18 bp, synthetic construct
  source 1..18: mol_type = other DNA
tattatgactcactttag

SEQ ID NO: 7472 - DNA, 18 bp, synthetic construct
  source 1..18: mol_type = other DNA
aaattcgattcactatag

SEQ ID NO: 7473 - DNA, 18 bp, synthetic construct
  source 1..18: mol_type = other DNA
taatacgattcactaatg

SEQ ID NO: 7474 - DNA, 18 bp, synthetic construct
  source 1..18: mol_type = other DNA
taatacgactctctcaag

SEQ ID NO: 7475 - DNA, 18 bp, synthetic construct
  source 1..18: mol_type = other DNA
taatatgactaactttag

SEQ ID NO: 7476 - DNA, 18 bp, synthetic construct
  source 1..18: mol_type = other DNA
ttataccactcactaaag

SEQ ID NO: 7477 - DNA, 18 bp, synthetic construct
  source 1..18: mol_type = other DNA
taatactactcacaatgg

SEQ ID NO: 7478 - DNA, 18 bp, synthetic construct
  source 1..18: mol_type = other DNA
taatccgtctctctatag

SEQ ID NO: 7479 - DNA, 18 bp, synthetic construct
  source 1..18: mol_type = other DNA
caattcgactcactattg

SEQ ID NO: 7480 - DNA, 18 bp, synthetic construct
  source 1..18: mol_type = other DNA
tagtactactcactaaag

SEQ ID NO: 7481 - DNA, 18 bp, synthetic construct
  source 1..18: mol_type = other DNA
ttctacgactcactttag

SEQ ID NO: 7482 - DNA, 18 bp, synthetic construct
  source 1..18: mol_type = other DNA
acatacgactcaatatag

SEQ ID NO: 7483 - DNA, 18 bp, synthetic construct
  source 1..18: mol_type = other DNA
agatacgaatcactatag

SEQ ID NO: 7484 - DNA, 18 bp, synthetic construct
  source 1..18: mol_type = other DNA
taataagtctcaccatag

SEQ ID NO: 7485 - DNA, 18 bp, synthetic construct
  source 1..18: mol_type = other DNA
taatacgtctccttatag

SEQ ID NO: 7486 - DNA, 18 bp, synthetic construct
  source 1..18: mol_type = other DNA
taatactacccaatatag

SEQ ID NO: 7487 - DNA, 18 bp, synthetic construct
  source 1..18: mol_type = other DNA
taatagcactcacaatag

SEQ ID NO: 7488 - DNA, 18 bp, synthetic construct
  source 1..18: mol_type = other DNA
taatatgacttattatag

SEQ ID NO: 7489 - DNA, 18 bp, synthetic construct
  source 1..18: mol_type = other DNA
taatccgacttattatag

SEQ ID NO: 7490 - DNA, 18 bp, synthetic construct
  source 1..18: mol_type = other DNA
taatgcgacacattatag

SEQ ID NO: 7491 - DNA, 18 bp, synthetic construct
  source 1..18: mol_type = other DNA
tactacgaatctctatag

SEQ ID NO: 7492 - DNA, 18 bp, synthetic construct
  source 1..18: mol_type = other DNA
tattaagactcagtatag

SEQ ID NO: 7493 - DNA, 18 bp, synthetic construct
  source 1..18: mol_type = other DNA
tattatgactccctatag

SEQ ID NO: 7494 - DNA, 18 bp, synthetic construct
  source 1..18: mol_type = other DNA
tcataggtctcactatag

SEQ ID NO: 7495 - DNA, 18 bp, synthetic construct
  source 1..18: mol_type = other DNA
ttatactactcacgatag

SEQ ID NO: 7496 - DNA, 18 bp, synthetic construct
  source 1..18: mol_type = other DNA
taatacgactaaccatgg

SEQ ID NO: 7497 - DNA, 18 bp, synthetic construct
  source 1..18: mol_type = other DNA
taatacgacttacaatcg

SEQ ID NO: 7498 - DNA, 18 bp, synthetic construct
  source 1..18: mol_type = other DNA
taatactattcactctag

SEQ ID NO: 7499 - DNA, 18 bp, synthetic construct
  source 1..18: mol_type = other DNA
tactacgacacacaatag

SEQ ID NO: 7500 - DNA, 18 bp, synthetic construct
  source 1..18: mol_type = other DNA
tagtacaactcacaatag

SEQ ID NO: 7501 - DNA, 18 bp, synthetic construct
  source 1..18: mol_type = other DNA
ctatacgactcaatatag

SEQ ID NO: 7502 - DNA, 18 bp, synthetic construct
  source 1..18: mol_type = other DNA
taaaaccactcactatgg

SEQ ID NO: 7503 - DNA, 18 bp, synthetic construct
  source 1..18: mol_type = other DNA
taataacactcattatag

SEQ ID NO: 7504 - DNA, 18 bp, synthetic construct
  source 1..18: mol_type = other DNA
taataagacctactatag

SEQ ID NO: 7505 - DNA, 18 bp, synthetic construct
  source 1..18: mol_type = other DNA
taataagactgactattg

SEQ ID NO: 7506 - DNA, 18 bp, synthetic construct
  source 1..18: mol_type = other DNA
taataatactcactacag

SEQ ID NO: 7507 - DNA, 18 bp, synthetic construct
  source 1..18: mol_type = other DNA
taatacaacttaccatag

SEQ ID NO: 7508 - DNA, 18 bp, synthetic construct
  source 1..18: mol_type = other DNA
taatacgaatgtctatag

SEQ ID NO: 7509 - DNA, 18 bp, synthetic construct
  source 1..18: mol_type = other DNA
taatacgatttagtatag

SEQ ID NO: 7510 - DNA, 18 bp, synthetic construct
  source 1..18: mol_type = other DNA
taatacgcttcattatag

SEQ ID NO: 7511 - DNA, 18 bp, synthetic construct
  source 1..18: mol_type = other DNA
taatacgtcccaccatag

SEQ ID NO: 7512 - DNA, 18 bp, synthetic construct
  source 1..18: mol_type = other DNA
taatactaatcactatgg

SEQ ID NO: 7513 - DNA, 18 bp, synthetic construct
  source 1..18: mol_type = other DNA
taatactacacactagag

SEQ ID NO: 7514 - DNA, 18 bp, synthetic construct
  source 1..18: mol_type = other DNA
taatactactcactactg

SEQ ID NO: 7515 - DNA, 18 bp, synthetic construct
  source 1..18: mol_type = other DNA
taatccaactcattatag

SEQ ID NO: 7516 - DNA, 18 bp, synthetic construct
  source 1..18: mol_type = other DNA
taatgcgattcactctag

SEQ ID NO: 7517 - DNA, 18 bp, synthetic construct
  source 1..18: mol_type = other DNA
taattcgagccactatag

SEQ ID NO: 7518 - DNA, 18 bp, synthetic construct
  source 1..18: mol_type = other DNA
taattggactcactatgg

SEQ ID NO: 7519 - DNA, 18 bp, synthetic construct
  source 1..18: mol_type = other DNA
tactgctactcactatag

SEQ ID NO: 7520 - DNA, 18 bp, synthetic construct
  source 1..18: mol_type = other DNA
tagtacgacaaactatag

SEQ ID NO: 7521 - DNA, 18 bp, synthetic construct
  source 1..18: mol_type = other DNA
tattacgactccctgtag

SEQ ID NO: 7522 - DNA, 18 bp, synthetic construct
  source 1..18: mol_type = other DNA
tgatacgacaccctatag

SEQ ID NO: 7523 - DNA, 18 bp, synthetic construct
  source 1..18: mol_type = other DNA
ttataccagtcactatag

SEQ ID NO: 7524 - DNA, 18 bp, synthetic construct
  source 1..18: mol_type = other DNA
aaataccacccactatag

SEQ ID NO: 7525 - DNA, 18 bp, synthetic construct
  source 1..18: mol_type = other DNA
aaataggacccactatag

SEQ ID NO: 7526 - DNA, 18 bp, synthetic construct
  source 1..18: mol_type = other DNA
caagaagactcactatag

SEQ ID NO: 7527 - DNA, 18 bp, synthetic construct
  source 1..18: mol_type = other DNA
caatacgaatcagtatag

SEQ ID NO: 7528 - DNA, 18 bp, synthetic construct
  source 1..18: mol_type = other DNA
caatacgactccctaaag

SEQ ID NO: 7529 - DNA, 18 bp, synthetic construct
  source 1..18: mol_type = other DNA
caatacggatcactatag

SEQ ID NO: 7530 - DNA, 18 bp, synthetic construct
  source 1..18: mol_type = other DNA
caatacgtcccactatag

SEQ ID NO: 7531 - DNA, 18 bp, synthetic construct
  source 1..18: mol_type = other DNA
caatccgactgactatag

SEQ ID NO: 7532 - DNA, 18 bp, synthetic construct
  source 1..18: mol_type = other DNA
gaacacgacacactatag

SEQ ID NO: 7533 - DNA, 18 bp, synthetic construct
  source 1..18: mol_type = other DNA
gaatatgtctcactatag

SEQ ID NO: 7534 - DNA, 18 bp, synthetic construct
  source 1..18: mol_type = other DNA
gcttacgactcactatag

SEQ ID NO: 7535 - DNA, 18 bp, synthetic construct
  source 1..18: mol_type = other DNA
taaaacgcgtcactatag

SEQ ID NO: 7536 - DNA, 18 bp, synthetic construct
  source 1..18: mol_type = other DNA
taacacgactcactaacg

SEQ ID NO: 7537 - DNA, 18 bp, synthetic construct
  source 1..18: mol_type = other DNA
taacccgactcacaatag

SEQ ID NO: 7538 - DNA, 18 bp, synthetic construct
  source 1..18: mol_type = other DNA
taagacgactctatatag

SEQ ID NO: 7539 - DNA, 18 bp, synthetic construct
  source 1..18: mol_type = other DNA
taagacgtctcactgtag

SEQ ID NO: 7540 - DNA, 18 bp, synthetic construct
  source 1..18: mol_type = other DNA
taataaaactgactatag

SEQ ID NO: 7541 - DNA, 18 bp, synthetic construct
  source 1..18: mol_type = other DNA
taataagactaactctag

SEQ ID NO: 7542 - DNA, 18 bp, synthetic construct
  source 1..18: mol_type = other DNA
taatacaaatccctatag

SEQ ID NO: 7543 - DNA, 18 bp, synthetic construct
  source 1..18: mol_type = other DNA
taatacaactcgcaatag

SEQ ID NO: 7544 - DNA, 18 bp, synthetic construct
  source 1..18: mol_type = other DNA
taataccaatccctatag

SEQ ID NO: 7545 - DNA, 18 bp, synthetic construct
  source 1..18: mol_type = other DNA
taataccactcagtacag

SEQ ID NO: 7546 - DNA, 18 bp, synthetic construct
  source 1..18: mol_type = other DNA
taataccagacactatag

SEQ ID NO: 7547 - DNA, 18 bp, synthetic construct
  source 1..18: mol_type = other DNA
taatacgaccgtctatag

SEQ ID NO: 7548 - DNA, 18 bp, synthetic construct
  source 1..18: mol_type = other DNA
taatacgactacctctag

SEQ ID NO: 7549 - DNA, 18 bp, synthetic construct
  source 1..18: mol_type = other DNA
taatacgactcactgcgg

SEQ ID NO: 7550 - DNA, 18 bp, synthetic construct
  source 1..18: mol_type = other DNA
taatacgactcacttgcg

SEQ ID NO: 7551 - DNA, 18 bp, synthetic construct
  source 1..18: mol_type = other DNA
taatacgactggctaaag

SEQ ID NO: 7552 - DNA, 18 bp, synthetic construct
  source 1..18: mol_type = other DNA
taatacgagtcactaagg

SEQ ID NO: 7553 - DNA, 18 bp, synthetic construct
  source 1..18: mol_type = other DNA
taatacgcccgactatag

SEQ ID NO: 7554 - DNA, 18 bp, synthetic construct
  source 1..18: mol_type = other DNA
taatacggctcaatctag

SEQ ID NO: 7555 - DNA, 18 bp, synthetic construct
  source 1..18: mol_type = other DNA
taatactactcagtatcg

SEQ ID NO: 7556 - DNA, 18 bp, synthetic construct
  source 1..18: mol_type = other DNA
taataggattcactatgg

SEQ ID NO: 7557 - DNA, 18 bp, synthetic construct
  source 1..18: mol_type = other DNA
taatagggctcgctatag

SEQ ID NO: 7558 - DNA, 18 bp, synthetic construct
  source 1..18: mol_type = other DNA
taatatgaatcactctag

SEQ ID NO: 7559 - DNA, 18 bp, synthetic construct
  source 1..18: mol_type = other DNA
taatatgactcactaggg

SEQ ID NO: 7560 - DNA, 18 bp, synthetic construct
  source 1..18: mol_type = other DNA
taatattactgactatag

SEQ ID NO: 7561 - DNA, 18 bp, synthetic construct
  source 1..18: mol_type = other DNA
taatccgactcaccttag

SEQ ID NO: 7562 - DNA, 18 bp, synthetic construct
  source 1..18: mol_type = other DNA
taatgagaatcactatag

SEQ ID NO: 7563 - DNA, 18 bp, synthetic construct
  source 1..18: mol_type = other DNA
taatgcgactcgctatgg

SEQ ID NO: 7564 - DNA, 18 bp, synthetic construct
  source 1..18: mol_type = other DNA
taattcgacccgctatag

SEQ ID NO: 7565 - DNA, 18 bp, synthetic construct
  source 1..18: mol_type = other DNA
tactacgactacctatag

SEQ ID NO: 7566 - DNA, 18 bp, synthetic construct
  source 1..18: mol_type = other DNA
tactacgactcagaatag

SEQ ID NO: 7567 - DNA, 18 bp, synthetic construct
  source 1..18: mol_type = other DNA
tactacgattccctatag

SEQ ID NO: 7568 - DNA, 18 bp, synthetic construct
  source 1..18: mol_type = other DNA
tactacggctcactatgg

SEQ ID NO: 7569 - DNA, 18 bp, synthetic construct
  source 1..18: mol_type = other DNA
tagtaagactgactatag

SEQ ID NO: 7570 - DNA, 18 bp, synthetic construct
  source 1..18: mol_type = other DNA
tagtacgactcaatatcg

SEQ ID NO: 7571 - DNA, 18 bp, synthetic construct
  source 1..18: mol_type = other DNA
tatcacgactcactagag

SEQ ID NO: 7572 - DNA, 18 bp, synthetic construct
  source 1..18: mol_type = other DNA
tattacgaccgactatag

SEQ ID NO: 7573 - DNA, 18 bp, synthetic construct
  source 1..18: mol_type = other DNA
tcacacgactcactatgg

SEQ ID NO: 7574 - DNA, 18 bp, synthetic construct
  source 1..18: mol_type = other DNA
tcacacgactgactatag

SEQ ID NO: 7575 - DNA, 18 bp, synthetic construct
  source 1..18: mol_type = other DNA
tcatacgacccactgtag

SEQ ID NO: 7576 - DNA, 18 bp, synthetic construct
  source 1..18: mol_type = other DNA
tcatacgacgcacaatag

SEQ ID NO: 7577 - DNA, 18 bp, synthetic construct
  source 1..18: mol_type = other DNA
tcatacgacgcactattg

SEQ ID NO: 7578 - DNA, 18 bp, synthetic construct
  source 1..18: mol_type = other DNA
tcttacgactcaccatag

SEQ ID NO: 7579 - DNA, 18 bp, synthetic construct
  source 1..18: mol_type = other DNA
tcttacgactcactatgg

SEQ ID NO: 7580 - DNA, 18 bp, synthetic construct
  source 1..18: mol_type = other DNA
tgagacgacacactatag

SEQ ID NO: 7581 - DNA, 18 bp, synthetic construct
  source 1..18: mol_type = other DNA
tgatacgactcacgttag

SEQ ID NO: 7582 - DNA, 18 bp, synthetic construct
  source 1..18: mol_type = other DNA
tgatacggctcactaaag

SEQ ID NO: 7583 - DNA, 18 bp, synthetic construct
  source 1..18: mol_type = other DNA
tgataggaatcactatag

SEQ ID NO: 7584 - DNA, 18 bp, synthetic construct
  source 1..18: mol_type = other DNA
tgataggactcactattg

SEQ ID NO: 7585 - DNA, 18 bp, synthetic construct
  source 1..18: mol_type = other DNA
tgctacgactcactatcg

SEQ ID NO: 7586 - DNA, 18 bp, synthetic construct
  source 1..18: mol_type = other DNA
tggtacgactcacaatag

SEQ ID NO: 7587 - DNA, 18 bp, synthetic construct
  source 1..18: mol_type = other DNA
ttagacgacccactatag

SEQ ID NO: 7588 - DNA, 18 bp, synthetic construct
  source 1..18: mol_type = other DNA
ttatgcggctcactatag

SEQ ID NO: 7589 - DNA, 18 bp, synthetic construct
  source 1..18: mol_type = other DNA
taaaacgtctcacaatag

SEQ ID NO: 7590 - DNA, 18 bp, synthetic construct
  source 1..18: mol_type = other DNA
tattacgacactctatag

SEQ ID NO: 7591 - DNA, 18 bp, synthetic construct
  source 1..18: mol_type = other DNA
taaaacgactcaatttag

SEQ ID NO: 7592 - DNA, 18 bp, synthetic construct
  source 1..18: mol_type = other DNA
taattctaatcactatag

SEQ ID NO: 7593 - DNA, 18 bp, synthetic construct
  source 1..18: mol_type = other DNA
tcattcgactcactattg

SEQ ID NO: 7594 - DNA, 18 bp, synthetic construct
  source 1..18: mol_type = other DNA
caatacgattcactttag

SEQ ID NO: 7595 - DNA, 18 bp, synthetic construct
  source 1..18: mol_type = other DNA
taatacgaatcagtattg

SEQ ID NO: 7596 - DNA, 18 bp, synthetic construct
  source 1..18: mol_type = other DNA
taatacgacaccctattg

SEQ ID NO: 7597 - DNA, 18 bp, synthetic construct
  source 1..18: mol_type = other DNA
taatacgactcagtatta

SEQ ID NO: 7598 - DNA, 18 bp, synthetic construct
  source 1..18: mol_type = other DNA
tatttcggctcactatag

SEQ ID NO: 7599 - DNA, 18 bp, synthetic construct
  source 1..18: mol_type = other DNA
aaatactactcactaaag

SEQ ID NO: 7600 - DNA, 18 bp, synthetic construct
  source 1..18: mol_type = other DNA
aattatgactcactatag

SEQ ID NO: 7601 - DNA, 18 bp, synthetic construct
  source 1..18: mol_type = other DNA
taatacatctcattatag

SEQ ID NO: 7602 - DNA, 18 bp, synthetic construct
  source 1..18: mol_type = other DNA
taatacgtttcaatatag

SEQ ID NO: 7603 - DNA, 18 bp, synthetic construct
  source 1..18: mol_type = other DNA
taatactacttactattg

SEQ ID NO: 7604 - DNA, 18 bp, synthetic construct
  source 1..18: mol_type = other DNA
taatccgactctctttag

SEQ ID NO: 7605 - DNA, 18 bp, synthetic construct
  source 1..18: mol_type = other DNA
taatacgactttctaaag

SEQ ID NO: 7606 - DNA, 18 bp, synthetic construct
  source 1..18: mol_type = other DNA
aaatacgactctctgtag

SEQ ID NO: 7607 - DNA, 18 bp, synthetic construct
  source 1..18: mol_type = other DNA
taaaacgaattactatag

SEQ ID NO: 7608 - DNA, 18 bp, synthetic construct
  source 1..18: mol_type = other DNA
taatacgacacacactag

SEQ ID NO: 7609 - DNA, 18 bp, synthetic construct
  source 1..18: mol_type = other DNA
taatacgacccacttaag

SEQ ID NO: 7610 - DNA, 18 bp, synthetic construct
  source 1..18: mol_type = other DNA
taatacgagacattatag

SEQ ID NO: 7611 - DNA, 18 bp, synthetic construct
  source 1..18: mol_type = other DNA
taatacgcctcaatattg

SEQ ID NO: 7612 - DNA, 18 bp, synthetic construct
  source 1..18: mol_type = other DNA
tagcacgactcactttag

SEQ ID NO: 7613 - DNA, 18 bp, synthetic construct
  source 1..18: mol_type = other DNA
tagtactattcactatag

SEQ ID NO: 7614 - DNA, 18 bp, synthetic construct
  source 1..18: mol_type = other DNA
tcatacgactctccatag

SEQ ID NO: 7615 - DNA, 18 bp, synthetic construct
  source 1..18: mol_type = other DNA
ttatacgacttactagag

SEQ ID NO: 7616 - DNA, 18 bp, synthetic construct
  source 1..18: mol_type = other DNA
tattacgattcacaatag

SEQ ID NO: 7617 - DNA, 18 bp, synthetic construct
  source 1..18: mol_type = other DNA
tattacgtctcattatag

SEQ ID NO: 7618 - DNA, 18 bp, synthetic construct
  source 1..18: mol_type = other DNA
aaataaaactcactatag

SEQ ID NO: 7619 - DNA, 18 bp, synthetic construct
  source 1..18: mol_type = other DNA
taatacgactcacatgag

SEQ ID NO: 7620 - DNA, 18 bp, synthetic construct
  source 1..18: mol_type = other DNA
aaatacgacttactattg

SEQ ID NO: 7621 - DNA, 18 bp, synthetic construct
  source 1..18: mol_type = other DNA
aaatattactcactatag

SEQ ID NO: 7622 - DNA, 18 bp, synthetic construct
  source 1..18: mol_type = other DNA
taatacgactctatttag

SEQ ID NO: 7623 - DNA, 18 bp, synthetic construct
  source 1..18: mol_type = other DNA
taatacgactctccttag

SEQ ID NO: 7624 - DNA, 18 bp, synthetic construct
  source 1..18: mol_type = other DNA
taatacgaattaatatag

SEQ ID NO: 7625 - DNA, 18 bp, synthetic construct
  source 1..18: mol_type = other DNA
taatacgtctcattatcg

SEQ ID NO: 7626 - DNA, 18 bp, synthetic construct
  source 1..18: mol_type = other DNA
taatacgtctctctacag

SEQ ID NO: 7627 - DNA, 18 bp, synthetic construct
  source 1..18: mol_type = other DNA
caatacgactccctttag

SEQ ID NO: 7628 - DNA, 18 bp, synthetic construct
  source 1..18: mol_type = other DNA
caatacgactgactaaag

SEQ ID NO: 7629 - DNA, 18 bp, synthetic construct
  source 1..18: mol_type = other DNA
ccatacgattcactatag

SEQ ID NO: 7630 - DNA, 18 bp, synthetic construct
  source 1..18: mol_type = other DNA
taaaaacactcactatag

SEQ ID NO: 7631 - DNA, 18 bp, synthetic construct
  source 1..18: mol_type = other DNA
taaaacgagtcactacag

SEQ ID NO: 7632 - DNA, 18 bp, synthetic construct
  source 1..18: mol_type = other DNA
taacaagattcactatag

SEQ ID NO: 7633 - DNA, 18 bp, synthetic construct
  source 1..18: mol_type = other DNA
taacacgaatccctatag

SEQ ID NO: 7634 - DNA, 18 bp, synthetic construct
  source 1..18: mol_type = other DNA
taacacgactcacaagag

SEQ ID NO: 7635 - DNA, 18 bp, synthetic construct
  source 1..18: mol_type = other DNA
taatacaacgctctatag

SEQ ID NO: 7636 - DNA, 18 bp, synthetic construct
  source 1..18: mol_type = other DNA
taatacgacacacgttag

SEQ ID NO: 7637 - DNA, 18 bp, synthetic construct
  source 1..18: mol_type = other DNA
taatacgagtctctacag

SEQ ID NO: 7638 - DNA, 18 bp, synthetic construct
  source 1..18: mol_type = other DNA
taatacgcaacactatag

SEQ ID NO: 7639 - DNA, 18 bp, synthetic construct
  source 1..18: mol_type = other DNA
taatacggatcactattg

SEQ ID NO: 7640 - DNA, 18 bp, synthetic construct
  source 1..18: mol_type = other DNA
taatacgtcgcactttag

SEQ ID NO: 7641 - DNA, 18 bp, synthetic construct
  source 1..18: mol_type = other DNA
taatacgtctaactctag

SEQ ID NO: 7642 - DNA, 18 bp, synthetic construct
  source 1..18: mol_type = other DNA
taatactacgcacaatag

SEQ ID NO: 7643 - DNA, 18 bp, synthetic construct
  source 1..18: mol_type = other DNA
taatccgactaactattg

SEQ ID NO: 7644 - DNA, 18 bp, synthetic construct
  source 1..18: mol_type = other DNA
taatctgactcaatatag

SEQ ID NO: 7645 - DNA, 18 bp, synthetic construct
  source 1..18: mol_type = other DNA
taatgcaacacactatag

SEQ ID NO: 7646 - DNA, 18 bp, synthetic construct
  source 1..18: mol_type = other DNA
taattggactaactatag

SEQ ID NO: 7647 - DNA, 18 bp, synthetic construct
  source 1..18: mol_type = other DNA
tagtacgactcactatta

SEQ ID NO: 7648 - DNA, 18 bp, synthetic construct
  source 1..18: mol_type = other DNA
tattagggctcactatag

SEQ ID NO: 7649 - DNA, 18 bp, synthetic construct
  source 1..18: mol_type = other DNA
tgataagactccctatag

SEQ ID NO: 7650 - DNA, 18 bp, synthetic construct
  source 1..18: mol_type = other DNA
tgattagactcactatag

SEQ ID NO: 7651 - DNA, 18 bp, synthetic construct
  source 1..18: mol_type = other DNA
tgttacgactccctatag

SEQ ID NO: 7652 - DNA, 18 bp, synthetic construct
  source 1..18: mol_type = other DNA
ttatacgactagctatag

SEQ ID NO: 7653 - DNA, 18 bp, synthetic construct
  source 1..18: mol_type = other DNA
ttatacgagtcactctag

SEQ ID NO: 7654 - DNA, 18 bp, synthetic construct
  source 1..18: mol_type = other DNA
taatatgtctcactattg

SEQ ID NO: 7655 - DNA, 18 bp, synthetic construct
  source 1..18: mol_type = other DNA
taatacgattcaaaatag

SEQ ID NO: 7656 - DNA, 18 bp, synthetic construct
  source 1..18: mol_type = other DNA
tagttcgactcactattg

SEQ ID NO: 7657 - DNA, 18 bp, synthetic construct
  source 1..18: mol_type = other DNA
tattacgactcacagtag

SEQ ID NO: 7658 - DNA, 18 bp, synthetic construct
  source 1..18: mol_type = other DNA
ttaaacgactccctatag

SEQ ID NO: 7659 - DNA, 18 bp, synthetic construct
  source 1..18: mol_type = other DNA
tattacgactcaaaatag

SEQ ID NO: 7660 - DNA, 18 bp, synthetic construct
  source 1..18: mol_type = other DNA
taaaacgtcacactatag

SEQ ID NO: 7661 - DNA, 18 bp, synthetic construct
  source 1..18: mol_type = other DNA
aaatacgacccactaaag

SEQ ID NO: 7662 - DNA, 18 bp, synthetic construct
  source 1..18: mol_type = other DNA
aaatccgaatcactatag

SEQ ID NO: 7663 - DNA, 18 bp, synthetic construct
  source 1..18: mol_type = other DNA
taacacgcctctctatag

SEQ ID NO: 7664 - DNA, 18 bp, synthetic construct
  source 1..18: mol_type = other DNA
taatacgactcattgttg

SEQ ID NO: 7665 - DNA, 18 bp, synthetic construct
  source 1..18: mol_type = other DNA
taatacgtcgcactaaag

SEQ ID NO: 7666 - DNA, 18 bp, synthetic construct
  source 1..18: mol_type = other DNA
taatcctactcaatatag

SEQ ID NO: 7667 - DNA, 18 bp, synthetic construct
  source 1..18: mol_type = other DNA
taattcgactcagaatag

SEQ ID NO: 7668 - DNA, 18 bp, synthetic construct
  source 1..18: mol_type = other DNA
tagtacgtttcactatag

SEQ ID NO: 7669 - DNA, 18 bp, synthetic construct
  source 1..18: mol_type = other DNA
tattacgactcactgtcg

SEQ ID NO: 7670 - DNA, 18 bp, synthetic construct
  source 1..18: mol_type = other DNA
ttatacgacttactacag

SEQ ID NO: 7671 - DNA, 18 bp, synthetic construct
  source 1..18: mol_type = other DNA
taagacgtcacactatag

SEQ ID NO: 7672 - DNA, 18 bp, synthetic construct
  source 1..18: mol_type = other DNA
taatacgtctagctatag

SEQ ID NO: 7673 - DNA, 18 bp, synthetic construct
  source 1..18: mol_type = other DNA
taatacgtctcgttatag

SEQ ID NO: 7674 - DNA, 18 bp, synthetic construct
  source 1..18: mol_type = other DNA
taattcgactaattatag

SEQ ID NO: 7675 - DNA, 18 bp, synthetic construct
  source 1..18: mol_type = other DNA
tattacgactcaatctag

SEQ ID NO: 7676 - DNA, 18 bp, synthetic construct
  source 1..18: mol_type = other DNA
tcatacgactcacaaaag

SEQ ID NO: 7677 - DNA, 18 bp, synthetic construct
  source 1..18: mol_type = other DNA
tataacgactcacaatag

SEQ ID NO: 7678 - DNA, 18 bp, synthetic construct
  source 1..18: mol_type = other DNA
atatacgactcactctag

SEQ ID NO: 7679 - DNA, 18 bp, synthetic construct
  source 1..18: mol_type = other DNA
taataaaactcacaatag

SEQ ID NO: 7680 - DNA, 18 bp, synthetic construct
  source 1..18: mol_type = other DNA
tgaaacgactctctatag

SEQ ID NO: 7681 - DNA, 18 bp, synthetic construct
  source 1..18: mol_type = other DNA
taataagtctcactattg

SEQ ID NO: 7682 - DNA, 18 bp, synthetic construct
  source 1..18: mol_type = other DNA
ttataagactcaatatag

SEQ ID NO: 7683 - DNA, 18 bp, synthetic construct
  source 1..18: mol_type = other DNA
tcatacgactctctaaag

SEQ ID NO: 7684 - DNA, 18 bp, synthetic construct
  source 1..18: mol_type = other DNA
taatacgtatcactaaag

SEQ ID NO: 7685 - DNA, 18 bp, synthetic construct
  source 1..18: mol_type = other DNA
tattacgattctctatag

SEQ ID NO: 7686 - DNA, 18 bp, synthetic construct
  source 1..18: mol_type = other DNA
taatacgacacacaacag

SEQ ID NO: 7687 - DNA, 18 bp, synthetic construct
  source 1..18: mol_type = other DNA
taaagcgattcactatag

SEQ ID NO: 7688 - DNA, 18 bp, synthetic construct
  source 1..18: mol_type = other DNA
taatacgactcaatgaag

SEQ ID NO: 7689 - DNA, 18 bp, synthetic construct
  source 1..18: mol_type = other DNA
taatactacacactgtag

SEQ ID NO: 7690 - DNA, 18 bp, synthetic construct
  source 1..18: mol_type = other DNA
taatactactcaacatag

SEQ ID NO: 7691 - DNA, 18 bp, synthetic construct
  source 1..18: mol_type = other DNA
taatactagtcactttag

SEQ ID NO: 7692 - DNA, 18 bp, synthetic construct
  source 1..18: mol_type = other DNA
taatgcgaatcactattg

SEQ ID NO: 7693 - DNA, 18 bp, synthetic construct
  source 1..18: mol_type = other DNA
taattcaactgactatag

SEQ ID NO: 7694 - DNA, 18 bp, synthetic construct
  source 1..18: mol_type = other DNA
taattggacccactatag

SEQ ID NO: 7695 - DNA, 18 bp, synthetic construct
  source 1..18: mol_type = other DNA
taatttgactccctatag

SEQ ID NO: 7696 - DNA, 18 bp, synthetic construct
  source 1..18: mol_type = other DNA
tactaagactcactattg

SEQ ID NO: 7697 - DNA, 18 bp, synthetic construct
  source 1..18: mol_type = other DNA
tagtacgattcactatcg

SEQ ID NO: 7698 - DNA, 18 bp, synthetic construct
  source 1..18: mol_type = other DNA
tagtatgacacactatag

SEQ ID NO: 7699 - DNA, 18 bp, synthetic construct
  source 1..18: mol_type = other DNA
tattacgactcacgaaag

SEQ ID NO: 7700 - DNA, 18 bp, synthetic construct
  source 1..18: mol_type = other DNA
ttataagactcactgtag

SEQ ID NO: 7701 - DNA, 18 bp, synthetic construct
  source 1..18: mol_type = other DNA
ttatacgtctcacgatag

SEQ ID NO: 7702 - DNA, 18 bp, synthetic construct
  source 1..18: mol_type = other DNA
taatactactcattattg

SEQ ID NO: 7703 - DNA, 18 bp, synthetic construct
  source 1..18: mol_type = other DNA
taattttactcactatag

SEQ ID NO: 7704 - DNA, 18 bp, synthetic construct
  source 1..18: mol_type = other DNA
taaaacgtctcattatag

SEQ ID NO: 7705 - DNA, 18 bp, synthetic construct
  source 1..18: mol_type = other DNA
taatacaactcaatattg

SEQ ID NO: 7706 - DNA, 18 bp, synthetic construct
  source 1..18: mol_type = other DNA
taataggaatcacaatag

SEQ ID NO: 7707 - DNA, 18 bp, synthetic construct
  source 1..18: mol_type = other DNA
taatacgactaaccattg

SEQ ID NO: 7708 - DNA, 18 bp, synthetic construct
  source 1..18: mol_type = other DNA
taatacgtctcatgatag

SEQ ID NO: 7709 - DNA, 18 bp, synthetic construct
  source 1..18: mol_type = other DNA
tattacgaataactatag

SEQ ID NO: 7710 - DNA, 18 bp, synthetic construct
  source 1..18: mol_type = other DNA
aaatacgacacactagag

SEQ ID NO: 7711 - DNA, 18 bp, synthetic construct
  source 1..18: mol_type = other DNA
aaatacgactcactatta

SEQ ID NO: 7712 - DNA, 18 bp, synthetic construct
  source 1..18: mol_type = other DNA
aaatactactgactatag

SEQ ID NO: 7713 - DNA, 18 bp, synthetic construct
  source 1..18: mol_type = other DNA
aaattcgactccctatag

SEQ ID NO: 7714 - DNA, 18 bp, synthetic construct
  source 1..18: mol_type = other DNA
aattacggctcactatag

SEQ ID NO: 7715 - DNA, 18 bp, synthetic construct
  source 1..18: mol_type = other DNA
caatacgactcacagtag

SEQ ID NO: 7716 - DNA, 18 bp, synthetic construct
  source 1..18: mol_type = other DNA
taaaacgagtcaccatag

SEQ ID NO: 7717 - DNA, 18 bp, synthetic construct
  source 1..18: mol_type = other DNA
taaagcgactcattatag

SEQ ID NO: 7718 - DNA, 18 bp, synthetic construct
  source 1..18: mol_type = other DNA
taaatcgactccctatag

SEQ ID NO: 7719 - DNA, 18 bp, synthetic construct
  source 1..18: mol_type = other DNA
taatacgaatctctagag

SEQ ID NO: 7720 - DNA, 18 bp, synthetic construct
  source 1..18: mol_type = other DNA
taatacgactctcgattg

SEQ ID NO: 7721 - DNA, 18 bp, synthetic construct
  source 1..18: mol_type = other DNA
taatacgacttacaatgg

SEQ ID NO: 7722 - DNA, 18 bp, synthetic construct
  source 1..18: mol_type = other DNA
taatacgtcccgctatag

SEQ ID NO: 7723 - DNA, 18 bp, synthetic construct
  source 1..18: mol_type = other DNA
taatacttctgactatag

SEQ ID NO: 7724 - DNA, 18 bp, synthetic construct
  source 1..18: mol_type = other DNA
taataggactaactttag

SEQ ID NO: 7725 - DNA, 18 bp, synthetic construct
  source 1..18: mol_type = other DNA
taattcgagttactatag

SEQ ID NO: 7726 - DNA, 18 bp, synthetic construct
  source 1..18: mol_type = other DNA
tactaagtctcactatag

SEQ ID NO: 7727 - DNA, 18 bp, synthetic construct
  source 1..18: mol_type = other DNA
tagtacgactagctatag

SEQ ID NO: 7728 - DNA, 18 bp, synthetic construct
  source 1..18: mol_type = other DNA
tattaccactcaatatag

SEQ ID NO: 7729 - DNA, 18 bp, synthetic construct
  source 1..18: mol_type = other DNA
tattacgagtcaatatag

SEQ ID NO: 7730 - DNA, 18 bp, synthetic construct
  source 1..18: mol_type = other DNA
tgatacaactcactattg

SEQ ID NO: 7731 - DNA, 18 bp, synthetic construct
  source 1..18: mol_type = other DNA
tgatacgactcgctttag

SEQ ID NO: 7732 - DNA, 18 bp, synthetic construct
  source 1..18: mol_type = other DNA
tgttacgactcactacag

SEQ ID NO: 7733 - DNA, 18 bp, synthetic construct
  source 1..18: mol_type = other DNA
ttataccacgcactatag

SEQ ID NO: 7734 - DNA, 18 bp, synthetic construct
  source 1..18: mol_type = other DNA
ttgcacgactcactatag

SEQ ID NO: 7735 - DNA, 18 bp, synthetic construct
  source 1..18: mol_type = other DNA
aaaaacgactcactatgg

SEQ ID NO: 7736 - DNA, 18 bp, synthetic construct
  source 1..18: mol_type = other DNA
aaataagactcgctatag

SEQ ID NO: 7737 - DNA, 18 bp, synthetic construct
  source 1..18: mol_type = other DNA
aaataccactgactatag

SEQ ID NO: 7738 - DNA, 18 bp, synthetic construct
  source 1..18: mol_type = other DNA
aaataccagtcactatag

SEQ ID NO: 7739 - DNA, 18 bp, synthetic construct
  source 1..18: mol_type = other DNA
aaatacgacccacgatag

SEQ ID NO: 7740 - DNA, 18 bp, synthetic construct
  source 1..18: mol_type = other DNA
aaatacgacgcactattg

SEQ ID NO: 7741 - DNA, 18 bp, synthetic construct
  source 1..18: mol_type = other DNA
aaatacgactcactgtac

SEQ ID NO: 7742 - DNA, 18 bp, synthetic construct
  source 1..18: mol_type = other DNA
aaatacgattcactagag

SEQ ID NO: 7743 - DNA, 18 bp, synthetic construct
  source 1..18: mol_type = other DNA
aactacgactcactatcg

SEQ ID NO: 7744 - DNA, 18 bp, synthetic construct
  source 1..18: mol_type = other DNA
aactacgactccctatag

SEQ ID NO: 7745 - DNA, 18 bp, synthetic construct
  source 1..18: mol_type = other DNA
caataagacttactatag

SEQ ID NO: 7746 - DNA, 18 bp, synthetic construct
  source 1..18: mol_type = other DNA
caataccactcactattg

SEQ ID NO: 7747 - DNA, 18 bp, synthetic construct
  source 1..18: mol_type = other DNA
caatacgactcatcatag

SEQ ID NO: 7748 - DNA, 18 bp, synthetic construct
  source 1..18: mol_type = other DNA
cagtacgactctctatag

SEQ ID NO: 7749 - DNA, 18 bp, synthetic construct
  source 1..18: mol_type = other DNA
cattacgcctcactatag

SEQ ID NO: 7750 - DNA, 18 bp, synthetic construct
  source 1..18: mol_type = other DNA
ccatacgactcactagag

SEQ ID NO: 7751 - DNA, 18 bp, synthetic construct
  source 1..18: mol_type = other DNA
gaatactactcactattg

SEQ ID NO: 7752 - DNA, 18 bp, synthetic construct
  source 1..18: mol_type = other DNA
gaattcgactaactatag

SEQ ID NO: 7753 - DNA, 18 bp, synthetic construct
  source 1..18: mol_type = other DNA
taaaacgactgactacag

SEQ ID NO: 7754 - DNA, 18 bp, synthetic construct
  source 1..18: mol_type = other DNA
taaaccgactccctatag

SEQ ID NO: 7755 - DNA, 18 bp, synthetic construct
  source 1..18: mol_type = other DNA
taacacgacgcacaatag

SEQ ID NO: 7756 - DNA, 18 bp, synthetic construct
  source 1..18: mol_type = other DNA
taacacgactcagtatgg

SEQ ID NO: 7757 - DNA, 18 bp, synthetic construct
  source 1..18: mol_type = other DNA
taagactactgactatag

SEQ ID NO: 7758 - DNA, 18 bp, synthetic construct
  source 1..18: mol_type = other DNA
taaggcgactcacaatag

SEQ ID NO: 7759 - DNA, 18 bp, synthetic construct
  source 1..18: mol_type = other DNA
taataagaatcactagag

SEQ ID NO: 7760 - DNA, 18 bp, synthetic construct
  source 1..18: mol_type = other DNA
taatacgaatcacgagag

SEQ ID NO: 7761 - DNA, 18 bp, synthetic construct
  source 1..18: mol_type = other DNA
taatacgacaaactgtag

SEQ ID NO: 7762 - DNA, 18 bp, synthetic construct
  source 1..18: mol_type = other DNA
taatacgaccctctacag

SEQ ID NO: 7763 - DNA, 18 bp, synthetic construct
  source 1..18: mol_type = other DNA
taatacgacctaatatag

SEQ ID NO: 7764 - DNA, 18 bp, synthetic construct
  source 1..18: mol_type = other DNA
taatacgactctcgacag

SEQ ID NO: 7765 - DNA, 18 bp, synthetic construct
  source 1..18: mol_type = other DNA
taatacgactgaatgtag

SEQ ID NO: 7766 - DNA, 18 bp, synthetic construct
  source 1..18: mol_type = other DNA
taatacgagtcattatcg

SEQ ID NO: 7767 - DNA, 18 bp, synthetic construct
  source 1..18: mol_type = other DNA
taatacgattcaatagag

SEQ ID NO: 7768 - DNA, 18 bp, synthetic construct
  source 1..18: mol_type = other DNA
taatacgattgaatatag

SEQ ID NO: 7769 - DNA, 18 bp, synthetic construct
  source 1..18: mol_type = other DNA
taatacgccccactacag

SEQ ID NO: 7770 - DNA, 18 bp, synthetic construct
  source 1..18: mol_type = other DNA
taatacgccccactgtag

SEQ ID NO: 7771 - DNA, 18 bp, synthetic construct
  source 1..18: mol_type = other DNA
taatacgcctcattagag

SEQ ID NO: 7772 - DNA, 18 bp, synthetic construct
  source 1..18: mol_type = other DNA
taatacggcccacaatag

SEQ ID NO: 7773 - DNA, 18 bp, synthetic construct
  source 1..18: mol_type = other DNA
taatactaatccctatag

SEQ ID NO: 7774 - DNA, 18 bp, synthetic construct
  source 1..18: mol_type = other DNA
taatactactcactgtcg

SEQ ID NO: 7775 - DNA, 18 bp, synthetic construct
  source 1..18: mol_type = other DNA
taatatgcctcaccatag

SEQ ID NO: 7776 - DNA, 18 bp, synthetic construct
  source 1..18: mol_type = other DNA
taatccgaattactatag

SEQ ID NO: 7777 - DNA, 18 bp, synthetic construct
  source 1..18: mol_type = other DNA
taatccgactgactattg

SEQ ID NO: 7778 - DNA, 18 bp, synthetic construct
  source 1..18: mol_type = other DNA
taatgcgactcagtacag

SEQ ID NO: 7779 - DNA, 18 bp, synthetic construct
  source 1..18: mol_type = other DNA
taatgcgagtcacgatag

SEQ ID NO: 7780 - DNA, 18 bp, synthetic construct
  source 1..18: mol_type = other DNA
taattcggctcactgtag

SEQ ID NO: 7781 - DNA, 18 bp, synthetic construct
  source 1..18: mol_type = other DNA
tacaacgacccactatag

SEQ ID NO: 7782 - DNA, 18 bp, synthetic construct
  source 1..18: mol_type = other DNA
tactacgacccactattg

SEQ ID NO: 7783 - DNA, 18 bp, synthetic construct
  source 1..18: mol_type = other DNA
tactacgactcaccttag

SEQ ID NO: 7784 - DNA, 18 bp, synthetic construct
  source 1..18: mol_type = other DNA
tactaggactcactattg

SEQ ID NO: 7785 - DNA, 18 bp, synthetic construct
  source 1..18: mol_type = other DNA
tactgcgacttactatag

SEQ ID NO: 7786 - DNA, 18 bp, synthetic construct
  source 1..18: mol_type = other DNA
tagtacgactcagaatag

SEQ ID NO: 7787 - DNA, 18 bp, synthetic construct
  source 1..18: mol_type = other DNA
tagtacgactcgcaatag

SEQ ID NO: 7788 - DNA, 18 bp, synthetic construct
  source 1..18: mol_type = other DNA
tattacgacgcactatgg

SEQ ID NO: 7789 - DNA, 18 bp, synthetic construct
  source 1..18: mol_type = other DNA
tattacgactcaccatgg

SEQ ID NO: 7790 - DNA, 18 bp, synthetic construct
  source 1..18: mol_type = other DNA
tcatacaagtcactatag

SEQ ID NO: 7791 - DNA, 18 bp, synthetic construct
  source 1..18: mol_type = other DNA
tcatacgattgactatag

SEQ ID NO: 7792 - DNA, 18 bp, synthetic construct
  source 1..18: mol_type = other DNA
tcatacgtctcactagag

SEQ ID NO: 7793 - DNA, 18 bp, synthetic construct
  source 1..18: mol_type = other DNA
tcttccgactcactatag

SEQ ID NO: 7794 - DNA, 18 bp, synthetic construct
  source 1..18: mol_type = other DNA
tgatacgactccctttag

SEQ ID NO: 7795 - DNA, 18 bp, synthetic construct
  source 1..18: mol_type = other DNA
tggtacgactcactaaag

SEQ ID NO: 7796 - DNA, 18 bp, synthetic construct
  source 1..18: mol_type = other DNA
ttctacgactcagtatag

SEQ ID NO: 7797 - DNA, 18 bp, synthetic construct
  source 1..18: mol_type = other DNA
taataagactctctttag

SEQ ID NO: 7798 - DNA, 18 bp, synthetic construct
  source 1..18: mol_type = other DNA
taaattgactcactatag

SEQ ID NO: 7799 - DNA, 18 bp, synthetic construct
  source 1..18: mol_type = other DNA
taaaacgacacactttag

SEQ ID NO: 7800 - DNA, 18 bp, synthetic construct
  source 1..18: mol_type = other DNA
taattcaactctctatag

SEQ ID NO: 7801 - DNA, 18 bp, synthetic construct
  source 1..18: mol_type = other DNA
ttctacgactcactaaag

SEQ ID NO: 7802 - DNA, 18 bp, synthetic construct
  source 1..18: mol_type = other DNA
caatacgactcaatttag

SEQ ID NO: 7803 - DNA, 18 bp, synthetic construct
  source 1..18: mol_type = other DNA
caatacgtatcactatag

SEQ ID NO: 7804 - DNA, 18 bp, synthetic construct
  source 1..18: mol_type = other DNA
taatacggctctcaatag

SEQ ID NO: 7805 - DNA, 18 bp, synthetic construct
  source 1..18: mol_type = other DNA
ttaaatgactcactatag

SEQ ID NO: 7806 - DNA, 18 bp, synthetic construct
  source 1..18: mol_type = other DNA
taatgcgtctctctatag

SEQ ID NO: 7807 - DNA, 18 bp, synthetic construct
  source 1..18: mol_type = other DNA
acaaacgactcactatag

SEQ ID NO: 7808 - DNA, 18 bp, synthetic construct
  source 1..18: mol_type = other DNA
tattatgactcactatcg

SEQ ID NO: 7809 - DNA, 18 bp, synthetic construct
  source 1..18: mol_type = other DNA
ttatacgactatctatag

SEQ ID NO: 7810 - DNA, 18 bp, synthetic construct
  source 1..18: mol_type = other DNA
taatacgaatcacttttg

SEQ ID NO: 7811 - DNA, 18 bp, synthetic construct
  source 1..18: mol_type = other DNA
tattatgtctcactatag

SEQ ID NO: 7812 - DNA, 18 bp, synthetic construct
  source 1..18: mol_type = other DNA
taaaactagtcactatag

SEQ ID NO: 7813 - DNA, 18 bp, synthetic construct
  source 1..18: mol_type = other DNA
taataccacaccctatag

SEQ ID NO: 7814 - DNA, 18 bp, synthetic construct
  source 1..18: mol_type = other DNA
taatacgaatcaaaatag

SEQ ID NO: 7815 - DNA, 18 bp, synthetic construct
  source 1..18: mol_type = other DNA
taatacgacacactttgg

SEQ ID NO: 7816 - DNA, 18 bp, synthetic construct
  source 1..18: mol_type = other DNA
tactacgactcagtattg

SEQ ID NO: 7817 - DNA, 18 bp, synthetic construct
  source 1..18: mol_type = other DNA
ttatacgactcacgttag

SEQ ID NO: 7818 - DNA, 18 bp, synthetic construct
  source 1..18: mol_type = other DNA
taataatactctctatag

SEQ ID NO: 7819 - DNA, 18 bp, synthetic construct
  source 1..18: mol_type = other DNA
ttatacgtctcaatatag

SEQ ID NO: 7820 - DNA, 18 bp, synthetic construct
  source 1..18: mol_type = other DNA
taatacgactctttttag

SEQ ID NO: 7821 - DNA, 18 bp, synthetic construct
  source 1..18: mol_type = other DNA
taatacgactaacaaaag

SEQ ID NO: 7822 - DNA, 18 bp, synthetic construct
  source 1..18: mol_type = other DNA
caatacgacttactattg

SEQ ID NO: 7823 - DNA, 18 bp, synthetic construct
  source 1..18: mol_type = other DNA
taataatactcacaatag

SEQ ID NO: 7824 - DNA, 18 bp, synthetic construct
  source 1..18: mol_type = other DNA
taatacgaaatactatag

SEQ ID NO: 7825 - DNA, 18 bp, synthetic construct
  source 1..18: mol_type = other DNA
taatacgagtctctttag

SEQ ID NO: 7826 - DNA, 18 bp, synthetic construct
  source 1..18: mol_type = other DNA
tagaacgactcactaaag

SEQ ID NO: 7827 - DNA, 18 bp, synthetic construct
  source 1..18: mol_type = other DNA
tattccgattcactatag

SEQ ID NO: 7828 - DNA, 18 bp, synthetic construct
  source 1..18: mol_type = other DNA
ttaaacgacccactatag

SEQ ID NO: 7829 - DNA, 18 bp, synthetic construct
  source 1..18: mol_type = other DNA
ttatacaactcactagag

SEQ ID NO: 7830 - DNA, 18 bp, synthetic construct
  source 1..18: mol_type = other DNA
aaatacgattccctatag

SEQ ID NO: 7831 - DNA, 18 bp, synthetic construct
  source 1..18: mol_type = other DNA
aaatacgattgactatag

SEQ ID NO: 7832 - DNA, 18 bp, synthetic construct
  source 1..18: mol_type = other DNA
caatcagactcactatag

SEQ ID NO: 7833 - DNA, 18 bp, synthetic construct
  source 1..18: mol_type = other DNA
taacacgactcagtattg

SEQ ID NO: 7834 - DNA, 18 bp, synthetic construct
  source 1..18: mol_type = other DNA
taataagaatcactgtag

SEQ ID NO: 7835 - DNA, 18 bp, synthetic construct
  source 1..18: mol_type = other DNA
taataagaccctctatag

SEQ ID NO: 7836 - DNA, 18 bp, synthetic construct
  source 1..18: mol_type = other DNA
taatacgactcaatctgg

SEQ ID NO: 7837 - DNA, 18 bp, synthetic construct
  source 1..18: mol_type = other DNA
taatacgactcatgattg

SEQ ID NO: 7838 - DNA, 18 bp, synthetic construct
  source 1..18: mol_type = other DNA
taatacgatgcactaaag

SEQ ID NO: 7839 - DNA, 18 bp, synthetic construct
  source 1..18: mol_type = other DNA
taatacggttcactctag

SEQ ID NO: 7840 - DNA, 18 bp, synthetic construct
  source 1..18: mol_type = other DNA
taatgccactcactttag

SEQ ID NO: 7841 - DNA, 18 bp, synthetic construct
  source 1..18: mol_type = other DNA
taatgcgacttactatcg

SEQ ID NO: 7842 - DNA, 18 bp, synthetic construct
  source 1..18: mol_type = other DNA
taattcgacacacgatag

SEQ ID NO: 7843 - DNA, 18 bp, synthetic construct
  source 1..18: mol_type = other DNA
taattcgactaactatgg

SEQ ID NO: 7844 - DNA, 18 bp, synthetic construct
  source 1..18: mol_type = other DNA
taattcgactcattctag

SEQ ID NO: 7845 - DNA, 18 bp, synthetic construct
  source 1..18: mol_type = other DNA
tagtacgactatctatag

SEQ ID NO: 7846 - DNA, 18 bp, synthetic construct
  source 1..18: mol_type = other DNA
tattacaagtcactatag

SEQ ID NO: 7847 - DNA, 18 bp, synthetic construct
  source 1..18: mol_type = other DNA
tattacgatgcactatag

SEQ ID NO: 7848 - DNA, 18 bp, synthetic construct
  source 1..18: mol_type = other DNA
tatttcgacgcactatag

SEQ ID NO: 7849 - DNA, 18 bp, synthetic construct
  source 1..18: mol_type = other DNA
tcaaacgactcactacag

SEQ ID NO: 7850 - DNA, 18 bp, synthetic construct
  source 1..18: mol_type = other DNA
tccttcgactcactatag

SEQ ID NO: 7851 - DNA, 18 bp, synthetic construct
  source 1..18: mol_type = other DNA
aaatatgactcattatag

SEQ ID NO: 7852 - DNA, 18 bp, synthetic construct
  source 1..18: mol_type = other DNA
taaaacaactctctatag

SEQ ID NO: 7853 - DNA, 18 bp, synthetic construct
  source 1..18: mol_type = other DNA
tagtacgactctctaaag

SEQ ID NO: 7854 - DNA, 18 bp, synthetic construct
  source 1..18: mol_type = other DNA
tcatttgactcactatag

SEQ ID NO: 7855 - DNA, 18 bp, synthetic construct
  source 1..18: mol_type = other DNA
taatacgcctctctattg

SEQ ID NO: 7856 - DNA, 18 bp, synthetic construct
  source 1..18: mol_type = other DNA
aattacgactcactctag

SEQ ID NO: 7857 - DNA, 18 bp, synthetic construct
  source 1..18: mol_type = other DNA
caatacaactcactaaag

SEQ ID NO: 7858 - DNA, 18 bp, synthetic construct
  source 1..18: mol_type = other DNA
taataagattcactgtag

SEQ ID NO: 7859 - DNA, 18 bp, synthetic construct
  source 1..18: mol_type = other DNA
taatacaacacgctatag

SEQ ID NO: 7860 - DNA, 18 bp, synthetic construct
  source 1..18: mol_type = other DNA
taatacgaatctctatcg

SEQ ID NO: 7861 - DNA, 18 bp, synthetic construct
  source 1..18: mol_type = other DNA
taatacgactcagtaagg

SEQ ID NO: 7862 - DNA, 18 bp, synthetic construct
  source 1..18: mol_type = other DNA
taatacgatccactttag

SEQ ID NO: 7863 - DNA, 18 bp, synthetic construct
  source 1..18: mol_type = other DNA
tacaatgactcactatag

SEQ ID NO: 7864 - DNA, 18 bp, synthetic construct
  source 1..18: mol_type = other DNA
tactccgtctcactatag

SEQ ID NO: 7865 - DNA, 18 bp, synthetic construct
  source 1..18: mol_type = other DNA
tattacaactccctatag

SEQ ID NO: 7866 - DNA, 18 bp, synthetic construct
  source 1..18: mol_type = other DNA
tccaacgactcactatag

SEQ ID NO: 7867 - DNA, 18 bp, synthetic construct
  source 1..18: mol_type = other DNA
taattcgacacacaatag

SEQ ID NO: 7868 - DNA, 18 bp, synthetic construct
  source 1..18: mol_type = other DNA
taattcgtctcacaatag

SEQ ID NO: 7869 - DNA, 18 bp, synthetic construct
  source 1..18: mol_type = other DNA
taatacgacttattttag

SEQ ID NO: 7870 - DNA, 18 bp, synthetic construct
  source 1..18: mol_type = other DNA
aaatacgactcaccttag

SEQ ID NO: 7871 - DNA, 18 bp, synthetic construct
  source 1..18: mol_type = other DNA
aaatactactcaatatag

SEQ ID NO: 7872 - DNA, 18 bp, synthetic construct
  source 1..18: mol_type = other DNA
taatgcgacacactattg

SEQ ID NO: 7873 - DNA, 18 bp, synthetic construct
  source 1..18: mol_type = other DNA
taattcgactaaatatag

SEQ ID NO: 7874 - DNA, 18 bp, synthetic construct
  source 1..18: mol_type = other DNA
tcaaacgtctcactatag

SEQ ID NO: 7875 - DNA, 18 bp, synthetic construct
  source 1..18: mol_type = other DNA
taataccactcacaattg

SEQ ID NO: 7876 - DNA, 18 bp, synthetic construct
  source 1..18: mol_type = other DNA
taatactcctcacaatag

SEQ ID NO: 7877 - DNA, 18 bp, synthetic construct
  source 1..18: mol_type = other DNA
tattacgactccttatag

SEQ ID NO: 7878 - DNA, 18 bp, synthetic construct
  source 1..18: mol_type = other DNA
taattctactctctatag

SEQ ID NO: 7879 - DNA, 18 bp, synthetic construct
  source 1..18: mol_type = other DNA
ttatacgtctcacaatag

SEQ ID NO: 7880 - DNA, 18 bp, synthetic construct
  source 1..18: mol_type = other DNA
taatacgacacactgaag

SEQ ID NO: 7881 - DNA, 18 bp, synthetic construct
  source 1..18: mol_type = other DNA
taattcgactcaatttag

SEQ ID NO: 7882 - DNA, 18 bp, synthetic construct
  source 1..18: mol_type = other DNA
taattcaactcattatag

SEQ ID NO: 7883 - DNA, 18 bp, synthetic construct
  source 1..18: mol_type = other DNA
aaattagactcactatag

SEQ ID NO: 7884 - DNA, 18 bp, synthetic construct
  source 1..18: mol_type = other DNA
tattaagactctctatag

SEQ ID NO: 7885 - DNA, 18 bp, synthetic construct
  source 1..18: mol_type = other DNA
taatacgtctcattttag

SEQ ID NO: 7886 - DNA, 18 bp, synthetic construct
  source 1..18: mol_type = other DNA
tattattactcactatag

SEQ ID NO: 7887 - DNA, 18 bp, synthetic construct
  source 1..18: mol_type = other DNA
ttataagtctcactatag

SEQ ID NO: 7888 - DNA, 18 bp, synthetic construct
  source 1..18: mol_type = other DNA
taatactattcactttag

SEQ ID NO: 7889 - DNA, 18 bp, synthetic construct
  source 1..18: mol_type = other DNA
caatacgactctctatcg

SEQ ID NO: 7890 - DNA, 18 bp, synthetic construct
  source 1..18: mol_type = other DNA
caatatgactcactttag

SEQ ID NO: 7891 - DNA, 18 bp, synthetic construct
  source 1..18: mol_type = other DNA
taatacgacacaatatcg

SEQ ID NO: 7892 - DNA, 18 bp, synthetic construct
  source 1..18: mol_type = other DNA
taatacgactcattcttg

SEQ ID NO: 7893 - DNA, 18 bp, synthetic construct
  source 1..18: mol_type = other DNA
taatgcaactaactatag

SEQ ID NO: 7894 - DNA, 18 bp, synthetic construct
  source 1..18: mol_type = other DNA
taattcgactcacaacag

SEQ ID NO: 7895 - DNA, 18 bp, synthetic construct
  source 1..18: mol_type = other DNA
tagtacgtatcactatag

SEQ ID NO: 7896 - DNA, 18 bp, synthetic construct
  source 1..18: mol_type = other DNA
tattccgactaactatag

SEQ ID NO: 7897 - DNA, 18 bp, synthetic construct
  source 1..18: mol_type = other DNA
ttgtactactcactatag

SEQ ID NO: 7898 - DNA, 18 bp, synthetic construct
  source 1..18: mol_type = other DNA
taaaacgattctctatag

SEQ ID NO: 7899 - DNA, 18 bp, synthetic construct
  source 1..18: mol_type = other DNA
taataagacacactattg

SEQ ID NO: 7900 - DNA, 18 bp, synthetic construct
  source 1..18: mol_type = other DNA
taacaagactcactattg

SEQ ID NO: 7901 - DNA, 18 bp, synthetic construct
  source 1..18: mol_type = other DNA
taattcgaatcattatag

SEQ ID NO: 7902 - DNA, 18 bp, synthetic construct
  source 1..18: mol_type = other DNA
tattacgactcactatta

SEQ ID NO: 7903 - DNA, 18 bp, synthetic construct
  source 1..18: mol_type = other DNA
ttataccactcaatatag

SEQ ID NO: 7904 - DNA, 18 bp, synthetic construct
  source 1..18: mol_type = other DNA
taaaacgaatcaatatag

SEQ ID NO: 7905 - DNA, 18 bp, synthetic construct
  source 1..18: mol_type = other DNA
taatacgactctgtttag

SEQ ID NO: 7906 - DNA, 18 bp, synthetic construct
  source 1..18: mol_type = other DNA
aaatacgacccattatag

SEQ ID NO: 7907 - DNA, 18 bp, synthetic construct
  source 1..18: mol_type = other DNA
aaatacgactcagaatag

SEQ ID NO: 7908 - DNA, 18 bp, synthetic construct
  source 1..18: mol_type = other DNA
aagtacgactcactacag

SEQ ID NO: 7909 - DNA, 18 bp, synthetic construct
  source 1..18: mol_type = other DNA
caatacgtctcgctatag

SEQ ID NO: 7910 - DNA, 18 bp, synthetic construct
  source 1..18: mol_type = other DNA
taaaacgccacactatag

SEQ ID NO: 7911 - DNA, 18 bp, synthetic construct
  source 1..18: mol_type = other DNA
taacactacccactatag

SEQ ID NO: 7912 - DNA, 18 bp, synthetic construct
  source 1..18: mol_type = other DNA
taataagacccactattg

SEQ ID NO: 7913 - DNA, 18 bp, synthetic construct
  source 1..18: mol_type = other DNA
taataccacacactacag

SEQ ID NO: 7914 - DNA, 18 bp, synthetic construct
  source 1..18: mol_type = other DNA
taatacgaaacactacag

SEQ ID NO: 7915 - DNA, 18 bp, synthetic construct
  source 1..18: mol_type = other DNA
taatacgactcaaactag

SEQ ID NO: 7916 - DNA, 18 bp, synthetic construct
  source 1..18: mol_type = other DNA
taatacgattcattagag

SEQ ID NO: 7917 - DNA, 18 bp, synthetic construct
  source 1..18: mol_type = other DNA
taatacgattccctctag

SEQ ID NO: 7918 - DNA, 18 bp, synthetic construct
  source 1..18: mol_type = other DNA
taatccgaatcactaaag

SEQ ID NO: 7919 - DNA, 18 bp, synthetic construct
  source 1..18: mol_type = other DNA
taatgcgaatcaatatag

SEQ ID NO: 7920 - DNA, 18 bp, synthetic construct
  source 1..18: mol_type = other DNA
taattcgacttagtatag

SEQ ID NO: 7921 - DNA, 18 bp, synthetic construct
  source 1..18: mol_type = other DNA
taattcgtctcactatgg

SEQ ID NO: 7922 - DNA, 18 bp, synthetic construct
  source 1..18: mol_type = other DNA
tactacgcctctctatag

SEQ ID NO: 7923 - DNA, 18 bp, synthetic construct
  source 1..18: mol_type = other DNA
tactaggacttactatag

SEQ ID NO: 7924 - DNA, 18 bp, synthetic construct
  source 1..18: mol_type = other DNA
tattacgcctccctatag

SEQ ID NO: 7925 - DNA, 18 bp, synthetic construct
  source 1..18: mol_type = other DNA
tcatacgactccctaaag

SEQ ID NO: 7926 - DNA, 18 bp, synthetic construct
  source 1..18: mol_type = other DNA
aaacacgactcactatcg

SEQ ID NO: 7927 - DNA, 18 bp, synthetic construct
  source 1..18: mol_type = other DNA
aaagaggactcactatag

SEQ ID NO: 7928 - DNA, 18 bp, synthetic construct
  source 1..18: mol_type = other DNA
aaatacgactgagtatag

SEQ ID NO: 7929 - DNA, 18 bp, synthetic construct
  source 1..18: mol_type = other DNA
aaatacggcacactatag

SEQ ID NO: 7930 - DNA, 18 bp, synthetic construct
  source 1..18: mol_type = other DNA
aaatcggactcactatag

SEQ ID NO: 7931 - DNA, 18 bp, synthetic construct
  source 1..18: mol_type = other DNA
caataagaatcactatag

SEQ ID NO: 7932 - DNA, 18 bp, synthetic construct
  source 1..18: mol_type = other DNA
caatacgacacactacag

SEQ ID NO: 7933 - DNA, 18 bp, synthetic construct
  source 1..18: mol_type = other DNA
caatacgacccactttag

SEQ ID NO: 7934 - DNA, 18 bp, synthetic construct
  source 1..18: mol_type = other DNA
caatacgactaaccatag

SEQ ID NO: 7935 - DNA, 18 bp, synthetic construct
  source 1..18: mol_type = other DNA
ccatacgactaactatag

SEQ ID NO: 7936 - DNA, 18 bp, synthetic construct
  source 1..18: mol_type = other DNA
gaaaccgactcactatag

SEQ ID NO: 7937 - DNA, 18 bp, synthetic construct
  source 1..18: mol_type = other DNA
gaatacgattcacaatag

SEQ ID NO: 7938 - DNA, 18 bp, synthetic construct
  source 1..18: mol_type = other DNA
gaatacgtctcacaatag

SEQ ID NO: 7939 - DNA, 18 bp, synthetic construct
  source 1..18: mol_type = other DNA
ggatacgactcaatatag

SEQ ID NO: 7940 - DNA, 18 bp, synthetic construct
  source 1..18: mol_type = other DNA
taaaacgactcaatatcg

SEQ ID NO: 7941 - DNA, 18 bp, synthetic construct
  source 1..18: mol_type = other DNA
taacaagaatcactatag

SEQ ID NO: 7942 - DNA, 18 bp, synthetic construct
  source 1..18: mol_type = other DNA
taacacgactcaatctag

SEQ ID NO: 7943 - DNA, 18 bp, synthetic construct
  source 1..18: mol_type = other DNA
taacacggctcacaatag

SEQ ID NO: 7944 - DNA, 18 bp, synthetic construct
  source 1..18: mol_type = other DNA
taacacggctcactacag

SEQ ID NO: 7945 - DNA, 18 bp, synthetic construct
  source 1..18: mol_type = other DNA
taagacgactcaccattg

SEQ ID NO: 7946 - DNA, 18 bp, synthetic construct
  source 1..18: mol_type = other DNA
taataacgctcactatag

SEQ ID NO: 7947 - DNA, 18 bp, synthetic construct
  source 1..18: mol_type = other DNA
taataagactcaacatag

SEQ ID NO: 7948 - DNA, 18 bp, synthetic construct
  source 1..18: mol_type = other DNA
taataagactctctagag

SEQ ID NO: 7949 - DNA, 18 bp, synthetic construct
  source 1..18: mol_type = other DNA
taataccagttactatag

SEQ ID NO: 7950 - DNA, 18 bp, synthetic construct
  source 1..18: mol_type = other DNA
taatacgacccgctatcg

SEQ ID NO: 7951 - DNA, 18 bp, synthetic construct
  source 1..18: mol_type = other DNA
taatacgacgcattaaag

SEQ ID NO: 7952 - DNA, 18 bp, synthetic construct
  source 1..18: mol_type = other DNA
taatacgactcacacgag

SEQ ID NO: 7953 - DNA, 18 bp, synthetic construct
  source 1..18: mol_type = other DNA
taatacgactcattctgg

SEQ ID NO: 7954 - DNA, 18 bp, synthetic construct
  source 1..18: mol_type = other DNA
taatacgactccatagag

SEQ ID NO: 7955 - DNA, 18 bp, synthetic construct
  source 1..18: mol_type = other DNA
taatacgagccactgtag

SEQ ID NO: 7956 - DNA, 18 bp, synthetic construct
  source 1..18: mol_type = other DNA
taatacgattcacgattg

SEQ ID NO: 7957 - DNA, 18 bp, synthetic construct
  source 1..18: mol_type = other DNA
taatacgattcactgtcg

SEQ ID NO: 7958 - DNA, 18 bp, synthetic construct
  source 1..18: mol_type = other DNA
taatacgattccgtatag

SEQ ID NO: 7959 - DNA, 18 bp, synthetic construct
  source 1..18: mol_type = other DNA
taatacgccacagtatag

SEQ ID NO: 7960 - DNA, 18 bp, synthetic construct
  source 1..18: mol_type = other DNA
taatactgctcactagag

SEQ ID NO: 7961 - DNA, 18 bp, synthetic construct
  source 1..18: mol_type = other DNA
taatagaacttactatag

SEQ ID NO: 7962 - DNA, 18 bp, synthetic construct
  source 1..18: mol_type = other DNA
taataggactcaacatag

SEQ ID NO: 7963 - DNA, 18 bp, synthetic construct
  source 1..18: mol_type = other DNA
taataggacttactatcg

SEQ ID NO: 7964 - DNA, 18 bp, synthetic construct
  source 1..18: mol_type = other DNA
taatatgacacactagag

SEQ ID NO: 7965 - DNA, 18 bp, synthetic construct
  source 1..18: mol_type = other DNA
taatatgactcatgatag

SEQ ID NO: 7966 - DNA, 18 bp, synthetic construct
  source 1..18: mol_type = other DNA
taatatgcctccctatag

SEQ ID NO: 7967 - DNA, 18 bp, synthetic construct
  source 1..18: mol_type = other DNA
taatatggctcaccatag

SEQ ID NO: 7968 - DNA, 18 bp, synthetic construct
  source 1..18: mol_type = other DNA
taatccgaatcactgtag

SEQ ID NO: 7969 - DNA, 18 bp, synthetic construct
  source 1..18: mol_type = other DNA
taatccgactgaatatag

SEQ ID NO: 7970 - DNA, 18 bp, synthetic construct
  source 1..18: mol_type = other DNA
taatgcacctcactatag

SEQ ID NO: 7971 - DNA, 18 bp, synthetic construct
  source 1..18: mol_type = other DNA
taatgcgacccgctatag

SEQ ID NO: 7972 - DNA, 18 bp, synthetic construct
  source 1..18: mol_type = other DNA
taatgcgactgactaaag

SEQ ID NO: 7973 - DNA, 18 bp, synthetic construct
  source 1..18: mol_type = other DNA
taatgcgagtcactgtag

SEQ ID NO: 7974 - DNA, 18 bp, synthetic construct
  source 1..18: mol_type = other DNA
taattcaactcacgatag

SEQ ID NO: 7975 - DNA, 18 bp, synthetic construct
  source 1..18: mol_type = other DNA
taattcgactaactagag

SEQ ID NO: 7976 - DNA, 18 bp, synthetic construct
  source 1..18: mol_type = other DNA
tactacgacacactacag

SEQ ID NO: 7977 - DNA, 18 bp, synthetic construct
  source 1..18: mol_type = other DNA
tactacgacccactacag

SEQ ID NO: 7978 - DNA, 18 bp, synthetic construct
  source 1..18: mol_type = other DNA
tactacgacgcactaaag

SEQ ID NO: 7979 - DNA, 18 bp, synthetic construct
  source 1..18: mol_type = other DNA
tactacgattcactgtag

SEQ ID NO: 7980 - DNA, 18 bp, synthetic construct
  source 1..18: mol_type = other DNA
tagcacgactcactgtag

SEQ ID NO: 7981 - DNA, 18 bp, synthetic construct
  source 1..18: mol_type = other DNA
taggacgactcactttag

SEQ ID NO: 7982 - DNA, 18 bp, synthetic construct
  source 1..18: mol_type = other DNA
tagtaccactcagtatag

SEQ ID NO: 7983 - DNA, 18 bp, synthetic construct
  source 1..18: mol_type = other DNA
tagtacgactaaatatag

SEQ ID NO: 7984 - DNA, 18 bp, synthetic construct
  source 1..18: mol_type = other DNA
tagtacgactcacactag

SEQ ID NO: 7985 - DNA, 18 bp, synthetic construct
  source 1..18: mol_type = other DNA
tagtacgacttactatcg

SEQ ID NO: 7986 - DNA, 18 bp, synthetic construct
  source 1..18: mol_type = other DNA
tagtacgacttcctatag

SEQ ID NO: 7987 - DNA, 18 bp, synthetic construct
  source 1..18: mol_type = other DNA
tagtacggatcactatag

SEQ ID NO: 7988 - DNA, 18 bp, synthetic construct
  source 1..18: mol_type = other DNA
tcatacaactcactatcg

SEQ ID NO: 7989 - DNA, 18 bp, synthetic construct
  source 1..18: mol_type = other DNA
tcatacgactaactatcg

SEQ ID NO: 7990 - DNA, 18 bp, synthetic construct
  source 1..18: mol_type = other DNA
tcatacgcctcacaatag

SEQ ID NO: 7991 - DNA, 18 bp, synthetic construct
  source 1..18: mol_type = other DNA
tcatactactcactatcg

SEQ ID NO: 7992 - DNA, 18 bp, synthetic construct
  source 1..18: mol_type = other DNA
tcataggactcactttag

SEQ ID NO: 7993 - DNA, 18 bp, synthetic construct
  source 1..18: mol_type = other DNA
tcctacgactcattatag

SEQ ID NO: 7994 - DNA, 18 bp, synthetic construct
  source 1..18: mol_type = other DNA
tgatacaacgcactatag

SEQ ID NO: 7995 - DNA, 18 bp, synthetic construct
  source 1..18: mol_type = other DNA
tgatacgacgcacaatag

SEQ ID NO: 7996 - DNA, 18 bp, synthetic construct
  source 1..18: mol_type = other DNA
ttataagacgcactatag

SEQ ID NO: 7997 - DNA, 18 bp, synthetic construct
  source 1..18: mol_type = other DNA
ttatacgacccactagag

SEQ ID NO: 7998 - DNA, 18 bp, synthetic construct
  source 1..18: mol_type = other DNA
ttatacgactcacgctag

SEQ ID NO: 7999 - DNA, 18 bp, synthetic construct
  source 1..18: mol_type = other DNA
taatacgacacactaatg

SEQ ID NO: 8000 - DNA, 18 bp, synthetic construct
  source 1..18: mol_type = other DNA
taatatgtctcactttag

SEQ ID NO: 8001 - DNA, 18 bp, synthetic construct
  source 1..18: mol_type = other DNA
ttatacaactcactattg

SEQ ID NO: 8002 - DNA, 18 bp, synthetic construct
  source 1..18: mol_type = other DNA
tattccgactctctatag

SEQ ID NO: 8003 - DNA, 18 bp, synthetic construct
  source 1..18: mol_type = other DNA
taatacatctcactattg

SEQ ID NO: 8004 - DNA, 18 bp, synthetic construct
  source 1..18: mol_type = other DNA
caatacgactctcaatag

SEQ ID NO: 8005 - DNA, 18 bp, synthetic construct
  source 1..18: mol_type = other DNA
tcatacgacacacaatag

SEQ ID NO: 8006 - DNA, 18 bp, synthetic construct
  source 1..18: mol_type = other DNA
ttataccattcactatag

SEQ ID NO: 8007 - DNA, 18 bp, synthetic construct
  source 1..18: mol_type = other DNA
taaaacgactctttatag

SEQ ID NO: 8008 - DNA, 18 bp, synthetic construct
  source 1..18: mol_type = other DNA
taatacgatactctatag

SEQ ID NO: 8009 - DNA, 18 bp, synthetic construct
  source 1..18: mol_type = other DNA
taaaaaaactcactatag

SEQ ID NO: 8010 - DNA, 18 bp, synthetic construct
  source 1..18: mol_type = other DNA
tattaccacacactatag

SEQ ID NO: 8011 - DNA, 18 bp, synthetic construct
  source 1..18: mol_type = other DNA
tattacgactcgcaatag

SEQ ID NO: 8012 - DNA, 18 bp, synthetic construct
  source 1..18: mol_type = other DNA
tcatacgtcacactatag

SEQ ID NO: 8013 - DNA, 18 bp, synthetic construct
  source 1..18: mol_type = other DNA
tgatacgtatcactatag

SEQ ID NO: 8014 - DNA, 18 bp, synthetic construct
  source 1..18: mol_type = other DNA
ttattcgactgactatag

SEQ ID NO: 8015 - DNA, 18 bp, synthetic construct
  source 1..18: mol_type = other DNA
aaatacgaattactatag

SEQ ID NO: 8016 - DNA, 18 bp, synthetic construct
  source 1..18: mol_type = other DNA
taatacgacacagtattg

SEQ ID NO: 8017 - DNA, 18 bp, synthetic construct
  source 1..18: mol_type = other DNA
taatacgagtaactaaag

SEQ ID NO: 8018 - DNA, 18 bp, synthetic construct
  source 1..18: mol_type = other DNA
taatacgatgcactttag

SEQ ID NO: 8019 - DNA, 18 bp, synthetic construct
  source 1..18: mol_type = other DNA
taatacgtctctctagag

SEQ ID NO: 8020 - DNA, 18 bp, synthetic construct
  source 1..18: mol_type = other DNA
taattcgactgactattg

SEQ ID NO: 8021 - DNA, 18 bp, synthetic construct
  source 1..18: mol_type = other DNA
taattcgattcgctatag

SEQ ID NO: 8022 - DNA, 18 bp, synthetic construct
  source 1..18: mol_type = other DNA
taaaacgactctctatcg

SEQ ID NO: 8023 - DNA, 18 bp, synthetic construct
  source 1..18: mol_type = other DNA
taactcgactcactttag

SEQ ID NO: 8024 - DNA, 18 bp, synthetic construct
  source 1..18: mol_type = other DNA
taatacaactaacaatag

SEQ ID NO: 8025 - DNA, 18 bp, synthetic construct
  source 1..18: mol_type = other DNA
taatactactcgctttag

SEQ ID NO: 8026 - DNA, 18 bp, synthetic construct
  source 1..18: mol_type = other DNA
taattcgaatcactttag

SEQ ID NO: 8027 - DNA, 18 bp, synthetic construct
  source 1..18: mol_type = other DNA
ttatacgagtcactattg

SEQ ID NO: 8028 - DNA, 18 bp, synthetic construct
  source 1..18: mol_type = other DNA
tattactactcaccatag

SEQ ID NO: 8029 - DNA, 18 bp, synthetic construct
  source 1..18: mol_type = other DNA
taattcgattcactttag

SEQ ID NO: 8030 - DNA, 18 bp, synthetic construct
  source 1..18: mol_type = other DNA
tattacgactcattttag

SEQ ID NO: 8031 - DNA, 18 bp, synthetic construct
  source 1..18: mol_type = other DNA
tattaccactcactttag

SEQ ID NO: 8032 - DNA, 18 bp, synthetic construct
  source 1..18: mol_type = other DNA
tattacgattcactatcg

SEQ ID NO: 8033 - DNA, 18 bp, synthetic construct
  source 1..18: mol_type = other DNA
taacacatctcactatag

SEQ ID NO: 8034 - DNA, 18 bp, synthetic construct
  source 1..18: mol_type = other DNA
taatacatctcactgtag

SEQ ID NO: 8035 - DNA, 18 bp, synthetic construct
  source 1..18: mol_type = other DNA
taatacgacacactaacg

SEQ ID NO: 8036 - DNA, 18 bp, synthetic construct
  source 1..18: mol_type = other DNA
taatacgattcaccattg

SEQ ID NO: 8037 - DNA, 18 bp, synthetic construct
  source 1..18: mol_type = other DNA
taaaaggactaactatag

SEQ ID NO: 8038 - DNA, 18 bp, synthetic construct
  source 1..18: mol_type = other DNA
taaaaggagtcactatag

SEQ ID NO: 8039 - DNA, 18 bp, synthetic construct
  source 1..18: mol_type = other DNA
taagaagactcactattg

SEQ ID NO: 8040 - DNA, 18 bp, synthetic construct
  source 1..18: mol_type = other DNA
taatacacctcattatag

SEQ ID NO: 8041 - DNA, 18 bp, synthetic construct
  source 1..18: mol_type = other DNA
taataccactaaatatag

SEQ ID NO: 8042 - DNA, 18 bp, synthetic construct
  source 1..18: mol_type = other DNA
taatacgactgattttag

SEQ ID NO: 8043 - DNA, 18 bp, synthetic construct
  source 1..18: mol_type = other DNA
taatacgtttgactatag

SEQ ID NO: 8044 - DNA, 18 bp, synthetic construct
  source 1..18: mol_type = other DNA
taatactaatcactgtag

SEQ ID NO: 8045 - DNA, 18 bp, synthetic construct
  source 1..18: mol_type = other DNA
taatactactgaatatag

SEQ ID NO: 8046 - DNA, 18 bp, synthetic construct
  source 1..18: mol_type = other DNA
taatccgactccatatag

SEQ ID NO: 8047 - DNA, 18 bp, synthetic construct
  source 1..18: mol_type = other DNA
taatccgtctgactatag

SEQ ID NO: 8048 - DNA, 18 bp, synthetic construct
  source 1..18: mol_type = other DNA
taattcgaatcagtatag

SEQ ID NO: 8049 - DNA, 18 bp, synthetic construct
  source 1..18: mol_type = other DNA
tattactactcacgatag

SEQ ID NO: 8050 - DNA, 18 bp, synthetic construct
  source 1..18: mol_type = other DNA
tcatacgactcacgctag

SEQ ID NO: 8051 - DNA, 18 bp, synthetic construct
  source 1..18: mol_type = other DNA
tcatacgactcactttgg

SEQ ID NO: 8052 - DNA, 18 bp, synthetic construct
  source 1..18: mol_type = other DNA
tgatacaactcactacag

SEQ ID NO: 8053 - DNA, 18 bp, synthetic construct
  source 1..18: mol_type = other DNA
taattcgactcacaattg

SEQ ID NO: 8054 - DNA, 18 bp, synthetic construct
  source 1..18: mol_type = other DNA
ttatacgtatcactatag

SEQ ID NO: 8055 - DNA, 18 bp, synthetic construct
  source 1..18: mol_type = other DNA
taaaccgtctcactatag

SEQ ID NO: 8056 - DNA, 18 bp, synthetic construct
  source 1..18: mol_type = other DNA
taatatgaataactatag

SEQ ID NO: 8057 - DNA, 18 bp, synthetic construct
  source 1..18: mol_type = other DNA
aaatacgactctctatcg

SEQ ID NO: 8058 - DNA, 18 bp, synthetic construct
  source 1..18: mol_type = other DNA
taatacgactctccacag

SEQ ID NO: 8059 - DNA, 18 bp, synthetic construct
  source 1..18: mol_type = other DNA
taatacgattcactttcg

SEQ ID NO: 8060 - DNA, 18 bp, synthetic construct
  source 1..18: mol_type = other DNA
taatacttctcactatgg

SEQ ID NO: 8061 - DNA, 18 bp, synthetic construct
  source 1..18: mol_type = other DNA
taatcagactcactttag

SEQ ID NO: 8062 - DNA, 18 bp, synthetic construct
  source 1..18: mol_type = other DNA
taattcgactcaccatgg

SEQ ID NO: 8063 - DNA, 18 bp, synthetic construct
  source 1..18: mol_type = other DNA
taccacgactcactattg

SEQ ID NO: 8064 - DNA, 18 bp, synthetic construct
  source 1..18: mol_type = other DNA
tactacgtctaactatag

SEQ ID NO: 8065 - DNA, 18 bp, synthetic construct
  source 1..18: mol_type = other DNA
taatacgactatctttag

SEQ ID NO: 8066 - DNA, 18 bp, synthetic construct
  source 1..18: mol_type = other DNA
atattcgactcactatag

SEQ ID NO: 8067 - DNA, 18 bp, synthetic construct
  source 1..18: mol_type = other DNA
taatacgactttcaatag

SEQ ID NO: 8068 - DNA, 18 bp, synthetic construct
  source 1..18: mol_type = other DNA
taatacgactagctaaag

SEQ ID NO: 8069 - DNA, 18 bp, synthetic construct
  source 1..18: mol_type = other DNA
tactaagactcactttag

SEQ ID NO: 8070 - DNA, 18 bp, synthetic construct
  source 1..18: mol_type = other DNA
tactacgactaacaatag

SEQ ID NO: 8071 - DNA, 18 bp, synthetic construct
  source 1..18: mol_type = other DNA
tactacgattcactattg

SEQ ID NO: 8072 - DNA, 18 bp, synthetic construct
  source 1..18: mol_type = other DNA
ttatactactcactgtag

SEQ ID NO: 8073 - DNA, 18 bp, synthetic construct
  source 1..18: mol_type = other DNA
tactacaactctctatag

SEQ ID NO: 8074 - DNA, 18 bp, synthetic construct
  source 1..18: mol_type = other DNA
ttatacgactcagaatag

SEQ ID NO: 8075 - DNA, 18 bp, synthetic construct
  source 1..18: mol_type = other DNA
aaatactactcattatag

SEQ ID NO: 8076 - DNA, 18 bp, synthetic construct
  source 1..18: mol_type = other DNA
taatacgaatcattaaag

SEQ ID NO: 8077 - DNA, 18 bp, synthetic construct
  source 1..18: mol_type = other DNA
taatacgaattactttag

SEQ ID NO: 8078 - DNA, 18 bp, synthetic construct
  source 1..18: mol_type = other DNA
taattcaaatcactatag

SEQ ID NO: 8079 - DNA, 18 bp, synthetic construct
  source 1..18: mol_type = other DNA
tattacgatttactatag

SEQ ID NO: 8080 - DNA, 18 bp, synthetic construct
  source 1..18: mol_type = other DNA
cattactactcactatag

SEQ ID NO: 8081 - DNA, 18 bp, synthetic construct
  source 1..18: mol_type = other DNA
taatacgactgtcaatag

SEQ ID NO: 8082 - DNA, 18 bp, synthetic construct
  source 1..18: mol_type = other DNA
taatacaactctgtatag

SEQ ID NO: 8083 - DNA, 18 bp, synthetic construct
  source 1..18: mol_type = other DNA
taattggacacactatag

SEQ ID NO: 8084 - DNA, 18 bp, synthetic construct
  source 1..18: mol_type = other DNA
tactacgacacactaaag

SEQ ID NO: 8085 - DNA, 18 bp, synthetic construct
  source 1..18: mol_type = other DNA
ttatacgattgactatag

SEQ ID NO: 8086 - DNA, 18 bp, synthetic construct
  source 1..18: mol_type = other DNA
aactacgactcactttag

SEQ ID NO: 8087 - DNA, 18 bp, synthetic construct
  source 1..18: mol_type = other DNA
taatacgcctctctttag

SEQ ID NO: 8088 - DNA, 18 bp, synthetic construct
  source 1..18: mol_type = other DNA
aaataccacacactatag

SEQ ID NO: 8089 - DNA, 18 bp, synthetic construct
  source 1..18: mol_type = other DNA
aaatacgactcacgattg

SEQ ID NO: 8090 - DNA, 18 bp, synthetic construct
  source 1..18: mol_type = other DNA
agataccactcactatag

SEQ ID NO: 8091 - DNA, 18 bp, synthetic construct
  source 1..18: mol_type = other DNA
caaaacgacccactatag

SEQ ID NO: 8092 - DNA, 18 bp, synthetic construct
  source 1..18: mol_type = other DNA
caaaacgactcattatag

SEQ ID NO: 8093 - DNA, 18 bp, synthetic construct
  source 1..18: mol_type = other DNA
caatacaactcactattg

SEQ ID NO: 8094 - DNA, 18 bp, synthetic construct
  source 1..18: mol_type = other DNA
taaaaccactaactatag

SEQ ID NO: 8095 - DNA, 18 bp, synthetic construct
  source 1..18: mol_type = other DNA
taacacgtctcactatgg

SEQ ID NO: 8096 - DNA, 18 bp, synthetic construct
  source 1..18: mol_type = other DNA
taataagactcacaatgg

SEQ ID NO: 8097 - DNA, 18 bp, synthetic construct
  source 1..18: mol_type = other DNA
taatacaactcaatacag

SEQ ID NO: 8098 - DNA, 18 bp, synthetic construct
  source 1..18: mol_type = other DNA
taataccaaacactatag

SEQ ID NO: 8099 - DNA, 18 bp, synthetic construct
  source 1..18: mol_type = other DNA
taatacgaaccactattg

SEQ ID NO: 8100 - DNA, 18 bp, synthetic construct
  source 1..18: mol_type = other DNA
taatacgaccacctatag

SEQ ID NO: 8101 - DNA, 18 bp, synthetic construct
  source 1..18: mol_type = other DNA
taatacgattcattatgg

SEQ ID NO: 8102 - DNA, 18 bp, synthetic construct
  source 1..18: mol_type = other DNA
taatacggctctctctag

SEQ ID NO: 8103 - DNA, 18 bp, synthetic construct
  source 1..18: mol_type = other DNA
taatacgtccccctatag

SEQ ID NO: 8104 - DNA, 18 bp, synthetic construct
  source 1..18: mol_type = other DNA
taatactactgtctatag

SEQ ID NO: 8105 - DNA, 18 bp, synthetic construct
  source 1..18: mol_type = other DNA
taatactacttactatgg

SEQ ID NO: 8106 - DNA, 18 bp, synthetic construct
  source 1..18: mol_type = other DNA
taatatgtctcactctag

SEQ ID NO: 8107 - DNA, 18 bp, synthetic construct
  source 1..18: mol_type = other DNA
taatccgactaactaaag

SEQ ID NO: 8108 - DNA, 18 bp, synthetic construct
  source 1..18: mol_type = other DNA
taatgcatctcactatag

SEQ ID NO: 8109 - DNA, 18 bp, synthetic construct
  source 1..18: mol_type = other DNA
taatgctactcacaatag

SEQ ID NO: 8110 - DNA, 18 bp, synthetic construct
  source 1..18: mol_type = other DNA
tactacgactcactaacg

SEQ ID NO: 8111 - DNA, 18 bp, synthetic construct
  source 1..18: mol_type = other DNA
tagtaagacttactatag

SEQ ID NO: 8112 - DNA, 18 bp, synthetic construct
  source 1..18: mol_type = other DNA
tagtacggctcactattg

SEQ ID NO: 8113 - DNA, 18 bp, synthetic construct
  source 1..18: mol_type = other DNA
tattacgactcacgacag

SEQ ID NO: 8114 - DNA, 18 bp, synthetic construct
  source 1..18: mol_type = other DNA
tattccgactcaatatag

SEQ ID NO: 8115 - DNA, 18 bp, synthetic construct
  source 1..18: mol_type = other DNA
tcatacgagtctctatag

SEQ ID NO: 8116 - DNA, 18 bp, synthetic construct
  source 1..18: mol_type = other DNA
tgatacgtgtcactatag

SEQ ID NO: 8117 - DNA, 18 bp, synthetic construct
  source 1..18: mol_type = other DNA
tgctacgtctcactatag

SEQ ID NO: 8118 - DNA, 18 bp, synthetic construct
  source 1..18: mol_type = other DNA
ttatacgactaaatatag

SEQ ID NO: 8119 - DNA, 18 bp, synthetic construct
  source 1..18: mol_type = other DNA
aaaaacgactcactagag

SEQ ID NO: 8120 - DNA, 18 bp, synthetic construct
  source 1..18: mol_type = other DNA
aaacccgactcactatag

SEQ ID NO: 8121 - DNA, 18 bp, synthetic construct
  source 1..18: mol_type = other DNA
aaatacgagtcactatgg

SEQ ID NO: 8122 - DNA, 18 bp, synthetic construct
  source 1..18: mol_type = other DNA
aaatacgagtcactctag

SEQ ID NO: 8123 - DNA, 18 bp, synthetic construct
  source 1..18: mol_type = other DNA
acatacgacgcactatag

SEQ ID NO: 8124 - DNA, 18 bp, synthetic construct
  source 1..18: mol_type = other DNA
agatacgactccctatag

SEQ ID NO: 8125 - DNA, 18 bp, synthetic construct
  source 1..18: mol_type = other DNA
caaaacgacgcactatag

SEQ ID NO: 8126 - DNA, 18 bp, synthetic construct
  source 1..18: mol_type = other DNA
caatacgactgattatag

SEQ ID NO: 8127 - DNA, 18 bp, synthetic construct
  source 1..18: mol_type = other DNA
caatacgcctcgctatag

SEQ ID NO: 8128 - DNA, 18 bp, synthetic construct
  source 1..18: mol_type = other DNA
caatacggctcacaatag

SEQ ID NO: 8129 - DNA, 18 bp, synthetic construct
  source 1..18: mol_type = other DNA
caatccgactcactttag

SEQ ID NO: 8130 - DNA, 18 bp, synthetic construct
  source 1..18: mol_type = other DNA
cagtacgactcaatatag

SEQ ID NO: 8131 - DNA, 18 bp, synthetic construct
  source 1..18: mol_type = other DNA
gaataccactcagtatag

SEQ ID NO: 8132 - DNA, 18 bp, synthetic construct
  source 1..18: mol_type = other DNA
gaatactactctctatag

SEQ ID NO: 8133 - DNA, 18 bp, synthetic construct
  source 1..18: mol_type = other DNA
taaaacgacccgctatag

SEQ ID NO: 8134 - DNA, 18 bp, synthetic construct
  source 1..18: mol_type = other DNA
taaaacgactcaccacag

SEQ ID NO: 8135 - DNA, 18 bp, synthetic construct
  source 1..18: mol_type = other DNA
taaaccgactcgctatag

SEQ ID NO: 8136 - DNA, 18 bp, synthetic construct
  source 1..18: mol_type = other DNA
taacacgacacactctag

SEQ ID NO: 8137 - DNA, 18 bp, synthetic construct
  source 1..18: mol_type = other DNA
taacacgacccattatag

SEQ ID NO: 8138 - DNA, 18 bp, synthetic construct
  source 1..18: mol_type = other DNA
taacacgagccactatag

SEQ ID NO: 8139 - DNA, 18 bp, synthetic construct
  source 1..18: mol_type = other DNA
taacgcgacgcactatag

SEQ ID NO: 8140 - DNA, 18 bp, synthetic construct
  source 1..18: mol_type = other DNA
taactcgactcactagag

SEQ ID NO: 8141 - DNA, 18 bp, synthetic construct
  source 1..18: mol_type = other DNA
taagacgaatcactttag

SEQ ID NO: 8142 - DNA, 18 bp, synthetic construct
  source 1..18: mol_type = other DNA
taagatgactcacaatag

SEQ ID NO: 8143 - DNA, 18 bp, synthetic construct
  source 1..18: mol_type = other DNA
taataagaatgactatag

SEQ ID NO: 8144 - DNA, 18 bp, synthetic construct
  source 1..18: mol_type = other DNA
taatacaactcgctagag

SEQ ID NO: 8145 - DNA, 18 bp, synthetic construct
  source 1..18: mol_type = other DNA
taataccactcagaatag

SEQ ID NO: 8146 - DNA, 18 bp, synthetic construct
  source 1..18: mol_type = other DNA
taatacgaagcactattg

SEQ ID NO: 8147 - DNA, 18 bp, synthetic construct
  source 1..18: mol_type = other DNA
taatacgacgcaatttag

SEQ ID NO: 8148 - DNA, 18 bp, synthetic construct
  source 1..18: mol_type = other DNA
taatacgactaacgacag

SEQ ID NO: 8149 - DNA, 18 bp, synthetic construct
  source 1..18: mol_type = other DNA
taatacgactcacaatta

SEQ ID NO: 8150 - DNA, 18 bp, synthetic construct
  source 1..18: mol_type = other DNA
taatacgactctccagag

SEQ ID NO: 8151 - DNA, 18 bp, synthetic construct
  source 1..18: mol_type = other DNA
taatacgactgacaatcg

SEQ ID NO: 8152 - DNA, 18 bp, synthetic construct
  source 1..18: mol_type = other DNA
taatacgactgagcatag

SEQ ID NO: 8153 - DNA, 18 bp, synthetic construct
  source 1..18: mol_type = other DNA
taatacgagtaactattg

SEQ ID NO: 8154 - DNA, 18 bp, synthetic construct
  source 1..18: mol_type = other DNA
taatacgagtcacaagag

SEQ ID NO: 8155 - DNA, 18 bp, synthetic construct
  source 1..18: mol_type = other DNA
taatacgagtccatatag

SEQ ID NO: 8156 - DNA, 18 bp, synthetic construct
  source 1..18: mol_type = other DNA
taatacgagttactatgg

SEQ ID NO: 8157 - DNA, 18 bp, synthetic construct
  source 1..18: mol_type = other DNA
taatacgattcgctagag

SEQ ID NO: 8158 - DNA, 18 bp, synthetic construct
  source 1..18: mol_type = other DNA
taatacgccccaatatag

SEQ ID NO: 8159 - DNA, 18 bp, synthetic construct
  source 1..18: mol_type = other DNA
taatacgcctgactaaag

SEQ ID NO: 8160 - DNA, 18 bp, synthetic construct
  source 1..18: mol_type = other DNA
taatactactcagtacag

SEQ ID NO: 8161 - DNA, 18 bp, synthetic construct
  source 1..18: mol_type = other DNA
taatactactcatgatag

SEQ ID NO: 8162 - DNA, 18 bp, synthetic construct
  source 1..18: mol_type = other DNA
taatactacttcctatag

SEQ ID NO: 8163 - DNA, 18 bp, synthetic construct
  source 1..18: mol_type = other DNA
taatagaactcacgatag

SEQ ID NO: 8164 - DNA, 18 bp, synthetic construct
  source 1..18: mol_type = other DNA
taataggactcacaagag

SEQ ID NO: 8165 - DNA, 18 bp, synthetic construct
  source 1..18: mol_type = other DNA
taataggcctcactattg

SEQ ID NO: 8166 - DNA, 18 bp, synthetic construct
  source 1..18: mol_type = other DNA
taatatgactgaatatag

SEQ ID NO: 8167 - DNA, 18 bp, synthetic construct
  source 1..18: mol_type = other DNA
taatatgagttactatag

SEQ ID NO: 8168 - DNA, 18 bp, synthetic construct
  source 1..18: mol_type = other DNA
taatatggctctctatag

SEQ ID NO: 8169 - DNA, 18 bp, synthetic construct
  source 1..18: mol_type = other DNA
taatattactcactatgg

SEQ ID NO: 8170 - DNA, 18 bp, synthetic construct
  source 1..18: mol_type = other DNA
taatccaagtcactatag

SEQ ID NO: 8171 - DNA, 18 bp, synthetic construct
  source 1..18: mol_type = other DNA
taatcccactcactacag

SEQ ID NO: 8172 - DNA, 18 bp, synthetic construct
  source 1..18: mol_type = other DNA
taatccgactcagtaaag

SEQ ID NO: 8173 - DNA, 18 bp, synthetic construct
  source 1..18: mol_type = other DNA
taatcggattcactatag

SEQ ID NO: 8174 - DNA, 18 bp, synthetic construct
  source 1..18: mol_type = other DNA
taatgcgagtcactttag

SEQ ID NO: 8175 - DNA, 18 bp, synthetic construct
  source 1..18: mol_type = other DNA
taattcgtctcacgatag

SEQ ID NO: 8176 - DNA, 18 bp, synthetic construct
  source 1..18: mol_type = other DNA
tactacgacgcactatcg

SEQ ID NO: 8177 - DNA, 18 bp, synthetic construct
  source 1..18: mol_type = other DNA
tactacgactaactacag

SEQ ID NO: 8178 - DNA, 18 bp, synthetic construct
  source 1..18: mol_type = other DNA
tactacgactcactctcg

SEQ ID NO: 8179 - DNA, 18 bp, synthetic construct
  source 1..18: mol_type = other DNA
tactacgagtcactttag

SEQ ID NO: 8180 - DNA, 18 bp, synthetic construct
  source 1..18: mol_type = other DNA
tactaggactcaccatag

SEQ ID NO: 8181 - DNA, 18 bp, synthetic construct
  source 1..18: mol_type = other DNA
tagaacgactcaccatag

SEQ ID NO: 8182 - DNA, 18 bp, synthetic construct
  source 1..18: mol_type = other DNA
tagaacgactccctatag

SEQ ID NO: 8183 - DNA, 18 bp, synthetic construct
  source 1..18: mol_type = other DNA
tagaccgactcactatag

SEQ ID NO: 8184 - DNA, 18 bp, synthetic construct
  source 1..18: mol_type = other DNA
tagtacgaatcactatcg

SEQ ID NO: 8185 - DNA, 18 bp, synthetic construct
  source 1..18: mol_type = other DNA
tagtacgactccatatag

SEQ ID NO: 8186 - DNA, 18 bp, synthetic construct
  source 1..18: mol_type = other DNA
tagtacgactgacaatag

SEQ ID NO: 8187 - DNA, 18 bp, synthetic construct
  source 1..18: mol_type = other DNA
tagtactacccactatag

SEQ ID NO: 8188 - DNA, 18 bp, synthetic construct
  source 1..18: mol_type = other DNA
tatgacggctcactatag

SEQ ID NO: 8189 - DNA, 18 bp, synthetic construct
  source 1..18: mol_type = other DNA
tattaggcctcactatag

SEQ ID NO: 8190 - DNA, 18 bp, synthetic construct
  source 1..18: mol_type = other DNA
tcatacgactcaatacag

SEQ ID NO: 8191 - DNA, 18 bp, synthetic construct
  source 1..18: mol_type = other DNA
tcatatgactcattatag

SEQ ID NO: 8192 - DNA, 18 bp, synthetic construct
  source 1..18: mol_type = other DNA
tgatacaactcactatcg

SEQ ID NO: 8193 - DNA, 18 bp, synthetic construct
  source 1..18: mol_type = other DNA
tgatacaactcactctag

SEQ ID NO: 8194 - DNA, 18 bp, synthetic construct
  source 1..18: mol_type = other DNA
tgctacgaatcactatag

SEQ ID NO: 8195 - DNA, 18 bp, synthetic construct
  source 1..18: mol_type = other DNA
ttctacgactcactctag

SEQ ID NO: 8196 - DNA, 18 bp, synthetic construct
  source 1..18: mol_type = other DNA
taaaacgactcacttaag

SEQ ID NO: 8197 - DNA, 18 bp, synthetic construct
  source 1..18: mol_type = other DNA
tattacgaatcactattg

SEQ ID NO: 8198 - DNA, 18 bp, synthetic construct
  source 1..18: mol_type = other DNA
tattacgacacaatatag

SEQ ID NO: 8199 - DNA, 18 bp, synthetic construct
  source 1..18: mol_type = other DNA
taatacgtctctctctag

SEQ ID NO: 8200 - DNA, 18 bp, synthetic construct
  source 1..18: mol_type = other DNA
taatacgacacacaaaag

SEQ ID NO: 8201 - DNA, 18 bp, synthetic construct
  source 1..18: mol_type = other DNA
tattaccactcactaaag

SEQ ID NO: 8202 - DNA, 18 bp, synthetic construct
  source 1..18: mol_type = other DNA
ttataagactctctatag

SEQ ID NO: 8203 - DNA, 18 bp, synthetic construct
  source 1..18: mol_type = other DNA
caatacgacacactttag

SEQ ID NO: 8204 - DNA, 18 bp, synthetic construct
  source 1..18: mol_type = other DNA
tcatacgtatcactatag

SEQ ID NO: 8205 - DNA, 18 bp, synthetic construct
  source 1..18: mol_type = other DNA
ttatacgaatccctatag

SEQ ID NO: 8206 - DNA, 18 bp, synthetic construct
  source 1..18: mol_type = other DNA
taatacgtctcacaacag

SEQ ID NO: 8207 - DNA, 18 bp, synthetic construct
  source 1..18: mol_type = other DNA
aataacgactcactatag

SEQ ID NO: 8208 - DNA, 18 bp, synthetic construct
  source 1..18: mol_type = other DNA
taataagaatcactttag

SEQ ID NO: 8209 - DNA, 18 bp, synthetic construct
  source 1..18: mol_type = other DNA
ttatactactcattatag

SEQ ID NO: 8210 - DNA, 18 bp, synthetic construct
  source 1..18: mol_type = other DNA
aaatccaactcactatag

SEQ ID NO: 8211 - DNA, 18 bp, synthetic construct
  source 1..18: mol_type = other DNA
taaaacgactcattacag

SEQ ID NO: 8212 - DNA, 18 bp, synthetic construct
  source 1..18: mol_type = other DNA
taatacagctcactttag

SEQ ID NO: 8213 - DNA, 18 bp, synthetic construct
  source 1..18: mol_type = other DNA
taatacgagtctctattg

SEQ ID NO: 8214 - DNA, 18 bp, synthetic construct
  source 1..18: mol_type = other DNA
taatacgattgtctatag

SEQ ID NO: 8215 - DNA, 18 bp, synthetic construct
  source 1..18: mol_type = other DNA
taatacgtctcaatctag

SEQ ID NO: 8216 - DNA, 18 bp, synthetic construct
  source 1..18: mol_type = other DNA
taatacgtctgactaaag

SEQ ID NO: 8217 - DNA, 18 bp, synthetic construct
  source 1..18: mol_type = other DNA
taatactaatcaccatag

SEQ ID NO: 8218 - DNA, 18 bp, synthetic construct
  source 1..18: mol_type = other DNA
taatactacaccctatag

SEQ ID NO: 8219 - DNA, 18 bp, synthetic construct
  source 1..18: mol_type = other DNA
tacttcgactcacaatag

SEQ ID NO: 8220 - DNA, 18 bp, synthetic construct
  source 1..18: mol_type = other DNA
tagtacgaatctctatag

SEQ ID NO: 8221 - DNA, 18 bp, synthetic construct
  source 1..18: mol_type = other DNA
tcattcgactcactctag

SEQ ID NO: 8222 - DNA, 18 bp, synthetic construct
  source 1..18: mol_type = other DNA
ttatacgaccctctatag

SEQ ID NO: 8223 - DNA, 18 bp, synthetic construct
  source 1..18: mol_type = other DNA
ttatccgactaactatag

SEQ ID NO: 8224 - DNA, 18 bp, synthetic construct
  source 1..18: mol_type = other DNA
ttatattactcactatag

SEQ ID NO: 8225 - DNA, 18 bp, synthetic construct
  source 1..18: mol_type = other DNA
taatacaacacattatag

SEQ ID NO: 8226 - DNA, 18 bp, synthetic construct
  source 1..18: mol_type = other DNA
taatacgattaactaaag

SEQ ID NO: 8227 - DNA, 18 bp, synthetic construct
  source 1..18: mol_type = other DNA
taattcgacccactttag

SEQ ID NO: 8228 - DNA, 18 bp, synthetic construct
  source 1..18: mol_type = other DNA
tactacgactctctattg

SEQ ID NO: 8229 - DNA, 18 bp, synthetic construct
  source 1..18: mol_type = other DNA
taacacgtctcacaatag

SEQ ID NO: 8230 - DNA, 18 bp, synthetic construct
  source 1..18: mol_type = other DNA
taatacgactcaaaaaag

SEQ ID NO: 8231 - DNA, 18 bp, synthetic construct
  source 1..18: mol_type = other DNA
tattacaacacactatag

SEQ ID NO: 8232 - DNA, 18 bp, synthetic construct
  source 1..18: mol_type = other DNA
atatccgactcactatag

SEQ ID NO: 8233 - DNA, 18 bp, synthetic construct
  source 1..18: mol_type = other DNA
ttatactaatcactatag

SEQ ID NO: 8234 - DNA, 18 bp, synthetic construct
  source 1..18: mol_type = other DNA
caattcgactcattatag

SEQ ID NO: 8235 - DNA, 18 bp, synthetic construct
  source 1..18: mol_type = other DNA
taatacgacatactgtag

SEQ ID NO: 8236 - DNA, 18 bp, synthetic construct
  source 1..18: mol_type = other DNA
taatacgatccactattg

SEQ ID NO: 8237 - DNA, 18 bp, synthetic construct
  source 1..18: mol_type = other DNA
taatacgattcactactg

SEQ ID NO: 8238 - DNA, 18 bp, synthetic construct
  source 1..18: mol_type = other DNA
taatactactcactcttg

SEQ ID NO: 8239 - DNA, 18 bp, synthetic construct
  source 1..18: mol_type = other DNA
ttctacgactcaatatag

SEQ ID NO: 8240 - DNA, 18 bp, synthetic construct
  source 1..18: mol_type = other DNA
aaaaacgacccactatag

SEQ ID NO: 8241 - DNA, 18 bp, synthetic construct
  source 1..18: mol_type = other DNA
aaatacgactcacaatcg

SEQ ID NO: 8242 - DNA, 18 bp, synthetic construct
  source 1..18: mol_type = other DNA
aaatacgacttactacag

SEQ ID NO: 8243 - DNA, 18 bp, synthetic construct
  source 1..18: mol_type = other DNA
caattcgaatcactatag

SEQ ID NO: 8244 - DNA, 18 bp, synthetic construct
  source 1..18: mol_type = other DNA
taatacaaatcactatgg

SEQ ID NO: 8245 - DNA, 18 bp, synthetic construct
  source 1..18: mol_type = other DNA
taataccactctctatgg

SEQ ID NO: 8246 - DNA, 18 bp, synthetic construct
  source 1..18: mol_type = other DNA
taataccattcaatatag

SEQ ID NO: 8247 - DNA, 18 bp, synthetic construct
  source 1..18: mol_type = other DNA
taatacctcttactatag

SEQ ID NO: 8248 - DNA, 18 bp, synthetic construct
  source 1..18: mol_type = other DNA
taatacgacgaactattg

SEQ ID NO: 8249 - DNA, 18 bp, synthetic construct
  source 1..18: mol_type = other DNA
taatacgactccttattg

SEQ ID NO: 8250 - DNA, 18 bp, synthetic construct
  source 1..18: mol_type = other DNA
taatacgattcgcaatag

SEQ ID NO: 8251 - DNA, 18 bp, synthetic construct
  source 1..18: mol_type = other DNA
taatacgcgtcactattg

SEQ ID NO: 8252 - DNA, 18 bp, synthetic construct
  source 1..18: mol_type = other DNA
taatactagtcactaaag

SEQ ID NO: 8253 - DNA, 18 bp, synthetic construct
  source 1..18: mol_type = other DNA
taataggactcaatacag

SEQ ID NO: 8254 - DNA, 18 bp, synthetic construct
  source 1..18: mol_type = other DNA
taataggtctccctatag

SEQ ID NO: 8255 - DNA, 18 bp, synthetic construct
  source 1..18: mol_type = other DNA
taattcggctaactatag

SEQ ID NO: 8256 - DNA, 18 bp, synthetic construct
  source 1..18: mol_type = other DNA
tactcagactcactatag

SEQ ID NO: 8257 - DNA, 18 bp, synthetic construct
  source 1..18: mol_type = other DNA
tagtactactcactatcg

SEQ ID NO: 8258 - DNA, 18 bp, synthetic construct
  source 1..18: mol_type = other DNA
tattacaactcactatgg

SEQ ID NO: 8259 - DNA, 18 bp, synthetic construct
  source 1..18: mol_type = other DNA
tattacgactggctatag

SEQ ID NO: 8260 - DNA, 18 bp, synthetic construct
  source 1..18: mol_type = other DNA
tattacgagtaactatag

SEQ ID NO: 8261 - DNA, 18 bp, synthetic construct
  source 1..18: mol_type = other DNA
ttatacgactgaccatag

SEQ ID NO: 8262 - DNA, 18 bp, synthetic construct
  source 1..18: mol_type = other DNA
tcattcgactctctatag

SEQ ID NO: 8263 - DNA, 18 bp, synthetic construct
  source 1..18: mol_type = other DNA
ttatacgtctctctatag

SEQ ID NO: 8264 - DNA, 18 bp, synthetic construct
  source 1..18: mol_type = other DNA
taaaacgtcttactatag

SEQ ID NO: 8265 - DNA, 18 bp, synthetic construct
  source 1..18: mol_type = other DNA
ttatacgactctgtatag

SEQ ID NO: 8266 - DNA, 18 bp, synthetic construct
  source 1..18: mol_type = other DNA
taatatgacttactattg

SEQ ID NO: 8267 - DNA, 18 bp, synthetic construct
  source 1..18: mol_type = other DNA
aaatacaaatcactatag

SEQ ID NO: 8268 - DNA, 18 bp, synthetic construct
  source 1..18: mol_type = other DNA
caatacgaatcactttag

SEQ ID NO: 8269 - DNA, 18 bp, synthetic construct
  source 1..18: mol_type = other DNA
taatacgacttattctag

SEQ ID NO: 8270 - DNA, 18 bp, synthetic construct
  source 1..18: mol_type = other DNA
taatacgctacactatag

SEQ ID NO: 8271 - DNA, 18 bp, synthetic construct
  source 1..18: mol_type = other DNA
taatatgactccctaaag

SEQ ID NO: 8272 - DNA, 18 bp, synthetic construct
  source 1..18: mol_type = other DNA
taatccgactcattttag

SEQ ID NO: 8273 - DNA, 18 bp, synthetic construct
  source 1..18: mol_type = other DNA
tacttccactcactatag

SEQ ID NO: 8274 - DNA, 18 bp, synthetic construct
  source 1..18: mol_type = other DNA
tattacgacacaccatag

SEQ ID NO: 8275 - DNA, 18 bp, synthetic construct
  source 1..18: mol_type = other DNA
ttattcgagtcactatag

SEQ ID NO: 8276 - DNA, 18 bp, synthetic construct
  source 1..18: mol_type = other DNA
ttatacgacacactaaag

SEQ ID NO: 8277 - DNA, 18 bp, synthetic construct
  source 1..18: mol_type = other DNA
taatacgtctccctttag

SEQ ID NO: 8278 - DNA, 18 bp, synthetic construct
  source 1..18: mol_type = other DNA
taattcgactaactaaag

SEQ ID NO: 8279 - DNA, 18 bp, synthetic construct
  source 1..18: mol_type = other DNA
tatcacgactcactaaag

SEQ ID NO: 8280 - DNA, 18 bp, synthetic construct
  source 1..18: mol_type = other DNA
taatatgactcactaatg

SEQ ID NO: 8281 - DNA, 18 bp, synthetic construct
  source 1..18: mol_type = other DNA
aaataccactcactttag

SEQ ID NO: 8282 - DNA, 18 bp, synthetic construct
  source 1..18: mol_type = other DNA
taatacctttcactatag

SEQ ID NO: 8283 - DNA, 18 bp, synthetic construct
  source 1..18: mol_type = other DNA
taatacgaatcaccattg

SEQ ID NO: 8284 - DNA, 18 bp, synthetic construct
  source 1..18: mol_type = other DNA
taatacgacccacaaaag

SEQ ID NO: 8285 - DNA, 18 bp, synthetic construct
  source 1..18: mol_type = other DNA
tagtactactcactattg

SEQ ID NO: 8286 - DNA, 18 bp, synthetic construct
  source 1..18: mol_type = other DNA
taatacaactctcaatag

SEQ ID NO: 8287 - DNA, 18 bp, synthetic construct
  source 1..18: mol_type = other DNA
taattcgacacactattg

SEQ ID NO: 8288 - DNA, 18 bp, synthetic construct
  source 1..18: mol_type = other DNA
taatatgaatcactttag

SEQ ID NO: 8289 - DNA, 18 bp, synthetic construct
  source 1..18: mol_type = other DNA
taatgcgacacactttag

SEQ ID NO: 8290 - DNA, 18 bp, synthetic construct
  source 1..18: mol_type = other DNA
aaatacgacacagtatag

SEQ ID NO: 8291 - DNA, 18 bp, synthetic construct
  source 1..18: mol_type = other DNA
taatacgtatcagtatag

SEQ ID NO: 8292 - DNA, 18 bp, synthetic construct
  source 1..18: mol_type = other DNA
taatactacttattatag

SEQ ID NO: 8293 - DNA, 18 bp, synthetic construct
  source 1..18: mol_type = other DNA
taatgcgactctatatag

SEQ ID NO: 8294 - DNA, 18 bp, synthetic construct
  source 1..18: mol_type = other DNA
taattccactcaatatag

SEQ ID NO: 8295 - DNA, 18 bp, synthetic construct
  source 1..18: mol_type = other DNA
taattcgtctgactatag

SEQ ID NO: 8296 - DNA, 18 bp, synthetic construct
  source 1..18: mol_type = other DNA
tacaacgacacactatag

SEQ ID NO: 8297 - DNA, 18 bp, synthetic construct
  source 1..18: mol_type = other DNA
tattacgactccatatag

SEQ ID NO: 8298 - DNA, 18 bp, synthetic construct
  source 1..18: mol_type = other DNA
tattacgactgactacag

SEQ ID NO: 8299 - DNA, 18 bp, synthetic construct
  source 1..18: mol_type = other DNA
tcttacgacacactatag

SEQ ID NO: 8300 - DNA, 18 bp, synthetic construct
  source 1..18: mol_type = other DNA
ttatacgactcattagag

SEQ ID NO: 8301 - DNA, 18 bp, synthetic construct
  source 1..18: mol_type = other DNA
taataggactcacattag

SEQ ID NO: 8302 - DNA, 18 bp, synthetic construct
  source 1..18: mol_type = other DNA
tattacgactcactttcg

SEQ ID NO: 8303 - DNA, 18 bp, synthetic construct
  source 1..18: mol_type = other DNA
tcatacgacacactaaag

SEQ ID NO: 8304 - DNA, 18 bp, synthetic construct
  source 1..18: mol_type = other DNA
ttatacgaataactatag

SEQ ID NO: 8305 - DNA, 18 bp, synthetic construct
  source 1..18: mol_type = other DNA
acatacgacacactatag

SEQ ID NO: 8306 - DNA, 18 bp, synthetic construct
  source 1..18: mol_type = other DNA
taatacgactaaccaaag

SEQ ID NO: 8307 - DNA, 18 bp, synthetic construct
  source 1..18: mol_type = other DNA
tcatacgactcaatattg

SEQ ID NO: 8308 - DNA, 18 bp, synthetic construct
  source 1..18: mol_type = other DNA
ttataccaatcactatag

SEQ ID NO: 8309 - DNA, 18 bp, synthetic construct
  source 1..18: mol_type = other DNA
ttatatgacttactatag

SEQ ID NO: 8310 - DNA, 18 bp, synthetic construct
  source 1..18: mol_type = other DNA
aaatcctactcactatag

SEQ ID NO: 8311 - DNA, 18 bp, synthetic construct
  source 1..18: mol_type = other DNA
caatacgactcaatattg

SEQ ID NO: 8312 - DNA, 18 bp, synthetic construct
  source 1..18: mol_type = other DNA
caattggactcactatag

SEQ ID NO: 8313 - DNA, 18 bp, synthetic construct
  source 1..18: mol_type = other DNA
gaatacatctcactatag

SEQ ID NO: 8314 - DNA, 18 bp, synthetic construct
  source 1..18: mol_type = other DNA
taaaacgaataactatag

SEQ ID NO: 8315 - DNA, 18 bp, synthetic construct
  source 1..18: mol_type = other DNA
taaaacgtgtcactatag

SEQ ID NO: 8316 - DNA, 18 bp, synthetic construct
  source 1..18: mol_type = other DNA
taaatcgactgactatag

SEQ ID NO: 8317 - DNA, 18 bp, synthetic construct
  source 1..18: mol_type = other DNA
taacataactcactatag

SEQ ID NO: 8318 - DNA, 18 bp, synthetic construct
  source 1..18: mol_type = other DNA
taactccactcactatag

SEQ ID NO: 8319 - DNA, 18 bp, synthetic construct
  source 1..18: mol_type = other DNA
taataagtctcactagag

SEQ ID NO: 8320 - DNA, 18 bp, synthetic construct
  source 1..18: mol_type = other DNA
taatacaacacactatgg

SEQ ID NO: 8321 - DNA, 18 bp, synthetic construct
  source 1..18: mol_type = other DNA
taatacgacatactacag

SEQ ID NO: 8322 - DNA, 18 bp, synthetic construct
  source 1..18: mol_type = other DNA
taatacgatttactatcg

SEQ ID NO: 8323 - DNA, 18 bp, synthetic construct
  source 1..18: mol_type = other DNA
taatacggcttaatatag

SEQ ID NO: 8324 - DNA, 18 bp, synthetic construct
  source 1..18: mol_type = other DNA
taataggaatcaatatag

SEQ ID NO: 8325 - DNA, 18 bp, synthetic construct
  source 1..18: mol_type = other DNA
taatatgacctactatag

SEQ ID NO: 8326 - DNA, 18 bp, synthetic construct
  source 1..18: mol_type = other DNA
taatatgactgactttag

SEQ ID NO: 8327 - DNA, 18 bp, synthetic construct
  source 1..18: mol_type = other DNA
taatccgacccactattg

SEQ ID NO: 8328 - DNA, 18 bp, synthetic construct
  source 1..18: mol_type = other DNA
taattcgactcagtttag

SEQ ID NO: 8329 - DNA, 18 bp, synthetic construct
  source 1..18: mol_type = other DNA
taattcgactccatatag

SEQ ID NO: 8330 - DNA, 18 bp, synthetic construct
  source 1..18: mol_type = other DNA
tcatatgactcaatatag

SEQ ID NO: 8331 - DNA, 18 bp, synthetic construct
  source 1..18: mol_type = other DNA
tcctacgactctctatag

SEQ ID NO: 8332 - DNA, 18 bp, synthetic construct
  source 1..18: mol_type = other DNA
tgataagactcactatcg

SEQ ID NO: 8333 - DNA, 18 bp, synthetic construct
  source 1..18: mol_type = other DNA
ttatacgacttactatgg

SEQ ID NO: 8334 - DNA, 18 bp, synthetic construct
  source 1..18: mol_type = other DNA
ttatgcgacttactatag

SEQ ID NO: 8335 - DNA, 18 bp, synthetic construct
  source 1..18: mol_type = other DNA
atatacgactcactagag

SEQ ID NO: 8336 - DNA, 18 bp, synthetic construct
  source 1..18: mol_type = other DNA
caacacgactcattatag

SEQ ID NO: 8337 - DNA, 18 bp, synthetic construct
  source 1..18: mol_type = other DNA
caatacgaataactatag

SEQ ID NO: 8338 - DNA, 18 bp, synthetic construct
  source 1..18: mol_type = other DNA
caatacgacgccctatag

SEQ ID NO: 8339 - DNA, 18 bp, synthetic construct
  source 1..18: mol_type = other DNA
caatgcgaatcactatag

SEQ ID NO: 8340 - DNA, 18 bp, synthetic construct
  source 1..18: mol_type = other DNA
ccatacgactcgctatag

SEQ ID NO: 8341 - DNA, 18 bp, synthetic construct
  source 1..18: mol_type = other DNA
gcatacgactcacaatag

SEQ ID NO: 8342 - DNA, 18 bp, synthetic construct
  source 1..18: mol_type = other DNA
gtatacgacacactatag

SEQ ID NO: 8343 - DNA, 18 bp, synthetic construct
  source 1..18: mol_type = other DNA
gtatacgagtcactatag

SEQ ID NO: 8344 - DNA, 18 bp, synthetic construct
  source 1..18: mol_type = other DNA
taaaaccactcactatcg

SEQ ID NO: 8345 - DNA, 18 bp, synthetic construct
  source 1..18: mol_type = other DNA
taaaaggcctcactatag

SEQ ID NO: 8346 - DNA, 18 bp, synthetic construct
  source 1..18: mol_type = other DNA
taacacaactcactatcg

SEQ ID NO: 8347 - DNA, 18 bp, synthetic construct
  source 1..18: mol_type = other DNA
taagaagactcattatag

SEQ ID NO: 8348 - DNA, 18 bp, synthetic construct
  source 1..18: mol_type = other DNA
taataagactccgtatag

SEQ ID NO: 8349 - DNA, 18 bp, synthetic construct
  source 1..18: mol_type = other DNA
taataatactcactatcg

SEQ ID NO: 8350 - DNA, 18 bp, synthetic construct
  source 1..18: mol_type = other DNA
taatacaactaactctag

SEQ ID NO: 8351 - DNA, 18 bp, synthetic construct
  source 1..18: mol_type = other DNA
taatacaactcacgctag

SEQ ID NO: 8352 - DNA, 18 bp, synthetic construct
  source 1..18: mol_type = other DNA
taatacaactgaatatag

SEQ ID NO: 8353 - DNA, 18 bp, synthetic construct
  source 1..18: mol_type = other DNA
taatacagcttactatag

SEQ ID NO: 8354 - DNA, 18 bp, synthetic construct
  source 1..18: mol_type = other DNA
taataccaatcactatcg

SEQ ID NO: 8355 - DNA, 18 bp, synthetic construct
  source 1..18: mol_type = other DNA
taataccactcactggag

SEQ ID NO: 8356 - DNA, 18 bp, synthetic construct
  source 1..18: mol_type = other DNA
taataccagtcactttag

SEQ ID NO: 8357 - DNA, 18 bp, synthetic construct
  source 1..18: mol_type = other DNA
taatacccctcactattg

SEQ ID NO: 8358 - DNA, 18 bp, synthetic construct
  source 1..18: mol_type = other DNA
taatacgacacactgcag

SEQ ID NO: 8359 - DNA, 18 bp, synthetic construct
  source 1..18: mol_type = other DNA
taatacgactccttatgg

SEQ ID NO: 8360 - DNA, 18 bp, synthetic construct
  source 1..18: mol_type = other DNA
taatacgacttagaatag

SEQ ID NO: 8361 - DNA, 18 bp, synthetic construct
  source 1..18: mol_type = other DNA
taatacgagtcaccttag

SEQ ID NO: 8362 - DNA, 18 bp, synthetic construct
  source 1..18: mol_type = other DNA
taatacggctcacgttag

SEQ ID NO: 8363 - DNA, 18 bp, synthetic construct
  source 1..18: mol_type = other DNA
taatacggctcactgaag

SEQ ID NO: 8364 - DNA, 18 bp, synthetic construct
  source 1..18: mol_type = other DNA
taatacggctcagtacag

SEQ ID NO: 8365 - DNA, 18 bp, synthetic construct
  source 1..18: mol_type = other DNA
taatacgtctcaccgtag

SEQ ID NO: 8366 - DNA, 18 bp, synthetic construct
  source 1..18: mol_type = other DNA
taataggaatcactatcg

SEQ ID NO: 8367 - DNA, 18 bp, synthetic construct
  source 1..18: mol_type = other DNA
taatccgactctctagag

SEQ ID NO: 8368 - DNA, 18 bp, synthetic construct
  source 1..18: mol_type = other DNA
taatctgactcagtatag

SEQ ID NO: 8369 - DNA, 18 bp, synthetic construct
  source 1..18: mol_type = other DNA
taatgcgacccactatgg

SEQ ID NO: 8370 - DNA, 18 bp, synthetic construct
  source 1..18: mol_type = other DNA
taatgcgactcagtttag

SEQ ID NO: 8371 - DNA, 18 bp, synthetic construct
  source 1..18: mol_type = other DNA
taatgcgactcattgtag

SEQ ID NO: 8372 - DNA, 18 bp, synthetic construct
  source 1..18: mol_type = other DNA
taatgctacttactatag

SEQ ID NO: 8373 - DNA, 18 bp, synthetic construct
  source 1..18: mol_type = other DNA
taatgggactcattatag

SEQ ID NO: 8374 - DNA, 18 bp, synthetic construct
  source 1..18: mol_type = other DNA
taattagactcactagag

SEQ ID NO: 8375 - DNA, 18 bp, synthetic construct
  source 1..18: mol_type = other DNA
tactacgactctcgatag

SEQ ID NO: 8376 - DNA, 18 bp, synthetic construct
  source 1..18: mol_type = other DNA
tacttcgactcagtatag

SEQ ID NO: 8377 - DNA, 18 bp, synthetic construct
  source 1..18: mol_type = other DNA
tagtacgactcactttcg

SEQ ID NO: 8378 - DNA, 18 bp, synthetic construct
  source 1..18: mol_type = other DNA
tagtacgactctccatag

SEQ ID NO: 8379 - DNA, 18 bp, synthetic construct
  source 1..18: mol_type = other DNA
tagtacgattccctatag

SEQ ID NO: 8380 - DNA, 18 bp, synthetic construct
  source 1..18: mol_type = other DNA
tattacgactcactagcg

SEQ ID NO: 8381 - DNA, 18 bp, synthetic construct
  source 1..18: mol_type = other DNA
tattacggctcactatgg

SEQ ID NO: 8382 - DNA, 18 bp, synthetic construct
  source 1..18: mol_type = other DNA
tattacggctgactatag

SEQ ID NO: 8383 - DNA, 18 bp, synthetic construct
  source 1..18: mol_type = other DNA
tattccgactcactagag

SEQ ID NO: 8384 - DNA, 18 bp, synthetic construct
  source 1..18: mol_type = other DNA
tcatacgactaacaatag

SEQ ID NO: 8385 - DNA, 18 bp, synthetic construct
  source 1..18: mol_type = other DNA
tgatacaactcagtatag

SEQ ID NO: 8386 - DNA, 18 bp, synthetic construct
  source 1..18: mol_type = other DNA
tgatacggctcacgatag

SEQ ID NO: 8387 - DNA, 18 bp, synthetic construct
  source 1..18: mol_type = other DNA
tgatccgactcactatcg

SEQ ID NO: 8388 - DNA, 18 bp, synthetic construct
  source 1..18: mol_type = other DNA
tggtaccactcactatag

SEQ ID NO: 8389 - DNA, 18 bp, synthetic construct
  source 1..18: mol_type = other DNA
tattacaacttactatag

SEQ ID NO: 8390 - DNA, 18 bp, synthetic construct
  source 1..18: mol_type = other DNA
taatacgacacataatag

SEQ ID NO: 8391 - DNA, 18 bp, synthetic construct
  source 1..18: mol_type = other DNA
taatactactccctattg

SEQ ID NO: 8392 - DNA, 18 bp, synthetic construct
  source 1..18: mol_type = other DNA
ttatgcgactctctatag

SEQ ID NO: 8393 - DNA, 18 bp, synthetic construct
  source 1..18: mol_type = other DNA
taatactactcacaattg

SEQ ID NO: 8394 - DNA, 18 bp, synthetic construct
  source 1..18: mol_type = other DNA
aaatacaattcactatag

SEQ ID NO: 8395 - DNA, 18 bp, synthetic construct
  source 1..18: mol_type = other DNA
taaagcgactctctatag

SEQ ID NO: 8396 - DNA, 18 bp, synthetic construct
  source 1..18: mol_type = other DNA
taatacgtcccactattg

SEQ ID NO: 8397 - DNA, 18 bp, synthetic construct
  source 1..18: mol_type = other DNA
taatttgactcaccatag

SEQ ID NO: 8398 - DNA, 18 bp, synthetic construct
  source 1..18: mol_type = other DNA
tagtacgactctctttag

SEQ ID NO: 8399 - DNA, 18 bp, synthetic construct
  source 1..18: mol_type = other DNA
taatacgaatcacaattg

SEQ ID NO: 8400 - DNA, 18 bp, synthetic construct
  source 1..18: mol_type = other DNA
atataggactcactatag

SEQ ID NO: 8401 - DNA, 18 bp, synthetic construct
  source 1..18: mol_type = other DNA
taataagactgtctatag

SEQ ID NO: 8402 - DNA, 18 bp, synthetic construct
  source 1..18: mol_type = other DNA
taataatactcaatatag

SEQ ID NO: 8403 - DNA, 18 bp, synthetic construct
  source 1..18: mol_type = other DNA
taatacgacttaccattg

SEQ ID NO: 8404 - DNA, 18 bp, synthetic construct
  source 1..18: mol_type = other DNA
taatacgagtctctaaag

SEQ ID NO: 8405 - DNA, 18 bp, synthetic construct
  source 1..18: mol_type = other DNA
taatacgatacaatatag

SEQ ID NO: 8406 - DNA, 18 bp, synthetic construct
  source 1..18: mol_type = other DNA
taatacgtttaactatag

SEQ ID NO: 8407 - DNA, 18 bp, synthetic construct
  source 1..18: mol_type = other DNA
taatactagtctctatag

SEQ ID NO: 8408 - DNA, 18 bp, synthetic construct
  source 1..18: mol_type = other DNA
tagaacgacacactatag

SEQ ID NO: 8409 - DNA, 18 bp, synthetic construct
  source 1..18: mol_type = other DNA
tcataagactcactattg

SEQ ID NO: 8410 - DNA, 18 bp, synthetic construct
  source 1..18: mol_type = other DNA
tcatacgtctcaccatag

SEQ ID NO: 8411 - DNA, 18 bp, synthetic construct
  source 1..18: mol_type = other DNA
taataagtctctctatag

SEQ ID NO: 8412 - DNA, 18 bp, synthetic construct
  source 1..18: mol_type = other DNA
taatacaactaactattg

SEQ ID NO: 8413 - DNA, 18 bp, synthetic construct
  source 1..18: mol_type = other DNA
taatacgacacaatttag

SEQ ID NO: 8414 - DNA, 18 bp, synthetic construct
  source 1..18: mol_type = other DNA
taaaactattcactatag

SEQ ID NO: 8415 - DNA, 18 bp, synthetic construct
  source 1..18: mol_type = other DNA
taatacgactaattattg

SEQ ID NO: 8416 - DNA, 18 bp, synthetic construct
  source 1..18: mol_type = other DNA
taatacgactcatactag

SEQ ID NO: 8417 - DNA, 18 bp, synthetic construct
  source 1..18: mol_type = other DNA
ttatacgactcccaatag

SEQ ID NO: 8418 - DNA, 18 bp, synthetic construct
  source 1..18: mol_type = other DNA
aaatacgtcgcactatag

SEQ ID NO: 8419 - DNA, 18 bp, synthetic construct
  source 1..18: mol_type = other DNA
ctacacgactcactatag

SEQ ID NO: 8420 - DNA, 18 bp, synthetic construct
  source 1..18: mol_type = other DNA
taaaagggctcactatag

SEQ ID NO: 8421 - DNA, 18 bp, synthetic construct
  source 1..18: mol_type = other DNA
taacacgtcccactatag

SEQ ID NO: 8422 - DNA, 18 bp, synthetic construct
  source 1..18: mol_type = other DNA
taataccaattactatag

SEQ ID NO: 8423 - DNA, 18 bp, synthetic construct
  source 1..18: mol_type = other DNA
taatacgactaagaatag

SEQ ID NO: 8424 - DNA, 18 bp, synthetic construct
  source 1..18: mol_type = other DNA
taatacgactatgtatag

SEQ ID NO: 8425 - DNA, 18 bp, synthetic construct
  source 1..18: mol_type = other DNA
taatacgactctctctcg

SEQ ID NO: 8426 - DNA, 18 bp, synthetic construct
  source 1..18: mol_type = other DNA
taatacgagtctttatag

SEQ ID NO: 8427 - DNA, 18 bp, synthetic construct
  source 1..18: mol_type = other DNA
taatacgtctaactatcg

SEQ ID NO: 8428 - DNA, 18 bp, synthetic construct
  source 1..18: mol_type = other DNA
taatactactcactccag

SEQ ID NO: 8429 - DNA, 18 bp, synthetic construct
  source 1..18: mol_type = other DNA
taatgccacttactatag

SEQ ID NO: 8430 - DNA, 18 bp, synthetic construct
  source 1..18: mol_type = other DNA
taattctactcactatgg

SEQ ID NO: 8431 - DNA, 18 bp, synthetic construct
  source 1..18: mol_type = other DNA
tactaagcctcactatag

SEQ ID NO: 8432 - DNA, 18 bp, synthetic construct
  source 1..18: mol_type = other DNA
tagtatgactcactattg

SEQ ID NO: 8433 - DNA, 18 bp, synthetic construct
  source 1..18: mol_type = other DNA
tatcacgactcagtatag

SEQ ID NO: 8434 - DNA, 18 bp, synthetic construct
  source 1..18: mol_type = other DNA
tattaggactcaatatag

SEQ ID NO: 8435 - DNA, 18 bp, synthetic construct
  source 1..18: mol_type = other DNA
tattccgacttactatag

SEQ ID NO: 8436 - DNA, 18 bp, synthetic construct
  source 1..18: mol_type = other DNA
tcataagactctctatag

SEQ ID NO: 8437 - DNA, 18 bp, synthetic construct
  source 1..18: mol_type = other DNA
tcatatgaatcactatag

SEQ ID NO: 8438 - DNA, 18 bp, synthetic construct
  source 1..18: mol_type = other DNA
tgatacgactaactaaag

SEQ ID NO: 8439 - DNA, 18 bp, synthetic construct
  source 1..18: mol_type = other DNA
tgatacgactcataatag

SEQ ID NO: 8440 - DNA, 18 bp, synthetic construct
  source 1..18: mol_type = other DNA
ttagacgactcactttag

SEQ ID NO: 8441 - DNA, 18 bp, synthetic construct
  source 1..18: mol_type = other DNA
taattcgactcaatattg

SEQ ID NO: 8442 - DNA, 18 bp, synthetic construct
  source 1..18: mol_type = other DNA
taaaacgattcaccatag

SEQ ID NO: 8443 - DNA, 18 bp, synthetic construct
  source 1..18: mol_type = other DNA
tattccgactcacaatag

SEQ ID NO: 8444 - DNA, 18 bp, synthetic construct
  source 1..18: mol_type = other DNA
acatgcgactcactatag

SEQ ID NO: 8445 - DNA, 18 bp, synthetic construct
  source 1..18: mol_type = other DNA
taatacaacccacaatag

SEQ ID NO: 8446 - DNA, 18 bp, synthetic construct
  source 1..18: mol_type = other DNA
taatactacccactattg

SEQ ID NO: 8447 - DNA, 18 bp, synthetic construct
  source 1..18: mol_type = other DNA
taatataattcactatag

SEQ ID NO: 8448 - DNA, 18 bp, synthetic construct
  source 1..18: mol_type = other DNA
tatcacgacacactatag

SEQ ID NO: 8449 - DNA, 18 bp, synthetic construct
  source 1..18: mol_type = other DNA
tattactagtcactatag

SEQ ID NO: 8450 - DNA, 18 bp, synthetic construct
  source 1..18: mol_type = other DNA
taatacgatttactattg

SEQ ID NO: 8451 - DNA, 18 bp, synthetic construct
  source 1..18: mol_type = other DNA
taaaactactcactttag

SEQ ID NO: 8452 - DNA, 18 bp, synthetic construct
  source 1..18: mol_type = other DNA
taatacttctcactaaag

SEQ ID NO: 8453 - DNA, 18 bp, synthetic construct
  source 1..18: mol_type = other DNA
tattacgtctcaatatag

SEQ ID NO: 8454 - DNA, 18 bp, synthetic construct
  source 1..18: mol_type = other DNA
taaaactcctcactatag

SEQ ID NO: 8455 - DNA, 18 bp, synthetic construct
  source 1..18: mol_type = other DNA
taataagactcactaacg

SEQ ID NO: 8456 - DNA, 18 bp, synthetic construct
  source 1..18: mol_type = other DNA
taatacgactaattaaag

SEQ ID NO: 8457 - DNA, 18 bp, synthetic construct
  source 1..18: mol_type = other DNA
taatactactccctttag

SEQ ID NO: 8458 - DNA, 18 bp, synthetic construct
  source 1..18: mol_type = other DNA
tataacgactcaatatag

SEQ ID NO: 8459 - DNA, 18 bp, synthetic construct
  source 1..18: mol_type = other DNA
tatttcgacccactatag

SEQ ID NO: 8460 - DNA, 18 bp, synthetic construct
  source 1..18: mol_type = other DNA
tcatacgtctctctatag

SEQ ID NO: 8461 - DNA, 18 bp, synthetic construct
  source 1..18: mol_type = other DNA
taatacgtatcactttag

SEQ ID NO: 8462 - DNA, 18 bp, synthetic construct
  source 1..18: mol_type = other DNA
taatactacttaatatag

SEQ ID NO: 8463 - DNA, 18 bp, synthetic construct
  source 1..18: mol_type = other DNA
tattacaaatcactatag

SEQ ID NO: 8464 - DNA, 18 bp, synthetic construct
  source 1..18: mol_type = other DNA
taatactaatcactattg

SEQ ID NO: 8465 - DNA, 18 bp, synthetic construct
  source 1..18: mol_type = other DNA
tattacgactctttatag

SEQ ID NO: 8466 - DNA, 18 bp, synthetic construct
  source 1..18: mol_type = other DNA
tattacgaatctctatag

SEQ ID NO: 8467 - DNA, 18 bp, synthetic construct
  source 1..18: mol_type = other DNA
taatactactctctattg

SEQ ID NO: 8468 - DNA, 18 bp, synthetic construct
  source 1..18: mol_type = other DNA
tattacgactcaatttag

SEQ ID NO: 8469 - DNA, 18 bp, synthetic construct
  source 1..18: mol_type = other DNA
atatacgactcaatatag

SEQ ID NO: 8470 - DNA, 18 bp, synthetic construct
  source 1..18: mol_type = other DNA
taatactattcactaaag

SEQ ID NO: 8471 - DNA, 18 bp, synthetic construct
  source 1..18: mol_type = other DNA
tagtacgactcacattag

SEQ ID NO: 8472 - DNA, 18 bp, synthetic construct
  source 1..18: mol_type = other DNA
taatacgattccctattg

SEQ ID NO: 8473 - DNA, 18 bp, synthetic construct
  source 1..18: mol_type = other DNA
tacaacgattcactatag

SEQ ID NO: 8474 - DNA, 18 bp, synthetic construct
  source 1..18: mol_type = other DNA
ttatacgaatcaccatag

SEQ ID NO: 8475 - DNA, 18 bp, synthetic construct
  source 1..18: mol_type = other DNA
ttatacgactcaatatgg

SEQ ID NO: 8476 - DNA, 18 bp, synthetic construct
  source 1..18: mol_type = other DNA
aaacacaactcactatag

SEQ ID NO: 8477 - DNA, 18 bp, synthetic construct
  source 1..18: mol_type = other DNA
aaatacacctcactatag

SEQ ID NO: 8478 - DNA, 18 bp, synthetic construct
  source 1..18: mol_type = other DNA
aaatacgacctactatag

SEQ ID NO: 8479 - DNA, 18 bp, synthetic construct
  source 1..18: mol_type = other DNA
taaaacgactcattatcg

SEQ ID NO: 8480 - DNA, 18 bp, synthetic construct
  source 1..18: mol_type = other DNA
taatacaacccattatag

SEQ ID NO: 8481 - DNA, 18 bp, synthetic construct
  source 1..18: mol_type = other DNA
taatacaactccttatag

SEQ ID NO: 8482 - DNA, 18 bp, synthetic construct
  source 1..18: mol_type = other DNA
taatacgaatcaatatgg

SEQ ID NO: 8483 - DNA, 18 bp, synthetic construct
  source 1..18: mol_type = other DNA
taatacgacttgctaaag

SEQ ID NO: 8484 - DNA, 18 bp, synthetic construct
  source 1..18: mol_type = other DNA
taatacgattcacgaaag

SEQ ID NO: 8485 - DNA, 18 bp, synthetic construct
  source 1..18: mol_type = other DNA
taatacgtgtcactacag

SEQ ID NO: 8486 - DNA, 18 bp, synthetic construct
  source 1..18: mol_type = other DNA
taatactgctgactatag

SEQ ID NO: 8487 - DNA, 18 bp, synthetic construct
  source 1..18: mol_type = other DNA
taatatgacacactctag

SEQ ID NO: 8488 - DNA, 18 bp, synthetic construct
  source 1..18: mol_type = other DNA
taatttgactaactatag

SEQ ID NO: 8489 - DNA, 18 bp, synthetic construct
  source 1..18: mol_type = other DNA
tacaacgactcattatag

SEQ ID NO: 8490 - DNA, 18 bp, synthetic construct
  source 1..18: mol_type = other DNA
tactacgaatcattatag

SEQ ID NO: 8491 - DNA, 18 bp, synthetic construct
  source 1..18: mol_type = other DNA
tactacgattcattatag

SEQ ID NO: 8492 - DNA, 18 bp, synthetic construct
  source 1..18: mol_type = other DNA
tactactactaactatag

SEQ ID NO: 8493 - DNA, 18 bp, synthetic construct
  source 1..18: mol_type = other DNA
tagtacgactcaataaag

SEQ ID NO: 8494 - DNA, 18 bp, synthetic construct
  source 1..18: mol_type = other DNA
tattatgacgcactatag

SEQ ID NO: 8495 - DNA, 18 bp, synthetic construct
  source 1..18: mol_type = other DNA
tcatacgaatcactttag

SEQ ID NO: 8496 - DNA, 18 bp, synthetic construct
  source 1..18: mol_type = other DNA
aaacaagactcactatag

SEQ ID NO: 8497 - DNA, 18 bp, synthetic construct
  source 1..18: mol_type = other DNA
aaatacgactcactaccg

SEQ ID NO: 8498 - DNA, 18 bp, synthetic construct
  source 1..18: mol_type = other DNA
aaatacgactcagtacag

SEQ ID NO: 8499 - DNA, 18 bp, synthetic construct
  source 1..18: mol_type = other DNA
aaatccgcctcactatag

SEQ ID NO: 8500 - DNA, 18 bp, synthetic construct
  source 1..18: mol_type = other DNA
acataccactcactatag

SEQ ID NO: 8501 - DNA, 18 bp, synthetic construct
  source 1..18: mol_type = other DNA
caatacaactcaatatag

SEQ ID NO: 8502 - DNA, 18 bp, synthetic construct
  source 1..18: mol_type = other DNA
caatacgactcccaatag

SEQ ID NO: 8503 - DNA, 18 bp, synthetic construct
  source 1..18: mol_type = other DNA
caatacgactcgatatag

SEQ ID NO: 8504 - DNA, 18 bp, synthetic construct
  source 1..18: mol_type = other DNA
caatacggctcactatgg

SEQ ID NO: 8505 - DNA, 18 bp, synthetic construct
  source 1..18: mol_type = other DNA
caatacgtcgcactatag

SEQ ID NO: 8506 - DNA, 18 bp, synthetic construct
  source 1..18: mol_type = other DNA
cactacgactcactattg

SEQ ID NO: 8507 - DNA, 18 bp, synthetic construct
  source 1..18: mol_type = other DNA
gcatacgactctctatag

SEQ ID NO: 8508 - DNA, 18 bp, synthetic construct
  source 1..18: mol_type = other DNA
taaaacgactaactagag

SEQ ID NO: 8509 - DNA, 18 bp, synthetic construct
  source 1..18: mol_type = other DNA
taacacgacacactacag

SEQ ID NO: 8510 - DNA, 18 bp, synthetic construct
  source 1..18: mol_type = other DNA
taacacggctcactaaag

SEQ ID NO: 8511 - DNA, 18 bp, synthetic construct
  source 1..18: mol_type = other DNA
taacacgtctgactatag

SEQ ID NO: 8512 - DNA, 18 bp, synthetic construct
  source 1..18: mol_type = other DNA
taagacgactaactttag

SEQ ID NO: 8513 - DNA, 18 bp, synthetic construct
  source 1..18: mol_type = other DNA
taagacgactcataatag

SEQ ID NO: 8514 - DNA, 18 bp, synthetic construct
  source 1..18: mol_type = other DNA
taagacgagtctctatag

SEQ ID NO: 8515 - DNA, 18 bp, synthetic construct
  source 1..18: mol_type = other DNA
taagacggctcactattg

SEQ ID NO: 8516 - DNA, 18 bp, synthetic construct
  source 1..18: mol_type = other DNA
taagacgtctcagtatag

SEQ ID NO: 8517 - DNA, 18 bp, synthetic construct
  source 1..18: mol_type = other DNA
taagactactcaatatag

SEQ ID NO: 8518 - DNA, 18 bp, synthetic construct
  source 1..18: mol_type = other DNA
taagatcactcactatag

SEQ ID NO: 8519 - DNA, 18 bp, synthetic construct
  source 1..18: mol_type = other DNA
taagatgaatcactatag

SEQ ID NO: 8520 - DNA, 18 bp, synthetic construct
  source 1..18: mol_type = other DNA
taagctgactcactatag

SEQ ID NO: 8521 - DNA, 18 bp, synthetic construct
  source 1..18: mol_type = other DNA
taataaggctcattatag

SEQ ID NO: 8522 - DNA, 18 bp, synthetic construct
  source 1..18: mol_type = other DNA
taataccacttactagag

SEQ ID NO: 8523 - DNA, 18 bp, synthetic construct
  source 1..18: mol_type = other DNA
taataccattcaccatag

SEQ ID NO: 8524 - DNA, 18 bp, synthetic construct
  source 1..18: mol_type = other DNA
taataccatttactatag

SEQ ID NO: 8525 - DNA, 18 bp, synthetic construct
  source 1..18: mol_type = other DNA
taatacgaatcaatacag

SEQ ID NO: 8526 - DNA, 18 bp, synthetic construct
  source 1..18: mol_type = other DNA
taatacgaatcaccagag

SEQ ID NO: 8527 - DNA, 18 bp, synthetic construct
  source 1..18: mol_type = other DNA
taatacgacgcaataaag

SEQ ID NO: 8528 - DNA, 18 bp, synthetic construct
  source 1..18: mol_type = other DNA
taatacgactcattctcg

SEQ ID NO: 8529 - DNA, 18 bp, synthetic construct
  source 1..18: mol_type = other DNA
taatacgactccctactg

SEQ ID NO: 8530 - DNA, 18 bp, synthetic construct
  source 1..18: mol_type = other DNA
taatacgactggcaatag

SEQ ID NO: 8531 - DNA, 18 bp, synthetic construct
  source 1..18: mol_type = other DNA
taatacgactgtctgtag

SEQ ID NO: 8532 - DNA, 18 bp, synthetic construct
  source 1..18: mol_type = other DNA
taatacgagacgctatag

SEQ ID NO: 8533 - DNA, 18 bp, synthetic construct
  source 1..18: mol_type = other DNA
taatacgagccattatag

SEQ ID NO: 8534 - DNA, 18 bp, synthetic construct
  source 1..18: mol_type = other DNA
taatacgattcactaccg

SEQ ID NO: 8535 - DNA, 18 bp, synthetic construct
  source 1..18: mol_type = other DNA
taatacgattcgcgatag

SEQ ID NO: 8536 - DNA, 18 bp, synthetic construct
  source 1..18: mol_type = other DNA
taatacgcttcaccatag

SEQ ID NO: 8537 - DNA, 18 bp, synthetic construct
  source 1..18: mol_type = other DNA
taatactacgcactattg

SEQ ID NO: 8538 - DNA, 18 bp, synthetic construct
  source 1..18: mol_type = other DNA
taatactactccctatcg

SEQ ID NO: 8539 - DNA, 18 bp, synthetic construct
  source 1..18: mol_type = other DNA
taatactagtaactatag

SEQ ID NO: 8540 - DNA, 18 bp, synthetic construct
  source 1..18: mol_type = other DNA
taatatcactcactctag

SEQ ID NO: 8541 - DNA, 18 bp, synthetic construct
  source 1..18: mol_type = other DNA
taatatgactcattgtag

SEQ ID NO: 8542 - DNA, 18 bp, synthetic construct
  source 1..18: mol_type = other DNA
taatatgagtcaccatag

SEQ ID NO: 8543 - DNA, 18 bp, synthetic construct
  source 1..18: mol_type = other DNA
taatccggcttactatag

SEQ ID NO: 8544 - DNA, 18 bp, synthetic construct
  source 1..18: mol_type = other DNA
taatgcgaccaactatag

SEQ ID NO: 8545 - DNA, 18 bp, synthetic construct
  source 1..18: mol_type = other DNA
taatgcgactcactaggg

SEQ ID NO: 8546 - DNA, 18 bp, synthetic construct
  source 1..18: mol_type = other DNA
tacaaagactcactatag

SEQ ID NO: 8547 - DNA, 18 bp, synthetic construct
  source 1..18: mol_type = other DNA
taccatgactcactatag

SEQ ID NO: 8548 - DNA, 18 bp, synthetic construct
  source 1..18: mol_type = other DNA
tactacaacccactatag

SEQ ID NO: 8549 - DNA, 18 bp, synthetic construct
  source 1..18: mol_type = other DNA
tacttcgactcactctag

SEQ ID NO: 8550 - DNA, 18 bp, synthetic construct
  source 1..18: mol_type = other DNA
tagaacgactgactatag

SEQ ID NO: 8551 - DNA, 18 bp, synthetic construct
  source 1..18: mol_type = other DNA
tagtacgactcactcttg

SEQ ID NO: 8552 - DNA, 18 bp, synthetic construct
  source 1..18: mol_type = other DNA
tatgacgactctctatag

SEQ ID NO: 8553 - DNA, 18 bp, synthetic construct
  source 1..18: mol_type = other DNA
tattacgactgaatatag

SEQ ID NO: 8554 - DNA, 18 bp, synthetic construct
  source 1..18: mol_type = other DNA
tcatacaactcacgatag

SEQ ID NO: 8555 - DNA, 18 bp, synthetic construct
  source 1..18: mol_type = other DNA
tcatacgactcactccag

SEQ ID NO: 8556 - DNA, 18 bp, synthetic construct
  source 1..18: mol_type = other DNA
tcatacgccccactatag

SEQ ID NO: 8557 - DNA, 18 bp, synthetic construct
  source 1..18: mol_type = other DNA
tgataaaactcactatag

SEQ ID NO: 8558 - DNA, 18 bp, synthetic construct
  source 1..18: mol_type = other DNA
tgataagactcaccatag

SEQ ID NO: 8559 - DNA, 18 bp, synthetic construct
  source 1..18: mol_type = other DNA
tgatacgactcacagtag

SEQ ID NO: 8560 - DNA, 18 bp, synthetic construct
  source 1..18: mol_type = other DNA
tgatacgagttactatag

SEQ ID NO: 8561 - DNA, 18 bp, synthetic construct
  source 1..18: mol_type = other DNA
tgatacgattcattatag

SEQ ID NO: 8562 - DNA, 18 bp, synthetic construct
  source 1..18: mol_type = other DNA
tgctacgattcactatag

SEQ ID NO: 8563 - DNA, 18 bp, synthetic construct
  source 1..18: mol_type = other DNA
ttagacgactaactatag

SEQ ID NO: 8564 - DNA, 18 bp, synthetic construct
  source 1..18: mol_type = other DNA
tattacgactcacaattg

SEQ ID NO: 8565 - DNA, 18 bp, synthetic construct
  source 1..18: mol_type = other DNA
aaatatgtctcactatag

SEQ ID NO: 8566 - DNA, 18 bp, synthetic construct
  source 1..18: mol_type = other DNA
taataccactcaatttag

SEQ ID NO: 8567 - DNA, 18 bp, synthetic construct
  source 1..18: mol_type = other DNA
taatacgactcagattag

SEQ ID NO: 8568 - DNA, 18 bp, synthetic construct
  source 1..18: mol_type = other DNA
taatacgcctcattattg

SEQ ID NO: 8569 - DNA, 18 bp, synthetic construct
  source 1..18: mol_type = other DNA
taatactaaacactatag

SEQ ID NO: 8570 - DNA, 18 bp, synthetic construct
  source 1..18: mol_type = other DNA
tactacgacacactattg

SEQ ID NO: 8571 - DNA, 18 bp, synthetic construct
  source 1..18: mol_type = other DNA
tcatacgcttcactatag

SEQ ID NO: 8572 - DNA, 18 bp, synthetic construct
  source 1..18: mol_type = other DNA
ttattcgacccactatag

SEQ ID NO: 8573 - DNA, 18 bp, synthetic construct
  source 1..18: mol_type = other DNA
taatacttctcactattg

SEQ ID NO: 8574 - DNA, 18 bp, synthetic construct
  source 1..18: mol_type = other DNA
tacaacgactcacaatag

SEQ ID NO: 8575 - DNA, 18 bp, synthetic construct
  source 1..18: mol_type = other DNA
tattacgactctctgtag

SEQ ID NO: 8576 - DNA, 18 bp, synthetic construct
  source 1..18: mol_type = other DNA
tattacgatacactatag

SEQ ID NO: 8577 - DNA, 18 bp, synthetic construct
  source 1..18: mol_type = other DNA
taaaacgactcacaatcg

SEQ ID NO: 8578 - DNA, 18 bp, synthetic construct
  source 1..18: mol_type = other DNA
taatacgactaaatattg

SEQ ID NO: 8579 - DNA, 18 bp, synthetic construct
  source 1..18: mol_type = other DNA
taatacgactctcttgag

SEQ ID NO: 8580 - DNA, 18 bp, synthetic construct
  source 1..18: mol_type = other DNA
tattacgaatcattatag

SEQ ID NO: 8581 - DNA, 18 bp, synthetic construct
  source 1..18: mol_type = other DNA
taatacgactctcaattg

SEQ ID NO: 8582 - DNA, 18 bp, synthetic construct
  source 1..18: mol_type = other DNA
aaataagactaactatag

SEQ ID NO: 8583 - DNA, 18 bp, synthetic construct
  source 1..18: mol_type = other DNA
caatacgcctcactttag

SEQ ID NO: 8584 - DNA, 18 bp, synthetic construct
  source 1..18: mol_type = other DNA
taaatcgactcactatgg

SEQ ID NO: 8585 - DNA, 18 bp, synthetic construct
  source 1..18: mol_type = other DNA
taatacgacactctacag

SEQ ID NO: 8586 - DNA, 18 bp, synthetic construct
  source 1..18: mol_type = other DNA
taatgcgactcattattg

SEQ ID NO: 8587 - DNA, 18 bp, synthetic construct
  source 1..18: mol_type = other DNA
taattcgactcacagtag

SEQ ID NO: 8588 - DNA, 18 bp, synthetic construct
  source 1..18: mol_type = other DNA
taattcgacttactatcg

SEQ ID NO: 8589 - DNA, 18 bp, synthetic construct
  source 1..18: mol_type = other DNA
taatttgactcaatatag

SEQ ID NO: 8590 - DNA, 18 bp, synthetic construct
  source 1..18: mol_type = other DNA
ttatacgactcattatgg

SEQ ID NO: 8591 - DNA, 18 bp, synthetic construct
  source 1..18: mol_type = other DNA
taattcgactcataatag

SEQ ID NO: 8592 - DNA, 18 bp, synthetic construct
  source 1..18: mol_type = other DNA
taatacgacatacaatag

SEQ ID NO: 8593 - DNA, 18 bp, synthetic construct
  source 1..18: mol_type = other DNA
taatatcactcactaaag

SEQ ID NO: 8594 - DNA, 18 bp, synthetic construct
  source 1..18: mol_type = other DNA
tactttgactcactatag

SEQ ID NO: 8595 - DNA, 18 bp, synthetic construct
  source 1..18: mol_type = other DNA
tattacgacttattatag

SEQ ID NO: 8596 - DNA, 18 bp, synthetic construct
  source 1..18: mol_type = other DNA
ttatacgactgactttag

SEQ ID NO: 8597 - DNA, 18 bp, synthetic construct
  source 1..18: mol_type = other DNA
aaacacgaatcactatag

SEQ ID NO: 8598 - DNA, 18 bp, synthetic construct
  source 1..18: mol_type = other DNA
aaatacgactcactctgg

SEQ ID NO: 8599 - DNA, 18 bp, synthetic construct
  source 1..18: mol_type = other DNA
cgatacgactcactttag

SEQ ID NO: 8600 - DNA, 18 bp, synthetic construct
  source 1..18: mol_type = other DNA
gtatacgactcacaatag

SEQ ID NO: 8601 - DNA, 18 bp, synthetic construct
  source 1..18: mol_type = other DNA
taaaacgactaactatcg

SEQ ID NO: 8602 - DNA, 18 bp, synthetic construct
  source 1..18: mol_type = other DNA
taaaacgactcacgattg

SEQ ID NO: 8603 - DNA, 18 bp, synthetic construct
  source 1..18: mol_type = other DNA
taaaacgacttaccatag

SEQ ID NO: 8604 - DNA, 18 bp, synthetic construct
  source 1..18: mol_type = other DNA
taaaacgattcactacag

SEQ ID NO: 8605 - DNA, 18 bp, synthetic construct
  source 1..18: mol_type = other DNA
taataagacacactatcg

SEQ ID NO: 8606 - DNA, 18 bp, synthetic construct
  source 1..18: mol_type = other DNA
taatacgaatctctatgg

SEQ ID NO: 8607 - DNA, 18 bp, synthetic construct
  source 1..18: mol_type = other DNA
taatacgactcgtcatag

SEQ ID NO: 8608 - DNA, 18 bp, synthetic construct
  source 1..18: mol_type = other DNA
taatacgactctatgtag

SEQ ID NO: 8609 - DNA, 18 bp, synthetic construct
  source 1..18: mol_type = other DNA
taatacgacttccaatag

SEQ ID NO: 8610 - DNA, 18 bp, synthetic construct
  source 1..18: mol_type = other DNA
taatacgattaattatag

SEQ ID NO: 8611 - DNA, 18 bp, synthetic construct
  source 1..18: mol_type = other DNA
taatactaatcgctatag

SEQ ID NO: 8612 - DNA, 18 bp, synthetic construct
  source 1..18: mol_type = other DNA
taatatgaatcgctatag

SEQ ID NO: 8613 - DNA, 18 bp, synthetic construct
  source 1..18: mol_type = other DNA
taatatgagtctctatag

SEQ ID NO: 8614 - DNA, 18 bp, synthetic construct
  source 1..18: mol_type = other DNA
taatcccacttactatag

SEQ ID NO: 8615 - DNA, 18 bp, synthetic construct
  source 1..18: mol_type = other DNA
tactacgacttaatatag

SEQ ID NO: 8616 - DNA, 18 bp, synthetic construct
  source 1..18: mol_type = other DNA
tattacgactaactacag

SEQ ID NO: 8617 - DNA, 18 bp, synthetic construct
  source 1..18: mol_type = other DNA
tattacgactaactgtag

SEQ ID NO: 8618 - DNA, 18 bp, synthetic construct
  source 1..18: mol_type = other DNA
tcaaacgactaactatag

SEQ ID NO: 8619 - DNA, 18 bp, synthetic construct
  source 1..18: mol_type = other DNA
tcatactactcaccatag

SEQ ID NO: 8620 - DNA, 18 bp, synthetic construct
  source 1..18: mol_type = other DNA
tcttacgattcactatag

SEQ ID NO: 8621 - DNA, 18 bp, synthetic construct
  source 1..18: mol_type = other DNA
tgatacgactctctctag

SEQ ID NO: 8622 - DNA, 18 bp, synthetic construct
  source 1..18: mol_type = other DNA
tgattcgaatcactatag

SEQ ID NO: 8623 - DNA, 18 bp, synthetic construct
  source 1..18: mol_type = other DNA
ttatacgactcagcatag

SEQ ID NO: 8624 - DNA, 18 bp, synthetic construct
  source 1..18: mol_type = other DNA
taaaaagactcattatag

SEQ ID NO: 8625 - DNA, 18 bp, synthetic construct
  source 1..18: mol_type = other DNA
taatactactaacaatag

SEQ ID NO: 8626 - DNA, 18 bp, synthetic construct
  source 1..18: mol_type = other DNA
aaattcgactcacaatag

SEQ ID NO: 8627 - DNA, 18 bp, synthetic construct
  source 1..18: mol_type = other DNA
taatacgattcacttaag

SEQ ID NO: 8628 - DNA, 18 bp, synthetic construct
  source 1..18: mol_type = other DNA
tattacgacacactttag

SEQ ID NO: 8629 - DNA, 18 bp, synthetic construct
  source 1..18: mol_type = other DNA
aaatccgactcacaatag

SEQ ID NO: 8630 - DNA, 18 bp, synthetic construct
  source 1..18: mol_type = other DNA
taacactactctctatag

SEQ ID NO: 8631 - DNA, 18 bp, synthetic construct
  source 1..18: mol_type = other DNA
taatacgactcgcaaaag

SEQ ID NO: 8632 - DNA, 18 bp, synthetic construct
  source 1..18: mol_type = other DNA
taatacgactgaatttag

SEQ ID NO: 8633 - DNA, 18 bp, synthetic construct
  source 1..18: mol_type = other DNA
taatacgccacactattg

SEQ ID NO: 8634 - DNA, 18 bp, synthetic construct
  source 1..18: mol_type = other DNA
taatactactcaccttag

SEQ ID NO: 8635 - DNA, 18 bp, synthetic construct
  source 1..18: mol_type = other DNA
taatatgactcaataaag

SEQ ID NO: 8636 - DNA, 18 bp, synthetic construct
  source 1..18: mol_type = other DNA
tagtacgacacactttag

SEQ ID NO: 8637 - DNA, 18 bp, synthetic construct
  source 1..18: mol_type = other DNA
ttattcgactcacgatag

SEQ ID NO: 8638 - DNA, 18 bp, synthetic construct
  source 1..18: mol_type = other DNA
taaaacgactcacattag

SEQ ID NO: 8639 - DNA, 18 bp, synthetic construct
  source 1..18: mol_type = other DNA
tattacttctcactatag

SEQ ID NO: 8640 - DNA, 18 bp, synthetic construct
  source 1..18: mol_type = other DNA
taattcgaatcacaatag

SEQ ID NO: 8641 - DNA, 18 bp, synthetic construct
  source 1..18: mol_type = other DNA
tcaaacgactcactattg

SEQ ID NO: 8642 - DNA, 18 bp, synthetic construct
  source 1..18: mol_type = other DNA
caatacgtctcacaatag

SEQ ID NO: 8643 - DNA, 18 bp, synthetic construct
  source 1..18: mol_type = other DNA
taataagtatcactatag

SEQ ID NO: 8644 - DNA, 18 bp, synthetic construct
  source 1..18: mol_type = other DNA
ttatacggctcactttag

SEQ ID NO: 8645 - DNA, 18 bp, synthetic construct
  source 1..18: mol_type = other DNA
ttcaacgactcactatag

SEQ ID NO: 8646 - DNA, 18 bp, synthetic construct
  source 1..18: mol_type = other DNA
taatacgtctccctattg

SEQ ID NO: 8647 - DNA, 18 bp, synthetic construct
  source 1..18: mol_type = other DNA
tatttcgactctctatag

SEQ ID NO: 8648 - DNA, 18 bp, synthetic construct
  source 1..18: mol_type = other DNA
taatacatctcaccatag

SEQ ID NO: 8649 - DNA, 18 bp, synthetic construct
  source 1..18: mol_type = other DNA
taatacgaatcataatag

SEQ ID NO: 8650 - DNA, 18 bp, synthetic construct
  source 1..18: mol_type = other DNA
taatacgtatcattatag

SEQ ID NO: 8651 - DNA, 18 bp, synthetic construct
  source 1..18: mol_type = other DNA
tcatatgtctcactatag

SEQ ID NO: 8652 - DNA, 18 bp, synthetic construct
  source 1..18: mol_type = other DNA
aaatactactcactacag

SEQ ID NO: 8653 - DNA, 18 bp, synthetic construct
  source 1..18: mol_type = other DNA
taatacgattcacagtag

SEQ ID NO: 8654 - DNA, 18 bp, synthetic construct
  source 1..18: mol_type = other DNA
taatatcactcacaatag

SEQ ID NO: 8655 - DNA, 18 bp, synthetic construct
  source 1..18: mol_type = other DNA
taatatgactcaccattg

SEQ ID NO: 8656 - DNA, 18 bp, synthetic construct
  source 1..18: mol_type = other DNA
taattcgaatcactatgg

SEQ ID NO: 8657 - DNA, 18 bp, synthetic construct
  source 1..18: mol_type = other DNA
tacttcgactcactacag

SEQ ID NO: 8658 - DNA, 18 bp, synthetic construct
  source 1..18: mol_type = other DNA
tataacggctcactatag

SEQ ID NO: 8659 - DNA, 18 bp, synthetic construct
  source 1..18: mol_type = other DNA
tcatacgacacactctag

SEQ ID NO: 8660 - DNA, 18 bp, synthetic construct
  source 1..18: mol_type = other DNA
tcatacgacacattatag

SEQ ID NO: 8661 - DNA, 18 bp, synthetic construct
  source 1..18: mol_type = other DNA
taaaacgactaaccatag

SEQ ID NO: 8662 - DNA, 18 bp, synthetic construct
  source 1..18: mol_type = other DNA
taaaacggcttactatag

SEQ ID NO: 8663 - DNA, 18 bp, synthetic construct
  source 1..18: mol_type = other DNA
taaaatgactcactacag

SEQ ID NO: 8664 - DNA, 18 bp, synthetic construct
  source 1..18: mol_type = other DNA
taacacgtctcactatcg

SEQ ID NO: 8665 - DNA, 18 bp, synthetic construct
  source 1..18: mol_type = other DNA
taataagaattactatag

SEQ ID NO: 8666 - DNA, 18 bp, synthetic construct
  source 1..18: mol_type = other DNA
taatacaactcaatctag

SEQ ID NO: 8667 - DNA, 18 bp, synthetic construct
  source 1..18: mol_type = other DNA
taatacgactcacctcag

SEQ ID NO: 8668 - DNA, 18 bp, synthetic construct
  source 1..18: mol_type = other DNA
taatacgagtcacattag

SEQ ID NO: 8669 - DNA, 18 bp, synthetic construct
  source 1..18: mol_type = other DNA
taatacgcctcataatag

SEQ ID NO: 8670 - DNA, 18 bp, synthetic construct
  source 1..18: mol_type = other DNA
taatacgtctcaatgtag

SEQ ID NO: 8671 - DNA, 18 bp, synthetic construct
  source 1..18: mol_type = other DNA
taatacgtctcacaagag

SEQ ID NO: 8672 - DNA, 18 bp, synthetic construct
  source 1..18: mol_type = other DNA
taatatgaatcaatatag

SEQ ID NO: 8673 - DNA, 18 bp, synthetic construct
  source 1..18: mol_type = other DNA
taattcaactcactatgg

SEQ ID NO: 8674 - DNA, 18 bp, synthetic construct
  source 1..18: mol_type = other DNA
tactacgactcaaaatag

SEQ ID NO: 8675 - DNA, 18 bp, synthetic construct
  source 1..18: mol_type = other DNA
tattaagactcactatcg

SEQ ID NO: 8676 - DNA, 18 bp, synthetic construct
  source 1..18: mol_type = other DNA
tcatacagctcactatag

SEQ ID NO: 8677 - DNA, 18 bp, synthetic construct
  source 1..18: mol_type = other DNA
tgataagattcactatag

SEQ ID NO: 8678 - DNA, 18 bp, synthetic construct
  source 1..18: mol_type = other DNA
tgatacgactcacactag

SEQ ID NO: 8679 - DNA, 18 bp, synthetic construct
  source 1..18: mol_type = other DNA
aaacacgacccactatag

SEQ ID NO: 8680 - DNA, 18 bp, synthetic construct
  source 1..18: mol_type = other DNA
aaatacgactcattacag

SEQ ID NO: 8681 - DNA, 18 bp, synthetic construct
  source 1..18: mol_type = other DNA
aaatacgagtcactgtag

SEQ ID NO: 8682 - DNA, 18 bp, synthetic construct
  source 1..18: mol_type = other DNA
caataccactcacaatag

SEQ ID NO: 8683 - DNA, 18 bp, synthetic construct
  source 1..18: mol_type = other DNA
caatacgactcacgatgg

SEQ ID NO: 8684 - DNA, 18 bp, synthetic construct
  source 1..18: mol_type = other DNA
gaataagactcacaatag

SEQ ID NO: 8685 - DNA, 18 bp, synthetic construct
  source 1..18: mol_type = other DNA
gaatacgaatcactttag

SEQ ID NO: 8686 - DNA, 18 bp, synthetic construct
  source 1..18: mol_type = other DNA
taaaacgaatcactgtag

SEQ ID NO: 8687 - DNA, 18 bp, synthetic construct
  source 1..18: mol_type = other DNA
taaaacgactcactagcg

SEQ ID NO: 8688 - DNA, 18 bp, synthetic construct
  source 1..18: mol_type = other DNA
taaagcgactgactatag

SEQ ID NO: 8689 - DNA, 18 bp, synthetic construct
  source 1..18: mol_type = other DNA
taaagcgagtcactatag

SEQ ID NO: 8690 - DNA, 18 bp, synthetic construct
  source 1..18: mol_type = other DNA
taacacgactcatgatag

SEQ ID NO: 8691 - DNA, 18 bp, synthetic construct
  source 1..18: mol_type = other DNA
taacacgactctgtatag

SEQ ID NO: 8692 - DNA, 18 bp, synthetic construct
  source 1..18: mol_type = other DNA
taacacggctcactctag

SEQ ID NO: 8693 - DNA, 18 bp, synthetic construct
  source 1..18: mol_type = other DNA
taacatgactcactgtag

SEQ ID NO: 8694 - DNA, 18 bp, synthetic construct
  source 1..18: mol_type = other DNA
taagacgactcattctag

SEQ ID NO: 8695 - DNA, 18 bp, synthetic construct
  source 1..18: mol_type = other DNA
taagaggattcactatag

SEQ ID NO: 8696 - DNA, 18 bp, synthetic construct
  source 1..18: mol_type = other DNA
taatacaactgactattg

SEQ ID NO: 8697 - DNA, 18 bp, synthetic construct
  source 1..18: mol_type = other DNA
taataccactcacagtag

SEQ ID NO: 8698 - DNA, 18 bp, synthetic construct
  source 1..18: mol_type = other DNA
taataccactcagtaaag

SEQ ID NO: 8699 - DNA, 18 bp, synthetic construct
  source 1..18: mol_type = other DNA
taatacctctcgctatag

SEQ ID NO: 8700 - DNA, 18 bp, synthetic construct
  source 1..18: mol_type = other DNA
taatacgactcaccagtg

SEQ ID NO: 8701 - DNA, 18 bp, synthetic construct
  source 1..18: mol_type = other DNA
taatacgacttactagtg

SEQ ID NO: 8702 - DNA, 18 bp, synthetic construct
  source 1..18: mol_type = other DNA
taatacgccttactctag

SEQ ID NO: 8703 - DNA, 18 bp, synthetic construct
  source 1..18: mol_type = other DNA
taatactaccgactatag

SEQ ID NO: 8704 - DNA, 18 bp, synthetic construct
  source 1..18: mol_type = other DNA
taatactacgcactaaag

SEQ ID NO: 8705 - DNA, 18 bp, synthetic construct
  source 1..18: mol_type = other DNA
taatactacgcattatag

SEQ ID NO: 8706 - DNA, 18 bp, synthetic construct
  source 1..18: mol_type = other DNA
taataggcgtcactatag

SEQ ID NO: 8707 - DNA, 18 bp, synthetic construct
  source 1..18: mol_type = other DNA
taatatgactgacaatag

SEQ ID NO: 8708 - DNA, 18 bp, synthetic construct
  source 1..18: mol_type = other DNA
taatatgactgactattg

SEQ ID NO: 8709 - DNA, 18 bp, synthetic construct
  source 1..18: mol_type = other DNA
taatccgaatccctatag

SEQ ID NO: 8710 - DNA, 18 bp, synthetic construct
  source 1..18: mol_type = other DNA
taatgagacccactatag

SEQ ID NO: 8711 - DNA, 18 bp, synthetic construct
  source 1..18: mol_type = other DNA
taatgcgactcacaagag

SEQ ID NO: 8712 - DNA, 18 bp, synthetic construct
  source 1..18: mol_type = other DNA
taatgcggctctctatag

SEQ ID NO: 8713 - DNA, 18 bp, synthetic construct
  source 1..18: mol_type = other DNA
taatgggattcactatag

SEQ ID NO: 8714 - DNA, 18 bp, synthetic construct
  source 1..18: mol_type = other DNA
taattcgactcactcgag

SEQ ID NO: 8715 - DNA, 18 bp, synthetic construct
  source 1..18: mol_type = other DNA
taatttgactgactatag

SEQ ID NO: 8716 - DNA, 18 bp, synthetic construct
  source 1..18: mol_type = other DNA
tactaacactcactatag

SEQ ID NO: 8717 - DNA, 18 bp, synthetic construct
  source 1..18: mol_type = other DNA
tactaccactctctatag

SEQ ID NO: 8718 - DNA, 18 bp, synthetic construct
  source 1..18: mol_type = other DNA
tactacgactctctagag

SEQ ID NO: 8719 - DNA, 18 bp, synthetic construct
  source 1..18: mol_type = other DNA
tactacgcctcattatag

SEQ ID NO: 8720 - DNA, 18 bp, synthetic construct
  source 1..18: mol_type = other DNA
tacttcgactcacgatag

SEQ ID NO: 8721 - DNA, 18 bp, synthetic construct
  source 1..18: mol_type = other DNA
tagtaaaactcactatag

SEQ ID NO: 8722 - DNA, 18 bp, synthetic construct
  source 1..18: mol_type = other DNA
tagtaccactctctatag

SEQ ID NO: 8723 - DNA, 18 bp, synthetic construct
  source 1..18: mol_type = other DNA
tagtacgattcactctag

SEQ ID NO: 8724 - DNA, 18 bp, synthetic construct
  source 1..18: mol_type = other DNA
tagtacggctcacaatag

SEQ ID NO: 8725 - DNA, 18 bp, synthetic construct
  source 1..18: mol_type = other DNA
tagtatgacttactatag

SEQ ID NO: 8726 - DNA, 18 bp, synthetic construct
  source 1..18: mol_type = other DNA
tagtatgagtcactatag

SEQ ID NO: 8727 - DNA, 18 bp, synthetic construct
  source 1..18: mol_type = other DNA
tattacgactcaccgtag

SEQ ID NO: 8728 - DNA, 18 bp, synthetic construct
  source 1..18: mol_type = other DNA
tattacgactcagtatcg

SEQ ID NO: 8729 - DNA, 18 bp, synthetic construct
  source 1..18: mol_type = other DNA
tattacgactgactagag

SEQ ID NO: 8730 - DNA, 18 bp, synthetic construct
  source 1..18: mol_type = other DNA
tcatacaacgcactatag

SEQ ID NO: 8731 - DNA, 18 bp, synthetic construct
  source 1..18: mol_type = other DNA
tcatacgactcacaatgg

SEQ ID NO: 8732 - DNA, 18 bp, synthetic construct
  source 1..18: mol_type = other DNA
tcatacgccttactatag

SEQ ID NO: 8733 - DNA, 18 bp, synthetic construct
  source 1..18: mol_type = other DNA
tcatacggctcactgtag

SEQ ID NO: 8734 - DNA, 18 bp, synthetic construct
  source 1..18: mol_type = other DNA
tcatatgactcactaaag

SEQ ID NO: 8735 - DNA, 18 bp, synthetic construct
  source 1..18: mol_type = other DNA
tgaaacgacccactatag

SEQ ID NO: 8736 - DNA, 18 bp, synthetic construct
  source 1..18: mol_type = other DNA
tgatacgcctcattatag

SEQ ID NO: 8737 - DNA, 18 bp, synthetic construct
  source 1..18: mol_type = other DNA
tgatacgtctcaccatag

SEQ ID NO: 8738 - DNA, 18 bp, synthetic construct
  source 1..18: mol_type = other DNA
tgctacgactcgctatag

SEQ ID NO: 8739 - DNA, 18 bp, synthetic construct
  source 1..18: mol_type = other DNA
ttatacgactcagtatgg

SEQ ID NO: 8740 - DNA, 18 bp, synthetic construct
  source 1..18: mol_type = other DNA
ttatatgagtcactatag

SEQ ID NO: 8741 - DNA, 18 bp, synthetic construct
  source 1..18: mol_type = other DNA
ttgtacgactcaccatag

SEQ ID NO: 8742 - DNA, 18 bp, synthetic construct
  source 1..18: mol_type = other DNA
taatatgactcacaattg

SEQ ID NO: 8743 - DNA, 18 bp, synthetic construct
  source 1..18: mol_type = other DNA
taattcgacttactttag

SEQ ID NO: 8744 - DNA, 18 bp, synthetic construct
  source 1..18: mol_type = other DNA
ttatacgaatcactattg

SEQ ID NO: 8745 - DNA, 18 bp, synthetic construct
  source 1..18: mol_type = other DNA
taatacgattcacaattg

SEQ ID NO: 8746 - DNA, 18 bp, synthetic construct
  source 1..18: mol_type = other DNA
ttatacaacacactatag

SEQ ID NO: 8747 - DNA, 18 bp, synthetic construct
  source 1..18: mol_type = other DNA
taatacgatacacaatag

SEQ ID NO: 8748 - DNA, 18 bp, synthetic construct
  source 1..18: mol_type = other DNA
ttatacgtctccctatag

SEQ ID NO: 8749 - DNA, 18 bp, synthetic construct
  source 1..18: mol_type = other DNA
taataagaatcactattg

SEQ ID NO: 8750 - DNA, 18 bp, synthetic construct
  source 1..18: mol_type = other DNA
taatacgactaattttag

SEQ ID NO: 8751 - DNA, 18 bp, synthetic construct
  source 1..18: mol_type = other DNA
taatatgactcattaaag

SEQ ID NO: 8752 - DNA, 18 bp, synthetic construct
  source 1..18: mol_type = other DNA
taatccgattcactttag

SEQ ID NO: 8753 - DNA, 18 bp, synthetic construct
  source 1..18: mol_type = other DNA
taatccgtctcactattg

SEQ ID NO: 8754 - DNA, 18 bp, synthetic construct
  source 1..18: mol_type = other DNA
tattacgactcacaatcg

SEQ ID NO: 8755 - DNA, 18 bp, synthetic construct
  source 1..18: mol_type = other DNA
taaaacgactctctttag

SEQ ID NO: 8756 - DNA, 18 bp, synthetic construct
  source 1..18: mol_type = other DNA
taatattactcactttag

SEQ ID NO: 8757 - DNA, 18 bp, synthetic construct
  source 1..18: mol_type = other DNA
ttatacgagtctctatag

SEQ ID NO: 8758 - DNA, 18 bp, synthetic construct
  source 1..18: mol_type = other DNA
taatacaactttctatag

SEQ ID NO: 8759 - DNA, 18 bp, synthetic construct
  source 1..18: mol_type = other DNA
ttaaacgactcattatag

SEQ ID NO: 8760 - DNA, 18 bp, synthetic construct
  source 1..18: mol_type = other DNA
taaaacgactcaccttag

SEQ ID NO: 8761 - DNA, 18 bp, synthetic construct
  source 1..18: mol_type = other DNA
taataagactcacaacag

SEQ ID NO: 8762 - DNA, 18 bp, synthetic construct
  source 1..18: mol_type = other DNA
taatactacctactatag

SEQ ID NO: 8763 - DNA, 18 bp, synthetic construct
  source 1..18: mol_type = other DNA
tcttacaactcactatag

SEQ ID NO: 8764 - DNA, 18 bp, synthetic construct
  source 1..18: mol_type = other DNA
tgatacgattcactattg

SEQ ID NO: 8765 - DNA, 18 bp, synthetic construct
  source 1..18: mol_type = other DNA
ttgtacaactcactatag

SEQ ID NO: 8766 - DNA, 18 bp, synthetic construct
  source 1..18: mol_type = other DNA
taatacgactcacaaatg

SEQ ID NO: 8767 - DNA, 18 bp, synthetic construct
  source 1..18: mol_type = other DNA
aaatacgaatcactaaag

SEQ ID NO: 8768 - DNA, 18 bp, synthetic construct
  source 1..18: mol_type = other DNA
taaaatgactcacaatag

SEQ ID NO: 8769 - DNA, 18 bp, synthetic construct
  source 1..18: mol_type = other DNA
tatttcgactcaatatag

SEQ ID NO: 8770 - DNA, 18 bp, synthetic construct
  source 1..18: mol_type = other DNA
tattatgactctctatag

SEQ ID NO: 8771 - DNA, 18 bp, synthetic construct
  source 1..18: mol_type = other DNA
taatacgtttctctatag

SEQ ID NO: 8772 - DNA, 18 bp, synthetic construct
  source 1..18: mol_type = other DNA
taatactactcaataaag

SEQ ID NO: 8773 - DNA, 18 bp, synthetic construct
  source 1..18: mol_type = other DNA
taattcgacacaatatag

SEQ ID NO: 8774 - DNA, 18 bp, synthetic construct
  source 1..18: mol_type = other DNA
tattacgcctctctatag

SEQ ID NO: 8775 - DNA, 18 bp, synthetic construct
  source 1..18: mol_type = other DNA
tattacggctcattatag

SEQ ID NO: 8776 - DNA, 18 bp, synthetic construct
  source 1..18: mol_type = other DNA
tcatacgtcttactatag

SEQ ID NO: 8777 - DNA, 18 bp, synthetic construct
  source 1..18: mol_type = other DNA
taaaacggctcaatatag

SEQ ID NO: 8778 - DNA, 18 bp, synthetic construct
  source 1..18: mol_type = other DNA
taaaccaactcactatag

SEQ ID NO: 8779 - DNA, 18 bp, synthetic construct
  source 1..18: mol_type = other DNA
taataagcctctctatag

SEQ ID NO: 8780 - DNA, 18 bp, synthetic construct
  source 1..18: mol_type = other DNA
taatacaacgcactttag

SEQ ID NO: 8781 - DNA, 18 bp, synthetic construct
  source 1..18: mol_type = other DNA
taatacgaataactgtag

SEQ ID NO: 8782 - DNA, 18 bp, synthetic construct
  source 1..18: mol_type = other DNA
taatacgacaaactacag

SEQ ID NO: 8783 - DNA, 18 bp, synthetic construct
  source 1..18: mol_type = other DNA
taatacgacgatctatag

SEQ ID NO: 8784 - DNA, 18 bp, synthetic construct
  source 1..18: mol_type = other DNA
taatacgactaactcaag

SEQ ID NO: 8785 - DNA, 18 bp, synthetic construct
  source 1..18: mol_type = other DNA
taatacgacttaccaaag

SEQ ID NO: 8786 - DNA, 18 bp, synthetic construct
  source 1..18: mol_type = other DNA
taatacgacttagtaaag

SEQ ID NO: 8787 - DNA, 18 bp, synthetic construct
  source 1..18: mol_type = other DNA
taatacgcctcaaaatag

SEQ ID NO: 8788 - DNA, 18 bp, synthetic construct
  source 1..18: mol_type = other DNA
taatacggcaaactatag

SEQ ID NO: 8789 - DNA, 18 bp, synthetic construct
  source 1..18: mol_type = other DNA
taatacggcatactatag

SEQ ID NO: 8790 - DNA, 18 bp, synthetic construct
  source 1..18: mol_type = other DNA
taatacgtcttactacag

SEQ ID NO: 8791 - DNA, 18 bp, synthetic construct
  source 1..18: mol_type = other DNA
taatatgactcagtattg

SEQ ID NO: 8792 - DNA, 18 bp, synthetic construct
  source 1..18: mol_type = other DNA
taattcgagacactatag

SEQ ID NO: 8793 - DNA, 18 bp, synthetic construct
  source 1..18: mol_type = other DNA
tactacgacttacaatag

SEQ ID NO: 8794 - DNA, 18 bp, synthetic construct
  source 1..18: mol_type = other DNA
tagtactactcactttag

SEQ ID NO: 8795 - DNA, 18 bp, synthetic construct
  source 1..18: mol_type = other DNA
tgatacgactctctatcg

SEQ ID NO: 8796 - DNA, 18 bp, synthetic construct
  source 1..18: mol_type = other DNA
tgattcgactaactatag

SEQ ID NO: 8797 - DNA, 18 bp, synthetic construct
  source 1..18: mol_type = other DNA
ttgtacggctcactatag

SEQ ID NO: 8798 - DNA, 18 bp, synthetic construct
  source 1..18: mol_type = other DNA
tattaagtctcactatag

SEQ ID NO: 8799 - DNA, 18 bp, synthetic construct
  source 1..18: mol_type = other DNA
taatactactcacaaaag

SEQ ID NO: 8800 - DNA, 18 bp, synthetic construct
  source 1..18: mol_type = other DNA
tattacgacacactattg

SEQ ID NO: 8801 - DNA, 18 bp, synthetic construct
  source 1..18: mol_type = other DNA
taatacaactaactttag

SEQ ID NO: 8802 - DNA, 18 bp, synthetic construct
  source 1..18: mol_type = other DNA
taattcgactaactattg

SEQ ID NO: 8803 - DNA, 18 bp, synthetic construct
  source 1..18: mol_type = other DNA
tagtacgactctctattg

SEQ ID NO: 8804 - DNA, 18 bp, synthetic construct
  source 1..18: mol_type = other DNA
taatatgtctctctatag

SEQ ID NO: 8805 - DNA, 18 bp, synthetic construct
  source 1..18: mol_type = other DNA
taatacgactaacttttg

SEQ ID NO: 8806 - DNA, 18 bp, synthetic construct
  source 1..18: mol_type = other DNA
taatatgacacactaaag

SEQ ID NO: 8807 - DNA, 18 bp, synthetic construct
  source 1..18: mol_type = other DNA
aaatacgacagactatag

SEQ ID NO: 8808 - DNA, 18 bp, synthetic construct
  source 1..18: mol_type = other DNA
taataagattcattatag

SEQ ID NO: 8809 - DNA, 18 bp, synthetic construct
  source 1..18: mol_type = other DNA
taatacaacacactatcg

SEQ ID NO: 8810 - DNA, 18 bp, synthetic construct
  source 1..18: mol_type = other DNA
taatacaactcacttgag

SEQ ID NO: 8811 - DNA, 18 bp, synthetic construct
  source 1..18: mol_type = other DNA
taatacggatcactaaag

SEQ ID NO: 8812 - DNA, 18 bp, synthetic construct
  source 1..18: mol_type = other DNA
tattacgtcgcactatag

SEQ ID NO: 8813 - DNA, 18 bp, synthetic construct
  source 1..18: mol_type = other DNA
tcatacgactatctatag

SEQ ID NO: 8814 - DNA, 18 bp, synthetic construct
  source 1..18: mol_type = other DNA
ttatacgactgactattg

SEQ ID NO: 8815 - DNA, 18 bp, synthetic construct
  source 1..18: mol_type = other DNA
taaaacgtcccactatag

SEQ ID NO: 8816 - DNA, 18 bp, synthetic construct
  source 1..18: mol_type = other DNA
ttactcgactcactatag

SEQ ID NO: 8817 - DNA, 18 bp, synthetic construct
  source 1..18: mol_type = other DNA
taatacgtctctatatag

SEQ ID NO: 8818 - DNA, 18 bp, synthetic construct
  source 1..18: mol_type = other DNA
aatttcgactcactatag

SEQ ID NO: 8819 - DNA, 18 bp, synthetic construct
  source 1..18: mol_type = other DNA
ttatatgactctctatag

SEQ ID NO: 8820 - DNA, 18 bp, synthetic construct
  source 1..18: mol_type = other DNA
taatacgtctcacaaaag

SEQ ID NO: 8821 - DNA, 18 bp, synthetic construct
  source 1..18: mol_type = other DNA
taattctactcactaaag

SEQ ID NO: 8822 - DNA, 18 bp, synthetic construct
  source 1..18: mol_type = other DNA
tcatacgaatcactattg

SEQ ID NO: 8823 - DNA, 18 bp, synthetic construct
  source 1..18: mol_type = other DNA
caatacgactcactaatg

SEQ ID NO: 8824 - DNA, 18 bp, synthetic construct
  source 1..18: mol_type = other DNA
taatatgactcaccttag

SEQ ID NO: 8825 - DNA, 18 bp, synthetic construct
  source 1..18: mol_type = other DNA
taaaacgcctcattatag

SEQ ID NO: 8826 - DNA, 18 bp, synthetic construct
  source 1..18: mol_type = other DNA
taataccactcccaatag

SEQ ID NO: 8827 - DNA, 18 bp, synthetic construct
  source 1..18: mol_type = other DNA
taatacgtctcgcaatag

SEQ ID NO: 8828 - DNA, 18 bp, synthetic construct
  source 1..18: mol_type = other DNA
tattacgacacagtatag

SEQ ID NO: 8829 - DNA, 18 bp, synthetic construct
  source 1..18: mol_type = other DNA
aaatacgaatcaccatag

SEQ ID NO: 8830 - DNA, 18 bp, synthetic construct
  source 1..18: mol_type = other DNA
gaattcgactcactaaag

SEQ ID NO: 8831 - DNA, 18 bp, synthetic construct
  source 1..18: mol_type = other DNA
taaaacgactagctatag

SEQ ID NO: 8832 - DNA, 18 bp, synthetic construct
  source 1..18: mol_type = other DNA
taaaacgactcattatgg

SEQ ID NO: 8833 - DNA, 18 bp, synthetic construct
  source 1..18: mol_type = other DNA
taagacgtctcattatag

SEQ ID NO: 8834 - DNA, 18 bp, synthetic construct
  source 1..18: mol_type = other DNA
taatacaactccctaaag

SEQ ID NO: 8835 - DNA, 18 bp, synthetic construct
  source 1..18: mol_type = other DNA
taatacgactcgaaatag

SEQ ID NO: 8836 - DNA, 18 bp, synthetic construct
  source 1..18: mol_type = other DNA
taatacgactctttacag

SEQ ID NO: 8837 - DNA, 18 bp, synthetic construct
  source 1..18: mol_type = other DNA
taatactactcacttgag

SEQ ID NO: 8838 - DNA, 18 bp, synthetic construct
  source 1..18: mol_type = other DNA
taatgctactcactagag

SEQ ID NO: 8839 - DNA, 18 bp, synthetic construct
  source 1..18: mol_type = other DNA
taccacgacacactatag

SEQ ID NO: 8840 - DNA, 18 bp, synthetic construct
  source 1..18: mol_type = other DNA
tactacgacatactatag

SEQ ID NO: 8841 - DNA, 18 bp, synthetic construct
  source 1..18: mol_type = other DNA
tagtacgactcaatttag

SEQ ID NO: 8842 - DNA, 18 bp, synthetic construct
  source 1..18: mol_type = other DNA
tagtacgactcattaaag

SEQ ID NO: 8843 - DNA, 18 bp, synthetic construct
  source 1..18: mol_type = other DNA
tatttcgactcagtatag

SEQ ID NO: 8844 - DNA, 18 bp, synthetic construct
  source 1..18: mol_type = other DNA
tcaaacgacttactatag

SEQ ID NO: 8845 - DNA, 18 bp, synthetic construct
  source 1..18: mol_type = other DNA
tgatacgtctaactatag

SEQ ID NO: 8846 - DNA, 18 bp, synthetic construct
  source 1..18: mol_type = other DNA
aaatacagctcactatag

SEQ ID NO: 8847 - DNA, 18 bp, synthetic construct
  source 1..18: mol_type = other DNA
agatacgactcattatag

SEQ ID NO: 8848 - DNA, 18 bp, synthetic construct
  source 1..18: mol_type = other DNA
caatacgacccactattg

SEQ ID NO: 8849 - DNA, 18 bp, synthetic construct
  source 1..18: mol_type = other DNA
caatacgacttgctatag

SEQ ID NO: 8850 - DNA, 18 bp, synthetic construct
  source 1..18: mol_type = other DNA
caatactactcactacag

SEQ ID NO: 8851 - DNA, 18 bp, synthetic construct
  source 1..18: mol_type = other DNA
caatattactcactatag

SEQ ID NO: 8852 - DNA, 18 bp, synthetic construct
  source 1..18: mol_type = other DNA
ccatacgtctcactatag

SEQ ID NO: 8853 - DNA, 18 bp, synthetic construct
  source 1..18: mol_type = other DNA
gaatacgaatccctatag

SEQ ID NO: 8854 - DNA, 18 bp, synthetic construct
  source 1..18: mol_type = other DNA
taaaacgacacagtatag

SEQ ID NO: 8855 - DNA, 18 bp, synthetic construct
  source 1..18: mol_type = other DNA
taaaacgcctccctatag

SEQ ID NO: 8856 - DNA, 18 bp, synthetic construct
  source 1..18: mol_type = other DNA
taaagccactcactatag

SEQ ID NO: 8857 - DNA, 18 bp, synthetic construct
  source 1..18: mol_type = other DNA
taacaagactccctatag

SEQ ID NO: 8858 - DNA, 18 bp, synthetic construct
  source 1..18: mol_type = other DNA
taacaccactcactatcg

SEQ ID NO: 8859 - DNA, 18 bp, synthetic construct
  source 1..18: mol_type = other DNA
taacccgactcactaaag

SEQ ID NO: 8860 - DNA, 18 bp, synthetic construct
  source 1..18: mol_type = other DNA
taagacgcctctctatag

SEQ ID NO: 8861 - DNA, 18 bp, synthetic construct
  source 1..18: mol_type = other DNA
taaggcgacacactatag

SEQ ID NO: 8862 - DNA, 18 bp, synthetic construct
  source 1..18: mol_type = other DNA
taataacactcactctag

SEQ ID NO: 8863 - DNA, 18 bp, synthetic construct
  source 1..18: mol_type = other DNA
taatacaacttagtatag

SEQ ID NO: 8864 - DNA, 18 bp, synthetic construct
  source 1..18: mol_type = other DNA
taatacaacttgctatag

SEQ ID NO: 8865 - DNA, 18 bp, synthetic construct
  source 1..18: mol_type = other DNA
taatacgaataacgatag

SEQ ID NO: 8866 - DNA, 18 bp, synthetic construct
  source 1..18: mol_type = other DNA
taatacgaatcgttatag

SEQ ID NO: 8867 - DNA, 18 bp, synthetic construct
  source 1..18: mol_type = other DNA
taatacgaatgactacag

SEQ ID NO: 8868 - DNA, 18 bp, synthetic construct
  source 1..18: mol_type = other DNA
taatacgacctcctatag

SEQ ID NO: 8869 - DNA, 18 bp, synthetic construct
  source 1..18: mol_type = other DNA
taatacgactcacaacgg

SEQ ID NO: 8870 - DNA, 18 bp, synthetic construct
  source 1..18: mol_type = other DNA
taatacgactcattagtg

SEQ ID NO: 8871 - DNA, 18 bp, synthetic construct
  source 1..18: mol_type = other DNA
taatacgactccctcaag

SEQ ID NO: 8872 - DNA, 18 bp, synthetic construct
  source 1..18: mol_type = other DNA
taatacgacttaatgtag

SEQ ID NO: 8873 - DNA, 18 bp, synthetic construct
  source 1..18: mol_type = other DNA
taatacgagtcattctag

SEQ ID NO: 8874 - DNA, 18 bp, synthetic construct
  source 1..18: mol_type = other DNA
taatacgatggactatag

SEQ ID NO: 8875 - DNA, 18 bp, synthetic construct
  source 1..18: mol_type = other DNA
taatacgattcacgttag

SEQ ID NO: 8876 - DNA, 18 bp, synthetic construct
  source 1..18: mol_type = other DNA
taatacgattgactaaag

SEQ ID NO: 8877 - DNA, 18 bp, synthetic construct
  source 1..18: mol_type = other DNA
taatacgattgattatag

SEQ ID NO: 8878 - DNA, 18 bp, synthetic construct
  source 1..18: mol_type = other DNA
taatacgccgcacaatag

SEQ ID NO: 8879 - DNA, 18 bp, synthetic construct
  source 1..18: mol_type = other DNA
taatacgcctctctctag

SEQ ID NO: 8880 - DNA, 18 bp, synthetic construct
  source 1..18: mol_type = other DNA
taatacggcacaccatag

SEQ ID NO: 8881 - DNA, 18 bp, synthetic construct
  source 1..18: mol_type = other DNA
taatactaatcagtatag

SEQ ID NO: 8882 - DNA, 18 bp, synthetic construct
  source 1..18: mol_type = other DNA
taataggattcactctag

SEQ ID NO: 8883 - DNA, 18 bp, synthetic construct
  source 1..18: mol_type = other DNA
taatatgactcagaatag

SEQ ID NO: 8884 - DNA, 18 bp, synthetic construct
  source 1..18: mol_type = other DNA
taatatgagtcactacag

SEQ ID NO: 8885 - DNA, 18 bp, synthetic construct
  source 1..18: mol_type = other DNA
taatccgacccaccatag

SEQ ID NO: 8886 - DNA, 18 bp, synthetic construct
  source 1..18: mol_type = other DNA
taatcgaactcactatag

SEQ ID NO: 8887 - DNA, 18 bp, synthetic construct
  source 1..18: mol_type = other DNA
taatgcgaaccactatag

SEQ ID NO: 8888 - DNA, 18 bp, synthetic construct
  source 1..18: mol_type = other DNA
taatgcgaatgactatag

SEQ ID NO: 8889 - DNA, 18 bp, synthetic construct
  source 1..18: mol_type = other DNA
tagtacgactcagtattg

SEQ ID NO: 8890 - DNA, 18 bp, synthetic construct
  source 1..18: mol_type = other DNA
tagtacgcctcactattg

SEQ ID NO: 8891 - DNA, 18 bp, synthetic construct
  source 1..18: mol_type = other DNA
tagtacgtctcaccatag

SEQ ID NO: 8892 - DNA, 18 bp, synthetic construct
  source 1..18: mol_type = other DNA
tcatacgactcaccaaag

SEQ ID NO: 8893 - DNA, 18 bp, synthetic construct
  source 1..18: mol_type = other DNA
tcatacgactcactggag

SEQ ID NO: 8894 - DNA, 18 bp, synthetic construct
  source 1..18: mol_type = other DNA
tcatacgactcatcatag

SEQ ID NO: 8895 - DNA, 18 bp, synthetic construct
  source 1..18: mol_type = other DNA
tcatacgactccgtatag

SEQ ID NO: 8896 - DNA, 18 bp, synthetic construct
  source 1..18: mol_type = other DNA
tcatccgactcaatatag

SEQ ID NO: 8897 - DNA, 18 bp, synthetic construct
  source 1..18: mol_type = other DNA
tcattcgactaactatag

SEQ ID NO: 8898 - DNA, 18 bp, synthetic construct
  source 1..18: mol_type = other DNA
tgatacgattcaccatag

SEQ ID NO: 8899 - DNA, 18 bp, synthetic construct
  source 1..18: mol_type = other DNA
tgatagtactcactatag

SEQ ID NO: 8900 - DNA, 18 bp, synthetic construct
  source 1..18: mol_type = other DNA
tggaacgactcactatag

SEQ ID NO: 8901 - DNA, 18 bp, synthetic construct
  source 1..18: mol_type = other DNA
ttagacgaatcactatag

SEQ ID NO: 8902 - DNA, 18 bp, synthetic construct
  source 1..18: mol_type = other DNA
ttatacgatgcactatag

SEQ ID NO: 8903 - DNA, 18 bp, synthetic construct
  source 1..18: mol_type = other DNA
ttatatgacacactatag

SEQ ID NO: 8904 - DNA, 18 bp, synthetic construct
  source 1..18: mol_type = other DNA
taatatgactctcaatag

SEQ ID NO: 8905 - DNA, 18 bp, synthetic construct
  source 1..18: mol_type = other DNA
taatacttcacactatag

SEQ ID NO: 8906 - DNA, 18 bp, synthetic construct
  source 1..18: mol_type = other DNA
taattctactcactattg

SEQ ID NO: 8907 - DNA, 18 bp, synthetic construct
  source 1..18: mol_type = other DNA
taacacgtttcactatag

SEQ ID NO: 8908 - DNA, 18 bp, synthetic construct
  source 1..18: mol_type = other DNA
taatacgaccctctttag

SEQ ID NO: 8909 - DNA, 18 bp, synthetic construct
  source 1..18: mol_type = other DNA
taatactacaaactatag

SEQ ID NO: 8910 - DNA, 18 bp, synthetic construct
  source 1..18: mol_type = other DNA
tattacgattgactatag

SEQ ID NO: 8911 - DNA, 18 bp, synthetic construct
  source 1..18: mol_type = other DNA
taattcgattcactattg

SEQ ID NO: 8912 - DNA, 18 bp, synthetic construct
  source 1..18: mol_type = other DNA
taatacgactcttaatag

SEQ ID NO: 8913 - DNA, 18 bp, synthetic construct
  source 1..18: mol_type = other DNA
taataagtctcattatag

SEQ ID NO: 8914 - DNA, 18 bp, synthetic construct
  source 1..18: mol_type = other DNA
taatacgacatgctatag

SEQ ID NO: 8915 - DNA, 18 bp, synthetic construct
  source 1..18: mol_type = other DNA
taatacgacccacttttg

SEQ ID NO: 8916 - DNA, 18 bp, synthetic construct
  source 1..18: mol_type = other DNA
taatatgatttactatag

SEQ ID NO: 8917 - DNA, 18 bp, synthetic construct
  source 1..18: mol_type = other DNA
tagaacgactcactattg

SEQ ID NO: 8918 - DNA, 18 bp, synthetic construct
  source 1..18: mol_type = other DNA
tattacggatcactatag

SEQ ID NO: 8919 - DNA, 18 bp, synthetic construct
  source 1..18: mol_type = other DNA
ttctacgacacactatag

SEQ ID NO: 8920 - DNA, 18 bp, synthetic construct
  source 1..18: mol_type = other DNA
ttattcgactcaatatag

SEQ ID NO: 8921 - DNA, 18 bp, synthetic construct
  source 1..18: mol_type = other DNA
ctatacgactctctatag

SEQ ID NO: 8922 - DNA, 18 bp, synthetic construct
  source 1..18: mol_type = other DNA
taaaaccactcactattg

SEQ ID NO: 8923 - DNA, 18 bp, synthetic construct
  source 1..18: mol_type = other DNA
ttatacctctcactatag

SEQ ID NO: 8924 - DNA, 18 bp, synthetic construct
  source 1..18: mol_type = other DNA
aaatacatctcactatag

SEQ ID NO: 8925 - DNA, 18 bp, synthetic construct
  source 1..18: mol_type = other DNA
taataagattcacaatag

SEQ ID NO: 8926 - DNA, 18 bp, synthetic construct
  source 1..18: mol_type = other DNA
taatacgattcataatag

SEQ ID NO: 8927 - DNA, 18 bp, synthetic construct
  source 1..18: mol_type = other DNA
taatactactaattatag

SEQ ID NO: 8928 - DNA, 18 bp, synthetic construct
  source 1..18: mol_type = other DNA
ttatacgacttaccatag

SEQ ID NO: 8929 - DNA, 18 bp, synthetic construct
  source 1..18: mol_type = other DNA
ttattcgactccctatag

SEQ ID NO: 8930 - DNA, 18 bp, synthetic construct
  source 1..18: mol_type = other DNA
aaatacgactcactcttg

SEQ ID NO: 8931 - DNA, 18 bp, synthetic construct
  source 1..18: mol_type = other DNA
aaatatgactcaccatag

SEQ ID NO: 8932 - DNA, 18 bp, synthetic construct
  source 1..18: mol_type = other DNA
aattacgaatcactatag

SEQ ID NO: 8933 - DNA, 18 bp, synthetic construct
  source 1..18: mol_type = other DNA
caatacgactcattttag

SEQ ID NO: 8934 - DNA, 18 bp, synthetic construct
  source 1..18: mol_type = other DNA
taatacaaatcaccatag

SEQ ID NO: 8935 - DNA, 18 bp, synthetic construct
  source 1..18: mol_type = other DNA
taatacgacttactcttg

SEQ ID NO: 8936 - DNA, 18 bp, synthetic construct
  source 1..18: mol_type = other DNA
taatacgatccacaatag

SEQ ID NO: 8937 - DNA, 18 bp, synthetic construct
  source 1..18: mol_type = other DNA
taatactactccctacag

SEQ ID NO: 8938 - DNA, 18 bp, synthetic construct
  source 1..18: mol_type = other DNA
taatccaactcaatatag

SEQ ID NO: 8939 - DNA, 18 bp, synthetic construct
  source 1..18: mol_type = other DNA
taatgcgattcactgtag

SEQ ID NO: 8940 - DNA, 18 bp, synthetic construct
  source 1..18: mol_type = other DNA
tactacgtctcactatgg

SEQ ID NO: 8941 - DNA, 18 bp, synthetic construct
  source 1..18: mol_type = other DNA
tattaagactcaccatag

SEQ ID NO: 8942 - DNA, 18 bp, synthetic construct
  source 1..18: mol_type = other DNA
ttgtacgactcattatag

SEQ ID NO: 8943 - DNA, 18 bp, synthetic construct
  source 1..18: mol_type = other DNA
taaaacgactctctattg

SEQ ID NO: 8944 - DNA, 18 bp, synthetic construct
  source 1..18: mol_type = other DNA
taaatctactcactatag

SEQ ID NO: 8945 - DNA, 18 bp, synthetic construct
  source 1..18: mol_type = other DNA
ttatactgctcactatag

SEQ ID NO: 8946 - DNA, 18 bp, synthetic construct
  source 1..18: mol_type = other DNA
taatacgactcattaatg

SEQ ID NO: 8947 - DNA, 18 bp, synthetic construct
  source 1..18: mol_type = other DNA
aaatactacacactatag

SEQ ID NO: 8948 - DNA, 18 bp, synthetic construct
  source 1..18: mol_type = other DNA
taaaacgacttaatatag

SEQ ID NO: 8949 - DNA, 18 bp, synthetic construct
  source 1..18: mol_type = other DNA
taaaacggctctctatag

SEQ ID NO: 8950 - DNA, 18 bp, synthetic construct
  source 1..18: mol_type = other DNA
taacacgactctttatag

SEQ ID NO: 8951 - DNA, 18 bp, synthetic construct
  source 1..18: mol_type = other DNA
taatacaaaacactatag

SEQ ID NO: 8952 - DNA, 18 bp, synthetic construct
  source 1..18: mol_type = other DNA
taatacaacttactatcg

SEQ ID NO: 8953 - DNA, 18 bp, synthetic construct
  source 1..18: mol_type = other DNA
taataccactctccatag

SEQ ID NO: 8954 - DNA, 18 bp, synthetic construct
  source 1..18: mol_type = other DNA
tgaaatgactcactatag

SEQ ID NO: 8955 - DNA, 18 bp, synthetic construct
  source 1..18: mol_type = other DNA
tgattcgactctctatag

SEQ ID NO: 8956 - DNA, 18 bp, synthetic construct
  source 1..18: mol_type = other DNA
ttatacgactcaccacag

SEQ ID NO: 8957 - DNA, 18 bp, synthetic construct
  source 1..18: mol_type = other DNA
ttatatgactcactatgg

SEQ ID NO: 8958 - DNA, 18 bp, synthetic construct
  source 1..18: mol_type = other DNA
taatactacacactattg

SEQ ID NO: 8959 - DNA, 18 bp, synthetic construct
  source 1..18: mol_type = other DNA
tattacatctcactatag

SEQ ID NO: 8960 - DNA, 18 bp, synthetic construct
  source 1..18: mol_type = other DNA
caatacgtcacactatag

SEQ ID NO: 8961 - DNA, 18 bp, synthetic construct
  source 1..18: mol_type = other DNA
taatacgactctatacag

SEQ ID NO: 8962 - DNA, 18 bp, synthetic construct
  source 1..18: mol_type = other DNA
taatacgtctgactttag

SEQ ID NO: 8963 - DNA, 18 bp, synthetic construct
  source 1..18: mol_type = other DNA
taatccgactcactaatg

SEQ ID NO: 8964 - DNA, 18 bp, synthetic construct
  source 1..18: mol_type = other DNA
taatgcttctcactatag

SEQ ID NO: 8965 - DNA, 18 bp, synthetic construct
  source 1..18: mol_type = other DNA
tcaaactactcactatag

SEQ ID NO: 8966 - DNA, 18 bp, synthetic construct
  source 1..18: mol_type = other DNA
tgaaacgacacactatag

SEQ ID NO: 8967 - DNA, 18 bp, synthetic construct
  source 1..18: mol_type = other DNA
taatacgactctcattag

SEQ ID NO: 8968 - DNA, 18 bp, synthetic construct
  source 1..18: mol_type = other DNA
taatacgtttcactattg

SEQ ID NO: 8969 - DNA, 18 bp, synthetic construct
  source 1..18: mol_type = other DNA
tattacgacacactatgg

SEQ ID NO: 8970 - DNA, 18 bp, synthetic construct
  source 1..18: mol_type = other DNA
ttaaacgacttactatag

SEQ ID NO: 8971 - DNA, 18 bp, synthetic construct
  source 1..18: mol_type = other DNA
caatacgtctctctatag

SEQ ID NO: 8972 - DNA, 18 bp, synthetic construct
  source 1..18: mol_type = other DNA
aagtacgactcaatatag

SEQ ID NO: 8973 - DNA, 18 bp, synthetic construct
  source 1..18: mol_type = other DNA
taaaacgacttactatcg

SEQ ID NO: 8974 - DNA, 18 bp, synthetic construct
  source 1..18: mol_type = other DNA
taaaaggattcactatag

SEQ ID NO: 8975 - DNA, 18 bp, synthetic construct
  source 1..18: mol_type = other DNA
taagacgactcacaacag

SEQ ID NO: 8976 - DNA, 18 bp, synthetic construct
  source 1..18: mol_type = other DNA
taataagcctcattatag

SEQ ID NO: 8977 - DNA, 18 bp, synthetic construct
  source 1..18: mol_type = other DNA
taatacaaatcactctag

SEQ ID NO: 8978 - DNA, 18 bp, synthetic construct
  source 1..18: mol_type = other DNA
taatacaacccactaaag

SEQ ID NO: 8979 - DNA, 18 bp, synthetic construct
  source 1..18: mol_type = other DNA
taatacaactcgttatag

SEQ ID NO: 8980 - DNA, 18 bp, synthetic construct
  source 1..18: mol_type = other DNA
taatacaagtcactacag

SEQ ID NO: 8981 - DNA, 18 bp, synthetic construct
  source 1..18: mol_type = other DNA
taatacgaccaactaaag

SEQ ID NO: 8982 - DNA, 18 bp, synthetic construct
  source 1..18: mol_type = other DNA
taatacgacttaatacag

SEQ ID NO: 8983 - DNA, 18 bp, synthetic construct
  source 1..18: mol_type = other DNA
taatactactctgtatag

SEQ ID NO: 8984 - DNA, 18 bp, synthetic construct
  source 1..18: mol_type = other DNA
taatatgaatcactacag

SEQ ID NO: 8985 - DNA, 18 bp, synthetic construct
  source 1..18: mol_type = other DNA
taatgcgacactctatag

SEQ ID NO: 8986 - DNA, 18 bp, synthetic construct
  source 1..18: mol_type = other DNA
taatgcgactcaatgtag

SEQ ID NO: 8987 - DNA, 18 bp, synthetic construct
  source 1..18: mol_type = other DNA
taattctactcactacag

SEQ ID NO: 8988 - DNA, 18 bp, synthetic construct
  source 1..18: mol_type = other DNA
tagtacaactctctatag

SEQ ID NO: 8989 - DNA, 18 bp, synthetic construct
  source 1..18: mol_type = other DNA
tattaccactccctatag

SEQ ID NO: 8990 - DNA, 18 bp, synthetic construct
  source 1..18: mol_type = other DNA
tattacgactagctatag

SEQ ID NO: 8991 - DNA, 18 bp, synthetic construct
  source 1..18: mol_type = other DNA
tattacgactcattctag

SEQ ID NO: 8992 - DNA, 18 bp, synthetic construct
  source 1..18: mol_type = other DNA
ttatacgattcagtatag

SEQ ID NO: 8993 - DNA, 18 bp, synthetic construct
  source 1..18: mol_type = other DNA
aaatacgagtcaccatag

SEQ ID NO: 8994 - DNA, 18 bp, synthetic construct
  source 1..18: mol_type = other DNA
aactacgactaactatag

SEQ ID NO: 8995 - DNA, 18 bp, synthetic construct
  source 1..18: mol_type = other DNA
aactacgactcaatatag

SEQ ID NO: 8996 - DNA, 18 bp, synthetic construct
  source 1..18: mol_type = other DNA
agatacgacccactatag

SEQ ID NO: 8997 - DNA, 18 bp, synthetic construct
  source 1..18: mol_type = other DNA
caatacgaatcacaatag

SEQ ID NO: 8998 - DNA, 18 bp, synthetic construct
  source 1..18: mol_type = other DNA
caatacgactcacgattg

SEQ ID NO: 8999 - DNA, 18 bp, synthetic construct
  source 1..18: mol_type = other DNA
caatacgtctcacgatag

SEQ ID NO: 9000 - DNA, 18 bp, synthetic construct
  source 1..18: mol_type = other DNA
cgatacgtctcactatag

SEQ ID NO: 9001 - DNA, 18 bp, synthetic construct
  source 1..18: mol_type = other DNA
cgatactactcactatag

SEQ ID NO: 9002 - DNA, 18 bp, synthetic construct
  source 1..18: mol_type = other DNA
taacacgacacactatgg

SEQ ID NO: 9003 - DNA, 18 bp, synthetic construct
  source 1..18: mol_type = other DNA
taacacgactcaatattg

SEQ ID NO: 9004 - DNA, 18 bp, synthetic construct
  source 1..18: mol_type = other DNA
taacacgactctctagag

SEQ ID NO: 9005 - DNA, 18 bp, synthetic construct
  source 1..18: mol_type = other DNA
taacccgagtcactatag

SEQ ID NO: 9006 - DNA, 18 bp, synthetic construct
  source 1..18: mol_type = other DNA
taagacgacacaccatag

SEQ ID NO: 9007 - DNA, 18 bp, synthetic construct
  source 1..18: mol_type = other DNA
taataagacgcactttag

SEQ ID NO: 9008 - DNA, 18 bp, synthetic construct
  source 1..18: mol_type = other DNA
taataagactcaccctag

SEQ ID NO: 9009 - DNA, 18 bp, synthetic construct
  source 1..18: mol_type = other DNA
taataagactcattatgg

SEQ ID NO: 9010 - DNA, 18 bp, synthetic construct
  source 1..18: mol_type = other DNA
taatacaactcagtatcg

SEQ ID NO: 9011 - DNA, 18 bp, synthetic construct
  source 1..18: mol_type = other DNA
taatacaactcagtctag

SEQ ID NO: 9012 - DNA, 18 bp, synthetic construct
  source 1..18: mol_type = other DNA
taatacacctcacaatag

SEQ ID NO: 9013 - DNA, 18 bp, synthetic construct
  source 1..18: mol_type = other DNA
taatacacctcactacag

SEQ ID NO: 9014 - DNA, 18 bp, synthetic construct
  source 1..18: mol_type = other DNA
taataccactcagtctag

SEQ ID NO: 9015 - DNA, 18 bp, synthetic construct
  source 1..18: mol_type = other DNA
taataccacttacgatag

SEQ ID NO: 9016 - DNA, 18 bp, synthetic construct
  source 1..18: mol_type = other DNA
taatacccctcactaaag

SEQ ID NO: 9017 - DNA, 18 bp, synthetic construct
  source 1..18: mol_type = other DNA
taatacctctcacgatag

SEQ ID NO: 9018 - DNA, 18 bp, synthetic construct
  source 1..18: mol_type = other DNA
taatacctctcactgtag

SEQ ID NO: 9019 - DNA, 18 bp, synthetic construct
  source 1..18: mol_type = other DNA
taatacgaatctcgatag

SEQ ID NO: 9020 - DNA, 18 bp, synthetic construct
  source 1..18: mol_type = other DNA
taatacgaatctgtatag

SEQ ID NO: 9021 - DNA, 18 bp, synthetic construct
  source 1..18: mol_type = other DNA
taatacgacaccctagag

SEQ ID NO: 9022 - DNA, 18 bp, synthetic construct
  source 1..18: mol_type = other DNA
taatacgaccaaatatag

SEQ ID NO: 9023 - DNA, 18 bp, synthetic construct
  source 1..18: mol_type = other DNA
taatacgacccactgttg

SEQ ID NO: 9024 - DNA, 18 bp, synthetic construct
  source 1..18: mol_type = other DNA
taatacgacccagaatag

SEQ ID NO: 9025 - DNA, 18 bp, synthetic construct
  source 1..18: mol_type = other DNA
taatacgactaagcatag

SEQ ID NO: 9026 - DNA, 18 bp, synthetic construct
  source 1..18: mol_type = other DNA
taatacgactcaccgttg

SEQ ID NO: 9027 - DNA, 18 bp, synthetic construct
  source 1..18: mol_type = other DNA
taatacgactcaccttcg

SEQ ID NO: 9028 - DNA, 18 bp, synthetic construct
  source 1..18: mol_type = other DNA
taatacgacttacgttag

SEQ ID NO: 9029 - DNA, 18 bp, synthetic construct
  source 1..18: mol_type = other DNA
taatacgattccctatcg

SEQ ID NO: 9030 - DNA, 18 bp, synthetic construct
  source 1..18: mol_type = other DNA
taatacgcctcacaacag

SEQ ID NO: 9031 - DNA, 18 bp, synthetic construct
  source 1..18: mol_type = other DNA
taatacggctgattatag

SEQ ID NO: 9032 - DNA, 18 bp, synthetic construct
  source 1..18: mol_type = other DNA
taatactaatcactatcg

SEQ ID NO: 9033 - DNA, 18 bp, synthetic construct
  source 1..18: mol_type = other DNA
taatactactcaccatcg

SEQ ID NO: 9034 - DNA, 18 bp, synthetic construct
  source 1..18: mol_type = other DNA
taatactacttacgatag

SEQ ID NO: 9035 - DNA, 18 bp, synthetic construct
  source 1..18: mol_type = other DNA
taatactagtccctatag

SEQ ID NO: 9036 - DNA, 18 bp, synthetic construct
  source 1..18: mol_type = other DNA
taatatggctcattatag

SEQ ID NO: 9037 - DNA, 18 bp, synthetic construct
  source 1..18: mol_type = other DNA
taatccgacttactatcg

SEQ ID NO: 9038 - DNA, 18 bp, synthetic construct
  source 1..18: mol_type = other DNA
taatgccactcaatatag

SEQ ID NO: 9039 - DNA, 18 bp, synthetic construct
  source 1..18: mol_type = other DNA
taatgcgattcactacag

SEQ ID NO: 9040 - DNA, 18 bp, synthetic construct
  source 1..18: mol_type = other DNA
taatgctactcactacag

SEQ ID NO: 9041 - DNA, 18 bp, synthetic construct
  source 1..18: mol_type = other DNA
taattcgactgaccatag

SEQ ID NO: 9042 - DNA, 18 bp, synthetic construct
  source 1..18: mol_type = other DNA
tactacgtctcagtatag

SEQ ID NO: 9043 - DNA, 18 bp, synthetic construct
  source 1..18: mol_type = other DNA
tacttcgaatcactatag

SEQ ID NO: 9044 - DNA, 18 bp, synthetic construct
  source 1..18: mol_type = other DNA
tagaaccactcactatag

SEQ ID NO: 9045 - DNA, 18 bp, synthetic construct
  source 1..18: mol_type = other DNA
tagcacgaatcactatag

SEQ ID NO: 9046 - DNA, 18 bp, synthetic construct
  source 1..18: mol_type = other DNA
tagtacgactcatcatag

SEQ ID NO: 9047 - DNA, 18 bp, synthetic construct
  source 1..18: mol_type = other DNA
tagtacgatttactatag

SEQ ID NO: 9048 - DNA, 18 bp, synthetic construct
  source 1..18: mol_type = other DNA
tagtatgaatcactatag

SEQ ID NO: 9049 - DNA, 18 bp, synthetic construct
  source 1..18: mol_type = other DNA
tagtgagactcactatag

SEQ ID NO: 9050 - DNA, 18 bp, synthetic construct
  source 1..18: mol_type = other DNA
tgatacgactcactaagg

SEQ ID NO: 9051 - DNA, 18 bp, synthetic construct
  source 1..18: mol_type = other DNA
ttagacgacacactatag

SEQ ID NO: 9052 - DNA, 18 bp, synthetic construct
  source 1..18: mol_type = other DNA
ttagacgactcacaatag

SEQ ID NO: 9053 - DNA, 18 bp, synthetic construct
  source 1..18: mol_type = other DNA
ttttacgattcactatag

SEQ ID NO: 9054 - DNA, 18 bp, synthetic construct
  source 1..18: mol_type = other DNA
ttgttcgactcactatag

SEQ ID NO: 9055 - DNA, 18 bp, synthetic construct
  source 1..18: mol_type = other DNA
aaatacgactccctattg

SEQ ID NO: 9056 - DNA, 18 bp, synthetic construct
  source 1..18: mol_type = other DNA
aaattcgacccactatag

SEQ ID NO: 9057 - DNA, 18 bp, synthetic construct
  source 1..18: mol_type = other DNA
atatacgcctcactatag

SEQ ID NO: 9058 - DNA, 18 bp, synthetic construct
  source 1..18: mol_type = other DNA
taaagcgacttactatag

SEQ ID NO: 9059 - DNA, 18 bp, synthetic construct
  source 1..18: mol_type = other DNA
taataagaatcattatag

SEQ ID NO: 9060 - DNA, 18 bp, synthetic construct
  source 1..18: mol_type = other DNA
taataagatacactatag

SEQ ID NO: 9061 - DNA, 18 bp, synthetic construct
  source 1..18: mol_type = other DNA
taataccacacattatag

SEQ ID NO: 9062 - DNA, 18 bp, synthetic construct
  source 1..18: mol_type = other DNA
tattacgagtcactttag

SEQ ID NO: 9063 - DNA, 18 bp, synthetic construct
  source 1..18: mol_type = other DNA
ttaaaccactcactatag

SEQ ID NO: 9064 - DNA, 18 bp, synthetic construct
  source 1..18: mol_type = other DNA
ttaaactactcactatag

SEQ ID NO: 9065 - DNA, 18 bp, synthetic construct
  source 1..18: mol_type = other DNA
aaaaacgactcacaatag

SEQ ID NO: 9066 - DNA, 18 bp, synthetic construct
  source 1..18: mol_type = other DNA
tacttcgactcactttag

SEQ ID NO: 9067 - DNA, 18 bp, synthetic construct
  source 1..18: mol_type = other DNA
aaatacgactctctttag

SEQ ID NO: 9068 - DNA, 18 bp, synthetic construct
  source 1..18: mol_type = other DNA
ttatacgagtcactttag

SEQ ID NO: 9069 - DNA, 18 bp, synthetic construct
  source 1..18: mol_type = other DNA
tataaccactcactatag

SEQ ID NO: 9070 - DNA, 18 bp, synthetic construct
  source 1..18: mol_type = other DNA
tatttcgattcactatag

SEQ ID NO: 9071 - DNA, 18 bp, synthetic construct
  source 1..18: mol_type = other DNA
taacatgattcactatag

SEQ ID NO: 9072 - DNA, 18 bp, synthetic construct
  source 1..18: mol_type = other DNA
taataagtctcaatatag

SEQ ID NO: 9073 - DNA, 18 bp, synthetic construct
  source 1..18: mol_type = other DNA
taatacaactaattatag

SEQ ID NO: 9074 - DNA, 18 bp, synthetic construct
  source 1..18: mol_type = other DNA
tcaaacgactctctatag

SEQ ID NO: 9075 - DNA, 18 bp, synthetic construct
  source 1..18: mol_type = other DNA
taaaacgacttactattg

SEQ ID NO: 9076 - DNA, 18 bp, synthetic construct
  source 1..18: mol_type = other DNA
ttttacgacttactatag

SEQ ID NO: 9077 - DNA, 18 bp, synthetic construct
  source 1..18: mol_type = other DNA
taatacgattcacattag

SEQ ID NO: 9078 - DNA, 18 bp, synthetic construct
  source 1..18: mol_type = other DNA
taataagacacactttag

SEQ ID NO: 9079 - DNA, 18 bp, synthetic construct
  source 1..18: mol_type = other DNA
taatacaacacactttag

SEQ ID NO: 9080 - DNA, 18 bp, synthetic construct
  source 1..18: mol_type = other DNA
aaaaacgtctcactatag

SEQ ID NO: 9081 - DNA, 18 bp, synthetic construct
  source 1..18: mol_type = other DNA
ttatacgactcaccaaag

SEQ ID NO: 9082 - DNA, 18 bp, synthetic construct
  source 1..18: mol_type = other DNA
aaatacgtctcaccatag

SEQ ID NO: 9083 - DNA, 18 bp, synthetic construct
  source 1..18: mol_type = other DNA
taatatgaatcactattg

SEQ ID NO: 9084 - DNA, 18 bp, synthetic construct
  source 1..18: mol_type = other DNA
taatatgactttctatag

SEQ ID NO: 9085 - DNA, 18 bp, synthetic construct
  source 1..18: mol_type = other DNA
aaagacaactcactatag

SEQ ID NO: 9086 - DNA, 18 bp, synthetic construct
  source 1..18: mol_type = other DNA
aaatacgactgacaatag

SEQ ID NO: 9087 - DNA, 18 bp, synthetic construct
  source 1..18: mol_type = other DNA
caaaacgaatcactatag

SEQ ID NO: 9088 - DNA, 18 bp, synthetic construct
  source 1..18: mol_type = other DNA
caataggactcactaaag

SEQ ID NO: 9089 - DNA, 18 bp, synthetic construct
  source 1..18: mol_type = other DNA
taaaacgacccactctag

SEQ ID NO: 9090 - DNA, 18 bp, synthetic construct
  source 1..18: mol_type = other DNA
taataaaactcattatag

SEQ ID NO: 9091 - DNA, 18 bp, synthetic construct
  source 1..18: mol_type = other DNA
taatacaaccaactatag

SEQ ID NO: 9092 - DNA, 18 bp, synthetic construct
  source 1..18: mol_type = other DNA
taatacgacactgtatag

SEQ ID NO: 9093 - DNA, 18 bp, synthetic construct
  source 1..18: mol_type = other DNA
taatacggttcactaaag

SEQ ID NO: 9094 - DNA, 18 bp, synthetic construct
  source 1..18: mol_type = other DNA
tagtaagactcacaatag

SEQ ID NO: 9095 - DNA, 18 bp, synthetic construct
  source 1..18: mol_type = other DNA
tattagtactcactatag

SEQ ID NO: 9096 - DNA, 18 bp, synthetic construct
  source 1..18: mol_type = other DNA
tcataagacttactatag

SEQ ID NO: 9097 - DNA, 18 bp, synthetic construct
  source 1..18: mol_type = other DNA
tcatactacacactatag

SEQ ID NO: 9098 - DNA, 18 bp, synthetic construct
  source 1..18: mol_type = other DNA
ttacaccactcactatag

SEQ ID NO: 9099 - DNA, 18 bp, synthetic construct
  source 1..18: mol_type = other DNA
ttatacgactaacgatag

SEQ ID NO: 9100 - DNA, 18 bp, synthetic construct
  source 1..18: mol_type = other DNA
ttatacgactcaccatgg

SEQ ID NO: 9101 - DNA, 18 bp, synthetic construct
  source 1..18: mol_type = other DNA
taatacttctctctatag

SEQ ID NO: 9102 - DNA, 18 bp, synthetic construct
  source 1..18: mol_type = other DNA
ttatactattcactatag

SEQ ID NO: 9103 - DNA, 18 bp, synthetic construct
  source 1..18: mol_type = other DNA
taattcgattcactaaag

SEQ ID NO: 9104 - DNA, 18 bp, synthetic construct
  source 1..18: mol_type = other DNA
aattacgactctctatag

SEQ ID NO: 9105 - DNA, 18 bp, synthetic construct
  source 1..18: mol_type = other DNA
taatacgtcacactaaag

SEQ ID NO: 9106 - DNA, 18 bp, synthetic construct
  source 1..18: mol_type = other DNA
taatacgtctctttatag

SEQ ID NO: 9107 - DNA, 18 bp, synthetic construct
  source 1..18: mol_type = other DNA
aaattcgacacactatag

SEQ ID NO: 9108 - DNA, 18 bp, synthetic construct
  source 1..18: mol_type = other DNA
taaaccgaatcactatag

SEQ ID NO: 9109 - DNA, 18 bp, synthetic construct
  source 1..18: mol_type = other DNA
taacccgactcactattg

SEQ ID NO: 9110 - DNA, 18 bp, synthetic construct
  source 1..18: mol_type = other DNA
taatgcgtctcattatag

SEQ ID NO: 9111 - DNA, 18 bp, synthetic construct
  source 1..18: mol_type = other DNA
tattacaactaactatag

SEQ ID NO: 9112 - DNA, 18 bp, synthetic construct
  source 1..18: mol_type = other DNA
tcatacgattcactaaag

SEQ ID NO: 9113 - DNA, 18 bp, synthetic construct
  source 1..18: mol_type = other DNA
taatacgtttcattatag

SEQ ID NO: 9114 - DNA, 18 bp, synthetic construct
  source 1..18: mol_type = other DNA
tattacgactaactaaag

SEQ ID NO: 9115 - DNA, 18 bp, synthetic construct
  source 1..18: mol_type = other DNA
ttatacgacttaatatag

SEQ ID NO: 9116 - DNA, 18 bp, synthetic construct
  source 1..18: mol_type = other DNA
aaatacgacacactattg

SEQ ID NO: 9117 - DNA, 18 bp, synthetic construct
  source 1..18: mol_type = other DNA
tagtacgtctcactaaag

SEQ ID NO: 9118 - DNA, 18 bp, synthetic construct
  source 1..18: mol_type = other DNA
taatacgtattactatag

SEQ ID NO: 9119 - DNA, 18 bp, synthetic construct
  source 1..18: mol_type = other DNA
tatcacgacttactatag

SEQ ID NO: 9120 - DNA, 18 bp, synthetic construct
  source 1..18: mol_type = other DNA
tgatacttctcactatag

SEQ ID NO: 9121 - DNA, 18 bp, synthetic construct
  source 1..18: mol_type = other DNA
taaaaccactcactctag

SEQ ID NO: 9122 - DNA, 18 bp, synthetic construct
  source 1..18: mol_type = other DNA
taaaactactcactatcg

SEQ ID NO: 9123 - DNA, 18 bp, synthetic construct
  source 1..18: mol_type = other DNA
taacaagactcaccatag

SEQ ID NO: 9124 - DNA, 18 bp, synthetic construct
  source 1..18: mol_type = other DNA
taacactacacactatag

SEQ ID NO: 9125 - DNA, 18 bp, synthetic construct
  source 1..18: mol_type = other DNA
taataccacacaatatag

SEQ ID NO: 9126 - DNA, 18 bp, synthetic construct
  source 1..18: mol_type = other DNA
taatacgaaacattatag

SEQ ID NO: 9127 - DNA, 18 bp, synthetic construct
  source 1..18: mol_type = other DNA
taatacgactaacactag

SEQ ID NO: 9128 - DNA, 18 bp, synthetic construct
  source 1..18: mol_type = other DNA
taatactactcaatctag

SEQ ID NO: 9129 - DNA, 18 bp, synthetic construct
  source 1..18: mol_type = other DNA
tacaactactcactatag

SEQ ID NO: 9130 - DNA, 18 bp, synthetic construct
  source 1..18: mol_type = other DNA
tattacgaatcaatatag

SEQ ID NO: 9131 - DNA, 18 bp, synthetic construct
  source 1..18: mol_type = other DNA
aagtactactcactatag

SEQ ID NO: 9132 - DNA, 18 bp, synthetic construct
  source 1..18: mol_type = other DNA
caattcgacttactatag

SEQ ID NO: 9133 - DNA, 18 bp, synthetic construct
  source 1..18: mol_type = other DNA
taaaacgactcaatgtag

SEQ ID NO: 9134 - DNA, 18 bp, synthetic construct
  source 1..18: mol_type = other DNA
taataccattcgctatag

SEQ ID NO: 9135 - DNA, 18 bp, synthetic construct
  source 1..18: mol_type = other DNA
taatacgatacaccatag

SEQ ID NO: 9136 - DNA, 18 bp, synthetic construct
  source 1..18: mol_type = other DNA
taatacgcctcaatacag

SEQ ID NO: 9137 - DNA, 18 bp, synthetic construct
  source 1..18: mol_type = other DNA
taatatgattccctatag

SEQ ID NO: 9138 - DNA, 18 bp, synthetic construct
  source 1..18: mol_type = other DNA
taatccgacttactattg

SEQ ID NO: 9139 - DNA, 18 bp, synthetic construct
  source 1..18: mol_type = other DNA
tagtactgctcactatag

SEQ ID NO: 9140 - DNA, 18 bp, synthetic construct
  source 1..18: mol_type = other DNA
tattacgactaactatcg

SEQ ID NO: 9141 - DNA, 18 bp, synthetic construct
  source 1..18: mol_type = other DNA
tcatactactcacaatag

SEQ ID NO: 9142 - DNA, 18 bp, synthetic construct
  source 1..18: mol_type = other DNA
ttataccactccctatag

SEQ ID NO: 9143 - DNA, 18 bp, synthetic construct
  source 1..18: mol_type = other DNA
aaataggagtcactatag

SEQ ID NO: 9144 - DNA, 18 bp, synthetic construct
  source 1..18: mol_type = other DNA
aaattcgacgcactatag

SEQ ID NO: 9145 - DNA, 18 bp, synthetic construct
  source 1..18: mol_type = other DNA
aactacgacttactatag

SEQ ID NO: 9146 - DNA, 18 bp, synthetic construct
  source 1..18: mol_type = other DNA
aagtacgactaactatag

SEQ ID NO: 9147 - DNA, 18 bp, synthetic construct
  source 1..18: mol_type = other DNA
caagactactcactatag

SEQ ID NO: 9148 - DNA, 18 bp, synthetic construct
  source 1..18: mol_type = other DNA
caatacgaatgactatag

SEQ ID NO: 9149 - DNA, 18 bp, synthetic construct
  source 1..18: mol_type = other DNA
caatacgactgactttag

SEQ ID NO: 9150 - DNA, 18 bp, synthetic construct
  source 1..18: mol_type = other DNA
caatacgtctcactagag

SEQ ID NO: 9151 - DNA, 18 bp, synthetic construct
  source 1..18: mol_type = other DNA
caatactattcactatag

SEQ ID NO: 9152 - DNA, 18 bp, synthetic construct
  source 1..18: mol_type = other DNA
caatgcgactcattatag

SEQ ID NO: 9153 - DNA, 18 bp, synthetic construct
  source 1..18: mol_type = other DNA
caattcgagtcactatag

SEQ ID NO: 9154 - DNA, 18 bp, synthetic construct
  source 1..18: mol_type = other DNA
gaatacgactcaatttag

SEQ ID NO: 9155 - DNA, 18 bp, synthetic construct
  source 1..18: mol_type = other DNA
gaatactactcactttag

SEQ ID NO: 9156 - DNA, 18 bp, synthetic construct
  source 1..18: mol_type = other DNA
gtatacgacttactatag

SEQ ID NO: 9157 - DNA, 18 bp, synthetic construct
  source 1..18: mol_type = other DNA
taacaaggctcactatag

SEQ ID NO: 9158 - DNA, 18 bp, synthetic construct
  source 1..18: mol_type = other DNA
taacaggactcactacag

SEQ ID NO: 9159 - DNA, 18 bp, synthetic construct
  source 1..18: mol_type = other DNA
taagacgaatcagtatag

SEQ ID NO: 9160 - DNA, 18 bp, synthetic construct
  source 1..18: mol_type = other DNA
taagacgactgactattg

SEQ ID NO: 9161 - DNA, 18 bp, synthetic construct
  source 1..18: mol_type = other DNA
taatacaaaccactatag

SEQ ID NO: 9162 - DNA, 18 bp, synthetic construct
  source 1..18: mol_type = other DNA
taatacaactccatatag

SEQ ID NO: 9163 - DNA, 18 bp, synthetic construct
  source 1..18: mol_type = other DNA
taatacgacgcattttag

SEQ ID NO: 9164 - DNA, 18 bp, synthetic construct
  source 1..18: mol_type = other DNA
taatacgactccatgtag

SEQ ID NO: 9165 - DNA, 18 bp, synthetic construct
  source 1..18: mol_type = other DNA
taatacgattaactgtag

SEQ ID NO: 9166 - DNA, 18 bp, synthetic construct
  source 1..18: mol_type = other DNA
taatacggcacactacag

SEQ ID NO: 9167 - DNA, 18 bp, synthetic construct
  source 1..18: mol_type = other DNA
taatacggctcacagtag

SEQ ID NO: 9168 - DNA, 18 bp, synthetic construct
  source 1..18: mol_type = other DNA
taatacgtctcactctcg

SEQ ID NO: 9169 - DNA, 18 bp, synthetic construct
  source 1..18: mol_type = other DNA
taatacgtctggctatag

SEQ ID NO: 9170 - DNA, 18 bp, synthetic construct
  source 1..18: mol_type = other DNA
taatactactaactctag

SEQ ID NO: 9171 - DNA, 18 bp, synthetic construct
  source 1..18: mol_type = other DNA
taataggacagactatag

SEQ ID NO: 9172 - DNA, 18 bp, synthetic construct
  source 1..18: mol_type = other DNA
taataggagtcactacag

SEQ ID NO: 9173 - DNA, 18 bp, synthetic construct
  source 1..18: mol_type = other DNA
taatatgactcaacatag

SEQ ID NO: 9174 - DNA, 18 bp, synthetic construct
  source 1..18: mol_type = other DNA
taatatgacttaatatag

SEQ ID NO: 9175 - DNA, 18 bp, synthetic construct
  source 1..18: mol_type = other DNA
taatgcgattcaatatag

SEQ ID NO: 9176 - DNA, 18 bp, synthetic construct
  source 1..18: mol_type = other DNA
taatgcgattcactatgg

SEQ ID NO: 9177 - DNA, 18 bp, synthetic construct
  source 1..18: mol_type = other DNA
taattcgacagactatag

SEQ ID NO: 9178 - DNA, 18 bp, synthetic construct
  source 1..18: mol_type = other DNA
taattcgacgccctatag

SEQ ID NO: 9179 - DNA, 18 bp, synthetic construct
  source 1..18: mol_type = other DNA
tactacgactcacagtag

SEQ ID NO: 9180 - DNA, 18 bp, synthetic construct
  source 1..18: mol_type = other DNA
tactacgactcactaccg

SEQ ID NO: 9181 - DNA, 18 bp, synthetic construct
  source 1..18: mol_type = other DNA
tactatgactcaccatag

SEQ ID NO: 9182 - DNA, 18 bp, synthetic construct
  source 1..18: mol_type = other DNA
tagtccgaatcactatag

SEQ ID NO: 9183 - DNA, 18 bp, synthetic construct
  source 1..18: mol_type = other DNA
tagtccgactcactattg

SEQ ID NO: 9184 - DNA, 18 bp, synthetic construct
  source 1..18: mol_type = other DNA
tagtcctactcactatag

SEQ ID NO: 9185 - DNA, 18 bp, synthetic construct
  source 1..18: mol_type = other DNA
tatgacgaatcactatag

SEQ ID NO: 9186 - DNA, 18 bp, synthetic construct
  source 1..18: mol_type = other DNA
tatgacgacttactatag

SEQ ID NO: 9187 - DNA, 18 bp, synthetic construct
  source 1..18: mol_type = other DNA
tattacgactcagcatag

SEQ ID NO: 9188 - DNA, 18 bp, synthetic construct
  source 1..18: mol_type = other DNA
tattatgactgactatag

SEQ ID NO: 9189 - DNA, 18 bp, synthetic construct
  source 1..18: mol_type = other DNA
tattccgacgcactatag

SEQ ID NO: 9190 - DNA, 18 bp, synthetic construct
  source 1..18: mol_type = other DNA
tattgcgagtcactatag

SEQ ID NO: 9191 - DNA, 18 bp, synthetic construct
  source 1..18: mol_type = other DNA
tcacacgactcattatag

SEQ ID NO: 9192 - DNA, 18 bp, synthetic construct
  source 1..18: mol_type = other DNA
tcataccacccactatag

SEQ ID NO: 9193 - DNA, 18 bp, synthetic construct
  source 1..18: mol_type = other DNA
tcatacgactctcgatag

SEQ ID NO: 9194 - DNA, 18 bp, synthetic construct
  source 1..18: mol_type = other DNA
tcatacggctcaccatag

SEQ ID NO: 9195 - DNA, 18 bp, synthetic construct
  source 1..18: mol_type = other DNA
tgagacaactcactatag

SEQ ID NO: 9196 - DNA, 18 bp, synthetic construct
  source 1..18: mol_type = other DNA
tgataagactctctatag

SEQ ID NO: 9197 - DNA, 18 bp, synthetic construct
  source 1..18: mol_type = other DNA
tgatacaactcaatatag

SEQ ID NO: 9198 - DNA, 18 bp, synthetic construct
  source 1..18: mol_type = other DNA
tgatacgactgtctatag

SEQ ID NO: 9199 - DNA, 18 bp, synthetic construct
  source 1..18: mol_type = other DNA
ttatacgaatcacgatag

SEQ ID NO: 9200 - DNA, 18 bp, synthetic construct
  source 1..18: mol_type = other DNA
ttatacgactaactgtag

SEQ ID NO: 9201 - DNA, 18 bp, synthetic construct
  source 1..18: mol_type = other DNA
ttatacggctcactctag

SEQ ID NO: 9202 - DNA, 18 bp, synthetic construct
  source 1..18: mol_type = other DNA
ttatacgaatctctatag

SEQ ID NO: 9203 - DNA, 18 bp, synthetic construct
  source 1..18: mol_type = other DNA
aaattcgactcactaaag

SEQ ID NO: 9204 - DNA, 18 bp, synthetic construct
  source 1..18: mol_type = other DNA
ttatacgacttactaaag

SEQ ID NO: 9205 - DNA, 18 bp, synthetic construct
  source 1..18: mol_type = other DNA
tgatacgactctctttag

SEQ ID NO: 9206 - DNA, 18 bp, synthetic construct
  source 1..18: mol_type = other DNA
ttatacgattctctatag

SEQ ID NO: 9207 - DNA, 18 bp, synthetic construct
  source 1..18: mol_type = other DNA
taatacgcttctctatag

SEQ ID NO: 9208 - DNA, 18 bp, synthetic construct
  source 1..18: mol_type = other DNA
ttatacgactctatatag

SEQ ID NO: 9209 - DNA, 18 bp, synthetic construct
  source 1..18: mol_type = other DNA
ttatacgattcactaaag

SEQ ID NO: 9210 - DNA, 18 bp, synthetic construct
  source 1..18: mol_type = other DNA
taaaacgactcataatag

SEQ ID NO: 9211 - DNA, 18 bp, synthetic construct
  source 1..18: mol_type = other DNA
taatacaaatcactaaag

SEQ ID NO: 9212 - DNA, 18 bp, synthetic construct
  source 1..18: mol_type = other DNA
caattcgactcaatatag

SEQ ID NO: 9213 - DNA, 18 bp, synthetic construct
  source 1..18: mol_type = other DNA
taataagaatctctatag

SEQ ID NO: 9214 - DNA, 18 bp, synthetic construct
  source 1..18: mol_type = other DNA
taataccattcactttag

SEQ ID NO: 9215 - DNA, 18 bp, synthetic construct
  source 1..18: mol_type = other DNA
taatacgaatcaatttag

SEQ ID NO: 9216 - DNA, 18 bp, synthetic construct
  source 1..18: mol_type = other DNA
tactacgattctctatag

SEQ ID NO: 9217 - DNA, 18 bp, synthetic construct
  source 1..18: mol_type = other DNA
tattacgactccctaaag

SEQ ID NO: 9218 - DNA, 18 bp, synthetic construct
  source 1..18: mol_type = other DNA
ttatacgacttactatcg

SEQ ID NO: 9219 - DNA, 18 bp, synthetic construct
  source 1..18: mol_type = other DNA
taatacgacattctatag

SEQ ID NO: 9220 - DNA, 18 bp, synthetic construct
  source 1..18: mol_type = other DNA
tattacgaccctctatag

SEQ ID NO: 9221 - DNA, 18 bp, synthetic construct
  source 1..18: mol_type = other DNA
ttaaacgactcaatatag

SEQ ID NO: 9222 - DNA, 18 bp, synthetic construct
  source 1..18: mol_type = other DNA
taatacgactcacataag

SEQ ID NO: 9223 - DNA, 18 bp, synthetic construct
  source 1..18: mol_type = other DNA
aaatacgtttcactatag

SEQ ID NO: 9224 - DNA, 18 bp, synthetic construct
  source 1..18: mol_type = other DNA
taatactattctctatag

SEQ ID NO: 9225 - DNA, 18 bp, synthetic construct
  source 1..18: mol_type = other DNA
tattacgactctccatag

SEQ ID NO: 9226 - DNA, 18 bp, synthetic construct
  source 1..18: mol_type = other DNA
tatttcgactaactatag

SEQ ID NO: 9227 - DNA, 18 bp, synthetic construct
  source 1..18: mol_type = other DNA
taataagacacacaatag

SEQ ID NO: 9228 - DNA, 18 bp, synthetic construct
  source 1..18: mol_type = other DNA
taataccactcacttttg

SEQ ID NO: 9229 - DNA, 18 bp, synthetic construct
  source 1..18: mol_type = other DNA
aaatacggctcattatag

SEQ ID NO: 9230 - DNA, 18 bp, synthetic construct
  source 1..18: mol_type = other DNA
caatacgacatactatag

SEQ ID NO: 9231 - DNA, 18 bp, synthetic construct
  source 1..18: mol_type = other DNA
caatacgactctctctag

SEQ ID NO: 9232 - DNA, 18 bp, synthetic construct
  source 1..18: mol_type = other DNA
caattcgactcagtatag

SEQ ID NO: 9233 - DNA, 18 bp, synthetic construct
  source 1..18: mol_type = other DNA
gtttacgactcactatag

SEQ ID NO: 9234 - DNA, 18 bp, synthetic construct
  source 1..18: mol_type = other DNA
taacacctctcactatag

SEQ ID NO: 9235 - DNA, 18 bp, synthetic construct
  source 1..18: mol_type = other DNA
taacacgactaacaatag

SEQ ID NO: 9236 - DNA, 18 bp, synthetic construct
  source 1..18: mol_type = other DNA
taactcaactcactatag

SEQ ID NO: 9237 - DNA, 18 bp, synthetic construct
  source 1..18: mol_type = other DNA
taataagattcactacag

SEQ ID NO: 9238 - DNA, 18 bp, synthetic construct
  source 1..18: mol_type = other DNA
taatacaactctctgtag

SEQ ID NO: 9239 - DNA, 18 bp, synthetic construct
  source 1..18: mol_type = other DNA
taatacacctcactttag

SEQ ID NO: 9240 - DNA, 18 bp, synthetic construct
  source 1..18: mol_type = other DNA
taatacgactcaatttgg

SEQ ID NO: 9241 - DNA, 18 bp, synthetic construct
  source 1..18: mol_type = other DNA
taatacgagtcaccattg

SEQ ID NO: 9242 - DNA, 18 bp, synthetic construct
  source 1..18: mol_type = other DNA
taatacgatcctctatag

SEQ ID NO: 9243 - DNA, 18 bp, synthetic construct
  source 1..18: mol_type = other DNA
taatacgatttaccatag

SEQ ID NO: 9244 - DNA, 18 bp, synthetic construct
  source 1..18: mol_type = other DNA
taatacttctcactagag

SEQ ID NO: 9245 - DNA, 18 bp, synthetic construct
  source 1..18: mol_type = other DNA
taattcgaaccactatag

SEQ ID NO: 9246 - DNA, 18 bp, synthetic construct
  source 1..18: mol_type = other DNA
taattcgccacactatag

SEQ ID NO: 9247 - DNA, 18 bp, synthetic construct
  source 1..18: mol_type = other DNA
tactacaactcactaaag

SEQ ID NO: 9248 - DNA, 18 bp, synthetic construct
  source 1..18: mol_type = other DNA
tattacagctcactatag

SEQ ID NO: 9249 - DNA, 18 bp, synthetic construct
  source 1..18: mol_type = other DNA
tattacgtctcactagag

SEQ ID NO: 9250 - DNA, 18 bp, synthetic construct
  source 1..18: mol_type = other DNA
tcacacgattcactatag

SEQ ID NO: 9251 - DNA, 18 bp, synthetic construct
  source 1..18: mol_type = other DNA
tcatacgacacactagag

SEQ ID NO: 9252 - DNA, 18 bp, synthetic construct
  source 1..18: mol_type = other DNA
tcatacgactcactcaag

SEQ ID NO: 9253 - DNA, 18 bp, synthetic construct
  source 1..18: mol_type = other DNA
ttatacgagtcgctatag

SEQ ID NO: 9254 - DNA, 18 bp, synthetic construct
  source 1..18: mol_type = other DNA
ttatacgatccactatag

SEQ ID NO: 9255 - DNA, 18 bp, synthetic construct
  source 1..18: mol_type = other DNA
ttatacggctaactatag

SEQ ID NO: 9256 - DNA, 18 bp, synthetic construct
  source 1..18: mol_type = other DNA
aaatacgtctcacaatag

SEQ ID NO: 9257 - DNA, 18 bp, synthetic construct
  source 1..18: mol_type = other DNA
taatacgattctttatag

SEQ ID NO: 9258 - DNA, 18 bp, synthetic construct
  source 1..18: mol_type = other DNA
aaatacgactatctatag

SEQ ID NO: 9259 - DNA, 18 bp, synthetic construct
  source 1..18: mol_type = other DNA
taaaaagaatcactatag

SEQ ID NO: 9260 - DNA, 18 bp, synthetic construct
  source 1..18: mol_type = other DNA
taatacgattaactttag

SEQ ID NO: 9261 - DNA, 18 bp, synthetic construct
  source 1..18: mol_type = other DNA
tgatacgtcttactatag

SEQ ID NO: 9262 - DNA, 18 bp, synthetic construct
  source 1..18: mol_type = other DNA
taatacgactaacaattg

SEQ ID NO: 9263 - DNA, 18 bp, synthetic construct
  source 1..18: mol_type = other DNA
tattacgtctaactatag

SEQ ID NO: 9264 - DNA, 18 bp, synthetic construct
  source 1..18: mol_type = other DNA
ttatacgaatcattatag

SEQ ID NO: 9265 - DNA, 18 bp, synthetic construct
  source 1..18: mol_type = other DNA
ttatacgcctctctatag

SEQ ID NO: 9266 - DNA, 18 bp, synthetic construct
  source 1..18: mol_type = other DNA
atatacgactaactatag

SEQ ID NO: 9267 - DNA, 18 bp, synthetic construct
  source 1..18: mol_type = other DNA
taatacaactcaataaag

SEQ ID NO: 9268 - DNA, 18 bp, synthetic construct
  source 1..18: mol_type = other DNA
taattcgtcttactatag

SEQ ID NO: 9269 - DNA, 18 bp, synthetic construct
  source 1..18: mol_type = other DNA
aaatacttctcactatag

SEQ ID NO: 9270 - DNA, 18 bp, synthetic construct
  source 1..18: mol_type = other DNA
taatacgactcaataatg

SEQ ID NO: 9271 - DNA, 18 bp, synthetic construct
  source 1..18: mol_type = other DNA
taattcgtctcattatag

SEQ ID NO: 9272 - DNA, 18 bp, synthetic construct
  source 1..18: mol_type = other DNA
tattccgactcactttag

SEQ ID NO: 9273 - DNA, 18 bp, synthetic construct
  source 1..18: mol_type = other DNA
taataagacatactatag

SEQ ID NO: 9274 - DNA, 18 bp, synthetic construct
  source 1..18: mol_type = other DNA
aaacacgactcacaatag

SEQ ID NO: 9275 - DNA, 18 bp, synthetic construct
  source 1..18: mol_type = other DNA
taatacgactcattttcg

SEQ ID NO: 9276 - DNA, 18 bp, synthetic construct
  source 1..18: mol_type = other DNA
taatacgccatactatag

SEQ ID NO: 9277 - DNA, 18 bp, synthetic construct
  source 1..18: mol_type = other DNA
taatacgtataactatag

SEQ ID NO: 9278 - DNA, 18 bp, synthetic construct
  source 1..18: mol_type = other DNA
taatacgtctcattctag

SEQ ID NO: 9279 - DNA, 18 bp, synthetic construct
  source 1..18: mol_type = other DNA
taatttaactcactatag

SEQ ID NO: 9280 - DNA, 18 bp, synthetic construct
  source 1..18: mol_type = other DNA
tactatgactcactattg

SEQ ID NO: 9281 - DNA, 18 bp, synthetic construct
  source 1..18: mol_type = other DNA
tactatgactcactttag

SEQ ID NO: 9282 - DNA, 18 bp, synthetic construct
  source 1..18: mol_type = other DNA
tattaccattcactatag

SEQ ID NO: 9283 - DNA, 18 bp, synthetic construct
  source 1..18: mol_type = other DNA
tatttcgactcactatgg

SEQ ID NO: 9284 - DNA, 18 bp, synthetic construct
  source 1..18: mol_type = other DNA
ttatacggctcacaatag

SEQ ID NO: 9285 - DNA, 18 bp, synthetic construct
  source 1..18: mol_type = other DNA
ttatatgactcagtatag

SEQ ID NO: 9286 - DNA, 18 bp, synthetic construct
  source 1..18: mol_type = other DNA
aaatacgactcagtaaag

SEQ ID NO: 9287 - DNA, 18 bp, synthetic construct
  source 1..18: mol_type = other DNA
aattacgactccctatag

SEQ ID NO: 9288 - DNA, 18 bp, synthetic construct
  source 1..18: mol_type = other DNA
taaaactactcactctag

SEQ ID NO: 9289 - DNA, 18 bp, synthetic construct
  source 1..18: mol_type = other DNA
taactcgactcactgtag

SEQ ID NO: 9290 - DNA, 18 bp, synthetic construct
  source 1..18: mol_type = other DNA
taataagacacactacag

SEQ ID NO: 9291 - DNA, 18 bp, synthetic construct
  source 1..18: mol_type = other DNA
taataaggctcactaaag

SEQ ID NO: 9292 - DNA, 18 bp, synthetic construct
  source 1..18: mol_type = other DNA
taatacaactctctatgg

SEQ ID NO: 9293 - DNA, 18 bp, synthetic construct
  source 1..18: mol_type = other DNA
taataccactccctttag

SEQ ID NO: 9294 - DNA, 18 bp, synthetic construct
  source 1..18: mol_type = other DNA
taatacgactcattcaag

SEQ ID NO: 9295 - DNA, 18 bp, synthetic construct
  source 1..18: mol_type = other DNA
taatacgatacagtatag

SEQ ID NO: 9296 - DNA, 18 bp, synthetic construct
  source 1..18: mol_type = other DNA
taatacggtacactatag

SEQ ID NO: 9297 - DNA, 18 bp, synthetic construct
  source 1..18: mol_type = other DNA
taataggactctatatag

SEQ ID NO: 9298 - DNA, 18 bp, synthetic construct
  source 1..18: mol_type = other DNA
tagtacaactcaatatag

SEQ ID NO: 9299 - DNA, 18 bp, synthetic construct
  source 1..18: mol_type = other DNA
tattaagactccctatag

SEQ ID NO: 9300 - DNA, 18 bp, synthetic construct
  source 1..18: mol_type = other DNA
tattacgaatcactgtag

SEQ ID NO: 9301 - DNA, 18 bp, synthetic construct
  source 1..18: mol_type = other DNA
tcatacgaatcactaaag

SEQ ID NO: 9302 - DNA, 18 bp, synthetic construct
  source 1..18: mol_type = other DNA
tgatacgacaaactatag

SEQ ID NO: 9303 - DNA, 18 bp, synthetic construct
  source 1..18: mol_type = other DNA
ttctatgactcactatag

SEQ ID NO: 9304 - DNA, 18 bp, synthetic construct
  source 1..18: mol_type = other DNA
aaagacgactcacaatag

SEQ ID NO: 9305 - DNA, 18 bp, synthetic construct
  source 1..18: mol_type = other DNA
aaatacgacttactgtag

SEQ ID NO: 9306 - DNA, 18 bp, synthetic construct
  source 1..18: mol_type = other DNA
aaatacggcttactatag

SEQ ID NO: 9307 - DNA, 18 bp, synthetic construct
  source 1..18: mol_type = other DNA
caaaacgactgactatag

SEQ ID NO: 9308 - DNA, 18 bp, synthetic construct
  source 1..18: mol_type = other DNA
caataagactcactaaag

SEQ ID NO: 9309 - DNA, 18 bp, synthetic construct
  source 1..18: mol_type = other DNA
caataccactcactaaag

SEQ ID NO: 9310 - DNA, 18 bp, synthetic construct
  source 1..18: mol_type = other DNA
caatagggctcactatag

SEQ ID NO: 9311 - DNA, 18 bp, synthetic construct
  source 1..18: mol_type = other DNA
ccataagactcactatag

SEQ ID NO: 9312 - DNA, 18 bp, synthetic construct
  source 1..18: mol_type = other DNA
gaaaacgactcactaaag

SEQ ID NO: 9313 - DNA, 18 bp, synthetic construct
  source 1..18: mol_type = other DNA
gaatacgactctctaaag

SEQ ID NO: 9314 - DNA, 18 bp, synthetic construct
  source 1..18: mol_type = other DNA
taaaacgacgcactctag

SEQ ID NO: 9315 - DNA, 18 bp, synthetic construct
  source 1..18: mol_type = other DNA
taacacgattcactctag

SEQ ID NO: 9316 - DNA, 18 bp, synthetic construct
  source 1..18: mol_type = other DNA
taacacgtctcactagag

SEQ ID NO: 9317 - DNA, 18 bp, synthetic construct
  source 1..18: mol_type = other DNA
taagatgacacactatag

SEQ ID NO: 9318 - DNA, 18 bp, synthetic construct
  source 1..18: mol_type = other DNA
taataagactccctagag

SEQ ID NO: 9319 - DNA, 18 bp, synthetic construct
  source 1..18: mol_type = other DNA
taataagactcgcaatag

SEQ ID NO: 9320 - DNA, 18 bp, synthetic construct
  source 1..18: mol_type = other DNA
taatacaactaaccatag

SEQ ID NO: 9321 - DNA, 18 bp, synthetic construct
  source 1..18: mol_type = other DNA
taatacaattcactatgg

SEQ ID NO: 9322 - DNA, 18 bp, synthetic construct
  source 1..18: mol_type = other DNA
taatacaccacactatag

SEQ ID NO: 9323 - DNA, 18 bp, synthetic construct
  source 1..18: mol_type = other DNA
taatacagctccctatag

SEQ ID NO: 9324 - DNA, 18 bp, synthetic construct
  source 1..18: mol_type = other DNA
taataccaccaactatag

SEQ ID NO: 9325 - DNA, 18 bp, synthetic construct
  source 1..18: mol_type = other DNA
taatacgacacactctgg

SEQ ID NO: 9326 - DNA, 18 bp, synthetic construct
  source 1..18: mol_type = other DNA
taatacgactcattaccg

SEQ ID NO: 9327 - DNA, 18 bp, synthetic construct
  source 1..18: mol_type = other DNA
taatacgactgaataaag

SEQ ID NO: 9328 - DNA, 18 bp, synthetic construct
  source 1..18: mol_type = other DNA
taatacggctgactaaag

SEQ ID NO: 9329 - DNA, 18 bp, synthetic construct
  source 1..18: mol_type = other DNA
taatacgtctcactaggg

SEQ ID NO: 9330 - DNA, 18 bp, synthetic construct
  source 1..18: mol_type = other DNA
taatactacgctctatag

SEQ ID NO: 9331 - DNA, 18 bp, synthetic construct
  source 1..18: mol_type = other DNA
taatactactcgctctag

SEQ ID NO: 9332 - DNA, 18 bp, synthetic construct
  source 1..18: mol_type = other DNA
taatactattcactatgg

SEQ ID NO: 9333 - DNA, 18 bp, synthetic construct
  source 1..18: mol_type = other DNA
taatatgactcagtatgg

SEQ ID NO: 9334 - DNA, 18 bp, synthetic construct
  source 1..18: mol_type = other DNA
taatatgcctcagtatag

SEQ ID NO: 9335 - DNA, 18 bp, synthetic construct
  source 1..18: mol_type = other DNA
taatatgccttactatag

SEQ ID NO: 9336 - DNA, 18 bp, synthetic construct
  source 1..18: mol_type = other DNA
taatcagactcaccatag

SEQ ID NO: 9337 - DNA, 18 bp, synthetic construct
  source 1..18: mol_type = other DNA
taatccgactcacttcag

SEQ ID NO: 9338 - DNA, 18 bp, synthetic construct
  source 1..18: mol_type = other DNA
taatccgattgactatag

SEQ ID NO: 9339 - DNA, 18 bp, synthetic construct
  source 1..18: mol_type = other DNA
taatgctactccctatag

SEQ ID NO: 9340 - DNA, 18 bp, synthetic construct
  source 1..18: mol_type = other DNA
taattcgacccactatcg

SEQ ID NO: 9341 - DNA, 18 bp, synthetic construct
  source 1..18: mol_type = other DNA
taattcgagtcactatcg

SEQ ID NO: 9342 - DNA, 18 bp, synthetic construct
  source 1..18: mol_type = other DNA
taattcgtcgcactatag

SEQ ID NO: 9343 - DNA, 18 bp, synthetic construct
  source 1..18: mol_type = other DNA
tactacaactcactacag

SEQ ID NO: 9344 - DNA, 18 bp, synthetic construct
  source 1..18: mol_type = other DNA
tactacgacacgctatag

SEQ ID NO: 9345 - DNA, 18 bp, synthetic construct
  source 1..18: mol_type = other DNA
tactacggcttactatag

SEQ ID NO: 9346 - DNA, 18 bp, synthetic construct
  source 1..18: mol_type = other DNA
tagtaagacacactatag

SEQ ID NO: 9347 - DNA, 18 bp, synthetic construct
  source 1..18: mol_type = other DNA
tagtaagactcactattg

SEQ ID NO: 9348 - DNA, 18 bp, synthetic construct
  source 1..18: mol_type = other DNA
tagtaccactcgctatag

SEQ ID NO: 9349 - DNA, 18 bp, synthetic construct
  source 1..18: mol_type = other DNA
tagtacgaataactatag

SEQ ID NO: 9350 - DNA, 18 bp, synthetic construct
  source 1..18: mol_type = other DNA
tagtactaatcactatag

SEQ ID NO: 9351 - DNA, 18 bp, synthetic construct
  source 1..18: mol_type = other DNA
tattacaactgactatag

SEQ ID NO: 9352 - DNA, 18 bp, synthetic construct
  source 1..18: mol_type = other DNA
tattacgaatcacgatag

SEQ ID NO: 9353 - DNA, 18 bp, synthetic construct
  source 1..18: mol_type = other DNA
tcatacgactaactctag

SEQ ID NO: 9354 - DNA, 18 bp, synthetic construct
  source 1..18: mol_type = other DNA
tcatacgactcgcaatag

SEQ ID NO: 9355 - DNA, 18 bp, synthetic construct
  source 1..18: mol_type = other DNA
tcatatgactcaccatag

SEQ ID NO: 9356 - DNA, 18 bp, synthetic construct
  source 1..18: mol_type = other DNA
tgagacgactcacaatag

SEQ ID NO: 9357 - DNA, 18 bp, synthetic construct
  source 1..18: mol_type = other DNA
tgatacgactcaccacag

SEQ ID NO: 9358 - DNA, 18 bp, synthetic construct
  source 1..18: mol_type = other DNA
tgatacggctcaccatag

SEQ ID NO: 9359 - DNA, 18 bp, synthetic construct
  source 1..18: mol_type = other DNA
ttatacgacccactatcg

SEQ ID NO: 9360 - DNA, 18 bp, synthetic construct
  source 1..18: mol_type = other DNA
ttatacgacgcgctatag

SEQ ID NO: 9361 - DNA, 18 bp, synthetic construct
  source 1..18: mol_type = other DNA
ttatacgtctaactatag

SEQ ID NO: 9362 - DNA, 18 bp, synthetic construct
  source 1..18: mol_type = other DNA
aaaaacgactctctatag

SEQ ID NO: 9363 - DNA, 18 bp, synthetic construct
  source 1..18: mol_type = other DNA
aaatactattcactatag

SEQ ID NO: 9364 - DNA, 18 bp, synthetic construct
  source 1..18: mol_type = other DNA
taataagattcactttag

SEQ ID NO: 9365 - DNA, 18 bp, synthetic construct
  source 1..18: mol_type = other DNA
taatacgactctccattg

SEQ ID NO: 9366 - DNA, 18 bp, synthetic construct
  source 1..18: mol_type = other DNA
taatacgtctcatcatag

SEQ ID NO: 9367 - DNA, 18 bp, synthetic construct
  source 1..18: mol_type = other DNA
tcatacgacttactattg

SEQ ID NO: 9368 - DNA, 18 bp, synthetic construct
  source 1..18: mol_type = other DNA
taaaatgtctcactatag

SEQ ID NO: 9369 - DNA, 18 bp, synthetic construct
  source 1..18: mol_type = other DNA
taatacaactcattaaag

SEQ ID NO: 9370 - DNA, 18 bp, synthetic construct
  source 1..18: mol_type = other DNA
tattacgacatactatag

SEQ ID NO: 9371 - DNA, 18 bp, synthetic construct
  source 1..18: mol_type = other DNA
taactcgactcacaatag

SEQ ID NO: 9372 - DNA, 18 bp, synthetic construct
  source 1..18: mol_type = other DNA
taatcccactcactaaag

SEQ ID NO: 9373 - DNA, 18 bp, synthetic construct
  source 1..18: mol_type = other DNA
tcatacgactctcaatag

SEQ ID NO: 9374 - DNA, 18 bp, synthetic construct
  source 1..18: mol_type = other DNA
tgtaacgactcactatag

SEQ ID NO: 9375 - DNA, 18 bp, synthetic construct
  source 1..18: mol_type = other DNA
tattacgattcactttag

SEQ ID NO: 9376 - DNA, 18 bp, synthetic construct
  source 1..18: mol_type = other DNA
taatacaactcacattag

SEQ ID NO: 9377 - DNA, 18 bp, synthetic construct
  source 1..18: mol_type = other DNA
taatacgactctcactag

SEQ ID NO: 9378 - DNA, 18 bp, synthetic construct
  source 1..18: mol_type = other DNA
tattacgtctcagtatag

SEQ ID NO: 9379 - DNA, 18 bp, synthetic construct
  source 1..18: mol_type = other DNA
ttatacgacacactacag

SEQ ID NO: 9380 - DNA, 18 bp, synthetic construct
  source 1..18: mol_type = other DNA
caatacgtctcaccatag

SEQ ID NO: 9381 - DNA, 18 bp, synthetic construct
  source 1..18: mol_type = other DNA
caatacgtgtcactatag

SEQ ID NO: 9382 - DNA, 18 bp, synthetic construct
  source 1..18: mol_type = other DNA
taaaacgtctgactatag

SEQ ID NO: 9383 - DNA, 18 bp, synthetic construct
  source 1..18: mol_type = other DNA
taacacgtctaactatag

SEQ ID NO: 9384 - DNA, 18 bp, synthetic construct
  source 1..18: mol_type = other DNA
taataagattaactatag

SEQ ID NO: 9385 - DNA, 18 bp, synthetic construct
  source 1..18: mol_type = other DNA
taatacgattcactaacg

SEQ ID NO: 9386 - DNA, 18 bp, synthetic construct
  source 1..18: mol_type = other DNA
taataggacactctatag

SEQ ID NO: 9387 - DNA, 18 bp, synthetic construct
  source 1..18: mol_type = other DNA
taattcgtctccctatag

SEQ ID NO: 9388 - DNA, 18 bp, synthetic construct
  source 1..18: mol_type = other DNA
taatttcactcactatag

SEQ ID NO: 9389 - DNA, 18 bp, synthetic construct
  source 1..18: mol_type = other DNA
tagtacgacttactattg

SEQ ID NO: 9390 - DNA, 18 bp, synthetic construct
  source 1..18: mol_type = other DNA
tattaagacccactatag

SEQ ID NO: 9391 - DNA, 18 bp, synthetic construct
  source 1..18: mol_type = other DNA
tcacacgtctcactatag

SEQ ID NO: 9392 - DNA, 18 bp, synthetic construct
  source 1..18: mol_type = other DNA
tgaaacgaatcactatag

SEQ ID NO: 9393 - DNA, 18 bp, synthetic construct
  source 1..18: mol_type = other DNA
tgatacgactaactttag

SEQ ID NO: 9394 - DNA, 18 bp, synthetic construct
  source 1..18: mol_type = other DNA
tgattcaactcactatag

SEQ ID NO: 9395 - DNA, 18 bp, synthetic construct
  source 1..18: mol_type = other DNA
taatacatctcactttag

SEQ ID NO: 9396 - DNA, 18 bp, synthetic construct
  source 1..18: mol_type = other DNA
taatactactcacttcag

SEQ ID NO: 9397 - DNA, 18 bp, synthetic construct
  source 1..18: mol_type = other DNA
aattacgattcactatag

SEQ ID NO: 9398 - DNA, 18 bp, synthetic construct
  source 1..18: mol_type = other DNA
taaaacgactcagtattg

SEQ ID NO: 9399 - DNA, 18 bp, synthetic construct
  source 1..18: mol_type = other DNA
taacacgactaactttag

SEQ ID NO: 9400 - DNA, 18 bp, synthetic construct
  source 1..18: mol_type = other DNA
taatacgagtctcaatag

SEQ ID NO: 9401 - DNA, 18 bp, synthetic construct
  source 1..18: mol_type = other DNA
taattcgactcattatcg

SEQ ID NO: 9402 - DNA, 18 bp, synthetic construct
  source 1..18: mol_type = other DNA
tatcactactcactatag

SEQ ID NO: 9403 - DNA, 18 bp, synthetic construct
  source 1..18: mol_type = other DNA
tcaaacgactcacaatag

SEQ ID NO: 9404 - DNA, 18 bp, synthetic construct
  source 1..18: mol_type = other DNA
tgatacgacacactattg

SEQ ID NO: 9405 - DNA, 18 bp, synthetic construct
  source 1..18: mol_type = other DNA
ttatacgactcattgtag

SEQ ID NO: 9406 - DNA, 18 bp, synthetic construct
  source 1..18: mol_type = other DNA
ttatactactcactttag

SEQ ID NO: 9407 - DNA, 18 bp, synthetic construct
  source 1..18: mol_type = other DNA
taattcgactctctttag

SEQ ID NO: 9408 - DNA, 18 bp, synthetic construct
  source 1..18: mol_type = other DNA
aaataagacacactatag

SEQ ID NO: 9409 - DNA, 18 bp, synthetic construct
  source 1..18: mol_type = other DNA
taatacgacacaccattg

SEQ ID NO: 9410 - DNA, 18 bp, synthetic construct
  source 1..18: mol_type = other DNA
taatacgattcacttcag

SEQ ID NO: 9411 - DNA, 18 bp, synthetic construct
  source 1..18: mol_type = other DNA
tcataagactcactttag

SEQ ID NO: 9412 - DNA, 18 bp, synthetic construct
  source 1..18: mol_type = other DNA
ttatatgtctcactatag

SEQ ID NO: 9413 - DNA, 18 bp, synthetic construct
  source 1..18: mol_type = other DNA
aaatatgactcactttag

SEQ ID NO: 9414 - DNA, 18 bp, synthetic construct
  source 1..18: mol_type = other DNA
tattacgattaactatag

SEQ ID NO: 9415 - DNA, 18 bp, synthetic construct
  source 1..18: mol_type = other DNA
taatacgacacacttttg

SEQ ID NO: 9416 - DNA, 18 bp, synthetic construct
  source 1..18: mol_type = other DNA
tattacaactctctatag

SEQ ID NO: 9417 - DNA, 18 bp, synthetic construct
  source 1..18: mol_type = other DNA
taatacaactcacaaaag

SEQ ID NO: 9418 - DNA, 18 bp, synthetic construct
  source 1..18: mol_type = other DNA
aaatacgactcataatag

SEQ ID NO: 9419 - DNA, 18 bp, synthetic construct
  source 1..18: mol_type = other DNA
tattatgactcactaaag

SEQ ID NO: 9420 - DNA, 18 bp, synthetic construct
  source 1..18: mol_type = other DNA
taatacgactcaatgttg

SEQ ID NO: 9421 - DNA, 18 bp, synthetic construct
  source 1..18: mol_type = other DNA
taatatgactcaatctag

SEQ ID NO: 9422 - DNA, 18 bp, synthetic construct
  source 1..18: mol_type = other DNA
tagttcaactcactatag

SEQ ID NO: 9423 - DNA, 18 bp, synthetic construct
  source 1..18: mol_type = other DNA
tattactactcactacag

SEQ ID NO: 9424 - DNA, 18 bp, synthetic construct
  source 1..18: mol_type = other DNA
taacacgtcttactatag

SEQ ID NO: 9425 - DNA, 18 bp, synthetic construct
  source 1..18: mol_type = other DNA
taatacgtctcacagtag

SEQ ID NO: 9426 - DNA, 18 bp, synthetic construct
  source 1..18: mol_type = other DNA
taatacgtctcaccttag

SEQ ID NO: 9427 - DNA, 18 bp, synthetic construct
  source 1..18: mol_type = other DNA
taatacttctcaatatag

SEQ ID NO: 9428 - DNA, 18 bp, synthetic construct
  source 1..18: mol_type = other DNA
aatcacgactcactatag

SEQ ID NO: 9429 - DNA, 18 bp, synthetic construct
  source 1..18: mol_type = other DNA
caatacgacacattatag

SEQ ID NO: 9430 - DNA, 18 bp, synthetic construct
  source 1..18: mol_type = other DNA
taaaacgacacactatcg

SEQ ID NO: 9431 - DNA, 18 bp, synthetic construct
  source 1..18: mol_type = other DNA
taaaacgtctcactatgg

SEQ ID NO: 9432 - DNA, 18 bp, synthetic construct
  source 1..18: mol_type = other DNA
taaaaggaatcactatag

SEQ ID NO: 9433 - DNA, 18 bp, synthetic construct
  source 1..18: mol_type = other DNA
taactcgacttactatag

SEQ ID NO: 9434 - DNA, 18 bp, synthetic construct
  source 1..18: mol_type = other DNA
taatacaacttactgtag

SEQ ID NO: 9435 - DNA, 18 bp, synthetic construct
  source 1..18: mol_type = other DNA
taatacgacacacgaaag

SEQ ID NO: 9436 - DNA, 18 bp, synthetic construct
  source 1..18: mol_type = other DNA
taatacgactatctacag

SEQ ID NO: 9437 - DNA, 18 bp, synthetic construct
  source 1..18: mol_type = other DNA
taatacgactcctaatag

SEQ ID NO: 9438 - DNA, 18 bp, synthetic construct
  source 1..18: mol_type = other DNA
taatacgattcaatctag

SEQ ID NO: 9439 - DNA, 18 bp, synthetic construct
  source 1..18: mol_type = other DNA
taatacgtctcacttgag

SEQ ID NO: 9440 - DNA, 18 bp, synthetic construct
  source 1..18: mol_type = other DNA
taatactcctctctatag

SEQ ID NO: 9441 - DNA, 18 bp, synthetic construct
  source 1..18: mol_type = other DNA
taatcctactaactatag

SEQ ID NO: 9442 - DNA, 18 bp, synthetic construct
  source 1..18: mol_type = other DNA
taatgctactcactatcg

SEQ ID NO: 9443 - DNA, 18 bp, synthetic construct
  source 1..18: mol_type = other DNA
taattcagctcactatag

SEQ ID NO: 9444 - DNA, 18 bp, synthetic construct
  source 1..18: mol_type = other DNA
taattcgagtcacaatag

SEQ ID NO: 9445 - DNA, 18 bp, synthetic construct
  source 1..18: mol_type = other DNA
tacaacgactcactaaag

SEQ ID NO: 9446 - DNA, 18 bp, synthetic construct
  source 1..18: mol_type = other DNA
tcttacgcctcactatag

SEQ ID NO: 9447 - DNA, 18 bp, synthetic construct
  source 1..18: mol_type = other DNA
aaaaacgagtcactatag

SEQ ID NO: 9448 - DNA, 18 bp, synthetic construct
  source 1..18: mol_type = other DNA
aaagacgactctctatag

SEQ ID NO: 9449 - DNA, 18 bp, synthetic construct
  source 1..18: mol_type = other DNA
aaataaggctcactatag

SEQ ID NO: 9450 - DNA, 18 bp, synthetic construct
  source 1..18: mol_type = other DNA
aaatacgactcacttgag

SEQ ID NO: 9451 - DNA, 18 bp, synthetic construct
  source 1..18: mol_type = other DNA
caacacgaatcactatag

SEQ ID NO: 9452 - DNA, 18 bp, synthetic construct
  source 1..18: mol_type = other DNA
caatacgtctcactctag

SEQ ID NO: 9453 - DNA, 18 bp, synthetic construct
  source 1..18: mol_type = other DNA
caatagtactcactatag

SEQ ID NO: 9454 - DNA, 18 bp, synthetic construct
  source 1..18: mol_type = other DNA
caatatgactcactaaag

SEQ ID NO: 9455 - DNA, 18 bp, synthetic construct
  source 1..18: mol_type = other DNA
cactacgactccctatag

SEQ ID NO: 9456 - DNA, 18 bp, synthetic construct
  source 1..18: mol_type = other DNA
taaaacgagtcgctatag

SEQ ID NO: 9457 - DNA, 18 bp, synthetic construct
  source 1..18: mol_type = other DNA
taaaaggactcattatag

SEQ ID NO: 9458 - DNA, 18 bp, synthetic construct
  source 1..18: mol_type = other DNA
taaaccgacgcactatag

SEQ ID NO: 9459 - DNA, 18 bp, synthetic construct
  source 1..18: mol_type = other DNA
taaaccgactaactatag

SEQ ID NO: 9460 - DNA, 18 bp, synthetic construct
  source 1..18: mol_type = other DNA
taacacgactgactgtag

SEQ ID NO: 9461 - DNA, 18 bp, synthetic construct
  source 1..18: mol_type = other DNA
taagacaactcactatcg

SEQ ID NO: 9462 - DNA, 18 bp, synthetic construct
  source 1..18: mol_type = other DNA
taagacgattcattatag

SEQ ID NO: 9463 - DNA, 18 bp, synthetic construct
  source 1..18: mol_type = other DNA
taagacggcacactatag

SEQ ID NO: 9464 - DNA, 18 bp, synthetic construct
  source 1..18: mol_type = other DNA
taagacgtctcactatgg

SEQ ID NO: 9465 - DNA, 18 bp, synthetic construct
  source 1..18: mol_type = other DNA
taagactactcacaatag

SEQ ID NO: 9466 - DNA, 18 bp, synthetic construct
  source 1..18: mol_type = other DNA
taataacactcacaatag

SEQ ID NO: 9467 - DNA, 18 bp, synthetic construct
  source 1..18: mol_type = other DNA
taatacaactcattatgg

SEQ ID NO: 9468 - DNA, 18 bp, synthetic construct
  source 1..18: mol_type = other DNA
taatacagctcactatgg

SEQ ID NO: 9469 - DNA, 18 bp, synthetic construct
  source 1..18: mol_type = other DNA
taataccactcaccacag

SEQ ID NO: 9470 - DNA, 18 bp, synthetic construct
  source 1..18: mol_type = other DNA
taatacgaaacgctatag

SEQ ID NO: 9471 - DNA, 18 bp, synthetic construct
  source 1..18: mol_type = other DNA
taatacgaccctctgtag

SEQ ID NO: 9472 - DNA, 18 bp, synthetic construct
  source 1..18: mol_type = other DNA
taatacgactcacaagcg

SEQ ID NO: 9473 - DNA, 18 bp, synthetic construct
  source 1..18: mol_type = other DNA
taatacgactcacagcag

SEQ ID NO: 9474 - DNA, 18 bp, synthetic construct
  source 1..18: mol_type = other DNA
taatacgactcatgttag

SEQ ID NO: 9475 - DNA, 18 bp, synthetic construct
  source 1..18: mol_type = other DNA
taatacgacttatcatag

SEQ ID NO: 9476 - DNA, 18 bp, synthetic construct
  source 1..18: mol_type = other DNA
taatacgagtaaatatag

SEQ ID NO: 9477 - DNA, 18 bp, synthetic construct
  source 1..18: mol_type = other DNA
taatacgatacactatcg

SEQ ID NO: 9478 - DNA, 18 bp, synthetic construct
  source 1..18: mol_type = other DNA
taatacggatcacaatag

SEQ ID NO: 9479 - DNA, 18 bp, synthetic construct
  source 1..18: mol_type = other DNA
taatacgtcccagtatag

SEQ ID NO: 9480 - DNA, 18 bp, synthetic construct
  source 1..18: mol_type = other DNA
taatactacccactatgg

SEQ ID NO: 9481 - DNA, 18 bp, synthetic construct
  source 1..18: mol_type = other DNA
taatactactcacgattg

SEQ ID NO: 9482 - DNA, 18 bp, synthetic construct
  source 1..18: mol_type = other DNA
taatactgctcaccatag

SEQ ID NO: 9483 - DNA, 18 bp, synthetic construct
  source 1..18: mol_type = other DNA
taataggaattactatag

SEQ ID NO: 9484 - DNA, 18 bp, synthetic construct
  source 1..18: mol_type = other DNA
taataggactcaatatcg

SEQ ID NO: 9485 - DNA, 18 bp, synthetic construct
  source 1..18: mol_type = other DNA
taataggagtcactaaag

SEQ ID NO: 9486 - DNA, 18 bp, synthetic construct
  source 1..18: mol_type = other DNA
taatattactcactatcg

SEQ ID NO: 9487 - DNA, 18 bp, synthetic construct
  source 1..18: mol_type = other DNA
taatcccactcactgtag

SEQ ID NO: 9488 - DNA, 18 bp, synthetic construct
  source 1..18: mol_type = other DNA
taatccgagtcactttag

SEQ ID NO: 9489 - DNA, 18 bp, synthetic construct
  source 1..18: mol_type = other DNA
taatgcaattcactatag

SEQ ID NO: 9490 - DNA, 18 bp, synthetic construct
  source 1..18: mol_type = other DNA
taatgcgacccactttag

SEQ ID NO: 9491 - DNA, 18 bp, synthetic construct
  source 1..18: mol_type = other DNA
taatgcgactcacgattg

SEQ ID NO: 9492 - DNA, 18 bp, synthetic construct
  source 1..18: mol_type = other DNA
taatgctaatcactatag

SEQ ID NO: 9493 - DNA, 18 bp, synthetic construct
  source 1..18: mol_type = other DNA
taattcgcctccctatag

SEQ ID NO: 9494 - DNA, 18 bp, synthetic construct
  source 1..18: mol_type = other DNA
tacagcgactcactatag

SEQ ID NO: 9495 - DNA, 18 bp, synthetic construct
  source 1..18: mol_type = other DNA
tactacgacagactatag

SEQ ID NO: 9496 - DNA, 18 bp, synthetic construct
  source 1..18: mol_type = other DNA
tactacgcctcaccatag

SEQ ID NO: 9497 - DNA, 18 bp, synthetic construct
  source 1..18: mol_type = other DNA
tactatgactcacaatag

SEQ ID NO: 9498 - DNA, 18 bp, synthetic construct
  source 1..18: mol_type = other DNA
tacttctactcactatag

SEQ ID NO: 9499 - DNA, 18 bp, synthetic construct
  source 1..18: mol_type = other DNA
tagtacctctcactatag

SEQ ID NO: 9500 - DNA, 18 bp, synthetic construct
  source 1..18: mol_type = other DNA
tagtactactcaccatag

SEQ ID NO: 9501 - DNA, 18 bp, synthetic construct
  source 1..18: mol_type = other DNA
tattgcgactcactatgg

SEQ ID NO: 9502 - DNA, 18 bp, synthetic construct
  source 1..18: mol_type = other DNA
tcataagactcaatatag

SEQ ID NO: 9503 - DNA, 18 bp, synthetic construct
  source 1..18: mol_type = other DNA
tcatacgaatcactacag

SEQ ID NO: 9504 - DNA, 18 bp, synthetic construct
  source 1..18: mol_type = other DNA
tgatactaatcactatag

SEQ ID NO: 9505 - DNA, 18 bp, synthetic construct
  source 1..18: mol_type = other DNA
ttatacgacgcaatatag

SEQ ID NO: 9506 - DNA, 18 bp, synthetic construct
  source 1..18: mol_type = other DNA
ttatacgactgactgtag

SEQ ID NO: 9507 - DNA, 18 bp, synthetic construct
  source 1..18: mol_type = other DNA
taatacgactctctaatg

SEQ ID NO: 9508 - DNA, 18 bp, synthetic construct
  source 1..18: mol_type = other DNA
taatacgattctctttag

SEQ ID NO: 9509 - DNA, 18 bp, synthetic construct
  source 1..18: mol_type = other DNA
tattacgactctctattg

SEQ ID NO: 9510 - DNA, 18 bp, synthetic construct
  source 1..18: mol_type = other DNA
aaatacgactcacttaag

SEQ ID NO: 9511 - DNA, 18 bp, synthetic construct
  source 1..18: mol_type = other DNA
taacacgactctcaatag

SEQ ID NO: 9512 - DNA, 18 bp, synthetic construct
  source 1..18: mol_type = other DNA
taataagtcacactatag

SEQ ID NO: 9513 - DNA, 18 bp, synthetic construct
  source 1..18: mol_type = other DNA
taatacgaaacacaatag

SEQ ID NO: 9514 - DNA, 18 bp, synthetic construct
  source 1..18: mol_type = other DNA
taatacaactcattttag

SEQ ID NO: 9515 - DNA, 18 bp, synthetic construct
  source 1..18: mol_type = other DNA
taatactattcacaatag

SEQ ID NO: 9516 - DNA, 18 bp, synthetic construct
  source 1..18: mol_type = other DNA
ttatacaactcacaatag

SEQ ID NO: 9517 - DNA, 18 bp, synthetic construct
  source 1..18: mol_type = other DNA
ttatacgactaactaaag

SEQ ID NO: 9518 - DNA, 18 bp, synthetic construct
  source 1..18: mol_type = other DNA
aaataggaatcactatag

SEQ ID NO: 9519 - DNA, 18 bp, synthetic construct
  source 1..18: mol_type = other DNA
taacacaactaactatag

SEQ ID NO: 9520 - DNA, 18 bp, synthetic construct
  source 1..18: mol_type = other DNA
taactcgacacactatag

SEQ ID NO: 9521 - DNA, 18 bp, synthetic construct
  source 1..18: mol_type = other DNA
taatacgactaactttcg

SEQ ID NO: 9522 - DNA, 18 bp, synthetic construct
  source 1..18: mol_type = other DNA
taatacgacttactttgg

SEQ ID NO: 9523 - DNA, 18 bp, synthetic construct
  source 1..18: mol_type = other DNA
taatacgattcgctaaag

SEQ ID NO: 9524 - DNA, 18 bp, synthetic construct
  source 1..18: mol_type = other DNA
taatactattcaatatag

SEQ ID NO: 9525 - DNA, 18 bp, synthetic construct
  source 1..18: mol_type = other DNA
taatatgacatactatag

SEQ ID NO: 9526 - DNA, 18 bp, synthetic construct
  source 1..18: mol_type = other DNA
taatgcgacacactaaag

SEQ ID NO: 9527 - DNA, 18 bp, synthetic construct
  source 1..18: mol_type = other DNA
tagtacgtctctctatag

SEQ ID NO: 9528 - DNA, 18 bp, synthetic construct
  source 1..18: mol_type = other DNA
tattaccaatcactatag

SEQ ID NO: 9529 - DNA, 18 bp, synthetic construct
  source 1..18: mol_type = other DNA
tattacgacccactaaag

SEQ ID NO: 9530 - DNA, 18 bp, synthetic construct
  source 1..18: mol_type = other DNA
ttataccacacactatag

SEQ ID NO: 9531 - DNA, 18 bp, synthetic construct
  source 1..18: mol_type = other DNA
tattacgactttctatag

SEQ ID NO: 9532 - DNA, 18 bp, synthetic construct
  source 1..18: mol_type = other DNA
aaatacgactaactattg

SEQ ID NO: 9533 - DNA, 18 bp, synthetic construct
  source 1..18: mol_type = other DNA
aaatacgtctaactatag

SEQ ID NO: 9534 - DNA, 18 bp, synthetic construct
  source 1..18: mol_type = other DNA
taaaacaaatcactatag

SEQ ID NO: 9535 - DNA, 18 bp, synthetic construct
  source 1..18: mol_type = other DNA
taatactacacactacag

SEQ ID NO: 9536 - DNA, 18 bp, synthetic construct
  source 1..18: mol_type = other DNA
tactacgactcacaaaag

SEQ ID NO: 9537 - DNA, 18 bp, synthetic construct
  source 1..18: mol_type = other DNA
aaatacgaatcactctag

SEQ ID NO: 9538 - DNA, 18 bp, synthetic construct
  source 1..18: mol_type = other DNA
taaaaccaatcactatag

SEQ ID NO: 9539 - DNA, 18 bp, synthetic construct
  source 1..18: mol_type = other DNA
taaaacgactgacaatag

SEQ ID NO: 9540 - DNA, 18 bp, synthetic construct
  source 1..18: mol_type = other DNA
taacacgactcaaaatag

SEQ ID NO: 9541 - DNA, 18 bp, synthetic construct
  source 1..18: mol_type = other DNA
taacacgactcattatcg

SEQ ID NO: 9542 - DNA, 18 bp, synthetic construct
  source 1..18: mol_type = other DNA
taatacaacacagtatag

SEQ ID NO: 9543 - DNA, 18 bp, synthetic construct
  source 1..18: mol_type = other DNA
taatacgacacacagtag

SEQ ID NO: 9544 - DNA, 18 bp, synthetic construct
  source 1..18: mol_type = other DNA
taatacgatagactatag

SEQ ID NO: 9545 - DNA, 18 bp, synthetic construct
  source 1..18: mol_type = other DNA
taatacgattgaccatag

SEQ ID NO: 9546 - DNA, 18 bp, synthetic construct
  source 1..18: mol_type = other DNA
taatgcgaatcacaatag

SEQ ID NO: 9547 - DNA, 18 bp, synthetic construct
  source 1..18: mol_type = other DNA
taattcgacccactattg

SEQ ID NO: 9548 - DNA, 18 bp, synthetic construct
  source 1..18: mol_type = other DNA
taattcgtctcagtatag

SEQ ID NO: 9549 - DNA, 18 bp, synthetic construct
  source 1..18: mol_type = other DNA
tactatgattcactatag

SEQ ID NO: 9550 - DNA, 18 bp, synthetic construct
  source 1..18: mol_type = other DNA
tattacgaatcaccatag

SEQ ID NO: 9551 - DNA, 18 bp, synthetic construct
  source 1..18: mol_type = other DNA
tattacgacccactctag

SEQ ID NO: 9552 - DNA, 18 bp, synthetic construct
  source 1..18: mol_type = other DNA
tattacgacctactatag

SEQ ID NO: 9553 - DNA, 18 bp, synthetic construct
  source 1..18: mol_type = other DNA
tcatatgactcgctatag

SEQ ID NO: 9554 - DNA, 18 bp, synthetic construct
  source 1..18: mol_type = other DNA
taatacgacacacaattg

SEQ ID NO: 9555 - DNA, 18 bp, synthetic construct
  source 1..18: mol_type = other DNA
taatacgaatcacattag

SEQ ID NO: 9556 - DNA, 18 bp, synthetic construct
  source 1..18: mol_type = other DNA
aaataatactcactatag

SEQ ID NO: 9557 - DNA, 18 bp, synthetic construct
  source 1..18: mol_type = other DNA
aaatactaatcactatag

SEQ ID NO: 9558 - DNA, 18 bp, synthetic construct
  source 1..18: mol_type = other DNA
taaaacgacacactctag

SEQ ID NO: 9559 - DNA, 18 bp, synthetic construct
  source 1..18: mol_type = other DNA
taatacgactgacttttg

SEQ ID NO: 9560 - DNA, 18 bp, synthetic construct
  source 1..18: mol_type = other DNA
taatacgtctcactagtg

SEQ ID NO: 9561 - DNA, 18 bp, synthetic construct
  source 1..18: mol_type = other DNA
taatttgaatcactatag

SEQ ID NO: 9562 - DNA, 18 bp, synthetic construct
  source 1..18: mol_type = other DNA
tagtacgattcactattg

SEQ ID NO: 9563 - DNA, 18 bp, synthetic construct
  source 1..18: mol_type = other DNA
ttataccactcattatag

SEQ ID NO: 9564 - DNA, 18 bp, synthetic construct
  source 1..18: mol_type = other DNA
ttatacgattcactacag

SEQ ID NO: 9565 - DNA, 18 bp, synthetic construct
  source 1..18: mol_type = other DNA
ttctacgactctctatag

SEQ ID NO: 9566 - DNA, 18 bp, synthetic construct
  source 1..18: mol_type = other DNA
ttatacgactcataatag

SEQ ID NO: 9567 - DNA, 18 bp, synthetic construct
  source 1..18: mol_type = other DNA
taatacgacttacttttg

SEQ ID NO: 9568 - DNA, 18 bp, synthetic construct
  source 1..18: mol_type = other DNA
taaaccgactctctatag

SEQ ID NO: 9569 - DNA, 18 bp, synthetic construct
  source 1..18: mol_type = other DNA
taatacctctcacaatag

SEQ ID NO: 9570 - DNA, 18 bp, synthetic construct
  source 1..18: mol_type = other DNA
taatacgacatactaaag

SEQ ID NO: 9571 - DNA, 18 bp, synthetic construct
  source 1..18: mol_type = other DNA
tgatacatctcactatag

SEQ ID NO: 9572 - DNA, 18 bp, synthetic construct
  source 1..18: mol_type = other DNA
aattactactcactatag

SEQ ID NO: 9573 - DNA, 18 bp, synthetic construct
  source 1..18: mol_type = other DNA
tattacgacttactaaag

SEQ ID NO: 9574 - DNA, 18 bp, synthetic construct
  source 1..18: mol_type = other DNA
taatacaactcacaattg

SEQ ID NO: 9575 - DNA, 18 bp, synthetic construct
  source 1..18: mol_type = other DNA
taatactactctcaatag

SEQ ID NO: 9576 - DNA, 18 bp, synthetic construct
  source 1..18: mol_type = other DNA
ttattcgacacactatag

SEQ ID NO: 9577 - DNA, 18 bp, synthetic construct
  source 1..18: mol_type = other DNA
ttatacgaatcactttag

SEQ ID NO: 9578 - DNA, 18 bp, synthetic construct
  source 1..18: mol_type = other DNA
tattaagattcactatag

SEQ ID NO: 9579 - DNA, 18 bp, synthetic construct
  source 1..18: mol_type = other DNA
ttatacgacacaccatag

SEQ ID NO: 9580 - DNA, 18 bp, synthetic construct
  source 1..18: mol_type = other DNA
taaaacgacacaatatag

SEQ ID NO: 9581 - DNA, 18 bp, synthetic construct
  source 1..18: mol_type = other DNA
taacacgacttactaaag

SEQ ID NO: 9582 - DNA, 18 bp, synthetic construct
  source 1..18: mol_type = other DNA
tattacgtctcactgtag

SEQ ID NO: 9583 - DNA, 18 bp, synthetic construct
  source 1..18: mol_type = other DNA
ttatacgagtcactaaag

SEQ ID NO: 9584 - DNA, 18 bp, synthetic construct
  source 1..18: mol_type = other DNA
ttatacgcctaactatag

SEQ ID NO: 9585 - DNA, 18 bp, synthetic construct
  source 1..18: mol_type = other DNA
taaaaccactcactaaag

SEQ ID NO: 9586 - DNA, 18 bp, synthetic construct
  source 1..18: mol_type = other DNA
taaaacgactcgttatag

SEQ ID NO: 9587 - DNA, 18 bp, synthetic construct
  source 1..18: mol_type = other DNA
taacacgtatcactatag

SEQ ID NO: 9588 - DNA, 18 bp, synthetic construct
  source 1..18: mol_type = other DNA
taatacgaataactatcg

SEQ ID NO: 9589 - DNA, 18 bp, synthetic construct
  source 1..18: mol_type = other DNA
taatacgacccaatttag

SEQ ID NO: 9590 - DNA, 18 bp, synthetic construct
  source 1..18: mol_type = other DNA
taatacgacccattttag

SEQ ID NO: 9591 - DNA, 18 bp, synthetic construct
  source 1..18: mol_type = other DNA
taatacgactaaacatag

SEQ ID NO: 9592 - DNA, 18 bp, synthetic construct
  source 1..18: mol_type = other DNA
taatacgcctctttatag

SEQ ID NO: 9593 - DNA, 18 bp, synthetic construct
  source 1..18: mol_type = other DNA
taatacgtctaactacag

SEQ ID NO: 9594 - DNA, 18 bp, synthetic construct
  source 1..18: mol_type = other DNA
taatactacacgctatag

SEQ ID NO: 9595 - DNA, 18 bp, synthetic construct
  source 1..18: mol_type = other DNA
taatagggctcactattg

SEQ ID NO: 9596 - DNA, 18 bp, synthetic construct
  source 1..18: mol_type = other DNA
taatattaatcactatag

SEQ ID NO: 9597 - DNA, 18 bp, synthetic construct
  source 1..18: mol_type = other DNA
taatccgactcacaattg

SEQ ID NO: 9598 - DNA, 18 bp, synthetic construct
  source 1..18: mol_type = other DNA
taattcgactctctagag

SEQ ID NO: 9599 - DNA, 18 bp, synthetic construct
  source 1..18: mol_type = other DNA
tactacgactcataatag

SEQ ID NO: 9600 - DNA, 18 bp, synthetic construct
  source 1..18: mol_type = other DNA
tagtacgcctcactttag

SEQ ID NO: 9601 - DNA, 18 bp, synthetic construct
  source 1..18: mol_type = other DNA
tagtaggactcactttag

SEQ ID NO: 9602 - DNA, 18 bp, synthetic construct
  source 1..18: mol_type = other DNA
tattacgcctcattatag

SEQ ID NO: 9603 - DNA, 18 bp, synthetic construct
  source 1..18: mol_type = other DNA
tcaagcgactcactatag

SEQ ID NO: 9604 - DNA, 18 bp, synthetic construct
  source 1..18: mol_type = other DNA
tgatacaacttactatag

SEQ ID NO: 9605 - DNA, 18 bp, synthetic construct
  source 1..18: mol_type = other DNA
aaatacggctaactatag

SEQ ID NO: 9606 - DNA, 18 bp, synthetic construct
  source 1..18: mol_type = other DNA
aaatacggctcactaaag

SEQ ID NO: 9607 - DNA, 18 bp, synthetic construct
  source 1..18: mol_type = other DNA
aagtacgacccactatag

SEQ ID NO: 9608 - DNA, 18 bp, synthetic construct
  source 1..18: mol_type = other DNA
caatacgaatcaatatag

SEQ ID NO: 9609 - DNA, 18 bp, synthetic construct
  source 1..18: mol_type = other DNA
caatacgactcattatcg

SEQ ID NO: 9610 - DNA, 18 bp, synthetic construct
  source 1..18: mol_type = other DNA
caatacgccacactatag

SEQ ID NO: 9611 - DNA, 18 bp, synthetic construct
  source 1..18: mol_type = other DNA
ctatacggctcactatag

SEQ ID NO: 9612 - DNA, 18 bp, synthetic construct
  source 1..18: mol_type = other DNA
taacaagactcactagag

SEQ ID NO: 9613 - DNA, 18 bp, synthetic construct
  source 1..18: mol_type = other DNA
taacacgaattactatag

SEQ ID NO: 9614 - DNA, 18 bp, synthetic construct
  source 1..18: mol_type = other DNA
taacactactccctatag

SEQ ID NO: 9615 - DNA, 18 bp, synthetic construct
  source 1..18: mol_type = other DNA
taaccccactcactatag

SEQ ID NO: 9616 - DNA, 18 bp, synthetic construct
  source 1..18: mol_type = other DNA
taactcgactcactatgg

SEQ ID NO: 9617 - DNA, 18 bp, synthetic construct
  source 1..18: mol_type = other DNA
taagacgtctcactaaag

SEQ ID NO: 9618 - DNA, 18 bp, synthetic construct
  source 1..18: mol_type = other DNA
taagaggactcactatcg

SEQ ID NO: 9619 - DNA, 18 bp, synthetic construct
  source 1..18: mol_type = other DNA
taagccgactcacaatag

SEQ ID NO: 9620 - DNA, 18 bp, synthetic construct
  source 1..18: mol_type = other DNA
taataaaactccctatag

SEQ ID NO: 9621 - DNA, 18 bp, synthetic construct
  source 1..18: mol_type = other DNA
taataagacttactacag

SEQ ID NO: 9622 - DNA, 18 bp, synthetic construct
  source 1..18: mol_type = other DNA
taataagattcactagag

SEQ ID NO: 9623 - DNA, 18 bp, synthetic construct
  source 1..18: mol_type = other DNA
taataagattcgctatag

SEQ ID NO: 9624 - DNA, 18 bp, synthetic construct
  source 1..18: mol_type = other DNA
taatacccctcactacag

SEQ ID NO: 9625 - DNA, 18 bp, synthetic construct
  source 1..18: mol_type = other DNA
taatacgaatccccatag

SEQ ID NO: 9626 - DNA, 18 bp, synthetic construct
  source 1..18: mol_type = other DNA
taatacgactctctggag

SEQ ID NO: 9627 - DNA, 18 bp, synthetic construct
  source 1..18: mol_type = other DNA
taatacgactgattctag

SEQ ID NO: 9628 - DNA, 18 bp, synthetic construct
  source 1..18: mol_type = other DNA
taatacgagtcaccctag

SEQ ID NO: 9629 - DNA, 18 bp, synthetic construct
  source 1..18: mol_type = other DNA
taatacgagtctccatag

SEQ ID NO: 9630 - DNA, 18 bp, synthetic construct
  source 1..18: mol_type = other DNA
taatacgtcctactatag

SEQ ID NO: 9631 - DNA, 18 bp, synthetic construct
  source 1..18: mol_type = other DNA
taatacgtctccctagag

SEQ ID NO: 9632 - DNA, 18 bp, synthetic construct
  source 1..18: mol_type = other DNA
taataggaatcactacag

SEQ ID NO: 9633 - DNA, 18 bp, synthetic construct
  source 1..18: mol_type = other DNA
taataggagtctctatag

SEQ ID NO: 9634 - DNA, 18 bp, synthetic construct
  source 1..18: mol_type = other DNA
taataggattcattatag

SEQ ID NO: 9635 - DNA, 18 bp, synthetic construct
  source 1..18: mol_type = other DNA
taatagtcctcactatag

SEQ ID NO: 9636 - DNA, 18 bp, synthetic construct
  source 1..18: mol_type = other DNA
taatagtgctcactatag

SEQ ID NO: 9637 - DNA, 18 bp, synthetic construct
  source 1..18: mol_type = other DNA
taatataactcactatgg

SEQ ID NO: 9638 - DNA, 18 bp, synthetic construct
  source 1..18: mol_type = other DNA
taatatgactccctatcg

SEQ ID NO: 9639 - DNA, 18 bp, synthetic construct
  source 1..18: mol_type = other DNA
taatatggctcactaaag

SEQ ID NO: 9640 - DNA, 18 bp, synthetic construct
  source 1..18: mol_type = other DNA
taatatgtctcactagag

SEQ ID NO: 9641 - DNA, 18 bp, synthetic construct
  source 1..18: mol_type = other DNA
taatattactcagtatag

SEQ ID NO: 9642 - DNA, 18 bp, synthetic construct
  source 1..18: mol_type = other DNA
taatcccactcactttag

SEQ ID NO: 9643 - DNA, 18 bp, synthetic construct
  source 1..18: mol_type = other DNA
taatccgaatcgctatag

SEQ ID NO: 9644 - DNA, 18 bp, synthetic construct
  source 1..18: mol_type = other DNA
taattagactcactatgg

SEQ ID NO: 9645 - DNA, 18 bp, synthetic construct
  source 1..18: mol_type = other DNA
taattccactgactatag

SEQ ID NO: 9646 - DNA, 18 bp, synthetic construct
  source 1..18: mol_type = other DNA
taattcgacccacaatag

SEQ ID NO: 9647 - DNA, 18 bp, synthetic construct
  source 1..18: mol_type = other DNA
taattcgacccactgtag

SEQ ID NO: 9648 - DNA, 18 bp, synthetic construct
  source 1..18: mol_type = other DNA
taccacgactgactatag

SEQ ID NO: 9649 - DNA, 18 bp, synthetic construct
  source 1..18: mol_type = other DNA
tacgactactcactatag

SEQ ID NO: 9650 - DNA, 18 bp, synthetic construct
  source 1..18: mol_type = other DNA
tactacgaatcactatgg

SEQ ID NO: 9651 - DNA, 18 bp, synthetic construct
  source 1..18: mol_type = other DNA
tactacgactcagtttag

SEQ ID NO: 9652 - DNA, 18 bp, synthetic construct
  source 1..18: mol_type = other DNA
tacttcgactcaccatag

SEQ ID NO: 9653 - DNA, 18 bp, synthetic construct
  source 1..18: mol_type = other DNA
tagaacgactcactgtag

SEQ ID NO: 9654 - DNA, 18 bp, synthetic construct
  source 1..18: mol_type = other DNA
tattacgactcaggatag

SEQ ID NO: 9655 - DNA, 18 bp, synthetic construct
  source 1..18: mol_type = other DNA
tcatacacctcactatag

SEQ ID NO: 9656 - DNA, 18 bp, synthetic construct
  source 1..18: mol_type = other DNA
tcatactactccctatag

SEQ ID NO: 9657 - DNA, 18 bp, synthetic construct
  source 1..18: mol_type = other DNA
tcctacgactcactattg

SEQ ID NO: 9658 - DNA, 18 bp, synthetic construct
  source 1..18: mol_type = other DNA
tgaaacgcctcactatag

SEQ ID NO: 9659 - DNA, 18 bp, synthetic construct
  source 1..18: mol_type = other DNA
tgatacgaccctctatag

SEQ ID NO: 9660 - DNA, 18 bp, synthetic construct
  source 1..18: mol_type = other DNA
ttatacgactcaccagag

SEQ ID NO: 9661 - DNA, 18 bp, synthetic construct
  source 1..18: mol_type = other DNA
taatacgactctttattg

SEQ ID NO: 9662 - DNA, 18 bp, synthetic construct
  source 1..18: mol_type = other DNA
taatacatctcactaaag

SEQ ID NO: 9663 - DNA, 18 bp, synthetic construct
  source 1..18: mol_type = other DNA
taatacgactcaaaattg

SEQ ID NO: 9664 - DNA, 18 bp, synthetic construct
  source 1..18: mol_type = other DNA
taatacgaatcacttaag

SEQ ID NO: 9665 - DNA, 18 bp, synthetic construct
  source 1..18: mol_type = other DNA
taatacgaattactaaag

SEQ ID NO: 9666 - DNA, 18 bp, synthetic construct
  source 1..18: mol_type = other DNA
tgttacgactctctatag

SEQ ID NO: 9667 - DNA, 18 bp, synthetic construct
  source 1..18: mol_type = other DNA
taatactacacacaatag

SEQ ID NO: 9668 - DNA, 18 bp, synthetic construct
  source 1..18: mol_type = other DNA
caatacgactaactttag

SEQ ID NO: 9669 - DNA, 18 bp, synthetic construct
  source 1..18: mol_type = other DNA
taaaacggctcactaaag

SEQ ID NO: 9670 - DNA, 18 bp, synthetic construct
  source 1..18: mol_type = other DNA
taatacgactcacctaag

SEQ ID NO: 9671 - DNA, 18 bp, synthetic construct
  source 1..18: mol_type = other DNA
taatatgactctctattg

SEQ ID NO: 9672 - DNA, 18 bp, synthetic construct
  source 1..18: mol_type = other DNA
tattacgattcactattg

SEQ ID NO: 9673 - DNA, 18 bp, synthetic construct
  source 1..18: mol_type = other DNA
taatacgacactttatag

SEQ ID NO: 9674 - DNA, 18 bp, synthetic construct
  source 1..18: mol_type = other DNA
aaatacgactcacattag

SEQ ID NO: 9675 - DNA, 18 bp, synthetic construct
  source 1..18: mol_type = other DNA
tattacgacaccctatag

SEQ ID NO: 9676 - DNA, 18 bp, synthetic construct
  source 1..18: mol_type = other DNA
tcatacgtctcactttag

SEQ ID NO: 9677 - DNA, 18 bp, synthetic construct
  source 1..18: mol_type = other DNA
ttatacgacacactatcg

SEQ ID NO: 9678 - DNA, 18 bp, synthetic construct
  source 1..18: mol_type = other DNA
ttattcgactcactatgg

SEQ ID NO: 9679 - DNA, 18 bp, synthetic construct
  source 1..18: mol_type = other DNA
taacattactcactatag

SEQ ID NO: 9680 - DNA, 18 bp, synthetic construct
  source 1..18: mol_type = other DNA
taataagtctcactgtag

SEQ ID NO: 9681 - DNA, 18 bp, synthetic construct
  source 1..18: mol_type = other DNA
taataccgctcactattg

SEQ ID NO: 9682 - DNA, 18 bp, synthetic construct
  source 1..18: mol_type = other DNA
taatacgacccattattg

SEQ ID NO: 9683 - DNA, 18 bp, synthetic construct
  source 1..18: mol_type = other DNA
taatacgactacctttag

SEQ ID NO: 9684 - DNA, 18 bp, synthetic construct
  source 1..18: mol_type = other DNA
taatacgactctatatcg

SEQ ID NO: 9685 - DNA, 18 bp, synthetic construct
  source 1..18: mol_type = other DNA
taatacgacttagtattg

SEQ ID NO: 9686 - DNA, 18 bp, synthetic construct
  source 1..18: mol_type = other DNA
taatacgattgactttag

SEQ ID NO: 9687 - DNA, 18 bp, synthetic construct
  source 1..18: mol_type = other DNA
taatactactctctatgg

SEQ ID NO: 9688 - DNA, 18 bp, synthetic construct
  source 1..18: mol_type = other DNA
taatatgacacaccatag

SEQ ID NO: 9689 - DNA, 18 bp, synthetic construct
  source 1..18: mol_type = other DNA
taatatgattcgctatag

SEQ ID NO: 9690 - DNA, 18 bp, synthetic construct
  source 1..18: mol_type = other DNA
tcaatcgactcactatag

SEQ ID NO: 9691 - DNA, 18 bp, synthetic construct
  source 1..18: mol_type = other DNA
ttatacaagtcactatag

SEQ ID NO: 9692 - DNA, 18 bp, synthetic construct
  source 1..18: mol_type = other DNA
taataagactcacaattg

SEQ ID NO: 9693 - DNA, 18 bp, synthetic construct
  source 1..18: mol_type = other DNA
atacacgactcactatag

SEQ ID NO: 9694 - DNA, 18 bp, synthetic construct
  source 1..18: mol_type = other DNA
taatacgatacattatag

SEQ ID NO: 9695 - DNA, 18 bp, synthetic construct
  source 1..18: mol_type = other DNA
taatacgattcattattg

SEQ ID NO: 9696 - DNA, 18 bp, synthetic construct
  source 1..18: mol_type = other DNA
aaataagactctctatag

SEQ ID NO: 9697 - DNA, 18 bp, synthetic construct
  source 1..18: mol_type = other DNA
aagaacgactcactatag

SEQ ID NO: 9698 - DNA, 18 bp, synthetic construct
  source 1..18: mol_type = other DNA
caatacgtttcactatag

SEQ ID NO: 9699 - DNA, 18 bp, synthetic construct
  source 1..18: mol_type = other DNA
taaaacgaatcactaaag

SEQ ID NO: 9700 - DNA, 18 bp, synthetic construct
  source 1..18: mol_type = other DNA
taatacgacagacaatag

SEQ ID NO: 9701 - DNA, 18 bp, synthetic construct
  source 1..18: mol_type = other DNA
taatacgtctgacaatag

SEQ ID NO: 9702 - DNA, 18 bp, synthetic construct
  source 1..18: mol_type = other DNA
taatacgtttcgctatag

SEQ ID NO: 9703 - DNA, 18 bp, synthetic construct
  source 1..18: mol_type = other DNA
tatcacgactcattatag

SEQ ID NO: 9704 - DNA, 18 bp, synthetic construct
  source 1..18: mol_type = other DNA
tattgtgactcactatag

SEQ ID NO: 9705 - DNA, 18 bp, synthetic construct
  source 1..18: mol_type = other DNA
ttatacacctcactatag

SEQ ID NO: 9706 - DNA, 18 bp, synthetic construct
  source 1..18: mol_type = other DNA
ttatacgactctctttag

SEQ ID NO: 9707 - DNA, 18 bp, synthetic construct
  source 1..18: mol_type = other DNA
taaaaagactaactatag

SEQ ID NO: 9708 - DNA, 18 bp, synthetic construct
  source 1..18: mol_type = other DNA
tagtacgactcattattg

SEQ ID NO: 9709 - DNA, 18 bp, synthetic construct
  source 1..18: mol_type = other DNA
taaaacaactcacaatag

SEQ ID NO: 9710 - DNA, 18 bp, synthetic construct
  source 1..18: mol_type = other DNA
aattacgactcacaatag

SEQ ID NO: 9711 - DNA, 18 bp, synthetic construct
  source 1..18: mol_type = other DNA
taatacgattctctaaag

SEQ ID NO: 9712 - DNA, 18 bp, synthetic construct
  source 1..18: mol_type = other DNA
taatacaacacactaaag

SEQ ID NO: 9713 - DNA, 18 bp, synthetic construct
  source 1..18: mol_type = other DNA
ttatacgaaacactatag

SEQ ID NO: 9714 - DNA, 18 bp, synthetic construct
  source 1..18: mol_type = other DNA
taatgcgactctcaatag

SEQ ID NO: 9715 - DNA, 18 bp, synthetic construct
  source 1..18: mol_type = other DNA
taatacgtctaaccatag

SEQ ID NO: 9716 - DNA, 18 bp, synthetic construct
  source 1..18: mol_type = other DNA
taatatgaatctctatag

SEQ ID NO: 9717 - DNA, 18 bp, synthetic construct
  source 1..18: mol_type = other DNA
taattcacctcactatag

SEQ ID NO: 9718 - DNA, 18 bp, synthetic construct
  source 1..18: mol_type = other DNA
tataacgacttactatag

SEQ ID NO: 9719 - DNA, 18 bp, synthetic construct
  source 1..18: mol_type = other DNA
tgatacgacttactttag

SEQ ID NO: 9720 - DNA, 18 bp, synthetic construct
  source 1..18: mol_type = other DNA
aaattcgactcattatag

SEQ ID NO: 9721 - DNA, 18 bp, synthetic construct
  source 1..18: mol_type = other DNA
caatacgactcacaaaag

SEQ ID NO: 9722 - DNA, 18 bp, synthetic construct
  source 1..18: mol_type = other DNA
caatactactcactaaag

SEQ ID NO: 9723 - DNA, 18 bp, synthetic construct
  source 1..18: mol_type = other DNA
taacacgacacacaatag

SEQ ID NO: 9724 - DNA, 18 bp, synthetic construct
  source 1..18: mol_type = other DNA
taatacgacaaattatag

SEQ ID NO: 9725 - DNA, 18 bp, synthetic construct
  source 1..18: mol_type = other DNA
taatacgagtcacaaaag

SEQ ID NO: 9726 - DNA, 18 bp, synthetic construct
  source 1..18: mol_type = other DNA
taattagactaactatag

SEQ ID NO: 9727 - DNA, 18 bp, synthetic construct
  source 1..18: mol_type = other DNA
tagtacgtctcactttag

SEQ ID NO: 9728 - DNA, 18 bp, synthetic construct
  source 1..18: mol_type = other DNA
tcatacgattcactttag

SEQ ID NO: 9729 - DNA, 18 bp, synthetic construct
  source 1..18: mol_type = other DNA
ttctacaactcactatag

SEQ ID NO: 9730 - DNA, 18 bp, synthetic construct
  source 1..18: mol_type = other DNA
aaaaacgactcagtatag

SEQ ID NO: 9731 - DNA, 18 bp, synthetic construct
  source 1..18: mol_type = other DNA
aaataacactcactatag

SEQ ID NO: 9732 - DNA, 18 bp, synthetic construct
  source 1..18: mol_type = other DNA
aaataagactcaatatag

SEQ ID NO: 9733 - DNA, 18 bp, synthetic construct
  source 1..18: mol_type = other DNA
acatatgactcactatag

SEQ ID NO: 9734 - DNA, 18 bp, synthetic construct
  source 1..18: mol_type = other DNA
taatacaactcacaacag

SEQ ID NO: 9735 - DNA, 18 bp, synthetic construct
  source 1..18: mol_type = other DNA
taatacgaccatctatag

SEQ ID NO: 9736 - DNA, 18 bp, synthetic construct
  source 1..18: mol_type = other DNA
taatacgactaccaatag

SEQ ID NO: 9737 - DNA, 18 bp, synthetic construct
  source 1..18: mol_type = other DNA
taatacgtctcacgattg

SEQ ID NO: 9738 - DNA, 18 bp, synthetic construct
  source 1..18: mol_type = other DNA
taataggatacactatag

SEQ ID NO: 9739 - DNA, 18 bp, synthetic construct
  source 1..18: mol_type = other DNA
taatataacttactatag

SEQ ID NO: 9740 - DNA, 18 bp, synthetic construct
  source 1..18: mol_type = other DNA
taatatgacttactatcg

SEQ ID NO: 9741 - DNA, 18 bp, synthetic construct
  source 1..18: mol_type = other DNA
taattcgactcaatagag

SEQ ID NO: 9742 - DNA, 18 bp, synthetic construct
  source 1..18: mol_type = other DNA
taattggacttactatag

SEQ ID NO: 9743 - DNA, 18 bp, synthetic construct
  source 1..18: mol_type = other DNA
tactacaactaactatag

SEQ ID NO: 9744 - DNA, 18 bp, synthetic construct
  source 1..18: mol_type = other DNA
ttatacgactcacaagag

SEQ ID NO: 9745 - DNA, 18 bp, synthetic construct
  source 1..18: mol_type = other DNA
ttatacgattcaccatag

SEQ ID NO: 9746 - DNA, 18 bp, synthetic construct
  source 1..18: mol_type = other DNA
aaatacgactgattatag

SEQ ID NO: 9747 - DNA, 18 bp, synthetic construct
  source 1..18: mol_type = other DNA
aaatatgactcactctag

SEQ ID NO: 9748 - DNA, 18 bp, synthetic construct
  source 1..18: mol_type = other DNA
aaccacgactcactatag

SEQ ID NO: 9749 - DNA, 18 bp, synthetic construct
  source 1..18: mol_type = other DNA
caatacgacacactagag

SEQ ID NO: 9750 - DNA, 18 bp, synthetic construct
  source 1..18: mol_type = other DNA
caatacgaccctctatag

SEQ ID NO: 9751 - DNA, 18 bp, synthetic construct
  source 1..18: mol_type = other DNA
caatacgcctcactaaag

SEQ ID NO: 9752 - DNA, 18 bp, synthetic construct
  source 1..18: mol_type = other DNA
gaatacgcctcactatcg

SEQ ID NO: 9753 - DNA, 18 bp, synthetic construct
  source 1..18: mol_type = other DNA
gaatatgactcacaatag

SEQ ID NO: 9754 - DNA, 18 bp, synthetic construct
  source 1..18: mol_type = other DNA
gattacgactccctatag

SEQ ID NO: 9755 - DNA, 18 bp, synthetic construct
  source 1..18: mol_type = other DNA
taaaccgacacactatag

SEQ ID NO: 9756 - DNA, 18 bp, synthetic construct
  source 1..18: mol_type = other DNA
taaaccgactcactatgg

SEQ ID NO: 9757 - DNA, 18 bp, synthetic construct
  source 1..18: mol_type = other DNA
taacacgacacaatatag

SEQ ID NO: 9758 - DNA, 18 bp, synthetic construct
  source 1..18: mol_type = other DNA
taacacgactcactctcg

SEQ ID NO: 9759 - DNA, 18 bp, synthetic construct
  source 1..18: mol_type = other DNA
taacacgcctcattatag

SEQ ID NO: 9760 - DNA, 18 bp, synthetic construct
  source 1..18: mol_type = other DNA
taacccgactcactatcg

SEQ ID NO: 9761 - DNA, 18 bp, synthetic construct
  source 1..18: mol_type = other DNA
taagatgactcaatatag

SEQ ID NO: 9762 - DNA, 18 bp, synthetic construct
  source 1..18: mol_type = other DNA
taataacaatcactatag

SEQ ID NO: 9763 - DNA, 18 bp, synthetic construct
  source 1..18: mol_type = other DNA
taataagacacacgatag

SEQ ID NO: 9764 - DNA, 18 bp, synthetic construct
  source 1..18: mol_type = other DNA
taataagagtcattatag

SEQ ID NO: 9765 - DNA, 18 bp, synthetic construct
  source 1..18: mol_type = other DNA
taataaggctctctatag

SEQ ID NO: 9766 - DNA, 18 bp, synthetic construct
  source 1..18: mol_type = other DNA
taatacaactcacagtag

SEQ ID NO: 9767 - DNA, 18 bp, synthetic construct
  source 1..18: mol_type = other DNA
taatacaactccctacag

SEQ ID NO: 9768 - DNA, 18 bp, synthetic construct
  source 1..18: mol_type = other DNA
taatacgaaacactgtag

SEQ ID NO: 9769 - DNA, 18 bp, synthetic construct
  source 1..18: mol_type = other DNA
taatacgaccaactacag

SEQ ID NO: 9770 - DNA, 18 bp, synthetic construct
  source 1..18: mol_type = other DNA
taatacgactcagaatcg

SEQ ID NO: 9771 - DNA, 18 bp, synthetic construct
  source 1..18: mol_type = other DNA
taatacgccttactatgg

SEQ ID NO: 9772 - DNA, 18 bp, synthetic construct
  source 1..18: mol_type = other DNA
taatacggctaaatatag

SEQ ID NO: 9773 - DNA, 18 bp, synthetic construct
  source 1..18: mol_type = other DNA
taataggactcccaatag

SEQ ID NO: 9774 - DNA, 18 bp, synthetic construct
  source 1..18: mol_type = other DNA
taatatcactcattatag

SEQ ID NO: 9775 - DNA, 18 bp, synthetic construct
  source 1..18: mol_type = other DNA
taattcgactcattagag

SEQ ID NO: 9776 - DNA, 18 bp, synthetic construct
  source 1..18: mol_type = other DNA
taattcgagtaactatag

SEQ ID NO: 9777 - DNA, 18 bp, synthetic construct
  source 1..18: mol_type = other DNA
tactacgactcactcaag

SEQ ID NO: 9778 - DNA, 18 bp, synthetic construct
  source 1..18: mol_type = other DNA
tactatgactcactaaag

SEQ ID NO: 9779 - DNA, 18 bp, synthetic construct
  source 1..18: mol_type = other DNA
tagcacgattcactatag

SEQ ID NO: 9780 - DNA, 18 bp, synthetic construct
  source 1..18: mol_type = other DNA
tagcccgactcactatag

SEQ ID NO: 9781 - DNA, 18 bp, synthetic construct
  source 1..18: mol_type = other DNA
tagtaccactcactatcg

SEQ ID NO: 9782 - DNA, 18 bp, synthetic construct
  source 1..18: mol_type = other DNA
tagtacgacttacaatag

SEQ ID NO: 9783 - DNA, 18 bp, synthetic construct
  source 1..18: mol_type = other DNA
tagtgcgtctcactatag

SEQ ID NO: 9784 - DNA, 18 bp, synthetic construct
  source 1..18: mol_type = other DNA
tattacgacccactatgg

SEQ ID NO: 9785 - DNA, 18 bp, synthetic construct
  source 1..18: mol_type = other DNA
tattacgactccctagag

SEQ ID NO: 9786 - DNA, 18 bp, synthetic construct
  source 1..18: mol_type = other DNA
tcataggacttactatag

SEQ ID NO: 9787 - DNA, 18 bp, synthetic construct
  source 1..18: mol_type = other DNA
tcttaccactcactatag

SEQ ID NO: 9788 - DNA, 18 bp, synthetic construct
  source 1..18: mol_type = other DNA
tgataccactcactacag

SEQ ID NO: 9789 - DNA, 18 bp, synthetic construct
  source 1..18: mol_type = other DNA
tgatacgactcattagag

SEQ ID NO: 9790 - DNA, 18 bp, synthetic construct
  source 1..18: mol_type = other DNA
tgatacgactcccaatag

SEQ ID NO: 9791 - DNA, 18 bp, synthetic construct
  source 1..18: mol_type = other DNA
tgctacgactcattatag

SEQ ID NO: 9792 - DNA, 18 bp, synthetic construct
  source 1..18: mol_type = other DNA
ttatactactcactattg

SEQ ID NO: 9793 - DNA, 18 bp, synthetic construct
  source 1..18: mol_type = other DNA
aattacgactcactattg

SEQ ID NO: 9794 - DNA, 18 bp, synthetic construct
  source 1..18: mol_type = other DNA
taattcgactatctatag

SEQ ID NO: 9795 - DNA, 18 bp, synthetic construct
  source 1..18: mol_type = other DNA
aaatacgaatcactattg

SEQ ID NO: 9796 - DNA, 18 bp, synthetic construct
  source 1..18: mol_type = other DNA
taaaacgactcaatattg

SEQ ID NO: 9797 - DNA, 18 bp, synthetic construct
  source 1..18: mol_type = other DNA
taattcgacttactaaag

SEQ ID NO: 9798 - DNA, 18 bp, synthetic construct
  source 1..18: mol_type = other DNA
atatacgaatcactatag

SEQ ID NO: 9799 - DNA, 18 bp, synthetic construct
  source 1..18: mol_type = other DNA
tattacgaatcacaatag

SEQ ID NO: 9800 - DNA, 18 bp, synthetic construct
  source 1..18: mol_type = other DNA
tatttcgacacactatag

SEQ ID NO: 9801 - DNA, 18 bp, synthetic construct
  source 1..18: mol_type = other DNA
aaatacggctcactattg

SEQ ID NO: 9802 - DNA, 18 bp, synthetic construct
  source 1..18: mol_type = other DNA
taaaatgactcaatatag

SEQ ID NO: 9803 - DNA, 18 bp, synthetic construct
  source 1..18: mol_type = other DNA
taatactaatctctatag

SEQ ID NO: 9804 - DNA, 18 bp, synthetic construct
  source 1..18: mol_type = other DNA
taaaactactcactattg

SEQ ID NO: 9805 - DNA, 18 bp, synthetic construct
  source 1..18: mol_type = other DNA
tattacgactcataatag

SEQ ID NO: 9806 - DNA, 18 bp, synthetic construct
  source 1..18: mol_type = other DNA
taattcgaatcactctag

SEQ ID NO: 9807 - DNA, 18 bp, synthetic construct
  source 1..18: mol_type = other DNA
tagtacgactcactaatg

SEQ ID NO: 9808 - DNA, 18 bp, synthetic construct
  source 1..18: mol_type = other DNA
tataacgactcagtatag

SEQ ID NO: 9809 - DNA, 18 bp, synthetic construct
  source 1..18: mol_type = other DNA
tattacgactcatcatag

SEQ ID NO: 9810 - DNA, 18 bp, synthetic construct
  source 1..18: mol_type = other DNA
tattacgcctcacaatag

SEQ ID NO: 9811 - DNA, 18 bp, synthetic construct
  source 1..18: mol_type = other DNA
tattaggacacactatag

SEQ ID NO: 9812 - DNA, 18 bp, synthetic construct
  source 1..18: mol_type = other DNA
tgattcgactcattatag

SEQ ID NO: 9813 - DNA, 18 bp, synthetic construct
  source 1..18: mol_type = other DNA
taatacgactaacttaag

SEQ ID NO: 9814 - DNA, 18 bp, synthetic construct
  source 1..18: mol_type = other DNA
taatatgacttactaaag

SEQ ID NO: 9815 - DNA, 18 bp, synthetic construct
  source 1..18: mol_type = other DNA
taaaacgactcaaaatag

SEQ ID NO: 9816 - DNA, 18 bp, synthetic construct
  source 1..18: mol_type = other DNA
taatacgacttaataaag

SEQ ID NO: 9817 - DNA, 18 bp, synthetic construct
  source 1..18: mol_type = other DNA
aaaaacgactcactatcg

SEQ ID NO: 9818 - DNA, 18 bp, synthetic construct
  source 1..18: mol_type = other DNA
aaataggacacactatag

SEQ ID NO: 9819 - DNA, 18 bp, synthetic construct
  source 1..18: mol_type = other DNA
taatacaacttaatatag

SEQ ID NO: 9820 - DNA, 18 bp, synthetic construct
  source 1..18: mol_type = other DNA
taatacgactcataatgg

SEQ ID NO: 9821 - DNA, 18 bp, synthetic construct
  source 1..18: mol_type = other DNA
taatgcgaatctctatag

SEQ ID NO: 9822 - DNA, 18 bp, synthetic construct
  source 1..18: mol_type = other DNA
taattcgacacactacag

SEQ ID NO: 9823 - DNA, 18 bp, synthetic construct
  source 1..18: mol_type = other DNA
tactatgacttactatag

SEQ ID NO: 9824 - DNA, 18 bp, synthetic construct
  source 1..18: mol_type = other DNA
tattaccgctcactatag

SEQ ID NO: 9825 - DNA, 18 bp, synthetic construct
  source 1..18: mol_type = other DNA
tcataagtctcactatag

SEQ ID NO: 9826 - DNA, 18 bp, synthetic construct
  source 1..18: mol_type = other DNA
ttaaacgactcacaatag

SEQ ID NO: 9827 - DNA, 18 bp, synthetic construct
  source 1..18: mol_type = other DNA
ttttactactcactatag

SEQ ID NO: 9828 - DNA, 18 bp, synthetic construct
  source 1..18: mol_type = other DNA
ttttacgactctctatag

SEQ ID NO: 9829 - DNA, 18 bp, synthetic construct
  source 1..18: mol_type = other DNA
taatacgaatctcaatag

SEQ ID NO: 9830 - DNA, 18 bp, synthetic construct
  source 1..18: mol_type = other DNA
taatacgactaacttcag

SEQ ID NO: 9831 - DNA, 18 bp, synthetic construct
  source 1..18: mol_type = other DNA
taatccttctcactatag

SEQ ID NO: 9832 - DNA, 18 bp, synthetic construct
  source 1..18: mol_type = other DNA
ttatacgactcattattg

SEQ ID NO: 9833 - DNA, 18 bp, synthetic construct
  source 1..18: mol_type = other DNA
taaaacgattcattatag

SEQ ID NO: 9834 - DNA, 18 bp, synthetic construct
  source 1..18: mol_type = other DNA
tcatacgactcacattag

SEQ ID NO: 9835 - DNA, 18 bp, synthetic construct
  source 1..18: mol_type = other DNA
tactacgactcacaattg

SEQ ID NO: 9836 - DNA, 18 bp, synthetic construct
  source 1..18: mol_type = other DNA
ttatactactctctatag

SEQ ID NO: 9837 - DNA, 18 bp, synthetic construct
  source 1..18: mol_type = other DNA
taatacgaatctctaaag

SEQ ID NO: 9838 - DNA, 18 bp, synthetic construct
  source 1..18: mol_type = other DNA
taattcgactaacaatag

SEQ ID NO: 9839 - DNA, 18 bp, synthetic construct
  source 1..18: mol_type = other DNA
taaatcgaatcactatag

SEQ ID NO: 9840 - DNA, 18 bp, synthetic construct
  source 1..18: mol_type = other DNA
taatacgagacactttag

SEQ ID NO: 9841 - DNA, 18 bp, synthetic construct
  source 1..18: mol_type = other DNA
taatccgattcacaatag

SEQ ID NO: 9842 - DNA, 18 bp, synthetic construct
  source 1..18: mol_type = other DNA
taatgcgacacacaatag

SEQ ID NO: 9843 - DNA, 18 bp, synthetic construct
  source 1..18: mol_type = other DNA
ttgtacgactcactaaag

SEQ ID NO: 9844 - DNA, 18 bp, synthetic construct
  source 1..18: mol_type = other DNA
taatacttctcactttag

SEQ ID NO: 9845 - DNA, 18 bp, synthetic construct
  source 1..18: mol_type = other DNA
aaattcgactaactatag

SEQ ID NO: 9846 - DNA, 18 bp, synthetic construct
  source 1..18: mol_type = other DNA
taaaactactcactatgg

SEQ ID NO: 9847 - DNA, 18 bp, synthetic construct
  source 1..18: mol_type = other DNA
taataccattcattatag

SEQ ID NO: 9848 - DNA, 18 bp, synthetic construct
  source 1..18: mol_type = other DNA
taatacgactcccagtag

SEQ ID NO: 9849 - DNA, 18 bp, synthetic construct
  source 1..18: mol_type = other DNA
taatacgagtcaaaatag

SEQ ID NO: 9850 - DNA, 18 bp, synthetic construct
  source 1..18: mol_type = other DNA
taataggacacactttag

SEQ ID NO: 9851 - DNA, 18 bp, synthetic construct
  source 1..18: mol_type = other DNA
taattcgcctcattatag

SEQ ID NO: 9852 - DNA, 18 bp, synthetic construct
  source 1..18: mol_type = other DNA
tactacgacttactattg

SEQ ID NO: 9853 - DNA, 18 bp, synthetic construct
  source 1..18: mol_type = other DNA
aaatacgactgactaaag

SEQ ID NO: 9854 - DNA, 18 bp, synthetic construct
  source 1..18: mol_type = other DNA
aaatacgagtcaatatag

SEQ ID NO: 9855 - DNA, 18 bp, synthetic construct
  source 1..18: mol_type = other DNA
aaatacgcctcaatatag

SEQ ID NO: 9856 - DNA, 18 bp, synthetic construct
  source 1..18: mol_type = other DNA
aaatacggctcactttag

SEQ ID NO: 9857 - DNA, 18 bp, synthetic construct
  source 1..18: mol_type = other DNA
aagtacgactcgctatag

SEQ ID NO: 9858 - DNA, 18 bp, synthetic construct
  source 1..18: mol_type = other DNA
caataaaactcactatag

SEQ ID NO: 9859 - DNA, 18 bp, synthetic construct
  source 1..18: mol_type = other DNA
caatacgaatcgctatag

SEQ ID NO: 9860 - DNA, 18 bp, synthetic construct
  source 1..18: mol_type = other DNA
caatacgacttacaatag

SEQ ID NO: 9861 - DNA, 18 bp, synthetic construct
  source 1..18: mol_type = other DNA
caatacgtctcactacag

SEQ ID NO: 9862 - DNA, 18 bp, synthetic construct
  source 1..18: mol_type = other DNA
caattcggctcactatag

SEQ ID NO: 9863 - DNA, 18 bp, synthetic construct
  source 1..18: mol_type = other DNA
cattacgactccctatag

SEQ ID NO: 9864 - DNA, 18 bp, synthetic construct
  source 1..18: mol_type = other DNA
gaataagacacactatag

SEQ ID NO: 9865 - DNA, 18 bp, synthetic construct
  source 1..18: mol_type = other DNA
taacacgacacagtatag

SEQ ID NO: 9866 - DNA, 18 bp, synthetic construct
  source 1..18: mol_type = other DNA
taacccgactcactttag

SEQ ID NO: 9867 - DNA, 18 bp, synthetic construct
  source 1..18: mol_type = other DNA
taataagactgactacag

SEQ ID NO: 9868 - DNA, 18 bp, synthetic construct
  source 1..18: mol_type = other DNA
taataaggatcactatag

SEQ ID NO: 9869 - DNA, 18 bp, synthetic construct
  source 1..18: mol_type = other DNA
taatacaaatcgctatag

SEQ ID NO: 9870 - DNA, 18 bp, synthetic construct
  source 1..18: mol_type = other DNA
taataccacacactatgg

SEQ ID NO: 9871 - DNA, 18 bp, synthetic construct
  source 1..18: mol_type = other DNA
taataccacgcattatag

SEQ ID NO: 9872 - DNA, 18 bp, synthetic construct
  source 1..18: mol_type = other DNA
taatacgacccactaacg

SEQ ID NO: 9873 - DNA, 18 bp, synthetic construct
  source 1..18: mol_type = other DNA
taatacgactctcgaaag

SEQ ID NO: 9874 - DNA, 18 bp, synthetic construct
  source 1..18: mol_type = other DNA
taatacgagtcaacatag

SEQ ID NO: 9875 - DNA, 18 bp, synthetic construct
  source 1..18: mol_type = other DNA
taatacgattgacaatag

SEQ ID NO: 9876 - DNA, 18 bp, synthetic construct
  source 1..18: mol_type = other DNA
taatacgcctaactacag

SEQ ID NO: 9877 - DNA, 18 bp, synthetic construct
  source 1..18: mol_type = other DNA
taatacggctcaatatcg

SEQ ID NO: 9878 - DNA, 18 bp, synthetic construct
  source 1..18: mol_type = other DNA
taatactactccctgtag

SEQ ID NO: 9879 - DNA, 18 bp, synthetic construct
  source 1..18: mol_type = other DNA
taatactcctcagtatag

SEQ ID NO: 9880 - DNA, 18 bp, synthetic construct
  source 1..18: mol_type = other DNA
taatatgactcagtaaag

SEQ ID NO: 9881 - DNA, 18 bp, synthetic construct
  source 1..18: mol_type = other DNA
taatcctactccctatag

SEQ ID NO: 9882 - DNA, 18 bp, synthetic construct
  source 1..18: mol_type = other DNA
taatctgactcacaatag

SEQ ID NO: 9883 - DNA, 18 bp, synthetic construct
  source 1..18: mol_type = other DNA
taatgcgactcaacatag

SEQ ID NO: 9884 - DNA, 18 bp, synthetic construct
  source 1..18: mol_type = other DNA
taatgcgattccctatag

SEQ ID NO: 9885 - DNA, 18 bp, synthetic construct
  source 1..18: mol_type = other DNA
tactacgacccactaaag

SEQ ID NO: 9886 - DNA, 18 bp, synthetic construct
  source 1..18: mol_type = other DNA
tactacgactcacaacag

SEQ ID NO: 9887 - DNA, 18 bp, synthetic construct
  source 1..18: mol_type = other DNA
tactacgactctctatcg

SEQ ID NO: 9888 - DNA, 18 bp, synthetic construct
  source 1..18: mol_type = other DNA
tagtacgactcactgaag

SEQ ID NO: 9889 - DNA, 18 bp, synthetic construct
  source 1..18: mol_type = other DNA
tagtactcctcactatag

SEQ ID NO: 9890 - DNA, 18 bp, synthetic construct
  source 1..18: mol_type = other DNA
tagtatgactaactatag

SEQ ID NO: 9891 - DNA, 18 bp, synthetic construct
  source 1..18: mol_type = other DNA
tagtatgactgactatag

SEQ ID NO: 9892 - DNA, 18 bp, synthetic construct
  source 1..18: mol_type = other DNA
tattatgactcgctatag

SEQ ID NO: 9893 - DNA, 18 bp, synthetic construct
  source 1..18: mol_type = other DNA
tcatacgactcaatatcg

SEQ ID NO: 9894 - DNA, 18 bp, synthetic construct
  source 1..18: mol_type = other DNA
tcatgcaactcactatag

SEQ ID NO: 9895 - DNA, 18 bp, synthetic construct
  source 1..18: mol_type = other DNA
tgataagactcaatatag

SEQ ID NO: 9896 - DNA, 18 bp, synthetic construct
  source 1..18: mol_type = other DNA
tgatacgactcatcatag

SEQ ID NO: 9897 - DNA, 18 bp, synthetic construct
  source 1..18: mol_type = other DNA
tgttaccactcactatag

SEQ ID NO: 9898 - DNA, 18 bp, synthetic construct
  source 1..18: mol_type = other DNA
ttatacgagtcactatcg

SEQ ID NO: 9899 - DNA, 18 bp, synthetic construct
  source 1..18: mol_type = other DNA
ttatacggcccactatag

SEQ ID NO: 9900 - DNA, 18 bp, synthetic construct
  source 1..18: mol_type = other DNA
ttatacggctcaatatag

SEQ ID NO: 9901 - DNA, 18 bp, synthetic construct
  source 1..18: mol_type = other DNA
ttatcccactcactatag

SEQ ID NO: 9902 - DNA, 18 bp, synthetic construct
  source 1..18: mol_type = other DNA
ttatccgacccactatag

SEQ ID NO: 9903 - DNA, 18 bp, synthetic construct
  source 1..18: mol_type = other DNA
cattacgactcactattg

SEQ ID NO: 9904 - DNA, 18 bp, synthetic construct
  source 1..18: mol_type = other DNA
taaaacgattcactattg

SEQ ID NO: 9905 - DNA, 18 bp, synthetic construct
  source 1..18: mol_type = other DNA
taatacgattcattttag

SEQ ID NO: 9906 - DNA, 18 bp, synthetic construct
  source 1..18: mol_type = other DNA
taataagactaactattg

SEQ ID NO: 9907 - DNA, 18 bp, synthetic construct
  source 1..18: mol_type = other DNA
taatacgactctcaatgg

SEQ ID NO: 9908 - DNA, 18 bp, synthetic construct
  source 1..18: mol_type = other DNA
taatatgtctcaatatag

SEQ ID NO: 9909 - DNA, 18 bp, synthetic construct
  source 1..18: mol_type = other DNA
taatacgtatcaccatag

SEQ ID NO: 9910 - DNA, 18 bp, synthetic construct
  source 1..18: mol_type = other DNA
taatacgtcacactacag

SEQ ID NO: 9911 - DNA, 18 bp, synthetic construct
  source 1..18: mol_type = other DNA
taattcgattcaatatag

SEQ ID NO: 9912 - DNA, 18 bp, synthetic construct
  source 1..18: mol_type = other DNA
taatactacacactttag

SEQ ID NO: 9913 - DNA, 18 bp, synthetic construct
  source 1..18: mol_type = other DNA
tattacgactctcaatag

SEQ ID NO: 9914 - DNA, 18 bp, synthetic construct
  source 1..18: mol_type = other DNA
taatatgactctctttag

SEQ ID NO: 9915 - DNA, 18 bp, synthetic construct
  source 1..18: mol_type = other DNA
taatacgactcaattaag

SEQ ID NO: 9916 - DNA, 18 bp, synthetic construct
  source 1..18: mol_type = other DNA
tataactactcactatag

SEQ ID NO: 9917 - DNA, 18 bp, synthetic construct
  source 1..18: mol_type = other DNA
taatactactaactaaag

SEQ ID NO: 9918 - DNA, 18 bp, synthetic construct
  source 1..18: mol_type = other DNA
taatatgactcattttag

SEQ ID NO: 9919 - DNA, 18 bp, synthetic construct
  source 1..18: mol_type = other DNA
taattcgacacattatag

SEQ ID NO: 9920 - DNA, 18 bp, synthetic construct
  source 1..18: mol_type = other DNA
tattgcgacttactatag

SEQ ID NO: 9921 - DNA, 18 bp, synthetic construct
  source 1..18: mol_type = other DNA
ttatacgactgtctatag

SEQ ID NO: 9922 - DNA, 18 bp, synthetic construct
  source 1..18: mol_type = other DNA
aaatacgacttaccatag

SEQ ID NO: 9923 - DNA, 18 bp, synthetic construct
  source 1..18: mol_type = other DNA
aaatacgattcactctag

SEQ ID NO: 9924 - DNA, 18 bp, synthetic construct
  source 1..18: mol_type = other DNA
taataccactcataatag

SEQ ID NO: 9925 - DNA, 18 bp, synthetic construct
  source 1..18: mol_type = other DNA
taatacgaaacactctag

SEQ ID NO: 9926 - DNA, 18 bp, synthetic construct
  source 1..18: mol_type = other DNA
taatacgacacactgttg

SEQ ID NO: 9927 - DNA, 18 bp, synthetic construct
  source 1..18: mol_type = other DNA
taatacgacagactttag

SEQ ID NO: 9928 - DNA, 18 bp, synthetic construct
  source 1..18: mol_type = other DNA
taatacgcctcacaaaag

SEQ ID NO: 9929 - DNA, 18 bp, synthetic construct
  source 1..18: mol_type = other DNA
taatacgtctccctatcg

SEQ ID NO: 9930 - DNA, 18 bp, synthetic construct
  source 1..18: mol_type = other DNA
taatactactcgcaatag

SEQ ID NO: 9931 - DNA, 18 bp, synthetic construct
  source 1..18: mol_type = other DNA
taatactagtcattatag

SEQ ID NO: 9932 - DNA, 18 bp, synthetic construct
  source 1..18: mol_type = other DNA
taatactattcactatcg

SEQ ID NO: 9933 - DNA, 18 bp, synthetic construct
  source 1..18: mol_type = other DNA
taatatcacacactatag

SEQ ID NO: 9934 - DNA, 18 bp, synthetic construct
  source 1..18: mol_type = other DNA
taatgagactcacaatag

SEQ ID NO: 9935 - DNA, 18 bp, synthetic construct
  source 1..18: mol_type = other DNA
tatcacgactcgctatag

SEQ ID NO: 9936 - DNA, 18 bp, synthetic construct
  source 1..18: mol_type = other DNA
tattacgaatcactacag

SEQ ID NO: 9937 - DNA, 18 bp, synthetic construct
  source 1..18: mol_type = other DNA
tattacgactcaccacag

SEQ ID NO: 9938 - DNA, 18 bp, synthetic construct
  source 1..18: mol_type = other DNA
tcatacgactcaataaag

SEQ ID NO: 9939 - DNA, 18 bp, synthetic construct
  source 1..18: mol_type = other DNA
tcatacgtctcgctatag

SEQ ID NO: 9940 - DNA, 18 bp, synthetic construct
  source 1..18: mol_type = other DNA
tgatacaactcactaaag

SEQ ID NO: 9941 - DNA, 18 bp, synthetic construct
  source 1..18: mol_type = other DNA
ttaaacgactgactatag

SEQ ID NO: 9942 - DNA, 18 bp, synthetic construct
  source 1..18: mol_type = other DNA
taattcgacactctatag

SEQ ID NO: 9943 - DNA, 18 bp, synthetic construct
  source 1..18: mol_type = other DNA
taatacaactcataatag

SEQ ID NO: 9944 - DNA, 18 bp, synthetic construct
  source 1..18: mol_type = other DNA
taatacgacttacaattg

SEQ ID NO: 9945 - DNA, 18 bp, synthetic construct
  source 1..18: mol_type = other DNA
aaatacgactcattaaag

SEQ ID NO: 9946 - DNA, 18 bp, synthetic construct
  source 1..18: mol_type = other DNA
agatactactcactatag

SEQ ID NO: 9947 - DNA, 18 bp, synthetic construct
  source 1..18: mol_type = other DNA
taatacaattcattatag

SEQ ID NO: 9948 - DNA, 18 bp, synthetic construct
  source 1..18: mol_type = other DNA
taatacgacacaccttag

SEQ ID NO: 9949 - DNA, 18 bp, synthetic construct
  source 1..18: mol_type = other DNA
taatacgtctctctatgg

SEQ ID NO: 9950 - DNA, 18 bp, synthetic construct
  source 1..18: mol_type = other DNA
taatacgtttcactatcg

SEQ ID NO: 9951 - DNA, 18 bp, synthetic construct
  source 1..18: mol_type = other DNA
taattcaacttactatag

SEQ ID NO: 9952 - DNA, 18 bp, synthetic construct
  source 1..18: mol_type = other DNA
tattacctctcactatag

SEQ ID NO: 9953 - DNA, 18 bp, synthetic construct
  source 1..18: mol_type = other DNA
taatactactctctttag

SEQ ID NO: 9954 - DNA, 18 bp, synthetic construct
  source 1..18: mol_type = other DNA
tactacgactctctttag

SEQ ID NO: 9955 - DNA, 18 bp, synthetic construct
  source 1..18: mol_type = other DNA
ttatcctactcactatag

SEQ ID NO: 9956 - DNA, 18 bp, synthetic construct
  source 1..18: mol_type = other DNA
tattacaattcactatag

SEQ ID NO: 9957 - DNA, 18 bp, synthetic construct
  source 1..18: mol_type = other DNA
ttaaacgattcactatag

SEQ ID NO: 9958 - DNA, 18 bp, synthetic construct
  source 1..18: mol_type = other DNA
aaatacgactctctattg

SEQ ID NO: 9959 - DNA, 18 bp, synthetic construct
  source 1..18: mol_type = other DNA
taaaacgattcacaatag

SEQ ID NO: 9960 - DNA, 18 bp, synthetic construct
  source 1..18: mol_type = other DNA
aactacgactcactaaag

SEQ ID NO: 9961 - DNA, 18 bp, synthetic construct
  source 1..18: mol_type = other DNA
taataagactcactatta

SEQ ID NO: 9962 - DNA, 18 bp, synthetic construct
  source 1..18: mol_type = other DNA
taatacaacttactttag

SEQ ID NO: 9963 - DNA, 18 bp, synthetic construct
  source 1..18: mol_type = other DNA
taatacgacatattatag

SEQ ID NO: 9964 - DNA, 18 bp, synthetic construct
  source 1..18: mol_type = other DNA
tagtactactcacaatag

SEQ ID NO: 9965 - DNA, 18 bp, synthetic construct
  source 1..18: mol_type = other DNA
tattacgtctgactatag

SEQ ID NO: 9966 - DNA, 18 bp, synthetic construct
  source 1..18: mol_type = other DNA
aaatacgactttctatag

SEQ ID NO: 9967 - DNA, 18 bp, synthetic construct
  source 1..18: mol_type = other DNA
taatacgtctcgctttag

SEQ ID NO: 9968 - DNA, 18 bp, synthetic construct
  source 1..18: mol_type = other DNA
taatactactcaatttag

SEQ ID NO: 9969 - DNA, 18 bp, synthetic construct
  source 1..18: mol_type = other DNA
tagtacgactcacaaaag

SEQ ID NO: 9970 - DNA, 18 bp, synthetic construct
  source 1..18: mol_type = other DNA
ttacacgtctcactatag

SEQ ID NO: 9971 - DNA, 18 bp, synthetic construct
  source 1..18: mol_type = other DNA
ttatacgactaacaatag

SEQ ID NO: 9972 - DNA, 18 bp, synthetic construct
  source 1..18: mol_type = other DNA
gattacgactcactttag

SEQ ID NO: 9973 - DNA, 18 bp, synthetic construct
  source 1..18: mol_type = other DNA
taacatgacacactatag

SEQ ID NO: 9974 - DNA, 18 bp, synthetic construct
  source 1..18: mol_type = other DNA
taataagactctctacag

SEQ ID NO: 9975 - DNA, 18 bp, synthetic construct
  source 1..18: mol_type = other DNA
taatacgactaacaatcg

SEQ ID NO: 9976 - DNA, 18 bp, synthetic construct
  source 1..18: mol_type = other DNA
taatacgactccataaag

SEQ ID NO: 9977 - DNA, 18 bp, synthetic construct
  source 1..18: mol_type = other DNA
taatactactcactaacg

SEQ ID NO: 9978 - DNA, 18 bp, synthetic construct
  source 1..18: mol_type = other DNA
taataggtctcaatatag

SEQ ID NO: 9979 - DNA, 18 bp, synthetic construct
  source 1..18: mol_type = other DNA
tactacacctcactatag

SEQ ID NO: 9980 - DNA, 18 bp, synthetic construct
  source 1..18: mol_type = other DNA
tagtacaacacactatag

SEQ ID NO: 9981 - DNA, 18 bp, synthetic construct
  source 1..18: mol_type = other DNA
tcattccactcactatag

SEQ ID NO: 9982 - DNA, 18 bp, synthetic construct
  source 1..18: mol_type = other DNA
ttatacgaatgactatag

SEQ ID NO: 9983 - DNA, 18 bp, synthetic construct
  source 1..18: mol_type = other DNA
aaatacgactccatatag

SEQ ID NO: 9984 - DNA, 18 bp, synthetic construct
  source 1..18: mol_type = other DNA
aaatacgcctcgctatag

SEQ ID NO: 9985 - DNA, 18 bp, synthetic construct
  source 1..18: mol_type = other DNA
aaatgcgactcaatatag

SEQ ID NO: 9986 - DNA, 18 bp, synthetic construct
  source 1..18: mol_type = other DNA
aagtacgactcaccatag

SEQ ID NO: 9987 - DNA, 18 bp, synthetic construct
  source 1..18: mol_type = other DNA
caatacgaatcactgtag

SEQ ID NO: 9988 - DNA, 18 bp, synthetic construct
  source 1..18: mol_type = other DNA
caatgcgactcaatatag

SEQ ID NO: 9989 - DNA, 18 bp, synthetic construct
  source 1..18: mol_type = other DNA
gaatacgaataactatag

SEQ ID NO: 9990 - DNA, 18 bp, synthetic construct
  source 1..18: mol_type = other DNA
taaaacgaagcactatag

SEQ ID NO: 9991 - DNA, 18 bp, synthetic construct
  source 1..18: mol_type = other DNA
taacacgacgctctatag

SEQ ID NO: 9992 - DNA, 18 bp, synthetic construct
  source 1..18: mol_type = other DNA
taacacgactaattatag

SEQ ID NO: 9993 - DNA, 18 bp, synthetic construct
  source 1..18: mol_type = other DNA
taacacgtgtcactatag

SEQ ID NO: 9994 - DNA, 18 bp, synthetic construct
  source 1..18: mol_type = other DNA
taacactactcactatgg

SEQ ID NO: 9995 - DNA, 18 bp, synthetic construct
  source 1..18: mol_type = other DNA
taacgagactcactatag

SEQ ID NO: 9996 - DNA, 18 bp, synthetic construct
  source 1..18: mol_type = other DNA
taataagcctcaccatag

SEQ ID NO: 9997 - DNA, 18 bp, synthetic construct
  source 1..18: mol_type = other DNA
taataccactcactcaag

SEQ ID NO: 9998 - DNA, 18 bp, synthetic construct
  source 1..18: mol_type = other DNA
taataccactctctgtag

SEQ ID NO: 9999 - DNA, 18 bp, synthetic construct
  source 1..18: mol_type = other DNA
taataccacttcctatag

SEQ ID NO: 10000 - DNA, 18 bp, synthetic construct
  source 1..18: mol_type = other DNA
taatacctcgcactatag

SEQ ID NO: 10001 - DNA, 18 bp, synthetic construct
  source 1..18: mol_type = other DNA
taatacgaatcagtctag

SEQ ID NO: 10002 - DNA, 18 bp, synthetic construct
  source 1..18: mol_type = other DNA
taatacgacatactctag

SEQ ID NO: 10003 - DNA, 18 bp, synthetic construct
  source 1..18: mol_type = other DNA
taatacgactaattagag

SEQ ID NO: 10004 - DNA, 18 bp, synthetic construct
  source 1..18: mol_type = other DNA
taatacgactcaccatta

SEQ ID NO: 10005 - DNA, 18 bp, synthetic construct
  source 1..18: mol_type = other DNA
taatacgactccatatcg

SEQ ID NO: 10006 - DNA, 18 bp, synthetic construct
  source 1..18: mol_type = other DNA
taatacgatgcactattg

SEQ ID NO: 10007 - DNA, 18 bp, synthetic construct
  source 1..18: mol_type = other DNA
taatacgccttaatatag

SEQ ID NO: 10008 - DNA, 18 bp, synthetic construct
  source 1..18: mol_type = other DNA
taatacgccttgctatag

SEQ ID NO: 10009 - DNA, 18 bp, synthetic construct
  source 1..18: mol_type = other DNA
taatacgcgacactatag

SEQ ID NO: 10010 - DNA, 18 bp, synthetic construct
  source 1..18: mol_type = other DNA
taatacgcttcactatgg

SEQ ID NO: 10011 - DNA, 18 bp, synthetic construct
  source 1..18: mol_type = other DNA
taatacgtatcactatcg

SEQ ID NO: 10012 - DNA, 18 bp, synthetic construct
  source 1..18: mol_type = other DNA
taatactacttactgtag

SEQ ID NO: 10013 - DNA, 18 bp, synthetic construct
  source 1..18: mol_type = other DNA
taataggacccactttag

SEQ ID NO: 10014 - DNA, 18 bp, synthetic construct
  source 1..18: mol_type = other DNA
taatccaactcaccatag

SEQ ID NO: 10015 - DNA, 18 bp, synthetic construct
  source 1..18: mol_type = other DNA
taatccgacacactatgg

SEQ ID NO: 10016 - DNA, 18 bp, synthetic construct
  source 1..18: mol_type = other DNA
taatccgacacattatag

SEQ ID NO: 10017 - DNA, 18 bp, synthetic construct
  source 1..18: mol_type = other DNA
taatgagactcattatag

SEQ ID NO: 10018 - DNA, 18 bp, synthetic construct
  source 1..18: mol_type = other DNA
taatgccacacactatag

SEQ ID NO: 10019 - DNA, 18 bp, synthetic construct
  source 1..18: mol_type = other DNA
taatgcgacttactctag

SEQ ID NO: 10020 - DNA, 18 bp, synthetic construct
  source 1..18: mol_type = other DNA
taattcgagtccctatag

SEQ ID NO: 10021 - DNA, 18 bp, synthetic construct
  source 1..18: mol_type = other DNA
tactaagactcactaaag

SEQ ID NO: 10022 - DNA, 18 bp, synthetic construct
  source 1..18: mol_type = other DNA
tagtacgactaactttag

SEQ ID NO: 10023 - DNA, 18 bp, synthetic construct
  source 1..18: mol_type = other DNA
tagtacgactccttatag

SEQ ID NO: 10024 - DNA, 18 bp, synthetic construct
  source 1..18: mol_type = other DNA
tagtacgactgactaaag

SEQ ID NO: 10025 - DNA, 18 bp, synthetic construct
  source 1..18: mol_type = other DNA
tagtacgtctgactatag

SEQ ID NO: 10026 - DNA, 18 bp, synthetic construct
  source 1..18: mol_type = other DNA
tagtatgactcaccatag

SEQ ID NO: 10027 - DNA, 18 bp, synthetic construct
  source 1..18: mol_type = other DNA
tatgaccactcactatag

SEQ ID NO: 10028 - DNA, 18 bp, synthetic construct
  source 1..18: mol_type = other DNA
tattactgctcactatag

SEQ ID NO: 10029 - DNA, 18 bp, synthetic construct
  source 1..18: mol_type = other DNA
tgaaacgactcactatgg

SEQ ID NO: 10030 - DNA, 18 bp, synthetic construct
  source 1..18: mol_type = other DNA
tgatacgactgactattg

SEQ ID NO: 10031 - DNA, 18 bp, synthetic construct
  source 1..18: mol_type = other DNA
tgatacgtctcactagag

SEQ ID NO: 10032 - DNA, 18 bp, synthetic construct
  source 1..18: mol_type = other DNA
ttataccactcaccatag

SEQ ID NO: 10033 - DNA, 18 bp, synthetic construct
  source 1..18: mol_type = other DNA
ttatacgactccctatcg

SEQ ID NO: 10034 - DNA, 18 bp, synthetic construct
  source 1..18: mol_type = other DNA
taataaatctcactatag

SEQ ID NO: 10035 - DNA, 18 bp, synthetic construct
  source 1..18: mol_type = other DNA
taatactacacaatatag

SEQ ID NO: 10036 - DNA, 18 bp, synthetic construct
  source 1..18: mol_type = other DNA
ttatacgacatactatag

SEQ ID NO: 10037 - DNA, 18 bp, synthetic construct
  source 1..18: mol_type = other DNA
taaaattactcactatag

SEQ ID NO: 10038 - DNA, 18 bp, synthetic construct
  source 1..18: mol_type = other DNA
taatacatctaactatag

SEQ ID NO: 10039 - DNA, 18 bp, synthetic construct
  source 1..18: mol_type = other DNA
ttatacgactcactgaag

SEQ ID NO: 10040 - DNA, 18 bp, synthetic construct
  source 1..18: mol_type = other DNA
aattacgactgactatag

SEQ ID NO: 10041 - DNA, 18 bp, synthetic construct
  source 1..18: mol_type = other DNA
taatacgtctctctgtag

SEQ ID NO: 10042 - DNA, 18 bp, synthetic construct
  source 1..18: mol_type = other DNA
taattagactcaccatag

SEQ ID NO: 10043 - DNA, 18 bp, synthetic construct
  source 1..18: mol_type = other DNA
taattctactcattatag

SEQ ID NO: 10044 - DNA, 18 bp, synthetic construct
  source 1..18: mol_type = other DNA
tagtacaactcactttag

SEQ ID NO: 10045 - DNA, 18 bp, synthetic construct
  source 1..18: mol_type = other DNA
acatacgactcactttag

SEQ ID NO: 10046 - DNA, 18 bp, synthetic construct
  source 1..18: mol_type = other DNA
taatacgatttacaatag

SEQ ID NO: 10047 - DNA, 18 bp, synthetic construct
  source 1..18: mol_type = other DNA
tataacgactctctatag

SEQ ID NO: 10048 - DNA, 18 bp, synthetic construct
  source 1..18: mol_type = other DNA
taataagactctcaatag

SEQ ID NO: 10049 - DNA, 18 bp, synthetic construct
  source 1..18: mol_type = other DNA
taatacgactaactttgg

SEQ ID NO: 10050 - DNA, 18 bp, synthetic construct
  source 1..18: mol_type = other DNA
taattctacttactatag

SEQ ID NO: 10051 - DNA, 18 bp, synthetic construct
  source 1..18: mol_type = other DNA
aaataagactcaccatag

SEQ ID NO: 10052 - DNA, 18 bp, synthetic construct
  source 1..18: mol_type = other DNA
aaatactactcactgtag

SEQ ID NO: 10053 - DNA, 18 bp, synthetic construct
  source 1..18: mol_type = other DNA
aagtacgactcactattg

SEQ ID NO: 10054 - DNA, 18 bp, synthetic construct
  source 1..18: mol_type = other DNA
caatacgtcttactatag

SEQ ID NO: 10055 - DNA, 18 bp, synthetic construct
  source 1..18: mol_type = other DNA
taaaaccacttactatag

SEQ ID NO: 10056 - DNA, 18 bp, synthetic construct
  source 1..18: mol_type = other DNA
taacacgacttactttag

SEQ ID NO: 10057 - DNA, 18 bp, synthetic construct
  source 1..18: mol_type = other DNA
taataatacttactatag

SEQ ID NO: 10058 - DNA, 18 bp, synthetic construct
  source 1..18: mol_type = other DNA
taatacgacacattatcg

SEQ ID NO: 10059 - DNA, 18 bp, synthetic construct
  source 1..18: mol_type = other DNA
taatacgactcaacaaag

SEQ ID NO: 10060 - DNA, 18 bp, synthetic construct
  source 1..18: mol_type = other DNA
taatacgactctcaagag

SEQ ID NO: 10061 - DNA, 18 bp, synthetic construct
  source 1..18: mol_type = other DNA
taatacgactctcgttag

SEQ ID NO: 10062 - DNA, 18 bp, synthetic construct
  source 1..18: mol_type = other DNA
taatacgtatcactgtag

SEQ ID NO: 10063 - DNA, 18 bp, synthetic construct
  source 1..18: mol_type = other DNA
taatacgtctccctaaag

SEQ ID NO: 10064 - DNA, 18 bp, synthetic construct
  source 1..18: mol_type = other DNA
taattcgaataactatag

SEQ ID NO: 10065 - DNA, 18 bp, synthetic construct
  source 1..18: mol_type = other DNA
tactaggactcacaatag

SEQ ID NO: 10066 - DNA, 18 bp, synthetic construct
  source 1..18: mol_type = other DNA
tagtacgactgactattg

SEQ ID NO: 10067 - DNA, 18 bp, synthetic construct
  source 1..18: mol_type = other DNA
tcatacaactcactttag

SEQ ID NO: 10068 - DNA, 18 bp, synthetic construct
  source 1..18: mol_type = other DNA
tcatacgattcactattg

SEQ ID NO: 10069 - DNA, 18 bp, synthetic construct
  source 1..18: mol_type = other DNA
ttataaggctcactatag

SEQ ID NO: 10070 - DNA, 18 bp, synthetic construct
  source 1..18: mol_type = other DNA
taataagattctctatag

SEQ ID NO: 10071 - DNA, 18 bp, synthetic construct
  source 1..18: mol_type = other DNA
taatatgactcacaaaag

SEQ ID NO: 10072 - DNA, 18 bp, synthetic construct
  source 1..18: mol_type = other DNA
taatacgtcttactaaag

SEQ ID NO: 10073 - DNA, 18 bp, synthetic construct
  source 1..18: mol_type = other DNA
taaaacgactcacagtag

SEQ ID NO: 10074 - DNA, 18 bp, synthetic construct
  source 1..18: mol_type = other DNA
taaaacgactgactttag

SEQ ID NO: 10075 - DNA, 18 bp, synthetic construct
  source 1..18: mol_type = other DNA
taataaaacacactatag

SEQ ID NO: 10076 - DNA, 18 bp, synthetic construct
  source 1..18: mol_type = other DNA
taatactaattactatag

SEQ ID NO: 10077 - DNA, 18 bp, synthetic construct
  source 1..18: mol_type = other DNA
tattacgattcgctatag

SEQ ID NO: 10078 - DNA, 18 bp, synthetic construct
  source 1..18: mol_type = other DNA
tcattcgactcactttag

SEQ ID NO: 10079 - DNA, 18 bp, synthetic construct
  source 1..18: mol_type = other DNA
taatacaattctctatag

SEQ ID NO: 10080 - DNA, 18 bp, synthetic construct
  source 1..18: mol_type = other DNA
tattacgacttacaatag

SEQ ID NO: 10081 - DNA, 18 bp, synthetic construct
  source 1..18: mol_type = other DNA
taatacgtctctctattg

SEQ ID NO: 10082 - DNA, 18 bp, synthetic construct
  source 1..18: mol_type = other DNA
ttatacgactcaatttag

SEQ ID NO: 10083 - DNA, 18 bp, synthetic construct
  source 1..18: mol_type = other DNA
aaatacgactctctacag

SEQ ID NO: 10084 - DNA, 18 bp, synthetic construct
  source 1..18: mol_type = other DNA
aaatactactcactattg

SEQ ID NO: 10085 - DNA, 18 bp, synthetic construct
  source 1..18: mol_type = other DNA
taatacgaatttctatag

SEQ ID NO: 10086 - DNA, 18 bp, synthetic construct
  source 1..18: mol_type = other DNA
taatttgacacactatag

SEQ ID NO: 10087 - DNA, 18 bp, synthetic construct
  source 1..18: mol_type = other DNA
aaatactactaactatag

SEQ ID NO: 10088 - DNA, 18 bp, synthetic construct
  source 1..18: mol_type = other DNA
taatacgacactccatag

SEQ ID NO: 10089 - DNA, 18 bp, synthetic construct
  source 1..18: mol_type = other DNA
tactacgactatctatag

SEQ ID NO: 10090 - DNA, 18 bp, synthetic construct
  source 1..18: mol_type = other DNA
ttatacgacccacaatag

SEQ ID NO: 10091 - DNA, 18 bp, synthetic construct
  source 1..18: mol_type = other DNA
aaatacgactcatcatag

SEQ ID NO: 10092 - DNA, 18 bp, synthetic construct
  source 1..18: mol_type = other DNA
caatacgactcattattg

SEQ ID NO: 10093 - DNA, 18 bp, synthetic construct
  source 1..18: mol_type = other DNA
taaaatgactaactatag

SEQ ID NO: 10094 - DNA, 18 bp, synthetic construct
  source 1..18: mol_type = other DNA
taagacgacactctatag

SEQ ID NO: 10095 - DNA, 18 bp, synthetic construct
  source 1..18: mol_type = other DNA
taataagactcagtttag

SEQ ID NO: 10096 - DNA, 18 bp, synthetic construct
  source 1..18: mol_type = other DNA
taataccactctctacag

SEQ ID NO: 10097 - DNA, 18 bp, synthetic construct
  source 1..18: mol_type = other DNA
taatacgattctctgtag

SEQ ID NO: 10098 - DNA, 18 bp, synthetic construct
  source 1..18: mol_type = other DNA
taatacggcttactaaag

SEQ ID NO: 10099 - DNA, 18 bp, synthetic construct
  source 1..18: mol_type = other DNA
taatccaactcacaatag

SEQ ID NO: 10100 - DNA, 18 bp, synthetic construct
  source 1..18: mol_type = other DNA
taatccgactctttatag

SEQ ID NO: 10101 - DNA, 18 bp, synthetic construct
  source 1..18: mol_type = other DNA
taattcgcctcacaatag

SEQ ID NO: 10102 - DNA, 18 bp, synthetic construct
  source 1..18: mol_type = other DNA
tagtacgacacacaatag

SEQ ID NO: 10103 - DNA, 18 bp, synthetic construct
  source 1..18: mol_type = other DNA
tattactactcgctatag

SEQ ID NO: 10104 - DNA, 18 bp, synthetic construct
  source 1..18: mol_type = other DNA
aaataagagtcactatag

SEQ ID NO: 10105 - DNA, 18 bp, synthetic construct
  source 1..18: mol_type = other DNA
aaatatcactcactatag

SEQ ID NO: 10106 - DNA, 18 bp, synthetic construct
  source 1..18: mol_type = other DNA
acgtacgactcactatag

SEQ ID NO: 10107 - DNA, 18 bp, synthetic construct
  source 1..18: mol_type = other DNA
caatacgacgctctatag

SEQ ID NO: 10108 - DNA, 18 bp, synthetic construct
  source 1..18: mol_type = other DNA
cgttacgactcactatag

SEQ ID NO: 10109 - DNA, 18 bp, synthetic construct
  source 1..18: mol_type = other DNA
gtatacggctcactatag

SEQ ID NO: 10110 - DNA, 18 bp, synthetic construct
  source 1..18: mol_type = other DNA
taaaacgacacacgatag

SEQ ID NO: 10111 - DNA, 18 bp, synthetic construct
  source 1..18: mol_type = other DNA
taacacaactcaccatag

SEQ ID NO: 10112 - DNA, 18 bp, synthetic construct
  source 1..18: mol_type = other DNA
taacacgactcccaatag

SEQ ID NO: 10113 - DNA, 18 bp, synthetic construct
  source 1..18: mol_type = other DNA
taacccgtctcactatag

SEQ ID NO: 10114 - DNA, 18 bp, synthetic construct
  source 1..18: mol_type = other DNA
taactcgactcactacag

SEQ ID NO: 10115 - DNA, 18 bp, synthetic construct
  source 1..18: mol_type = other DNA
taagacgactcattttag

SEQ ID NO: 10116 - DNA, 18 bp, synthetic construct
  source 1..18: mol_type = other DNA
taataagacccattatag

SEQ ID NO: 10117 - DNA, 18 bp, synthetic construct
  source 1..18: mol_type = other DNA
taataagtctcagtatag

SEQ ID NO: 10118 - DNA, 18 bp, synthetic construct
  source 1..18: mol_type = other DNA
taataccaatcaccatag

SEQ ID NO: 10119 - DNA, 18 bp, synthetic construct
  source 1..18: mol_type = other DNA
taataccattaactatag

SEQ ID NO: 10120 - DNA, 18 bp, synthetic construct
  source 1..18: mol_type = other DNA
taatacctctcactatgg

SEQ ID NO: 10121 - DNA, 18 bp, synthetic construct
  source 1..18: mol_type = other DNA
taatacgactgacaatgg

SEQ ID NO: 10122 - DNA, 18 bp, synthetic construct
  source 1..18: mol_type = other DNA
taatacgacttgctttag

SEQ ID NO: 10123 - DNA, 18 bp, synthetic construct
  source 1..18: mol_type = other DNA
taatacgagtcacttcag

SEQ ID NO: 10124 - DNA, 18 bp, synthetic construct
  source 1..18: mol_type = other DNA
taatacgagtcatcatag

SEQ ID NO: 10125 - DNA, 18 bp, synthetic construct
  source 1..18: mol_type = other DNA
taatacgatgctctatag

SEQ ID NO: 10126 - DNA, 18 bp, synthetic construct
  source 1..18: mol_type = other DNA
taatacgattaactctag

SEQ ID NO: 10127 - DNA, 18 bp, synthetic construct
  source 1..18: mol_type = other DNA
taatacggctaactttag

SEQ ID NO: 10128 - DNA, 18 bp, synthetic construct
  source 1..18: mol_type = other DNA
taatacgtctaagtatag

SEQ ID NO: 10129 - DNA, 18 bp, synthetic construct
  source 1..18: mol_type = other DNA
taatactccttactatag

SEQ ID NO: 10130 - DNA, 18 bp, synthetic construct
  source 1..18: mol_type = other DNA
taatagcactcactatgg

SEQ ID NO: 10131 - DNA, 18 bp, synthetic construct
  source 1..18: mol_type = other DNA
taatatggcacactatag

SEQ ID NO: 10132 - DNA, 18 bp, synthetic construct
  source 1..18: mol_type = other DNA
taatccgactaacaatag

SEQ ID NO: 10133 - DNA, 18 bp, synthetic construct
  source 1..18: mol_type = other DNA
taatcctacccactatag

SEQ ID NO: 10134 - DNA, 18 bp, synthetic construct
  source 1..18: mol_type = other DNA
taatgcgaataactatag

SEQ ID NO: 10135 - DNA, 18 bp, synthetic construct
  source 1..18: mol_type = other DNA
taattcgacctactatag

SEQ ID NO: 10136 - DNA, 18 bp, synthetic construct
  source 1..18: mol_type = other DNA
tactacgacacactatgg

SEQ ID NO: 10137 - DNA, 18 bp, synthetic construct
  source 1..18: mol_type = other DNA
tactacgactcaccaaag

SEQ ID NO: 10138 - DNA, 18 bp, synthetic construct
  source 1..18: mol_type = other DNA
tactacgtcttactatag

SEQ ID NO: 10139 - DNA, 18 bp, synthetic construct
  source 1..18: mol_type = other DNA
tactactactcgctatag

SEQ ID NO: 10140 - DNA, 18 bp, synthetic construct
  source 1..18: mol_type = other DNA
tagtaccactcacaatag

SEQ ID NO: 10141 - DNA, 18 bp, synthetic construct
  source 1..18: mol_type = other DNA
tagtacgactcacgaaag

SEQ ID NO: 10142 - DNA, 18 bp, synthetic construct
  source 1..18: mol_type = other DNA
tagtatcactcactatag

SEQ ID NO: 10143 - DNA, 18 bp, synthetic construct
  source 1..18: mol_type = other DNA
tagttggactcactatag

SEQ ID NO: 10144 - DNA, 18 bp, synthetic construct
  source 1..18: mol_type = other DNA
tcaaacgcctcactatag

SEQ ID NO: 10145 - DNA, 18 bp, synthetic construct
  source 1..18: mol_type = other DNA
tcatatgactctctatag

SEQ ID NO: 10146 - DNA, 18 bp, synthetic construct
  source 1..18: mol_type = other DNA
tgatacgattccctatag

SEQ ID NO: 10147 - DNA, 18 bp, synthetic construct
  source 1..18: mol_type = other DNA
ttacacgagtcactatag

SEQ ID NO: 10148 - DNA, 18 bp, synthetic construct
  source 1..18: mol_type = other DNA
ttataccactcacgatag

SEQ ID NO: 10149 - DNA, 18 bp, synthetic construct
  source 1..18: mol_type = other DNA
taatacgactatctattg

SEQ ID NO: 10150 - DNA, 18 bp, synthetic construct
  source 1..18: mol_type = other DNA
taatacgactcataaaag

SEQ ID NO: 10151 - DNA, 18 bp, synthetic construct
  source 1..18: mol_type = other DNA
taatacttctaactatag

SEQ ID NO: 10152 - DNA, 18 bp, synthetic construct
  source 1..18: mol_type = other DNA
taatacgtctcattattg

SEQ ID NO: 10153 - DNA, 18 bp, synthetic construct
  source 1..18: mol_type = other DNA
tataacgacacactatag

SEQ ID NO: 10154 - DNA, 18 bp, synthetic construct
  source 1..18: mol_type = other DNA
caatacgactcacattag

SEQ ID NO: 10155 - DNA, 18 bp, synthetic construct
  source 1..18: mol_type = other DNA
taatatgacacactattg

SEQ ID NO: 10156 - DNA, 18 bp, synthetic construct
  source 1..18: mol_type = other DNA
tattatgactcacaatag

SEQ ID NO: 10157 - DNA, 18 bp, synthetic construct
  source 1..18: mol_type = other DNA
caatacgattctctatag

SEQ ID NO: 10158 - DNA, 18 bp, synthetic construct
  source 1..18: mol_type = other DNA
taatacgactaacattag

SEQ ID NO: 10159 - DNA, 18 bp, synthetic construct
  source 1..18: mol_type = other DNA
tcatacgactaactattg

SEQ ID NO: 10160 - DNA, 18 bp, synthetic construct
  source 1..18: mol_type = other DNA
ttttacgactccctatag

SEQ ID NO: 10161 - DNA, 18 bp, synthetic construct
  source 1..18: mol_type = other DNA
taaaacatctcactatag

SEQ ID NO: 10162 - DNA, 18 bp, synthetic construct
  source 1..18: mol_type = other DNA
taatacgactttctattg

SEQ ID NO: 10163 - DNA, 18 bp, synthetic construct
  source 1..18: mol_type = other DNA
ttatacgactctcaatag

SEQ ID NO: 10164 - DNA, 18 bp, synthetic construct
  source 1..18: mol_type = other DNA
tattacgactaattatag

SEQ ID NO: 10165 - DNA, 18 bp, synthetic construct
  source 1..18: mol_type = other DNA
ttatacaaatcactatag

SEQ ID NO: 10166 - DNA, 18 bp, synthetic construct
  source 1..18: mol_type = other DNA
taacacgtctcaatatag

SEQ ID NO: 10167 - DNA, 18 bp, synthetic construct
  source 1..18: mol_type = other DNA
taatacaactgactttag

SEQ ID NO: 10168 - DNA, 18 bp, synthetic construct
  source 1..18: mol_type = other DNA
taatacgactcacgtaag

SEQ ID NO: 10169 - DNA, 18 bp, synthetic construct
  source 1..18: mol_type = other DNA
taatacgacttcctattg

SEQ ID NO: 10170 - DNA, 18 bp, synthetic construct
  source 1..18: mol_type = other DNA
taatacgcctcattaaag

SEQ ID NO: 10171 - DNA, 18 bp, synthetic construct
  source 1..18: mol_type = other DNA
taatacgccttactattg

SEQ ID NO: 10172 - DNA, 18 bp, synthetic construct
  source 1..18: mol_type = other DNA
taatacgtcttactatcg

SEQ ID NO: 10173 - DNA, 18 bp, synthetic construct
  source 1..18: mol_type = other DNA
taataggaatcactttag

SEQ ID NO: 10174 - DNA, 18 bp, synthetic construct
  source 1..18: mol_type = other DNA
tcatacaactcactaaag

SEQ ID NO: 10175 - DNA, 18 bp, synthetic construct
  source 1..18: mol_type = other DNA
ttgtacgacacactatag

SEQ ID NO: 10176 - DNA, 18 bp, synthetic construct
  source 1..18: mol_type = other DNA
ttatacgtttcactatag

SEQ ID NO: 10177 - DNA, 18 bp, synthetic construct
  source 1..18: mol_type = other DNA
tattacgagtcacaatag

SEQ ID NO: 10178 - DNA, 18 bp, synthetic construct
  source 1..18: mol_type = other DNA
taatacaacacaccatag

SEQ ID NO: 10179 - DNA, 18 bp, synthetic construct
  source 1..18: mol_type = other DNA
taatattactcactattg

SEQ ID NO: 10180 - DNA, 18 bp, synthetic construct
  source 1..18: mol_type = other DNA
tactacgtctctctatag

SEQ ID NO: 10181 - DNA, 18 bp, synthetic construct
  source 1..18: mol_type = other DNA
aaatacgactcattttag

SEQ ID NO: 10182 - DNA, 18 bp, synthetic construct
  source 1..18: mol_type = other DNA
taaaacgattcactttag

SEQ ID NO: 10183 - DNA, 18 bp, synthetic construct
  source 1..18: mol_type = other DNA
ttttaccactcactatag

SEQ ID NO: 10184 - DNA, 18 bp, synthetic construct
  source 1..18: mol_type = other DNA
taaaatgactcactttag

SEQ ID NO: 10185 - DNA, 18 bp, synthetic construct
  source 1..18: mol_type = other DNA
taatacgactcccttttg

SEQ ID NO: 10186 - DNA, 18 bp, synthetic construct
  source 1..18: mol_type = other DNA
taatacgattcacaatcg

SEQ ID NO: 10187 - DNA, 18 bp, synthetic construct
  source 1..18: mol_type = other DNA
taatatgactcataatag

SEQ ID NO: 10188 - DNA, 18 bp, synthetic construct
  source 1..18: mol_type = other DNA
tattacgacttactacag

SEQ ID NO: 10189 - DNA, 18 bp, synthetic construct
  source 1..18: mol_type = other DNA
tgatacgactctcaatag

SEQ ID NO: 10190 - DNA, 18 bp, synthetic construct
  source 1..18: mol_type = other DNA
caatacaactctctatag

SEQ ID NO: 10191 - DNA, 18 bp, synthetic construct
  source 1..18: mol_type = other DNA
aaatacgactcacaacag

SEQ ID NO: 10192 - DNA, 18 bp, synthetic construct
  source 1..18: mol_type = other DNA
taaaacgacccacaatag

SEQ ID NO: 10193 - DNA, 18 bp, synthetic construct
  source 1..18: mol_type = other DNA
taaaacgacttgctatag

SEQ ID NO: 10194 - DNA, 18 bp, synthetic construct
  source 1..18: mol_type = other DNA
taataaaaatcactatag

SEQ ID NO: 10195 - DNA, 18 bp, synthetic construct
  source 1..18: mol_type = other DNA
taataaaactcaatatag

SEQ ID NO: 10196 - DNA, 18 bp, synthetic construct
  source 1..18: mol_type = other DNA
taatacgactttctgtag

SEQ ID NO: 10197 - DNA, 18 bp, synthetic construct
  source 1..18: mol_type = other DNA
taatgcgactaactattg

SEQ ID NO: 10198 - DNA, 18 bp, synthetic construct
  source 1..18: mol_type = other DNA
taattcaactcaccatag

SEQ ID NO: 10199 - DNA, 18 bp, synthetic construct
  source 1..18: mol_type = other DNA
tagtacgactcattttag

SEQ ID NO: 10200 - DNA, 18 bp, synthetic construct
  source 1..18: mol_type = other DNA
tagtatgactcactaaag

SEQ ID NO: 10201 - DNA, 18 bp, synthetic construct
  source 1..18: mol_type = other DNA
tattacgactcaacatag

SEQ ID NO: 10202 - DNA, 18 bp, synthetic construct
  source 1..18: mol_type = other DNA
tattacgacttactatcg

SEQ ID NO: 10203 - DNA, 18 bp, synthetic construct
  source 1..18: mol_type = other DNA
tattacgtctccctatag

SEQ ID NO: 10204 - DNA, 18 bp, synthetic construct
  source 1..18: mol_type = other DNA
tattatgactcaccatag

SEQ ID NO: 10205 - DNA, 18 bp, synthetic construct
  source 1..18: mol_type = other DNA
tcatacgaatctctatag

SEQ ID NO: 10206 - DNA, 18 bp, synthetic construct
  source 1..18: mol_type = other DNA
ttatacaacccactatag

SEQ ID NO: 10207 - DNA, 18 bp, synthetic construct
  source 1..18: mol_type = other DNA
aaaaacgactgactatag

SEQ ID NO: 10208 - DNA, 18 bp, synthetic construct
  source 1..18: mol_type = other DNA
aaacacgactcactattg

SEQ ID NO: 10209 - DNA, 18 bp, synthetic construct
  source 1..18: mol_type = other DNA
aaatacgagtgactatag

SEQ ID NO: 10210 - DNA, 18 bp, synthetic construct
  source 1..18: mol_type = other DNA
aaatatgactgactatag

SEQ ID NO: 10211 - DNA, 18 bp, synthetic construct
  source 1..18: mol_type = other DNA
atatacgactcacgatag

SEQ ID NO: 10212 - DNA, 18 bp, synthetic construct
  source 1..18: mol_type = other DNA
caatacgattcactacag

SEQ ID NO: 10213 - DNA, 18 bp, synthetic construct
  source 1..18: mol_type = other DNA
caatactaatcactatag

SEQ ID NO: 10214 - DNA, 18 bp, synthetic construct
  source 1..18: mol_type = other DNA
caatatgacttactatag

SEQ ID NO: 10215 - DNA, 18 bp, synthetic construct
  source 1..18: mol_type = other DNA
caatccgactctctatag

SEQ ID NO: 10216 - DNA, 18 bp, synthetic construct
  source 1..18: mol_type = other DNA
cagaacgactcactatag

SEQ ID NO: 10217 - DNA, 18 bp, synthetic construct
  source 1..18: mol_type = other DNA
taaaacaactcagtatag

SEQ ID NO: 10218 - DNA, 18 bp, synthetic construct
  source 1..18: mol_type = other DNA
taaaacgtcgcactatag

SEQ ID NO: 10219 - DNA, 18 bp, synthetic construct
  source 1..18: mol_type = other DNA
taacacgaatcactaaag

SEQ ID NO: 10220 - DNA, 18 bp, synthetic construct
  source 1..18: mol_type = other DNA
taacactactaactatag

SEQ ID NO: 10221 - DNA, 18 bp, synthetic construct
  source 1..18: mol_type = other DNA
taactcgacccactatag

SEQ ID NO: 10222 - DNA, 18 bp, synthetic construct
  source 1..18: mol_type = other DNA
taagacgaattactatag

SEQ ID NO: 10223 - DNA, 18 bp, synthetic construct
  source 1..18: mol_type = other DNA
taatacaagtaactatag

SEQ ID NO: 10224 - DNA, 18 bp, synthetic construct
  source 1..18: mol_type = other DNA
taataccacccactttag

SEQ ID NO: 10225 - DNA, 18 bp, synthetic construct
  source 1..18: mol_type = other DNA
taatacgacatagtatag

SEQ ID NO: 10226 - DNA, 18 bp, synthetic construct
  source 1..18: mol_type = other DNA
taatacgacgcactcttg

SEQ ID NO: 10227 - DNA, 18 bp, synthetic construct
  source 1..18: mol_type = other DNA
taatacgactaacgattg

SEQ ID NO: 10228 - DNA, 18 bp, synthetic construct
  source 1..18: mol_type = other DNA
taatacgactacatatag

SEQ ID NO: 10229 - DNA, 18 bp, synthetic construct
  source 1..18: mol_type = other DNA
taatacgactgtgtatag

SEQ ID NO: 10230 - DNA, 18 bp, synthetic construct
  source 1..18: mol_type = other DNA
taatacgacttaatagag

SEQ ID NO: 10231 - DNA, 18 bp, synthetic construct
  source 1..18: mol_type = other DNA
taatacgacttaccacag

SEQ ID NO: 10232 - DNA, 18 bp, synthetic construct
  source 1..18: mol_type = other DNA
taatacgacttattgtag

SEQ ID NO: 10233 - DNA, 18 bp, synthetic construct
  source 1..18: mol_type = other DNA
taatacgatacactagag

SEQ ID NO: 10234 - DNA, 18 bp, synthetic construct
  source 1..18: mol_type = other DNA
taatacggcacactgtag

SEQ ID NO: 10235 - DNA, 18 bp, synthetic construct
  source 1..18: mol_type = other DNA
taataggactcattgtag

SEQ ID NO: 10236 - DNA, 18 bp, synthetic construct
  source 1..18: mol_type = other DNA
taatataacccactatag

SEQ ID NO: 10237 - DNA, 18 bp, synthetic construct
  source 1..18: mol_type = other DNA
taatatcactcaatatag

SEQ ID NO: 10238 - DNA, 18 bp, synthetic construct
  source 1..18: mol_type = other DNA
taatatgactgactatgg

SEQ ID NO: 10239 - DNA, 18 bp, synthetic construct
  source 1..18: mol_type = other DNA
taatatggcttactatag

SEQ ID NO: 10240 - DNA, 18 bp, synthetic construct
  source 1..18: mol_type = other DNA
taatcggtctcactatag

SEQ ID NO: 10241 - DNA, 18 bp, synthetic construct
  source 1..18: mol_type = other DNA
taatgcgacgaactatag

SEQ ID NO: 10242 - DNA, 18 bp, synthetic construct
  source 1..18: mol_type = other DNA
taatgcgactcacaacag

SEQ ID NO: 10243 - DNA, 18 bp, synthetic construct
  source 1..18: mol_type = other DNA
taatgcgattaactatag

SEQ ID NO: 10244 - DNA, 18 bp, synthetic construct
  source 1..18: mol_type = other DNA
taatgtgagtcactatag

SEQ ID NO: 10245 - DNA, 18 bp, synthetic construct
  source 1..18: mol_type = other DNA
taattcggctccctatag

SEQ ID NO: 10246 - DNA, 18 bp, synthetic construct
  source 1..18: mol_type = other DNA
tactacgacccaccatag

SEQ ID NO: 10247 - DNA, 18 bp, synthetic construct
  source 1..18: mol_type = other DNA
tactacgcctcacaatag

SEQ ID NO: 10248 - DNA, 18 bp, synthetic construct
  source 1..18: mol_type = other DNA
tactacgcttcactatag

SEQ ID NO: 10249 - DNA, 18 bp, synthetic construct
  source 1..18: mol_type = other DNA
tagtacgactcaatattg

SEQ ID NO: 10250 - DNA, 18 bp, synthetic construct
  source 1..18: mol_type = other DNA
tcatacaactcaatatag

SEQ ID NO: 10251 - DNA, 18 bp, synthetic construct
  source 1..18: mol_type = other DNA
tcatacgaatgactatag

SEQ ID NO: 10252 - DNA, 18 bp, synthetic construct
  source 1..18: mol_type = other DNA
tcatacgactcccaatag

SEQ ID NO: 10253 - DNA, 18 bp, synthetic construct
  source 1..18: mol_type = other DNA
ttagacgactcaatatag

SEQ ID NO: 10254 - DNA, 18 bp, synthetic construct
  source 1..18: mol_type = other DNA
ttagacgattcactatag

SEQ ID NO: 10255 - DNA, 18 bp, synthetic construct
  source 1..18: mol_type = other DNA
ttatacgactggctatag

SEQ ID NO: 10256 - DNA, 18 bp, synthetic construct
  source 1..18: mol_type = other DNA
ttatactacgcactatag

SEQ ID NO: 10257 - DNA, 18 bp, synthetic construct
  source 1..18: mol_type = other DNA
taaaacgacatactatag

SEQ ID NO: 10258 - DNA, 18 bp, synthetic construct
  source 1..18: mol_type = other DNA
taatacaactctatatag

SEQ ID NO: 10259 - DNA, 18 bp, synthetic construct
  source 1..18: mol_type = other DNA
taatacctcacactatag

SEQ ID NO: 10260 - DNA, 18 bp, synthetic construct
  source 1..18: mol_type = other DNA
ttatactactcactatcg

SEQ ID NO: 10261 - DNA, 18 bp, synthetic construct
  source 1..18: mol_type = other DNA
taacacaacacactatag

SEQ ID NO: 10262 - DNA, 18 bp, synthetic construct
  source 1..18: mol_type = other DNA
taattagactcaatatag

SEQ ID NO: 10263 - DNA, 18 bp, synthetic construct
  source 1..18: mol_type = other DNA
taatatttctcactatag

SEQ ID NO: 10264 - DNA, 18 bp, synthetic construct
  source 1..18: mol_type = other DNA
tattacgaatcactttag

SEQ ID NO: 10265 - DNA, 18 bp, synthetic construct
  source 1..18: mol_type = other DNA
taatacgaatctctattg

SEQ ID NO: 10266 - DNA, 18 bp, synthetic construct
  source 1..18: mol_type = other DNA
taatacgtcccactttag

SEQ ID NO: 10267 - DNA, 18 bp, synthetic construct
  source 1..18: mol_type = other DNA
tattacaactcaatatag

SEQ ID NO: 10268 - DNA, 18 bp, synthetic construct
  source 1..18: mol_type = other DNA
aactacgactctctatag

SEQ ID NO: 10269 - DNA, 18 bp, synthetic construct
  source 1..18: mol_type = other DNA
caatacgacacacaatag

SEQ ID NO: 10270 - DNA, 18 bp, synthetic construct
  source 1..18: mol_type = other DNA
caatatgactcactattg

SEQ ID NO: 10271 - DNA, 18 bp, synthetic construct
  source 1..18: mol_type = other DNA
cattacgattcactatag

SEQ ID NO: 10272 - DNA, 18 bp, synthetic construct
  source 1..18: mol_type = other DNA
cattacggctcactatag

SEQ ID NO: 10273 - DNA, 18 bp, synthetic construct
  source 1..18: mol_type = other DNA
taaaacgactaacaatag

SEQ ID NO: 10274 - DNA, 18 bp, synthetic construct
  source 1..18: mol_type = other DNA
taagactactcactattg

SEQ ID NO: 10275 - DNA, 18 bp, synthetic construct
  source 1..18: mol_type = other DNA
taatacgacacacttcag

SEQ ID NO: 10276 - DNA, 18 bp, synthetic construct
  source 1..18: mol_type = other DNA
taatacgactctttctag

SEQ ID NO: 10277 - DNA, 18 bp, synthetic construct
  source 1..18: mol_type = other DNA
taatacgactgtctttag

SEQ ID NO: 10278 - DNA, 18 bp, synthetic construct
  source 1..18: mol_type = other DNA
taatattactcattatag

SEQ ID NO: 10279 - DNA, 18 bp, synthetic construct
  source 1..18: mol_type = other DNA
taatccgaatcactttag

SEQ ID NO: 10280 - DNA, 18 bp, synthetic construct
  source 1..18: mol_type = other DNA
taatccgattcactattg

SEQ ID NO: 10281 - DNA, 18 bp, synthetic construct
  source 1..18: mol_type = other DNA
taattcgactaactctag

SEQ ID NO: 10282 - DNA, 18 bp, synthetic construct
  source 1..18: mol_type = other DNA
tactacaactcaatatag

SEQ ID NO: 10283 - DNA, 18 bp, synthetic construct
  source 1..18: mol_type = other DNA
tactaccactcactaaag

SEQ ID NO: 10284 - DNA, 18 bp, synthetic construct
  source 1..18: mol_type = other DNA
tattacggctcacaatag

SEQ ID NO: 10285 - DNA, 18 bp, synthetic construct
  source 1..18: mol_type = other DNA
tgatatgaatcactatag

SEQ ID NO: 10286 - DNA, 18 bp, synthetic construct
  source 1..18: mol_type = other DNA
ttatacagctcactatag

SEQ ID NO: 10287 - DNA, 18 bp, synthetic construct
  source 1..18: mol_type = other DNA
taatacgtctctctttag

SEQ ID NO: 10288 - DNA, 18 bp, synthetic construct
  source 1..18: mol_type = other DNA
caattcgacacactatag

SEQ ID NO: 10289 - DNA, 18 bp, synthetic construct
  source 1..18: mol_type = other DNA
taacacgacatactatag

SEQ ID NO: 10290 - DNA, 18 bp, synthetic construct
  source 1..18: mol_type = other DNA
taatacgtctcactgaag

SEQ ID NO: 10291 - DNA, 18 bp, synthetic construct
  source 1..18: mol_type = other DNA
ttatacgattcactttag

SEQ ID NO: 10292 - DNA, 18 bp, synthetic construct
  source 1..18: mol_type = other DNA
tcatacgactcacttttg

SEQ ID NO: 10293 - DNA, 18 bp, synthetic construct
  source 1..18: mol_type = other DNA
tcatacgactctctattg

SEQ ID NO: 10294 - DNA, 18 bp, synthetic construct
  source 1..18: mol_type = other DNA
ttaaacgactctctatag

SEQ ID NO: 10295 - DNA, 18 bp, synthetic construct
  source 1..18: mol_type = other DNA
taatacgacaccctttag

SEQ ID NO: 10296 - DNA, 18 bp, synthetic construct
  source 1..18: mol_type = other DNA
taatatgactcaatattg

SEQ ID NO: 10297 - DNA, 18 bp, synthetic construct
  source 1..18: mol_type = other DNA
taacacgtctctctatag

SEQ ID NO: 10298 - DNA, 18 bp, synthetic construct
  source 1..18: mol_type = other DNA
taatacgaatcattattg

SEQ ID NO: 10299 - DNA, 18 bp, synthetic construct
  source 1..18: mol_type = other DNA
taatacgactcaaattag

SEQ ID NO: 10300 - DNA, 18 bp, synthetic construct
  source 1..18: mol_type = other DNA
ttgtacgactctctatag

SEQ ID NO: 10301 - DNA, 18 bp, synthetic construct
  source 1..18: mol_type = other DNA
aaatacaactaactatag

SEQ ID NO: 10302 - DNA, 18 bp, synthetic construct
  source 1..18: mol_type = other DNA
aaatcagactcactatag

SEQ ID NO: 10303 - DNA, 18 bp, synthetic construct
  source 1..18: mol_type = other DNA
acataagactcactatag

SEQ ID NO: 10304 - DNA, 18 bp, synthetic construct
  source 1..18: mol_type = other DNA
caatacgacttattatag

SEQ ID NO: 10305 - DNA, 18 bp, synthetic construct
  source 1..18: mol_type = other DNA
taatacgacagtctatag

SEQ ID NO: 10306 - DNA, 18 bp, synthetic construct
  source 1..18: mol_type = other DNA
tacaacgactaactatag

SEQ ID NO: 10307 - DNA, 18 bp, synthetic construct
  source 1..18: mol_type = other DNA
tactacgaatcactttag

SEQ ID NO: 10308 - DNA, 18 bp, synthetic construct
  source 1..18: mol_type = other DNA
tattacgattccctatag

SEQ ID NO: 10309 - DNA, 18 bp, synthetic construct
  source 1..18: mol_type = other DNA
tcatacatctcactatag

SEQ ID NO: 10310 - DNA, 18 bp, synthetic construct
  source 1..18: mol_type = other DNA
aaatacgactcattgtag

SEQ ID NO: 10311 - DNA, 18 bp, synthetic construct
  source 1..18: mol_type = other DNA
caatacgactcgttatag

SEQ ID NO: 10312 - DNA, 18 bp, synthetic construct
  source 1..18: mol_type = other DNA
taaaaccactgactatag

SEQ ID NO: 10313 - DNA, 18 bp, synthetic construct
  source 1..18: mol_type = other DNA
taacaagcctcactatag

SEQ ID NO: 10314 - DNA, 18 bp, synthetic construct
  source 1..18: mol_type = other DNA
taacacgaatcaatatag

SEQ ID NO: 10315 - DNA, 18 bp, synthetic construct
  source 1..18: mol_type = other DNA
taacacgactctcgatag

SEQ ID NO: 10316 - DNA, 18 bp, synthetic construct
  source 1..18: mol_type = other DNA
taacacgagttactatag

SEQ ID NO: 10317 - DNA, 18 bp, synthetic construct
  source 1..18: mol_type = other DNA
taacaggactcactaaag

SEQ ID NO: 10318 - DNA, 18 bp, synthetic construct
  source 1..18: mol_type = other DNA
taacgtgactcactatag

SEQ ID NO: 10319 - DNA, 18 bp, synthetic construct
  source 1..18: mol_type = other DNA
taataagactaaatatag

SEQ ID NO: 10320 - DNA, 18 bp, synthetic construct
  source 1..18: mol_type = other DNA
taataagccttactatag

SEQ ID NO: 10321 - DNA, 18 bp, synthetic construct
  source 1..18: mol_type = other DNA
taatacaagtcaccatag

SEQ ID NO: 10322 - DNA, 18 bp, synthetic construct
  source 1..18: mol_type = other DNA
taatacaattcactctag

SEQ ID NO: 10323 - DNA, 18 bp, synthetic construct
  source 1..18: mol_type = other DNA
taataccactcactctcg

SEQ ID NO: 10324 - DNA, 18 bp, synthetic construct
  source 1..18: mol_type = other DNA
taatacctgtcactatag

SEQ ID NO: 10325 - DNA, 18 bp, synthetic construct
  source 1..18: mol_type = other DNA
taatacgactcgcactag

SEQ ID NO: 10326 - DNA, 18 bp, synthetic construct
  source 1..18: mol_type = other DNA
taatacgactcgccttag

SEQ ID NO: 10327 - DNA, 18 bp, synthetic construct
  source 1..18: mol_type = other DNA
taatactactgaccatag

SEQ ID NO: 10328 - DNA, 18 bp, synthetic construct
  source 1..18: mol_type = other DNA
taatactacttagtatag

SEQ ID NO: 10329 - DNA, 18 bp, synthetic construct
  source 1..18: mol_type = other DNA
taatccgactcacaatgg

SEQ ID NO: 10330 - DNA, 18 bp, synthetic construct
  source 1..18: mol_type = other DNA
tactacagctcactatag

SEQ ID NO: 10331 - DNA, 18 bp, synthetic construct
  source 1..18: mol_type = other DNA
tacttcgactcactatgg

SEQ ID NO: 10332 - DNA, 18 bp, synthetic construct
  source 1..18: mol_type = other DNA
tagtacgactcgctgtag

SEQ ID NO: 10333 - DNA, 18 bp, synthetic construct
  source 1..18: mol_type = other DNA
tattacgaatcagtatag

SEQ ID NO: 10334 - DNA, 18 bp, synthetic construct
  source 1..18: mol_type = other DNA
tattacgactcgatatag

SEQ ID NO: 10335 - DNA, 18 bp, synthetic construct
  source 1..18: mol_type = other DNA
tcatacgacaccctatag

SEQ ID NO: 10336 - DNA, 18 bp, synthetic construct
  source 1..18: mol_type = other DNA
tcatacgattaactatag

SEQ ID NO: 10337 - DNA, 18 bp, synthetic construct
  source 1..18: mol_type = other DNA
tcatacgattcactctag

SEQ ID NO: 10338 - DNA, 18 bp, synthetic construct
  source 1..18: mol_type = other DNA
tgacactactcactatag

SEQ ID NO: 10339 - DNA, 18 bp, synthetic construct
  source 1..18: mol_type = other DNA
tgatacaagtcactatag

SEQ ID NO: 10340 - DNA, 18 bp, synthetic construct
  source 1..18: mol_type = other DNA
tgatacgaatcactatcg

SEQ ID NO: 10341 - DNA, 18 bp, synthetic construct
  source 1..18: mol_type = other DNA
tgatacgactaattatag

SEQ ID NO: 10342 - DNA, 18 bp, synthetic construct
  source 1..18: mol_type = other DNA
tgatacgactcacaatgg

SEQ ID NO: 10343 - DNA, 18 bp, synthetic construct
  source 1..18: mol_type = other DNA
tgatacgtctcaatatag

SEQ ID NO: 10344 - DNA, 18 bp, synthetic construct
  source 1..18: mol_type = other DNA
ttatacgactaactatgg

SEQ ID NO: 10345 - DNA, 18 bp, synthetic construct
  source 1..18: mol_type = other DNA
taatacgtctgtctatag

SEQ ID NO: 10346 - DNA, 18 bp, synthetic construct
  source 1..18: mol_type = other DNA
taatatgtttcactatag

SEQ ID NO: 10347 - DNA, 18 bp, synthetic construct
  source 1..18: mol_type = other DNA
taattcgactcattattg

SEQ ID NO: 10348 - DNA, 18 bp, synthetic construct
  source 1..18: mol_type = other DNA
aaaaacaactcactatag

SEQ ID NO: 10349 - DNA, 18 bp, synthetic construct
  source 1..18: mol_type = other DNA
aaatacgactcaccaaag

SEQ ID NO: 10350 - DNA, 18 bp, synthetic construct
  source 1..18: mol_type = other DNA
taaaacgactaactacag

SEQ ID NO: 10351 - DNA, 18 bp, synthetic construct
  source 1..18: mol_type = other DNA
taaaacgacttacaatag

SEQ ID NO: 10352 - DNA, 18 bp, synthetic construct
  source 1..18: mol_type = other DNA
taataagacttacaatag

SEQ ID NO: 10353 - DNA, 18 bp, synthetic construct
  source 1..18: mol_type = other DNA
taatacaatacactatag

SEQ ID NO: 10354 - DNA, 18 bp, synthetic construct
  source 1..18: mol_type = other DNA
taatactactcactcaag

SEQ ID NO: 10355 - DNA, 18 bp, synthetic construct
  source 1..18: mol_type = other DNA
tcatacgactcattattg

SEQ ID NO: 10356 - DNA, 18 bp, synthetic construct
  source 1..18: mol_type = other DNA
ttataagactcacaatag

SEQ ID NO: 10357 - DNA, 18 bp, synthetic construct
  source 1..18: mol_type = other DNA
ttatacgattcactattg

SEQ ID NO: 10358 - DNA, 18 bp, synthetic construct
  source 1..18: mol_type = other DNA
taatatgattcacaatag

SEQ ID NO: 10359 - DNA, 18 bp, synthetic construct
  source 1..18: mol_type = other DNA
taatattactcactaaag

SEQ ID NO: 10360 - DNA, 18 bp, synthetic construct
  source 1..18: mol_type = other DNA
tcattcgtctcactatag

SEQ ID NO: 10361 - DNA, 18 bp, synthetic construct
  source 1..18: mol_type = other DNA
aaatacctctcactatag

SEQ ID NO: 10362 - DNA, 18 bp, synthetic construct
  source 1..18: mol_type = other DNA
ctatacgacttactatag

SEQ ID NO: 10363 - DNA, 18 bp, synthetic construct
  source 1..18: mol_type = other DNA
taacaccactctctatag

SEQ ID NO: 10364 - DNA, 18 bp, synthetic construct
  source 1..18: mol_type = other DNA
taatacgacaagctatag

SEQ ID NO: 10365 - DNA, 18 bp, synthetic construct
  source 1..18: mol_type = other DNA
taatacgactcgtaatag

SEQ ID NO: 10366 - DNA, 18 bp, synthetic construct
  source 1..18: mol_type = other DNA
taatacgagtttctatag

SEQ ID NO: 10367 - DNA, 18 bp, synthetic construct
  source 1..18: mol_type = other DNA
taatactactcacgaaag

SEQ ID NO: 10368 - DNA, 18 bp, synthetic construct
  source 1..18: mol_type = other DNA
taatccgtctcattatag

SEQ ID NO: 10369 - DNA, 18 bp, synthetic construct
  source 1..18: mol_type = other DNA
taatgcgactcattaaag

SEQ ID NO: 10370 - DNA, 18 bp, synthetic construct
  source 1..18: mol_type = other DNA
tagtaagactctctatag

SEQ ID NO: 10371 - DNA, 18 bp, synthetic construct
  source 1..18: mol_type = other DNA
ttatacaactcaccatag

SEQ ID NO: 10372 - DNA, 18 bp, synthetic construct
  source 1..18: mol_type = other DNA
ttatccgaatcactatag

SEQ ID NO: 10373 - DNA, 18 bp, synthetic construct
  source 1..18: mol_type = other DNA
ttatccgacttactatag

SEQ ID NO: 10374 - DNA, 18 bp, synthetic construct
  source 1..18: mol_type = other DNA
taatacgtccctctatag

SEQ ID NO: 10375 - DNA, 18 bp, synthetic construct
  source 1..18: mol_type = other DNA
ttatacgactccctttag

SEQ ID NO: 10376 - DNA, 18 bp, synthetic construct
  source 1..18: mol_type = other DNA
tattacgactctctacag

SEQ ID NO: 10377 - DNA, 18 bp, synthetic construct
  source 1..18: mol_type = other DNA
ttataccactctctatag

SEQ ID NO: 10378 - DNA, 18 bp, synthetic construct
  source 1..18: mol_type = other DNA
taattcgacatactatag

SEQ ID NO: 10379 - DNA, 18 bp, synthetic construct
  source 1..18: mol_type = other DNA
ttatacgactcacattag

SEQ ID NO: 10380 - DNA, 18 bp, synthetic construct
  source 1..18: mol_type = other DNA
ttatacgaatcactaaag

SEQ ID NO: 10381 - DNA, 18 bp, synthetic construct
  source 1..18: mol_type = other DNA
taatactacacactaaag

SEQ ID NO: 10382 - DNA, 18 bp, synthetic construct
  source 1..18: mol_type = other DNA
aaatacgacaaactatag

SEQ ID NO: 10383 - DNA, 18 bp, synthetic construct
  source 1..18: mol_type = other DNA
taatacgacacagtaaag

SEQ ID NO: 10384 - DNA, 18 bp, synthetic construct
  source 1..18: mol_type = other DNA
taatacgacttattaaag

SEQ ID NO: 10385 - DNA, 18 bp, synthetic construct
  source 1..18: mol_type = other DNA
ataaacgactcactatag

SEQ ID NO: 10386 - DNA, 18 bp, synthetic construct
  source 1..18: mol_type = other DNA
taaaacgtctaactatag

SEQ ID NO: 10387 - DNA, 18 bp, synthetic construct
  source 1..18: mol_type = other DNA
caatacgatttactatag

SEQ ID NO: 10388 - DNA, 18 bp, synthetic construct
  source 1..18: mol_type = other DNA
cattacgactcattatag

SEQ ID NO: 10389 - DNA, 18 bp, synthetic construct
  source 1..18: mol_type = other DNA
gaatacgactctcaatag

SEQ ID NO: 10390 - DNA, 18 bp, synthetic construct
  source 1..18: mol_type = other DNA
taaaacgattaactatag

SEQ ID NO: 10391 - DNA, 18 bp, synthetic construct
  source 1..18: mol_type = other DNA
tagtacgattcaatatag

SEQ ID NO: 10392 - DNA, 18 bp, synthetic construct
  source 1..18: mol_type = other DNA
tagtactacacactatag

SEQ ID NO: 10393 - DNA, 18 bp, synthetic construct
  source 1..18: mol_type = other DNA
tataacgactgactatag

SEQ ID NO: 10394 - DNA, 18 bp, synthetic construct
  source 1..18: mol_type = other DNA
tattacgactcattacag

SEQ ID NO: 10395 - DNA, 18 bp, synthetic construct
  source 1..18: mol_type = other DNA
tgatacgatacactatag

SEQ ID NO: 10396 - DNA, 18 bp, synthetic construct
  source 1..18: mol_type = other DNA
aaagacgactcactaaag

SEQ ID NO: 10397 - DNA, 18 bp, synthetic construct
  source 1..18: mol_type = other DNA
aaataccactcattatag

SEQ ID NO: 10398 - DNA, 18 bp, synthetic construct
  source 1..18: mol_type = other DNA
aaataggactcaatatag

SEQ ID NO: 10399 - DNA, 18 bp, synthetic construct
  source 1..18: mol_type = other DNA
aaatatgactcagtatag

SEQ ID NO: 10400 - DNA, 18 bp, synthetic construct
  source 1..18: mol_type = other DNA
caatatgactcgctatag

SEQ ID NO: 10401 - DNA, 18 bp, synthetic construct
  source 1..18: mol_type = other DNA
caatccgaatcactatag

SEQ ID NO: 10402 - DNA, 18 bp, synthetic construct
  source 1..18: mol_type = other DNA
taaaacggcacactatag

SEQ ID NO: 10403 - DNA, 18 bp, synthetic construct
  source 1..18: mol_type = other DNA
taaaaggactcaccatag

SEQ ID NO: 10404 - DNA, 18 bp, synthetic construct
  source 1..18: mol_type = other DNA
taaagcgacccactatag

SEQ ID NO: 10405 - DNA, 18 bp, synthetic construct
  source 1..18: mol_type = other DNA
taacacgactcacattag

SEQ ID NO: 10406 - DNA, 18 bp, synthetic construct
  source 1..18: mol_type = other DNA
taacacgactcataatag

SEQ ID NO: 10407 - DNA, 18 bp, synthetic construct
  source 1..18: mol_type = other DNA
taacacgtctcagtatag

SEQ ID NO: 10408 - DNA, 18 bp, synthetic construct
  source 1..18: mol_type = other DNA
taagacgactcacaaaag

SEQ ID NO: 10409 - DNA, 18 bp, synthetic construct
  source 1..18: mol_type = other DNA
taagacgcctcactattg

SEQ ID NO: 10410 - DNA, 18 bp, synthetic construct
  source 1..18: mol_type = other DNA
taagataactcactatag

SEQ ID NO: 10411 - DNA, 18 bp, synthetic construct
  source 1..18: mol_type = other DNA
taataagacagactatag

SEQ ID NO: 10412 - DNA, 18 bp, synthetic construct
  source 1..18: mol_type = other DNA
taataagacgcactaaag

SEQ ID NO: 10413 - DNA, 18 bp, synthetic construct
  source 1..18: mol_type = other DNA
taataagcctcaatatag

SEQ ID NO: 10414 - DNA, 18 bp, synthetic construct
  source 1..18: mol_type = other DNA
taataatactcactgtag

SEQ ID NO: 10415 - DNA, 18 bp, synthetic construct
  source 1..18: mol_type = other DNA
taataccagtcattatag

SEQ ID NO: 10416 - DNA, 18 bp, synthetic construct
  source 1..18: mol_type = other DNA
taatacgaaccactaaag

SEQ ID NO: 10417 - DNA, 18 bp, synthetic construct
  source 1..18: mol_type = other DNA
taatacgaatcagaatag

SEQ ID NO: 10418 - DNA, 18 bp, synthetic construct
  source 1..18: mol_type = other DNA
taatacgacaccctgtag

SEQ ID NO: 10419 - DNA, 18 bp, synthetic construct
  source 1..18: mol_type = other DNA
taatacgactaagtattg

SEQ ID NO: 10420 - DNA, 18 bp, synthetic construct
  source 1..18: mol_type = other DNA
taatacgactcactttcc

SEQ ID NO: 10421 - DNA, 18 bp, synthetic construct
  source 1..18: mol_type = other DNA
taatacggctaattatag

SEQ ID NO: 10422 - DNA, 18 bp, synthetic construct
  source 1..18: mol_type = other DNA
taatacggcttactacag

SEQ ID NO: 10423 - DNA, 18 bp, synthetic construct
  source 1..18: mol_type = other DNA
taatacgtctcactatta

SEQ ID NO: 10424 - DNA, 18 bp, synthetic construct
  source 1..18: mol_type = other DNA
taatacgtcttcctatag

SEQ ID NO: 10425 - DNA, 18 bp, synthetic construct
  source 1..18: mol_type = other DNA
taatactacttactctag

SEQ ID NO: 10426 - DNA, 18 bp, synthetic construct
  source 1..18: mol_type = other DNA
taatccgactctatatag

SEQ ID NO: 10427 - DNA, 18 bp, synthetic construct
  source 1..18: mol_type = other DNA
taatgcgacacactctag

SEQ ID NO: 10428 - DNA, 18 bp, synthetic construct
  source 1..18: mol_type = other DNA
taccacgaatcactatag

SEQ ID NO: 10429 - DNA, 18 bp, synthetic construct
  source 1..18: mol_type = other DNA
tactaagactcaatatag

SEQ ID NO: 10430 - DNA, 18 bp, synthetic construct
  source 1..18: mol_type = other DNA
tactaccactcactattg

SEQ ID NO: 10431 - DNA, 18 bp, synthetic construct
  source 1..18: mol_type = other DNA
tagaacgactaactatag

SEQ ID NO: 10432 - DNA, 18 bp, synthetic construct
  source 1..18: mol_type = other DNA
tagtgcgactcactattg

SEQ ID NO: 10433 - DNA, 18 bp, synthetic construct
  source 1..18: mol_type = other DNA
tattacgacgcactttag

SEQ ID NO: 10434 - DNA, 18 bp, synthetic construct
  source 1..18: mol_type = other DNA
tattatgagtcactatag

SEQ ID NO: 10435 - DNA, 18 bp, synthetic construct
  source 1..18: mol_type = other DNA
tcatacctctcactatag

SEQ ID NO: 10436 - DNA, 18 bp, synthetic construct
  source 1..18: mol_type = other DNA
tcatacgactcaatgtag

SEQ ID NO: 10437 - DNA, 18 bp, synthetic construct
  source 1..18: mol_type = other DNA
tcatacgactcagtattg

SEQ ID NO: 10438 - DNA, 18 bp, synthetic construct
  source 1..18: mol_type = other DNA
tgataagactcactctag

SEQ ID NO: 10439 - DNA, 18 bp, synthetic construct
  source 1..18: mol_type = other DNA
tgatacaactaactatag

SEQ ID NO: 10440 - DNA, 18 bp, synthetic construct
  source 1..18: mol_type = other DNA
tgatacgacgcactaaag

SEQ ID NO: 10441 - DNA, 18 bp, synthetic construct
  source 1..18: mol_type = other DNA
taattctactcactttag

SEQ ID NO: 10442 - DNA, 18 bp, synthetic construct
  source 1..18: mol_type = other DNA
aaatacgaatcactttag

SEQ ID NO: 10443 - DNA, 18 bp, synthetic construct
  source 1..18: mol_type = other DNA
taatacggcacaatatag

SEQ ID NO: 10444 - DNA, 18 bp, synthetic construct
  source 1..18: mol_type = other DNA
taatatgtctcattatag

SEQ ID NO: 10445 - DNA, 18 bp, synthetic construct
  source 1..18: mol_type = other DNA
tcattcgactcactaaag

SEQ ID NO: 10446 - DNA, 18 bp, synthetic construct
  source 1..18: mol_type = other DNA
ttaaacgactaactatag

SEQ ID NO: 10447 - DNA, 18 bp, synthetic construct
  source 1..18: mol_type = other DNA
taatacgtctcaatttag

SEQ ID NO: 10448 - DNA, 18 bp, synthetic construct
  source 1..18: mol_type = other DNA
ttatacgacttactttag

SEQ ID NO: 10449 - DNA, 18 bp, synthetic construct
  source 1..18: mol_type = other DNA
aaatacgacacaccatag

SEQ ID NO: 10450 - DNA, 18 bp, synthetic construct
  source 1..18: mol_type = other DNA
aagtacgactcactaaag

SEQ ID NO: 10451 - DNA, 18 bp, synthetic construct
  source 1..18: mol_type = other DNA
taaaacgactctctctag

SEQ ID NO: 10452 - DNA, 18 bp, synthetic construct
  source 1..18: mol_type = other DNA
taataacactcactattg

SEQ ID NO: 10453 - DNA, 18 bp, synthetic construct
  source 1..18: mol_type = other DNA
taatacgactcaatactg

SEQ ID NO: 10454 - DNA, 18 bp, synthetic construct
  source 1..18: mol_type = other DNA
taatactactgactttag

SEQ ID NO: 10455 - DNA, 18 bp, synthetic construct
  source 1..18: mol_type = other DNA
taatatgacttacaatag

SEQ ID NO: 10456 - DNA, 18 bp, synthetic construct
  source 1..18: mol_type = other DNA
taatatgagtcacaatag

SEQ ID NO: 10457 - DNA, 18 bp, synthetic construct
  source 1..18: mol_type = other DNA
taattcgaccaactatag

SEQ ID NO: 10458 - DNA, 18 bp, synthetic construct
  source 1..18: mol_type = other DNA
tactactactcactaaag

SEQ ID NO: 10459 - DNA, 18 bp, synthetic construct
  source 1..18: mol_type = other DNA
tattacgagtcactaaag

SEQ ID NO: 10460 - DNA, 18 bp, synthetic construct
  source 1..18: mol_type = other DNA
ttatatgactcactatcg

SEQ ID NO: 10461 - DNA, 18 bp, synthetic construct
  source 1..18: mol_type = other DNA
caatacgattcactattg

SEQ ID NO: 10462 - DNA, 18 bp, synthetic construct
  source 1..18: mol_type = other DNA
taatataaatcactatag

SEQ ID NO: 10463 - DNA, 18 bp, synthetic construct
  source 1..18: mol_type = other DNA
taatgctactctctatag

SEQ ID NO: 10464 - DNA, 18 bp, synthetic construct
  source 1..18: mol_type = other DNA
taatacgacacaatattg

SEQ ID NO: 10465 - DNA, 18 bp, synthetic construct
  source 1..18: mol_type = other DNA
ttatacgactcaatattg

SEQ ID NO: 10466 - DNA, 18 bp, synthetic construct
  source 1..18: mol_type = other DNA
taatacgactcatttttg

SEQ ID NO: 10467 - DNA, 18 bp, synthetic construct
  source 1..18: mol_type = other DNA
taatacgtcacattatag

SEQ ID NO: 10468 - DNA, 18 bp, synthetic construct
  source 1..18: mol_type = other DNA
taatacgattctcaatag

SEQ ID NO: 10469 - DNA, 18 bp, synthetic construct
  source 1..18: mol_type = other DNA
taaaactactcattatag

SEQ ID NO: 10470 - DNA, 18 bp, synthetic construct
  source 1..18: mol_type = other DNA
taatacgtaacactatag

SEQ ID NO: 10471 - DNA, 18 bp, synthetic construct
  source 1..18: mol_type = other DNA
cattacgactcacaatag

SEQ ID NO: 10472 - DNA, 18 bp, synthetic construct
  source 1..18: mol_type = other DNA
taatacgataaactatag

SEQ ID NO: 10473 - DNA, 18 bp, synthetic construct
  source 1..18: mol_type = other DNA
taatatgaatcacaatag

SEQ ID NO: 10474 - DNA, 18 bp, synthetic construct
  source 1..18: mol_type = other DNA
tagaacgactctctatag

SEQ ID NO: 10475 - DNA, 18 bp, synthetic construct
  source 1..18: mol_type = other DNA
tattactactcaatatag

SEQ ID NO: 10476 - DNA, 18 bp, synthetic construct
  source 1..18: mol_type = other DNA
aattacgactcactatcg

SEQ ID NO: 10477 - DNA, 18 bp, synthetic construct
  source 1..18: mol_type = other DNA
taacacgactcattttag

SEQ ID NO: 10478 - DNA, 18 bp, synthetic construct
  source 1..18: mol_type = other DNA
taactcgattcactatag

SEQ ID NO: 10479 - DNA, 18 bp, synthetic construct
  source 1..18: mol_type = other DNA
taatacgactcaataagg

SEQ ID NO: 10480 - DNA, 18 bp, synthetic construct
  source 1..18: mol_type = other DNA
taatacgtcacactatgg

SEQ ID NO: 10481 - DNA, 18 bp, synthetic construct
  source 1..18: mol_type = other DNA
taattcgactcacttgag

SEQ ID NO: 10482 - DNA, 18 bp, synthetic construct
  source 1..18: mol_type = other DNA
tagtaatactcactatag

SEQ ID NO: 10483 - DNA, 18 bp, synthetic construct
  source 1..18: mol_type = other DNA
tattaggacttactatag

SEQ ID NO: 10484 - DNA, 18 bp, synthetic construct
  source 1..18: mol_type = other DNA
tattatgactaactatag

SEQ ID NO: 10485 - DNA, 18 bp, synthetic construct
  source 1..18: mol_type = other DNA
tgatacaattcactatag

SEQ ID NO: 10486 - DNA, 18 bp, synthetic construct
  source 1..18: mol_type = other DNA
ttatacgacttcctatag

SEQ ID NO: 10487 - DNA, 18 bp, synthetic construct
  source 1..18: mol_type = other DNA
aaatacgacccaatatag

SEQ ID NO: 10488 - DNA, 18 bp, synthetic construct
  source 1..18: mol_type = other DNA
agacacgactcactatag

SEQ ID NO: 10489 - DNA, 18 bp, synthetic construct
  source 1..18: mol_type = other DNA
caatacgactcagtttag

SEQ ID NO: 10490 - DNA, 18 bp, synthetic construct
  source 1..18: mol_type = other DNA
caatacgactctccatag

SEQ ID NO: 10491 - DNA, 18 bp, synthetic construct
  source 1..18: mol_type = other DNA
caatgcgacttactatag

SEQ ID NO: 10492 - DNA, 18 bp, synthetic construct
  source 1..18: mol_type = other DNA
cattacgactcactatcg

SEQ ID NO: 10493 - DNA, 18 bp, synthetic construct
  source 1..18: mol_type = other DNA
ctatacgactgactatag

SEQ ID NO: 10494 - DNA, 18 bp, synthetic construct
  source 1..18: mol_type = other DNA
gaaaacgactcactattg

SEQ ID NO: 10495 - DNA, 18 bp, synthetic construct
  source 1..18: mol_type = other DNA
gaatacgacacactattg

SEQ ID NO: 10496 - DNA, 18 bp, synthetic construct
  source 1..18: mol_type = other DNA
taaaagcactcactatag

SEQ ID NO: 10497 - DNA, 18 bp, synthetic construct
  source 1..18: mol_type = other DNA
taacacgactccctctag

SEQ ID NO: 10498 - DNA, 18 bp, synthetic construct
  source 1..18: mol_type = other DNA
taacatgactcactctag

SEQ ID NO: 10499 - DNA, 18 bp, synthetic construct
  source 1..18: mol_type = other DNA
taagatgactcactaaag

SEQ ID NO: 10500 - DNA, 18 bp, synthetic construct
  source 1..18: mol_type = other DNA
taataagacccactttag

SEQ ID NO: 10501 - DNA, 18 bp, synthetic construct
  source 1..18: mol_type = other DNA
taataaggttcactatag

SEQ ID NO: 10502 - DNA, 18 bp, synthetic construct
  source 1..18: mol_type = other DNA
taataatactcactctag

SEQ ID NO: 10503 - DNA, 18 bp, synthetic construct
  source 1..18: mol_type = other DNA
taatacaacacacgatag

SEQ ID NO: 10504 - DNA, 18 bp, synthetic construct
  source 1..18: mol_type = other DNA
taataccactcaaaatag

SEQ ID NO: 10505 - DNA, 18 bp, synthetic construct
  source 1..18: mol_type = other DNA
taatacgaatcattatgg

SEQ ID NO: 10506 - DNA, 18 bp, synthetic construct
  source 1..18: mol_type = other DNA
taatacgacaccccatag

SEQ ID NO: 10507 - DNA, 18 bp, synthetic construct
  source 1..18: mol_type = other DNA
taatacgacccactcaag

SEQ ID NO: 10508 - DNA, 18 bp, synthetic construct
  source 1..18: mol_type = other DNA
taatacgacccgctttag

SEQ ID NO: 10509 - DNA, 18 bp, synthetic construct
  source 1..18: mol_type = other DNA
taatacgaccctctatcg

SEQ ID NO: 10510 - DNA, 18 bp, synthetic construct
  source 1..18: mol_type = other DNA
taatacgacttacttgag

SEQ ID NO: 10511 - DNA, 18 bp, synthetic construct
  source 1..18: mol_type = other DNA
taatacgatacactatgg

SEQ ID NO: 10512 - DNA, 18 bp, synthetic construct
  source 1..18: mol_type = other DNA
taatacgattccctaaag

SEQ ID NO: 10513 - DNA, 18 bp, synthetic construct
  source 1..18: mol_type = other DNA
taatacggatcaatatag

SEQ ID NO: 10514 - DNA, 18 bp, synthetic construct
  source 1..18: mol_type = other DNA
taatacggctcaccaaag

SEQ ID NO: 10515 - DNA, 18 bp, synthetic construct
  source 1..18: mol_type = other DNA
taatacggctcactcaag

SEQ ID NO: 10516 - DNA, 18 bp, synthetic construct
  source 1..18: mol_type = other DNA
taatacgtctcactgcag

SEQ ID NO: 10517 - DNA, 18 bp, synthetic construct
  source 1..18: mol_type = other DNA
taatacgtctcagtaaag

SEQ ID NO: 10518 - DNA, 18 bp, synthetic construct
  source 1..18: mol_type = other DNA
taataggacttaccatag

SEQ ID NO: 10519 - DNA, 18 bp, synthetic construct
  source 1..18: mol_type = other DNA
taattccactcactagag

SEQ ID NO: 10520 - DNA, 18 bp, synthetic construct
  source 1..18: mol_type = other DNA
tactacggctcactaaag

SEQ ID NO: 10521 - DNA, 18 bp, synthetic construct
  source 1..18: mol_type = other DNA
tatcacgactccctatag

SEQ ID NO: 10522 - DNA, 18 bp, synthetic construct
  source 1..18: mol_type = other DNA
tattacgaccaactatag

SEQ ID NO: 10523 - DNA, 18 bp, synthetic construct
  source 1..18: mol_type = other DNA
tcatacgactgacaatag

SEQ ID NO: 10524 - DNA, 18 bp, synthetic construct
  source 1..18: mol_type = other DNA
tcatacgacttactacag

SEQ ID NO: 10525 - DNA, 18 bp, synthetic construct
  source 1..18: mol_type = other DNA
tcattcgactccctatag

SEQ ID NO: 10526 - DNA, 18 bp, synthetic construct
  source 1..18: mol_type = other DNA
tgatacgacccactttag

SEQ ID NO: 10527 - DNA, 18 bp, synthetic construct
  source 1..18: mol_type = other DNA
tgatacgactcactttcg

SEQ ID NO: 10528 - DNA, 18 bp, synthetic construct
  source 1..18: mol_type = other DNA
tgatatgactcattatag

SEQ ID NO: 10529 - DNA, 18 bp, synthetic construct
  source 1..18: mol_type = other DNA
aaatacgtcacactatag

SEQ ID NO: 10530 - DNA, 18 bp, synthetic construct
  source 1..18: mol_type = other DNA
taatatgtcacactatag

SEQ ID NO: 10531 - DNA, 18 bp, synthetic construct
  source 1..18: mol_type = other DNA
aaatacgtcttactatag

SEQ ID NO: 10532 - DNA, 18 bp, synthetic construct
  source 1..18: mol_type = other DNA
taataagacacactaaag

SEQ ID NO: 10533 - DNA, 18 bp, synthetic construct
  source 1..18: mol_type = other DNA
taatacaaattactatag

SEQ ID NO: 10534 - DNA, 18 bp, synthetic construct
  source 1..18: mol_type = other DNA
taatacgacatactagag

SEQ ID NO: 10535 - DNA, 18 bp, synthetic construct
  source 1..18: mol_type = other DNA
taatacgactccctaatg

SEQ ID NO: 10536 - DNA, 18 bp, synthetic construct
  source 1..18: mol_type = other DNA
taatacgtctgactattg

SEQ ID NO: 10537 - DNA, 18 bp, synthetic construct
  source 1..18: mol_type = other DNA
taatatgactcaccaaag

SEQ ID NO: 10538 - DNA, 18 bp, synthetic construct
  source 1..18: mol_type = other DNA
taatatgattcattatag

SEQ ID NO: 10539 - DNA, 18 bp, synthetic construct
  source 1..18: mol_type = other DNA
taatgcgtttcactatag

SEQ ID NO: 10540 - DNA, 18 bp, synthetic construct
  source 1..18: mol_type = other DNA
tagtacgacactctatag

SEQ ID NO: 10541 - DNA, 18 bp, synthetic construct
  source 1..18: mol_type = other DNA
tagtacgactaactaaag

SEQ ID NO: 10542 - DNA, 18 bp, synthetic construct
  source 1..18: mol_type = other DNA
tcataagactcactaaag

SEQ ID NO: 10543 - DNA, 18 bp, synthetic construct
  source 1..18: mol_type = other DNA
taatacgacacacttaag

SEQ ID NO: 10544 - DNA, 18 bp, synthetic construct
  source 1..18: mol_type = other DNA
tattactactcacaatag

SEQ ID NO: 10545 - DNA, 18 bp, synthetic construct
  source 1..18: mol_type = other DNA
aaatactactctctatag

SEQ ID NO: 10546 - DNA, 18 bp, synthetic construct
  source 1..18: mol_type = other DNA
tattacgacacactacag

SEQ ID NO: 10547 - DNA, 18 bp, synthetic construct
  source 1..18: mol_type = other DNA
taaaacgtttcactatag

SEQ ID NO: 10548 - DNA, 18 bp, synthetic construct
  source 1..18: mol_type = other DNA
taatacgacacaaaatag

SEQ ID NO: 10549 - DNA, 18 bp, synthetic construct
  source 1..18: mol_type = other DNA
ttatacgactctccatag

SEQ ID NO: 10550 - DNA, 18 bp, synthetic construct
  source 1..18: mol_type = other DNA
ttatactactcactaaag

SEQ ID NO: 10551 - DNA, 18 bp, synthetic construct
  source 1..18: mol_type = other DNA
tattactactcactattg

SEQ ID NO: 10552 - DNA, 18 bp, synthetic construct
  source 1..18: mol_type = other DNA
aaatacgactcaataaag

SEQ ID NO: 10553 - DNA, 18 bp, synthetic construct
  source 1..18: mol_type = other DNA
taatacaacacaatatag

SEQ ID NO: 10554 - DNA, 18 bp, synthetic construct
  source 1..18: mol_type = other DNA
taatcctactcactattg

SEQ ID NO: 10555 - DNA, 18 bp, synthetic construct
  source 1..18: mol_type = other DNA
ttataagaatcactatag

SEQ ID NO: 10556 - DNA, 18 bp, synthetic construct
  source 1..18: mol_type = other DNA
taaatcgacccactatag

SEQ ID NO: 10557 - DNA, 18 bp, synthetic construct
  source 1..18: mol_type = other DNA
taacaagactcactttag

SEQ ID NO: 10558 - DNA, 18 bp, synthetic construct
  source 1..18: mol_type = other DNA
taataagactctatatag

SEQ ID NO: 10559 - DNA, 18 bp, synthetic construct
  source 1..18: mol_type = other DNA
taatacaacttattatag

SEQ ID NO: 10560 - DNA, 18 bp, synthetic construct
  source 1..18: mol_type = other DNA
taatacgacaccctacag

SEQ ID NO: 10561 - DNA, 18 bp, synthetic construct
  source 1..18: mol_type = other DNA
taatacgacactctgtag

SEQ ID NO: 10562 - DNA, 18 bp, synthetic construct
  source 1..18: mol_type = other DNA
taatacggttcactattg

SEQ ID NO: 10563 - DNA, 18 bp, synthetic construct
  source 1..18: mol_type = other DNA
taatatgactctttatag

SEQ ID NO: 10564 - DNA, 18 bp, synthetic construct
  source 1..18: mol_type = other DNA
tagtatgtctcactatag

SEQ ID NO: 10565 - DNA, 18 bp, synthetic construct
  source 1..18: mol_type = other DNA
tattacgtcccactatag

SEQ ID NO: 10566 - DNA, 18 bp, synthetic construct
  source 1..18: mol_type = other DNA
tcatatgattcactatag

SEQ ID NO: 10567 - DNA, 18 bp, synthetic construct
  source 1..18: mol_type = other DNA
ttatacaactgactatag

SEQ ID NO: 10568 - DNA, 18 bp, synthetic construct
  source 1..18: mol_type = other DNA
aaacatgactcactatag

SEQ ID NO: 10569 - DNA, 18 bp, synthetic construct
  source 1..18: mol_type = other DNA
aaatacgacccagtatag

SEQ ID NO: 10570 - DNA, 18 bp, synthetic construct
  source 1..18: mol_type = other DNA
aaatacgacttaatatag

SEQ ID NO: 10571 - DNA, 18 bp, synthetic construct
  source 1..18: mol_type = other DNA
aagtacgacttactatag

SEQ ID NO: 10572 - DNA, 18 bp, synthetic construct
  source 1..18: mol_type = other DNA
taaagcgactcaccatag

SEQ ID NO: 10573 - DNA, 18 bp, synthetic construct
  source 1..18: mol_type = other DNA
taacacgacccactttag

SEQ ID NO: 10574 - DNA, 18 bp, synthetic construct
  source 1..18: mol_type = other DNA
taacaggactcacaatag

SEQ ID NO: 10575 - DNA, 18 bp, synthetic construct
  source 1..18: mol_type = other DNA
taacatgacccactatag

SEQ ID NO: 10576 - DNA, 18 bp, synthetic construct
  source 1..18: mol_type = other DNA
taacccgacacactatag

SEQ ID NO: 10577 - DNA, 18 bp, synthetic construct
  source 1..18: mol_type = other DNA
taataccactctctatcg

SEQ ID NO: 10578 - DNA, 18 bp, synthetic construct
  source 1..18: mol_type = other DNA
taatacgaatcaccacag

SEQ ID NO: 10579 - DNA, 18 bp, synthetic construct
  source 1..18: mol_type = other DNA
taatacgaccaactttag

SEQ ID NO: 10580 - DNA, 18 bp, synthetic construct
  source 1..18: mol_type = other DNA
taatacgacctactttag

SEQ ID NO: 10581 - DNA, 18 bp, synthetic construct
  source 1..18: mol_type = other DNA
taatacgacctattatag

SEQ ID NO: 10582 - DNA, 18 bp, synthetic construct
  source 1..18: mol_type = other DNA
taatacgactccttacag

SEQ ID NO: 10583 - DNA, 18 bp, synthetic construct
  source 1..18: mol_type = other DNA
taatacgactgcctttag

SEQ ID NO: 10584 - DNA, 18 bp, synthetic construct
  source 1..18: mol_type = other DNA
taatacgactgtccatag

SEQ ID NO: 10585 - DNA, 18 bp, synthetic construct
  source 1..18: mol_type = other DNA
taatacgactgtctagag

SEQ ID NO: 10586 - DNA, 18 bp, synthetic construct
  source 1..18: mol_type = other DNA
taatacgactgtctatcg

SEQ ID NO: 10587 - DNA, 18 bp, synthetic construct
  source 1..18: mol_type = other DNA
taatacgagtcactaacg

SEQ ID NO: 10588 - DNA, 18 bp, synthetic construct
  source 1..18: mol_type = other DNA
taatacgagtcactcttg

SEQ ID NO: 10589 - DNA, 18 bp, synthetic construct
  source 1..18: mol_type = other DNA
taatacgccaaactatag

SEQ ID NO: 10590 - DNA, 18 bp, synthetic construct
  source 1..18: mol_type = other DNA
taatacgccccactaaag

SEQ ID NO: 10591 - DNA, 18 bp, synthetic construct
  source 1..18: mol_type = other DNA
taatacgcttcactctag

SEQ ID NO: 10592 - DNA, 18 bp, synthetic construct
  source 1..18: mol_type = other DNA
taatacgtctcagtatcg

SEQ ID NO: 10593 - DNA, 18 bp, synthetic construct
  source 1..18: mol_type = other DNA
taatactactcatcatag

SEQ ID NO: 10594 - DNA, 18 bp, synthetic construct
  source 1..18: mol_type = other DNA
taatactcctccctatag

SEQ ID NO: 10595 - DNA, 18 bp, synthetic construct
  source 1..18: mol_type = other DNA
taataggactcacaatcg

SEQ ID NO: 10596 - DNA, 18 bp, synthetic construct
  source 1..18: mol_type = other DNA
taataggtctaactatag

SEQ ID NO: 10597 - DNA, 18 bp, synthetic construct
  source 1..18: mol_type = other DNA
taatatcactcactacag

SEQ ID NO: 10598 - DNA, 18 bp, synthetic construct
  source 1..18: mol_type = other DNA
taatatgacttaccatag

SEQ ID NO: 10599 - DNA, 18 bp, synthetic construct
  source 1..18: mol_type = other DNA
taatccgacgctctatag

SEQ ID NO: 10600 - DNA, 18 bp, synthetic construct
  source 1..18: mol_type = other DNA
taatgtgactctctatag

SEQ ID NO: 10601 - DNA, 18 bp, synthetic construct
  source 1..18: mol_type = other DNA
taattcgcctgactatag

SEQ ID NO: 10602 - DNA, 18 bp, synthetic construct
  source 1..18: mol_type = other DNA
tacaaggactcactatag

SEQ ID NO: 10603 - DNA, 18 bp, synthetic construct
  source 1..18: mol_type = other DNA
taccacgactcactgtag

SEQ ID NO: 10604 - DNA, 18 bp, synthetic construct
  source 1..18: mol_type = other DNA
tacctcgactcactatag

SEQ ID NO: 10605 - DNA, 18 bp, synthetic construct
  source 1..18: mol_type = other DNA
tactacgagttactatag

SEQ ID NO: 10606 - DNA, 18 bp, synthetic construct
  source 1..18: mol_type = other DNA
tactacgtctcactgtag

SEQ ID NO: 10607 - DNA, 18 bp, synthetic construct
  source 1..18: mol_type = other DNA
tactaggactctctatag

SEQ ID NO: 10608 - DNA, 18 bp, synthetic construct
  source 1..18: mol_type = other DNA
tagtacgacacgctatag

SEQ ID NO: 10609 - DNA, 18 bp, synthetic construct
  source 1..18: mol_type = other DNA
tagtacgattaactatag

SEQ ID NO: 10610 - DNA, 18 bp, synthetic construct
  source 1..18: mol_type = other DNA
tagttcgactgactatag

SEQ ID NO: 10611 - DNA, 18 bp, synthetic construct
  source 1..18: mol_type = other DNA
tattacgactcagtctag

SEQ ID NO: 10612 - DNA, 18 bp, synthetic construct
  source 1..18: mol_type = other DNA
tattacggctcactctag

SEQ ID NO: 10613 - DNA, 18 bp, synthetic construct
  source 1..18: mol_type = other DNA
tcacacgactaactatag

SEQ ID NO: 10614 - DNA, 18 bp, synthetic construct
  source 1..18: mol_type = other DNA
tcatacaactcgctatag

SEQ ID NO: 10615 - DNA, 18 bp, synthetic construct
  source 1..18: mol_type = other DNA
tcataccattcactatag

SEQ ID NO: 10616 - DNA, 18 bp, synthetic construct
  source 1..18: mol_type = other DNA
tcatacgtctcactgtag

SEQ ID NO: 10617 - DNA, 18 bp, synthetic construct
  source 1..18: mol_type = other DNA
tcatacgtctgactatag

SEQ ID NO: 10618 - DNA, 18 bp, synthetic construct
  source 1..18: mol_type = other DNA
tcatccgtctcactatag

SEQ ID NO: 10619 - DNA, 18 bp, synthetic construct
  source 1..18: mol_type = other DNA
tgataagactcactacag

SEQ ID NO: 10620 - DNA, 18 bp, synthetic construct
  source 1..18: mol_type = other DNA
tgataaggctcactatag

SEQ ID NO: 10621 - DNA, 18 bp, synthetic construct
  source 1..18: mol_type = other DNA
tgatacgacacgctatag

SEQ ID NO: 10622 - DNA, 18 bp, synthetic construct
  source 1..18: mol_type = other DNA
tgatacgactcacgctag

SEQ ID NO: 10623 - DNA, 18 bp, synthetic construct
  source 1..18: mol_type = other DNA
tgatccaactcactatag

SEQ ID NO: 10624 - DNA, 18 bp, synthetic construct
  source 1..18: mol_type = other DNA
ttacacgactcactatgg

SEQ ID NO: 10625 - DNA, 18 bp, synthetic construct
  source 1..18: mol_type = other DNA
ttagccgactcactatag

SEQ ID NO: 10626 - DNA, 18 bp, synthetic construct
  source 1..18: mol_type = other DNA
ttatacgacacactttag

SEQ ID NO: 10627 - DNA, 18 bp, synthetic construct
  source 1..18: mol_type = other DNA
taaaactactctctatag

SEQ ID NO: 10628 - DNA, 18 bp, synthetic construct
  source 1..18: mol_type = other DNA
ttatacgacacattatag

SEQ ID NO: 10629 - DNA, 18 bp, synthetic construct
  source 1..18: mol_type = other DNA
taatatgactcacattag

SEQ ID NO: 10630 - DNA, 18 bp, synthetic construct
  source 1..18: mol_type = other DNA
tatctcgactcactatag

SEQ ID NO: 10631 - DNA, 18 bp, synthetic construct
  source 1..18: mol_type = other DNA
taataagactttctatag

SEQ ID NO: 10632 - DNA, 18 bp, synthetic construct
  source 1..18: mol_type = other DNA
taatacgaattacaatag

SEQ ID NO: 10633 - DNA, 18 bp, synthetic construct
  source 1..18: mol_type = other DNA
taatacgactctctatta

SEQ ID NO: 10634 - DNA, 18 bp, synthetic construct
  source 1..18: mol_type = other DNA
ttattcgactcacaatag

SEQ ID NO: 10635 - DNA, 18 bp, synthetic construct
  source 1..18: mol_type = other DNA
taaatcgactcattatag

SEQ ID NO: 10636 - DNA, 18 bp, synthetic construct
  source 1..18: mol_type = other DNA
taacactacttactatag

SEQ ID NO: 10637 - DNA, 18 bp, synthetic construct
  source 1..18: mol_type = other DNA
taataagaatcaatatag

SEQ ID NO: 10638 - DNA, 18 bp, synthetic construct
  source 1..18: mol_type = other DNA
taataagagtcactttag

SEQ ID NO: 10639 - DNA, 18 bp, synthetic construct
  source 1..18: mol_type = other DNA
taatacgtcacacgatag

SEQ ID NO: 10640 - DNA, 18 bp, synthetic construct
  source 1..18: mol_type = other DNA
taatacgtctcattacag

SEQ ID NO: 10641 - DNA, 18 bp, synthetic construct
  source 1..18: mol_type = other DNA
tagtacatctcactatag

SEQ ID NO: 10642 - DNA, 18 bp, synthetic construct
  source 1..18: mol_type = other DNA
tcatacgaatcacaatag

SEQ ID NO: 10643 - DNA, 18 bp, synthetic construct
  source 1..18: mol_type = other DNA
taaaacgaatcactttag

SEQ ID NO: 10644 - DNA, 18 bp, synthetic construct
  source 1..18: mol_type = other DNA
taatacaaatcactttag

SEQ ID NO: 10645 - DNA, 18 bp, synthetic construct
  source 1..18: mol_type = other DNA
taatacttctcaccatag

SEQ ID NO: 10646 - DNA, 18 bp, synthetic construct
  source 1..18: mol_type = other DNA
taatactaatcactttag

SEQ ID NO: 10647 - DNA, 18 bp, synthetic construct
  source 1..18: mol_type = other DNA
tattaagacacactatag

SEQ ID NO: 10648 - DNA, 18 bp, synthetic construct
  source 1..18: mol_type = other DNA
tattacgacacactaaag

SEQ ID NO: 10649 - DNA, 18 bp, synthetic construct
  source 1..18: mol_type = other DNA
taaaacgattcactaaag

SEQ ID NO: 10650 - DNA, 18 bp, synthetic construct
  source 1..18: mol_type = other DNA
taaaacgaatcactattg

SEQ ID NO: 10651 - DNA, 18 bp, synthetic construct
  source 1..18: mol_type = other DNA
taattcgtttcactatag

SEQ ID NO: 10652 - DNA, 18 bp, synthetic construct
  source 1..18: mol_type = other DNA
acatacgactctctatag

SEQ ID NO: 10653 - DNA, 18 bp, synthetic construct
  source 1..18: mol_type = other DNA
atatacggctcactatag

SEQ ID NO: 10654 - DNA, 18 bp, synthetic construct
  source 1..18: mol_type = other DNA
tattacgactcacaacag

SEQ ID NO: 10655 - DNA, 18 bp, synthetic construct
  source 1..18: mol_type = other DNA
aaatacaagtcactatag

SEQ ID NO: 10656 - DNA, 18 bp, synthetic construct
  source 1..18: mol_type = other DNA
taatacatctcagtatag

SEQ ID NO: 10657 - DNA, 18 bp, synthetic construct
  source 1..18: mol_type = other DNA
taatacgactttctctag

SEQ ID NO: 10658 - DNA, 18 bp, synthetic construct
  source 1..18: mol_type = other DNA
taatacttgtcactatag

SEQ ID NO: 10659 - DNA, 18 bp, synthetic construct
  source 1..18: mol_type = other DNA
taattcgacacactgtag

SEQ ID NO: 10660 - DNA, 18 bp, synthetic construct
  source 1..18: mol_type = other DNA
ttatacgactcattatcg

SEQ ID NO: 10661 - DNA, 18 bp, synthetic construct
  source 1..18: mol_type = other DNA
aaaaccgactcactatag

SEQ ID NO: 10662 - DNA, 18 bp, synthetic construct
  source 1..18: mol_type = other DNA
aaatacgacccactttag

SEQ ID NO: 10663 - DNA, 18 bp, synthetic construct
  source 1..18: mol_type = other DNA
aaatacgacgcactaaag

SEQ ID NO: 10664 - DNA, 18 bp, synthetic construct
  source 1..18: mol_type = other DNA
aaatacgtctcacgatag

SEQ ID NO: 10665 - DNA, 18 bp, synthetic construct
  source 1..18: mol_type = other DNA
ctatacgacccactatag

SEQ ID NO: 10666 - DNA, 18 bp, synthetic construct
  source 1..18: mol_type = other DNA
ctatacgactcactatgg

SEQ ID NO: 10667 - DNA, 18 bp, synthetic construct
  source 1..18: mol_type = other DNA
ctatacgactccctatag

SEQ ID NO: 10668 - DNA, 18 bp, synthetic construct
  source 1..18: mol_type = other DNA
taaaactacccactatag

SEQ ID NO: 10669 - DNA, 18 bp, synthetic construct
  source 1..18: mol_type = other DNA
taaaactactcacgatag

SEQ ID NO: 10670 - DNA, 18 bp, synthetic construct
  source 1..18: mol_type = other DNA
taacaagactcactgtag

SEQ ID NO: 10671 - DNA, 18 bp, synthetic construct
  source 1..18: mol_type = other DNA
taacacgacacaccatag

SEQ ID NO: 10672 - DNA, 18 bp, synthetic construct
  source 1..18: mol_type = other DNA
taactcgactccctatag

SEQ ID NO: 10673 - DNA, 18 bp, synthetic construct
  source 1..18: mol_type = other DNA
taagacaactcactaaag

SEQ ID NO: 10674 - DNA, 18 bp, synthetic construct
  source 1..18: mol_type = other DNA
taataacactcactaaag

SEQ ID NO: 10675 - DNA, 18 bp, synthetic construct
  source 1..18: mol_type = other DNA
taataagacacactctag

SEQ ID NO: 10676 - DNA, 18 bp, synthetic construct
  source 1..18: mol_type = other DNA
taatacaacttactatgg

SEQ ID NO: 10677 - DNA, 18 bp, synthetic construct
  source 1..18: mol_type = other DNA
taataccactcagtttag

SEQ ID NO: 10678 - DNA, 18 bp, synthetic construct
  source 1..18: mol_type = other DNA
taatacgacccactgaag

SEQ ID NO: 10679 - DNA, 18 bp, synthetic construct
  source 1..18: mol_type = other DNA
taatacgactcattccag

SEQ ID NO: 10680 - DNA, 18 bp, synthetic construct
  source 1..18: mol_type = other DNA
taatacgactctccatgg

SEQ ID NO: 10681 - DNA, 18 bp, synthetic construct
  source 1..18: mol_type = other DNA
taatacgtctccccatag

SEQ ID NO: 10682 - DNA, 18 bp, synthetic construct
  source 1..18: mol_type = other DNA
taatactgctcattatag

SEQ ID NO: 10683 - DNA, 18 bp, synthetic construct
  source 1..18: mol_type = other DNA
taatatgattaactatag

SEQ ID NO: 10684 - DNA, 18 bp, synthetic construct
  source 1..18: mol_type = other DNA
taatgcgaatcactagag

SEQ ID NO: 10685 - DNA, 18 bp, synthetic construct
  source 1..18: mol_type = other DNA
taatgcgactcaccttag

SEQ ID NO: 10686 - DNA, 18 bp, synthetic construct
  source 1..18: mol_type = other DNA
taattccactcagtatag

SEQ ID NO: 10687 - DNA, 18 bp, synthetic construct
  source 1..18: mol_type = other DNA
taattcgactcagcatag

SEQ ID NO: 10688 - DNA, 18 bp, synthetic construct
  source 1..18: mol_type = other DNA
tactaggactcattatag

SEQ ID NO: 10689 - DNA, 18 bp, synthetic construct
  source 1..18: mol_type = other DNA
tactatgactcactacag

SEQ ID NO: 10690 - DNA, 18 bp, synthetic construct
  source 1..18: mol_type = other DNA
taggacgtctcactatag

SEQ ID NO: 10691 - DNA, 18 bp, synthetic construct
  source 1..18: mol_type = other DNA
tagtacgtctcactacag

SEQ ID NO: 10692 - DNA, 18 bp, synthetic construct
  source 1..18: mol_type = other DNA
tattacgattcacgatag

SEQ ID NO: 10693 - DNA, 18 bp, synthetic construct
  source 1..18: mol_type = other DNA
tattactactgactatag

SEQ ID NO: 10694 - DNA, 18 bp, synthetic construct
  source 1..18: mol_type = other DNA
tcaaccgactcactatag

SEQ ID NO: 10695 - DNA, 18 bp, synthetic construct
  source 1..18: mol_type = other DNA
tcacacgactcactttag

SEQ ID NO: 10696 - DNA, 18 bp, synthetic construct
  source 1..18: mol_type = other DNA
tcttacgactcactgtag

SEQ ID NO: 10697 - DNA, 18 bp, synthetic construct
  source 1..18: mol_type = other DNA
tcttacgagtcactatag

SEQ ID NO: 10698 - DNA, 18 bp, synthetic construct
  source 1..18: mol_type = other DNA
ttgtacgactaactatag

SEQ ID NO: 10699 - DNA, 18 bp, synthetic construct
  source 1..18: mol_type = other DNA
ttgtacgactcaatatag

SEQ ID NO: 10700 - DNA, 18 bp, synthetic construct
  source 1..18: mol_type = other DNA
ttgtacgcctcactatag

SEQ ID NO: 10701 - DNA, 18 bp, synthetic construct
  source 1..18: mol_type = other DNA
atatacgtctcactatag

SEQ ID NO: 10702 - DNA, 18 bp, synthetic construct
  source 1..18: mol_type = other DNA
taacacgtctcactattg

SEQ ID NO: 10703 - DNA, 18 bp, synthetic construct
  source 1..18: mol_type = other DNA
taatacgtctcataatag

SEQ ID NO: 10704 - DNA, 18 bp, synthetic construct
  source 1..18: mol_type = other DNA
taatacgtcatactatag

SEQ ID NO: 10705 - DNA, 18 bp, synthetic construct
  source 1..18: mol_type = other DNA
aaatatgacacactatag

SEQ ID NO: 10706 - DNA, 18 bp, synthetic construct
  source 1..18: mol_type = other DNA
taataccactctcaatag

SEQ ID NO: 10707 - DNA, 18 bp, synthetic construct
  source 1..18: mol_type = other DNA
taatacgacacactcttg

SEQ ID NO: 10708 - DNA, 18 bp, synthetic construct
  source 1..18: mol_type = other DNA
taatactactcaccattg

SEQ ID NO: 10709 - DNA, 18 bp, synthetic construct
  source 1..18: mol_type = other DNA
aaatactactcaccatag

SEQ ID NO: 10710 - DNA, 18 bp, synthetic construct
  source 1..18: mol_type = other DNA
aaatactacttactatag

SEQ ID NO: 10711 - DNA, 18 bp, synthetic construct
  source 1..18: mol_type = other DNA
taaaacgactaattatag

SEQ ID NO: 10712 - DNA, 18 bp, synthetic construct
  source 1..18: mol_type = other DNA
taataacacttactatag

SEQ ID NO: 10713 - DNA, 18 bp, synthetic construct
  source 1..18: mol_type = other DNA
taatacgacacactaagg

SEQ ID NO: 10714 - DNA, 18 bp, synthetic construct
  source 1..18: mol_type = other DNA
taatacgacacactagtg

SEQ ID NO: 10715 - DNA, 18 bp, synthetic construct
  source 1..18: mol_type = other DNA
taattcgactaactgtag

SEQ ID NO: 10716 - DNA, 18 bp, synthetic construct
  source 1..18: mol_type = other DNA
tacttcgacacactatag

SEQ ID NO: 10717 - DNA, 18 bp, synthetic construct
  source 1..18: mol_type = other DNA
tgatacgaatcacaatag

SEQ ID NO: 10718 - DNA, 18 bp, synthetic construct
  source 1..18: mol_type = other DNA
taattcaacacactatag

SEQ ID NO: 10719 - DNA, 18 bp, synthetic construct
  source 1..18: mol_type = other DNA
taatacgaccctttatag

SEQ ID NO: 10720 - DNA, 18 bp, synthetic construct
  source 1..18: mol_type = other DNA
tattacgtctcactatgg

SEQ ID NO: 10721 - DNA, 18 bp, synthetic construct
  source 1..18: mol_type = other DNA
taattcgactctcaatag

SEQ ID NO: 10722 - DNA, 18 bp, synthetic construct
  source 1..18: mol_type = other DNA
taaaacgactaactttag

SEQ ID NO: 10723 - DNA, 18 bp, synthetic construct
  source 1..18: mol_type = other DNA
taaaacgactcattaaag

SEQ ID NO: 10724 - DNA, 18 bp, synthetic construct
  source 1..18: mol_type = other DNA
taatacgacttactaatg

SEQ ID NO: 10725 - DNA, 18 bp, synthetic construct
  source 1..18: mol_type = other DNA
taatactactcacattag

SEQ ID NO: 10726 - DNA, 18 bp, synthetic construct
  source 1..18: mol_type = other DNA
taatacgacactatatag

SEQ ID NO: 10727 - DNA, 18 bp, synthetic construct
  source 1..18: mol_type = other DNA
tattccgactcattatag

SEQ ID NO: 10728 - DNA, 18 bp, synthetic construct
  source 1..18: mol_type = other DNA
ttataagacttactatag

SEQ ID NO: 10729 - DNA, 18 bp, synthetic construct
  source 1..18: mol_type = other DNA
aaatacgactctctctag

SEQ ID NO: 10730 - DNA, 18 bp, synthetic construct
  source 1..18: mol_type = other DNA
caaaacgactctctatag

SEQ ID NO: 10731 - DNA, 18 bp, synthetic construct
  source 1..18: mol_type = other DNA
taaaaagacacactatag

SEQ ID NO: 10732 - DNA, 18 bp, synthetic construct
  source 1..18: mol_type = other DNA
taaaaagactctctatag

SEQ ID NO: 10733 - DNA, 18 bp, synthetic construct
  source 1..18: mol_type = other DNA
taaaacgacagactatag

SEQ ID NO: 10734 - DNA, 18 bp, synthetic construct
  source 1..18: mol_type = other DNA
taatacaaatcattatag

SEQ ID NO: 10735 - DNA, 18 bp, synthetic construct
  source 1..18: mol_type = other DNA
taatacgaccctctattg

SEQ ID NO: 10736 - DNA, 18 bp, synthetic construct
  source 1..18: mol_type = other DNA
taatacgactttccatag

SEQ ID NO: 10737 - DNA, 18 bp, synthetic construct
  source 1..18: mol_type = other DNA
taatatgtctaactatag

SEQ ID NO: 10738 - DNA, 18 bp, synthetic construct
  source 1..18: mol_type = other DNA
taattcgactcaacatag

SEQ ID NO: 10739 - DNA, 18 bp, synthetic construct
  source 1..18: mol_type = other DNA
tattacgacttcctatag

SEQ ID NO: 10740 - DNA, 18 bp, synthetic construct
  source 1..18: mol_type = other DNA
tattatgacttactatag

SEQ ID NO: 10741 - DNA, 18 bp, synthetic construct
  source 1..18: mol_type = other DNA
tattgctactcactatag

SEQ ID NO: 10742 - DNA, 18 bp, synthetic construct
  source 1..18: mol_type = other DNA
aaatacgactcaatctag

SEQ ID NO: 10743 - DNA, 18 bp, synthetic construct
  source 1..18: mol_type = other DNA
aaataggacttactatag

SEQ ID NO: 10744 - DNA, 18 bp, synthetic construct
  source 1..18: mol_type = other DNA
aaatgcgacacactatag

SEQ ID NO: 10745 - DNA, 18 bp, synthetic construct
  source 1..18: mol_type = other DNA
acatacgactcagtatag

SEQ ID NO: 10746 - DNA, 18 bp, synthetic construct
  source 1..18: mol_type = other DNA
taaaacgagacactatag

SEQ ID NO: 10747 - DNA, 18 bp, synthetic construct
  source 1..18: mol_type = other DNA
taacaacactcactatag

SEQ ID NO: 10748 - DNA, 18 bp, synthetic construct
  source 1..18: mol_type = other DNA
taacacaactcagtatag

SEQ ID NO: 10749 - DNA, 18 bp, synthetic construct
  source 1..18: mol_type = other DNA
taacaccacttactatag

SEQ ID NO: 10750 - DNA, 18 bp, synthetic construct
  source 1..18: mol_type = other DNA
taacacgactcaatatgg

SEQ ID NO: 10751 - DNA, 18 bp, synthetic construct
  source 1..18: mol_type = other DNA
taacacgattcactacag

SEQ ID NO: 10752 - DNA, 18 bp, synthetic construct
  source 1..18: mol_type = other DNA
taacatgactaactatag

SEQ ID NO: 10753 - DNA, 18 bp, synthetic construct
  source 1..18: mol_type = other DNA
taagacgactcattattg

SEQ ID NO: 10754 - DNA, 18 bp, synthetic construct
  source 1..18: mol_type = other DNA
taatacgaatcactatta

SEQ ID NO: 10755 - DNA, 18 bp, synthetic construct
  source 1..18: mol_type = other DNA
taatacgaatcagtaaag

SEQ ID NO: 10756 - DNA, 18 bp, synthetic construct
  source 1..18: mol_type = other DNA
taatacgacacactccag

SEQ ID NO: 10757 - DNA, 18 bp, synthetic construct
  source 1..18: mol_type = other DNA
taatacgacacgatatag

SEQ ID NO: 10758 - DNA, 18 bp, synthetic construct
  source 1..18: mol_type = other DNA
taatacgacagactatcg

SEQ ID NO: 10759 - DNA, 18 bp, synthetic construct
  source 1..18: mol_type = other DNA
taatacgacctaccatag

SEQ ID NO: 10760 - DNA, 18 bp, synthetic construct
  source 1..18: mol_type = other DNA
taatacgacttgcaatag

SEQ ID NO: 10761 - DNA, 18 bp, synthetic construct
  source 1..18: mol_type = other DNA
taatacgagtatctatag

SEQ ID NO: 10762 - DNA, 18 bp, synthetic construct
  source 1..18: mol_type = other DNA
taatacgagtcactgaag

SEQ ID NO: 10763 - DNA, 18 bp, synthetic construct
  source 1..18: mol_type = other DNA
taatacggatctctatag

SEQ ID NO: 10764 - DNA, 18 bp, synthetic construct
  source 1..18: mol_type = other DNA
taatacggttcaatatag

SEQ ID NO: 10765 - DNA, 18 bp, synthetic construct
  source 1..18: mol_type = other DNA
taatacgtctcaatatgg

SEQ ID NO: 10766 - DNA, 18 bp, synthetic construct
  source 1..18: mol_type = other DNA
taatacgtgtcaccatag

SEQ ID NO: 10767 - DNA, 18 bp, synthetic construct
  source 1..18: mol_type = other DNA
taatactaatgactatag

SEQ ID NO: 10768 - DNA, 18 bp, synthetic construct
  source 1..18: mol_type = other DNA
taatactactcactgcag

SEQ ID NO: 10769 - DNA, 18 bp, synthetic construct
  source 1..18: mol_type = other DNA
taatactattgactatag

SEQ ID NO: 10770 - DNA, 18 bp, synthetic construct
  source 1..18: mol_type = other DNA
taataggactcattttag

SEQ ID NO: 10771 - DNA, 18 bp, synthetic construct
  source 1..18: mol_type = other DNA
taatagtactctctatag

SEQ ID NO: 10772 - DNA, 18 bp, synthetic construct
  source 1..18: mol_type = other DNA
taatccgactaattatag

SEQ ID NO: 10773 - DNA, 18 bp, synthetic construct
  source 1..18: mol_type = other DNA
taatccgattcaatatag

SEQ ID NO: 10774 - DNA, 18 bp, synthetic construct
  source 1..18: mol_type = other DNA
taatgcgacagactatag

SEQ ID NO: 10775 - DNA, 18 bp, synthetic construct
  source 1..18: mol_type = other DNA
taatgcgacttacaatag

SEQ ID NO: 10776 - DNA, 18 bp, synthetic construct
  source 1..18: mol_type = other DNA
tactacaactcagtatag

SEQ ID NO: 10777 - DNA, 18 bp, synthetic construct
  source 1..18: mol_type = other DNA
tactacgacacacgatag

SEQ ID NO: 10778 - DNA, 18 bp, synthetic construct
  source 1..18: mol_type = other DNA
tactacgacttagtatag

SEQ ID NO: 10779 - DNA, 18 bp, synthetic construct
  source 1..18: mol_type = other DNA
tacttggactcactatag

SEQ ID NO: 10780 - DNA, 18 bp, synthetic construct
  source 1..18: mol_type = other DNA
tagtacgagtctctatag

SEQ ID NO: 10781 - DNA, 18 bp, synthetic construct
  source 1..18: mol_type = other DNA
tagtacgccacactatag

SEQ ID NO: 10782 - DNA, 18 bp, synthetic construct
  source 1..18: mol_type = other DNA
tattacgactcacaagag

SEQ ID NO: 10783 - DNA, 18 bp, synthetic construct
  source 1..18: mol_type = other DNA
tcataagactcacaatag

SEQ ID NO: 10784 - DNA, 18 bp, synthetic construct
  source 1..18: mol_type = other DNA
tcatacgaaccactatag

SEQ ID NO: 10785 - DNA, 18 bp, synthetic construct
  source 1..18: mol_type = other DNA
tcataggactctctatag

SEQ ID NO: 10786 - DNA, 18 bp, synthetic construct
  source 1..18: mol_type = other DNA
tcatatgagtcactatag

SEQ ID NO: 10787 - DNA, 18 bp, synthetic construct
  source 1..18: mol_type = other DNA
tgatacgaccaactatag

SEQ ID NO: 10788 - DNA, 18 bp, synthetic construct
  source 1..18: mol_type = other DNA
ttatacgactccgtatag

SEQ ID NO: 10789 - DNA, 18 bp, synthetic construct
  source 1..18: mol_type = other DNA
ttatccgacgcactatag

SEQ ID NO: 10790 - DNA, 18 bp, synthetic construct
  source 1..18: mol_type = other DNA
tactactactctctatag

SEQ ID NO: 10791 - DNA, 18 bp, synthetic construct
  source 1..18: mol_type = other DNA
taatcctactcacaatag

SEQ ID NO: 10792 - DNA, 18 bp, synthetic construct
  source 1..18: mol_type = other DNA
taatacgacacacattag

SEQ ID NO: 10793 - DNA, 18 bp, synthetic construct
  source 1..18: mol_type = other DNA
taatactactcaatattg

SEQ ID NO: 10794 - DNA, 18 bp, synthetic construct
  source 1..18: mol_type = other DNA
taatacctctcaatatag

SEQ ID NO: 10795 - DNA, 18 bp, synthetic construct
  source 1..18: mol_type = other DNA
taatacgaatctccatag

SEQ ID NO: 10796 - DNA, 18 bp, synthetic construct
  source 1..18: mol_type = other DNA
taatacgaattactattg

SEQ ID NO: 10797 - DNA, 18 bp, synthetic construct
  source 1..18: mol_type = other DNA
taatacgaccaactattg

SEQ ID NO: 10798 - DNA, 18 bp, synthetic construct
  source 1..18: mol_type = other DNA
taataggattcacaatag

SEQ ID NO: 10799 - DNA, 18 bp, synthetic construct
  source 1..18: mol_type = other DNA
taatcatactcactatag

SEQ ID NO: 10800 - DNA, 18 bp, synthetic construct
  source 1..18: mol_type = other DNA
taatccgactcataatag

SEQ ID NO: 10801 - DNA, 18 bp, synthetic construct
  source 1..18: mol_type = other DNA
taattcgacccactaaag

SEQ ID NO: 10802 - DNA, 18 bp, synthetic construct
  source 1..18: mol_type = other DNA
tcaaacgacacactatag

SEQ ID NO: 10803 - DNA, 18 bp, synthetic construct
  source 1..18: mol_type = other DNA
tcattcaactcactatag

SEQ ID NO: 10804 - DNA, 18 bp, synthetic construct
  source 1..18: mol_type = other DNA
ttatacgaatcacaatag

SEQ ID NO: 10805 - DNA, 18 bp, synthetic construct
  source 1..18: mol_type = other DNA
aaatacgtctcattatag

SEQ ID NO: 10806 - DNA, 18 bp, synthetic construct
  source 1..18: mol_type = other DNA
tcatacgacactctatag

SEQ ID NO: 10807 - DNA, 18 bp, synthetic construct
  source 1..18: mol_type = other DNA
taaaacgactcattattg

SEQ ID NO: 10808 - DNA, 18 bp, synthetic construct
  source 1..18: mol_type = other DNA
taatactactctatatag

SEQ ID NO: 10809 - DNA, 18 bp, synthetic construct
  source 1..18: mol_type = other DNA
tcattcgactcacaatag

SEQ ID NO: 10810 - DNA, 18 bp, synthetic construct
  source 1..18: mol_type = other DNA
ttaaacgaatcactatag

SEQ ID NO: 10811 - DNA, 18 bp, synthetic construct
  source 1..18: mol_type = other DNA
ttacacgactcactaaag

SEQ ID NO: 10812 - DNA, 18 bp, synthetic construct
  source 1..18: mol_type = other DNA
taaaacgacacactattg

SEQ ID NO: 10813 - DNA, 18 bp, synthetic construct
  source 1..18: mol_type = other DNA
taaaacttctcactatag

SEQ ID NO: 10814 - DNA, 18 bp, synthetic construct
  source 1..18: mol_type = other DNA
taacacgacttactattg

SEQ ID NO: 10815 - DNA, 18 bp, synthetic construct
  source 1..18: mol_type = other DNA
taaaacaactcattatag

SEQ ID NO: 10816 - DNA, 18 bp, synthetic construct
  source 1..18: mol_type = other DNA
taataacactctctatag

SEQ ID NO: 10817 - DNA, 18 bp, synthetic construct
  source 1..18: mol_type = other DNA
taatacaactcaccttag

SEQ ID NO: 10818 - DNA, 18 bp, synthetic construct
  source 1..18: mol_type = other DNA
taatatgactcacactag

SEQ ID NO: 10819 - DNA, 18 bp, synthetic construct
  source 1..18: mol_type = other DNA
taatgcgactatctatag

SEQ ID NO: 10820 - DNA, 18 bp, synthetic construct
  source 1..18: mol_type = other DNA
tagttcgactcactttag

SEQ ID NO: 10821 - DNA, 18 bp, synthetic construct
  source 1..18: mol_type = other DNA
tattacgattcaccatag

SEQ ID NO: 10822 - DNA, 18 bp, synthetic construct
  source 1..18: mol_type = other DNA
aaatacgactcgatatag

SEQ ID NO: 10823 - DNA, 18 bp, synthetic construct
  source 1..18: mol_type = other DNA
aaatacgacttactatgg

SEQ ID NO: 10824 - DNA, 18 bp, synthetic construct
  source 1..18: mol_type = other DNA
aaatccgactcattatag

SEQ ID NO: 10825 - DNA, 18 bp, synthetic construct
  source 1..18: mol_type = other DNA
aactacgattcactatag

SEQ ID NO: 10826 - DNA, 18 bp, synthetic construct
  source 1..18: mol_type = other DNA
aagtacggctcactatag

SEQ ID NO: 10827 - DNA, 18 bp, synthetic construct
  source 1..18: mol_type = other DNA
caatacgactcaataaag

SEQ ID NO: 10828 - DNA, 18 bp, synthetic construct
  source 1..18: mol_type = other DNA
gattacgaatcactatag

SEQ ID NO: 10829 - DNA, 18 bp, synthetic construct
  source 1..18: mol_type = other DNA
taacaccactcattatag

SEQ ID NO: 10830 - DNA, 18 bp, synthetic construct
  source 1..18: mol_type = other DNA
taacacgaataactatag

SEQ ID NO: 10831 - DNA, 18 bp, synthetic construct
  source 1..18: mol_type = other DNA
taacacgactaaatatag

SEQ ID NO: 10832 - DNA, 18 bp, synthetic construct
  source 1..18: mol_type = other DNA
taataagactcgctttag

SEQ ID NO: 10833 - DNA, 18 bp, synthetic construct
  source 1..18: mol_type = other DNA
taataagactgaatatag

SEQ ID NO: 10834 - DNA, 18 bp, synthetic construct
  source 1..18: mol_type = other DNA
taataccactcacaacag

SEQ ID NO: 10835 - DNA, 18 bp, synthetic construct
  source 1..18: mol_type = other DNA
taatacctctcactatcg

SEQ ID NO: 10836 - DNA, 18 bp, synthetic construct
  source 1..18: mol_type = other DNA
taatacgaatcgatatag

SEQ ID NO: 10837 - DNA, 18 bp, synthetic construct
  source 1..18: mol_type = other DNA
taatacgactgaatattg

SEQ ID NO: 10838 - DNA, 18 bp, synthetic construct
  source 1..18: mol_type = other DNA
taataggacacaatatag

SEQ ID NO: 10839 - DNA, 18 bp, synthetic construct
  source 1..18: mol_type = other DNA
taatcagactaactatag

SEQ ID NO: 10840 - DNA, 18 bp, synthetic construct
  source 1..18: mol_type = other DNA
taatccgtctccctatag

SEQ ID NO: 10841 - DNA, 18 bp, synthetic construct
  source 1..18: mol_type = other DNA
taatgcgacacactatcg

SEQ ID NO: 10842 - DNA, 18 bp, synthetic construct
  source 1..18: mol_type = other DNA
taattctactgactatag

SEQ ID NO: 10843 - DNA, 18 bp, synthetic construct
  source 1..18: mol_type = other DNA
tactaagactcactctag

SEQ ID NO: 10844 - DNA, 18 bp, synthetic construct
  source 1..18: mol_type = other DNA
tactacgactctctctag

SEQ ID NO: 10845 - DNA, 18 bp, synthetic construct
  source 1..18: mol_type = other DNA
tagaacgacttactatag

SEQ ID NO: 10846 - DNA, 18 bp, synthetic construct
  source 1..18: mol_type = other DNA
tagcacgactcacaatag

SEQ ID NO: 10847 - DNA, 18 bp, synthetic construct
  source 1..18: mol_type = other DNA
tagtaagtctcactatag

SEQ ID NO: 10848 - DNA, 18 bp, synthetic construct
  source 1..18: mol_type = other DNA
tagtacgcctctctatag

SEQ ID NO: 10849 - DNA, 18 bp, synthetic construct
  source 1..18: mol_type = other DNA
tagtacggctctctatag

SEQ ID NO: 10850 - DNA, 18 bp, synthetic construct
  source 1..18: mol_type = other DNA
tagtactactaactatag

SEQ ID NO: 10851 - DNA, 18 bp, synthetic construct
  source 1..18: mol_type = other DNA
tatgacgactcactattg

SEQ ID NO: 10852 - DNA, 18 bp, synthetic construct
  source 1..18: mol_type = other DNA
tattaccactgactatag

SEQ ID NO: 10853 - DNA, 18 bp, synthetic construct
  source 1..18: mol_type = other DNA
tattacgactccctctag

SEQ ID NO: 10854 - DNA, 18 bp, synthetic construct
  source 1..18: mol_type = other DNA
tcataccactcattatag

SEQ ID NO: 10855 - DNA, 18 bp, synthetic construct
  source 1..18: mol_type = other DNA
tcatacgaccctctatag

SEQ ID NO: 10856 - DNA, 18 bp, synthetic construct
  source 1..18: mol_type = other DNA
tcatactaatcactatag

SEQ ID NO: 10857 - DNA, 18 bp, synthetic construct
  source 1..18: mol_type = other DNA
tgataggactcattatag

SEQ ID NO: 10858 - DNA, 18 bp, synthetic construct
  source 1..18: mol_type = other DNA
tgcttcgactcactatag

SEQ ID NO: 10859 - DNA, 18 bp, synthetic construct
  source 1..18: mol_type = other DNA
ttacccgactcactatag

SEQ ID NO: 10860 - DNA, 18 bp, synthetic construct
  source 1..18: mol_type = other DNA
ttatacgactccttatag

SEQ ID NO: 10861 - DNA, 18 bp, synthetic construct
  source 1..18: mol_type = other DNA
aaatacgactctttatag

SEQ ID NO: 10862 - DNA, 18 bp, synthetic construct
  source 1..18: mol_type = other DNA
taatacgactatctaaag

SEQ ID NO: 10863 - DNA, 18 bp, synthetic construct
  source 1..18: mol_type = other DNA
taatactactcattaaag

SEQ ID NO: 10864 - DNA, 18 bp, synthetic construct
  source 1..18: mol_type = other DNA
taatacgccacactttag

SEQ ID NO: 10865 - DNA, 18 bp, synthetic construct
  source 1..18: mol_type = other DNA
taatactaatcactaaag

SEQ ID NO: 10866 - DNA, 18 bp, synthetic construct
  source 1..18: mol_type = other DNA
taatataactctctatag

SEQ ID NO: 10867 - DNA, 18 bp, synthetic construct
  source 1..18: mol_type = other DNA
taatacgactctcaaaag

SEQ ID NO: 10868 - DNA, 18 bp, synthetic construct
  source 1..18: mol_type = other DNA
taacacgaatctctatag

SEQ ID NO: 10869 - DNA, 18 bp, synthetic construct
  source 1..18: mol_type = other DNA
taataccattcactacag

SEQ ID NO: 10870 - DNA, 18 bp, synthetic construct
  source 1..18: mol_type = other DNA
tagtactactctctatag

SEQ ID NO: 10871 - DNA, 18 bp, synthetic construct
  source 1..18: mol_type = other DNA
tgattcgactcaccatag

SEQ ID NO: 10872 - DNA, 18 bp, synthetic construct
  source 1..18: mol_type = other DNA
ttatacgacacagtatag

SEQ ID NO: 10873 - DNA, 18 bp, synthetic construct
  source 1..18: mol_type = other DNA
taattcgactctttatag

SEQ ID NO: 10874 - DNA, 18 bp, synthetic construct
  source 1..18: mol_type = other DNA
tacttcgactcactaaag

SEQ ID NO: 10875 - DNA, 18 bp, synthetic construct
  source 1..18: mol_type = other DNA
tattacgactaacaatag

SEQ ID NO: 10876 - DNA, 18 bp, synthetic construct
  source 1..18: mol_type = other DNA
ttatactactcaatatag

SEQ ID NO: 10877 - DNA, 18 bp, synthetic construct
  source 1..18: mol_type = other DNA
taatacgattcacttttg

SEQ ID NO: 10878 - DNA, 18 bp, synthetic construct
  source 1..18: mol_type = other DNA
taaaacgactcacaaaag

SEQ ID NO: 10879 - DNA, 18 bp, synthetic construct
  source 1..18: mol_type = other DNA
tattacgtatcactatag

SEQ ID NO: 10880 - DNA, 18 bp, synthetic construct
  source 1..18: mol_type = other DNA
tcatactactctctatag

SEQ ID NO: 10881 - DNA, 18 bp, synthetic construct
  source 1..18: mol_type = other DNA
taaaaccactcacaatag

SEQ ID NO: 10882 - DNA, 18 bp, synthetic construct
  source 1..18: mol_type = other DNA
taataccactctgtatag

SEQ ID NO: 10883 - DNA, 18 bp, synthetic construct
  source 1..18: mol_type = other DNA
taataccactttctatag

SEQ ID NO: 10884 - DNA, 18 bp, synthetic construct
  source 1..18: mol_type = other DNA
taatacgtctcaccatgg

SEQ ID NO: 10885 - DNA, 18 bp, synthetic construct
  source 1..18: mol_type = other DNA
taatactattcattatag

SEQ ID NO: 10886 - DNA, 18 bp, synthetic construct
  source 1..18: mol_type = other DNA
taatccgtctcacaatag

SEQ ID NO: 10887 - DNA, 18 bp, synthetic construct
  source 1..18: mol_type = other DNA
taatgcgatttactatag

SEQ ID NO: 10888 - DNA, 18 bp, synthetic construct
  source 1..18: mol_type = other DNA
tagaacaactcactatag

SEQ ID NO: 10889 - DNA, 18 bp, synthetic construct
  source 1..18: mol_type = other DNA
tattaccactaactatag

SEQ ID NO: 10890 - DNA, 18 bp, synthetic construct
  source 1..18: mol_type = other DNA
tgatacaacacactatag

SEQ ID NO: 10891 - DNA, 18 bp, synthetic construct
  source 1..18: mol_type = other DNA
tgatacgaatcactttag

SEQ ID NO: 10892 - DNA, 18 bp, synthetic construct
  source 1..18: mol_type = other DNA
ttttacgactgactatag

SEQ ID NO: 10893 - DNA, 18 bp, synthetic construct
  source 1..18: mol_type = other DNA
aaataagactccctatag

SEQ ID NO: 10894 - DNA, 18 bp, synthetic construct
  source 1..18: mol_type = other DNA
caatacaacttactatag

SEQ ID NO: 10895 - DNA, 18 bp, synthetic construct
  source 1..18: mol_type = other DNA
caatacgacacaatatag

SEQ ID NO: 10896 - DNA, 18 bp, synthetic construct
  source 1..18: mol_type = other DNA
taaaaccactcactacag

SEQ ID NO: 10897 - DNA, 18 bp, synthetic construct
  source 1..18: mol_type = other DNA
taacactactcactctag

SEQ ID NO: 10898 - DNA, 18 bp, synthetic construct
  source 1..18: mol_type = other DNA
taataagacacaccatag

SEQ ID NO: 10899 - DNA, 18 bp, synthetic construct
  source 1..18: mol_type = other DNA
taataagagtcacaatag

SEQ ID NO: 10900 - DNA, 18 bp, synthetic construct
  source 1..18: mol_type = other DNA
taataccactcaccaaag

SEQ ID NO: 10901 - DNA, 18 bp, synthetic construct
  source 1..18: mol_type = other DNA
taataccactccctattg

SEQ ID NO: 10902 - DNA, 18 bp, synthetic construct
  source 1..18: mol_type = other DNA
taatacgacaaaatatag

SEQ ID NO: 10903 - DNA, 18 bp, synthetic construct
  source 1..18: mol_type = other DNA
taatacgacatactatcg

SEQ ID NO: 10904 - DNA, 18 bp, synthetic construct
  source 1..18: mol_type = other DNA
taatacgagtctctgtag

SEQ ID NO: 10905 - DNA, 18 bp, synthetic construct
  source 1..18: mol_type = other DNA
taatacgattaactatgg

SEQ ID NO: 10906 - DNA, 18 bp, synthetic construct
  source 1..18: mol_type = other DNA
taatacgcctccctatcg

SEQ ID NO: 10907 - DNA, 18 bp, synthetic construct
  source 1..18: mol_type = other DNA
taatacgcgtcacaatag

SEQ ID NO: 10908 - DNA, 18 bp, synthetic construct
  source 1..18: mol_type = other DNA
taataggtgtcactatag

SEQ ID NO: 10909 - DNA, 18 bp, synthetic construct
  source 1..18: mol_type = other DNA
taatagtactcgctatag

SEQ ID NO: 10910 - DNA, 18 bp, synthetic construct
  source 1..18: mol_type = other DNA
taatatgactcaccacag

SEQ ID NO: 10911 - DNA, 18 bp, synthetic construct
  source 1..18: mol_type = other DNA
taatatgattcactagag

SEQ ID NO: 10912 - DNA, 18 bp, synthetic construct
  source 1..18: mol_type = other DNA
taatattgctcactatag

SEQ ID NO: 10913 - DNA, 18 bp, synthetic construct
  source 1..18: mol_type = other DNA
taattcgattcactatgg

SEQ ID NO: 10914 - DNA, 18 bp, synthetic construct
  source 1..18: mol_type = other DNA
tactaccacttactatag

SEQ ID NO: 10915 - DNA, 18 bp, synthetic construct
  source 1..18: mol_type = other DNA
tagcatgactcactatag

SEQ ID NO: 10916 - DNA, 18 bp, synthetic construct
  source 1..18: mol_type = other DNA
tcatacgaatccctatag

SEQ ID NO: 10917 - DNA, 18 bp, synthetic construct
  source 1..18: mol_type = other DNA
tgatacgactccccatag

SEQ ID NO: 10918 - DNA, 18 bp, synthetic construct
  source 1..18: mol_type = other DNA
tgatacgtctccctatag

SEQ ID NO: 10919 - DNA, 18 bp, synthetic construct
  source 1..18: mol_type = other DNA
ttataagactcaccatag

SEQ ID NO: 10920 - DNA, 18 bp, synthetic construct
  source 1..18: mol_type = other DNA
ttataccactcactgtag

SEQ ID NO: 10921 - DNA, 18 bp, synthetic construct
  source 1..18: mol_type = other DNA
ttatacgaaccactatag

SEQ ID NO: 10922 - DNA, 18 bp, synthetic construct
  source 1..18: mol_type = other DNA
ttatacgaatcactgtag

SEQ ID NO: 10923 - DNA, 18 bp, synthetic construct
  source 1..18: mol_type = other DNA
taatacatctctctatag

SEQ ID NO: 10924 - DNA, 18 bp, synthetic construct
  source 1..18: mol_type = other DNA
ttatacatctcactatag

SEQ ID NO: 10925 - DNA, 18 bp, synthetic construct
  source 1..18: mol_type = other DNA
taaatcgattcactatag

SEQ ID NO: 10926 - DNA, 18 bp, synthetic construct
  source 1..18: mol_type = other DNA
taatacatctcacaatag

SEQ ID NO: 10927 - DNA, 18 bp, synthetic construct
  source 1..18: mol_type = other DNA
taatttgattcactatag

SEQ ID NO: 10928 - DNA, 18 bp, synthetic construct
  source 1..18: mol_type = other DNA
aattacaactcactatag

SEQ ID NO: 10929 - DNA, 18 bp, synthetic construct
  source 1..18: mol_type = other DNA
ttattcgactaactatag

SEQ ID NO: 10930 - DNA, 18 bp, synthetic construct
  source 1..18: mol_type = other DNA
taatatcactcactttag

SEQ ID NO: 10931 - DNA, 18 bp, synthetic construct
  source 1..18: mol_type = other DNA
tagtacgacacactattg

SEQ ID NO: 10932 - DNA, 18 bp, synthetic construct
  source 1..18: mol_type = other DNA
tattacggctctctatag

SEQ ID NO: 10933 - DNA, 18 bp, synthetic construct
  source 1..18: mol_type = other DNA
taatacgtctctcaatag

SEQ ID NO: 10934 - DNA, 18 bp, synthetic construct
  source 1..18: mol_type = other DNA
taatacgacactctttag

SEQ ID NO: 10935 - DNA, 18 bp, synthetic construct
  source 1..18: mol_type = other DNA
tattacgactcattattg

SEQ ID NO: 10936 - DNA, 18 bp, synthetic construct
  source 1..18: mol_type = other DNA
ttatacgacacaatatag

SEQ ID NO: 10937 - DNA, 18 bp, synthetic construct
  source 1..18: mol_type = other DNA
tattacgtctctctatag

SEQ ID NO: 10938 - DNA, 18 bp, synthetic construct
  source 1..18: mol_type = other DNA
ttatacgattcacaatag

SEQ ID NO: 10939 - DNA, 18 bp, synthetic construct
  source 1..18: mol_type = other DNA
taatactactcactttgg

SEQ ID NO: 10940 - DNA, 18 bp, synthetic construct
  source 1..18: mol_type = other DNA
aaattcaactcactatag

SEQ ID NO: 10941 - DNA, 18 bp, synthetic construct
  source 1..18: mol_type = other DNA
tatttcgacttactatag

SEQ ID NO: 10942 - DNA, 18 bp, synthetic construct
  source 1..18: mol_type = other DNA
taaaacgactctatatag

SEQ ID NO: 10943 - DNA, 18 bp, synthetic construct
  source 1..18: mol_type = other DNA
taatacgtcacgctatag

SEQ ID NO: 10944 - DNA, 18 bp, synthetic construct
  source 1..18: mol_type = other DNA
taatgcgactctccatag

SEQ ID NO: 10945 - DNA, 18 bp, synthetic construct
  source 1..18: mol_type = other DNA
ttatacgacccactttag

SEQ ID NO: 10946 - DNA, 18 bp, synthetic construct
  source 1..18: mol_type = other DNA
ttatacgactcattacag

SEQ ID NO: 10947 - DNA, 18 bp, synthetic construct
  source 1..18: mol_type = other DNA
aaaaaagactcactatag

SEQ ID NO: 10948 - DNA, 18 bp, synthetic construct
  source 1..18: mol_type = other DNA
aaacacgacttactatag

SEQ ID NO: 10949 - DNA, 18 bp, synthetic construct
  source 1..18: mol_type = other DNA
aaatacaactgactatag

SEQ ID NO: 10950 - DNA, 18 bp, synthetic construct
  source 1..18: mol_type = other DNA
aaatacgaatcactgtag

SEQ ID NO: 10951 - DNA, 18 bp, synthetic construct
  source 1..18: mol_type = other DNA
aaatacgacccaccatag

SEQ ID NO: 10952 - DNA, 18 bp, synthetic construct
  source 1..18: mol_type = other DNA
aaatacgactggctatag

SEQ ID NO: 10953 - DNA, 18 bp, synthetic construct
  source 1..18: mol_type = other DNA
acatacgattcactatag

SEQ ID NO: 10954 - DNA, 18 bp, synthetic construct
  source 1..18: mol_type = other DNA
atatacgacgcactatag

SEQ ID NO: 10955 - DNA, 18 bp, synthetic construct
  source 1..18: mol_type = other DNA
caatacgacaaactatag

SEQ ID NO: 10956 - DNA, 18 bp, synthetic construct
  source 1..18: mol_type = other DNA
gaatacgactcacaattg

SEQ ID NO: 10957 - DNA, 18 bp, synthetic construct
  source 1..18: mol_type = other DNA
taaaacaactcactatgg

SEQ ID NO: 10958 - DNA, 18 bp, synthetic construct
  source 1..18: mol_type = other DNA
taagtcaactcactatag

SEQ ID NO: 10959 - DNA, 18 bp, synthetic construct
  source 1..18: mol_type = other DNA
taataagactcattacag

SEQ ID NO: 10960 - DNA, 18 bp, synthetic construct
  source 1..18: mol_type = other DNA
taatacccctcacaatag

SEQ ID NO: 10961 - DNA, 18 bp, synthetic construct
  source 1..18: mol_type = other DNA
taatacgacactctagag

SEQ ID NO: 10962 - DNA, 18 bp, synthetic construct
  source 1..18: mol_type = other DNA
taatacgactaacaacag

SEQ ID NO: 10963 - DNA, 18 bp, synthetic construct
  source 1..18: mol_type = other DNA
taatacgactcatcgtag

SEQ ID NO: 10964 - DNA, 18 bp, synthetic construct
  source 1..18: mol_type = other DNA
taatacgattcagaatag

SEQ ID NO: 10965 - DNA, 18 bp, synthetic construct
  source 1..18: mol_type = other DNA
taatacgcttcaatatag

SEQ ID NO: 10966 - DNA, 18 bp, synthetic construct
  source 1..18: mol_type = other DNA
taatacggttcattatag

SEQ ID NO: 10967 - DNA, 18 bp, synthetic construct
  source 1..18: mol_type = other DNA
taataggattcaatatag

SEQ ID NO: 10968 - DNA, 18 bp, synthetic construct
  source 1..18: mol_type = other DNA
taatatgagtcactattg

SEQ ID NO: 10969 - DNA, 18 bp, synthetic construct
  source 1..18: mol_type = other DNA
taatattactcactgtag

SEQ ID NO: 10970 - DNA, 18 bp, synthetic construct
  source 1..18: mol_type = other DNA
taattccactcactctag

SEQ ID NO: 10971 - DNA, 18 bp, synthetic construct
  source 1..18: mol_type = other DNA
taattccactccctatag

SEQ ID NO: 10972 - DNA, 18 bp, synthetic construct
  source 1..18: mol_type = other DNA
taattcgagtcactattg

SEQ ID NO: 10973 - DNA, 18 bp, synthetic construct
  source 1..18: mol_type = other DNA
tacaacgactcactctag

SEQ ID NO: 10974 - DNA, 18 bp, synthetic construct
  source 1..18: mol_type = other DNA
tagaacgactcactatcg

SEQ ID NO: 10975 - DNA, 18 bp, synthetic construct
  source 1..18: mol_type = other DNA
tagtacgaatcattatag

SEQ ID NO: 10976 - DNA, 18 bp, synthetic construct
  source 1..18: mol_type = other DNA
tagtacgactcacaatcg

SEQ ID NO: 10977 - DNA, 18 bp, synthetic construct
  source 1..18: mol_type = other DNA
tattacggcacactatag

SEQ ID NO: 10978 - DNA, 18 bp, synthetic construct
  source 1..18: mol_type = other DNA
tcttacgactccctatag

SEQ ID NO: 10979 - DNA, 18 bp, synthetic construct
  source 1..18: mol_type = other DNA
tgatacgactcattacag

SEQ ID NO: 10980 - DNA, 18 bp, synthetic construct
  source 1..18: mol_type = other DNA
tgatactacttactatag

SEQ ID NO: 10981 - DNA, 18 bp, synthetic construct
  source 1..18: mol_type = other DNA
tgataggactaactatag

SEQ ID NO: 10982 - DNA, 18 bp, synthetic construct
  source 1..18: mol_type = other DNA
ttatacgacccaatatag

SEQ ID NO: 10983 - DNA, 18 bp, synthetic construct
  source 1..18: mol_type = other DNA
taatacgtctaacaatag

SEQ ID NO: 10984 - DNA, 18 bp, synthetic construct
  source 1..18: mol_type = other DNA
taaaatgactcactattg

SEQ ID NO: 10985 - DNA, 18 bp, synthetic construct
  source 1..18: mol_type = other DNA
taataagactcaataaag

SEQ ID NO: 10986 - DNA, 18 bp, synthetic construct
  source 1..18: mol_type = other DNA
tattacgactccctttag

SEQ ID NO: 10987 - DNA, 18 bp, synthetic construct
  source 1..18: mol_type = other DNA
ttatactacacactatag

SEQ ID NO: 10988 - DNA, 18 bp, synthetic construct
  source 1..18: mol_type = other DNA
aaatacgacacaatatag

SEQ ID NO: 10989 - DNA, 18 bp, synthetic construct
  source 1..18: mol_type = other DNA
aaattcgacttactatag

SEQ ID NO: 10990 - DNA, 18 bp, synthetic construct
  source 1..18: mol_type = other DNA
caatactactcactttag

SEQ ID NO: 10991 - DNA, 18 bp, synthetic construct
  source 1..18: mol_type = other DNA
taaaacctctcactatag

SEQ ID NO: 10992 - DNA, 18 bp, synthetic construct
  source 1..18: mol_type = other DNA
taataaaattcactatag

SEQ ID NO: 10993 - DNA, 18 bp, synthetic construct
  source 1..18: mol_type = other DNA
taatacgactaaaaatag

SEQ ID NO: 10994 - DNA, 18 bp, synthetic construct
  source 1..18: mol_type = other DNA
taatacttctcagtatag

SEQ ID NO: 10995 - DNA, 18 bp, synthetic construct
  source 1..18: mol_type = other DNA
taattcgactcaatacag

SEQ ID NO: 10996 - DNA, 18 bp, synthetic construct
  source 1..18: mol_type = other DNA
taataatactcactttag

SEQ ID NO: 10997 - DNA, 18 bp, synthetic construct
  source 1..18: mol_type = other DNA
taatacgacaaactttag

SEQ ID NO: 10998 - DNA, 18 bp, synthetic construct
  source 1..18: mol_type = other DNA
ttatacgacttacaatag

SEQ ID NO: 10999 - DNA, 18 bp, synthetic construct
  source 1..18: mol_type = other DNA
taaaactacttactatag

SEQ ID NO: 11000 - DNA, 18 bp, synthetic construct
  source 1..18: mol_type = other DNA
taatacgcctaactttag

SEQ ID NO: 11001 - DNA, 18 bp, synthetic construct
  source 1..18: mol_type = other DNA
ttatacgactcactatta

SEQ ID NO: 11002 - DNA, 18 bp, synthetic construct
  source 1..18: mol_type = other DNA
tattacgactcattaaag

SEQ ID NO: 11003 - DNA, 18 bp, synthetic construct
  source 1..18: mol_type = other DNA
aaaaacggctcactatag

SEQ ID NO: 11004 - DNA, 18 bp, synthetic construct
  source 1..18: mol_type = other DNA
aaatacgactcagtattg

SEQ ID NO: 11005 - DNA, 18 bp, synthetic construct
  source 1..18: mol_type = other DNA
taatacgtctcaacatag

SEQ ID NO: 11006 - DNA, 18 bp, synthetic construct
  source 1..18: mol_type = other DNA
taatactacacactctag

SEQ ID NO: 11007 - DNA, 18 bp, synthetic construct
  source 1..18: mol_type = other DNA
taatacttcccactatag

SEQ ID NO: 11008 - DNA, 18 bp, synthetic construct
  source 1..18: mol_type = other DNA
taattcctctcactatag

SEQ ID NO: 11009 - DNA, 18 bp, synthetic construct
  source 1..18: mol_type = other DNA
tattacgacccattatag

SEQ ID NO: 11010 - DNA, 18 bp, synthetic construct
  source 1..18: mol_type = other DNA
tattacgactaaatatag

SEQ ID NO: 11011 - DNA, 18 bp, synthetic construct
  source 1..18: mol_type = other DNA
ttatatgactaactatag

SEQ ID NO: 11012 - DNA, 18 bp, synthetic construct
  source 1..18: mol_type = other DNA
aaatacgatccactatag

SEQ ID NO: 11013 - DNA, 18 bp, synthetic construct
  source 1..18: mol_type = other DNA
caataggtctcactatag

SEQ ID NO: 11014 - DNA, 18 bp, synthetic construct
  source 1..18: mol_type = other DNA
taaaacgagtcactattg

SEQ ID NO: 11015 - DNA, 18 bp, synthetic construct
  source 1..18: mol_type = other DNA
taacactactcactacag

SEQ ID NO: 11016 - DNA, 18 bp, synthetic construct
  source 1..18: mol_type = other DNA
taataacactaactatag

SEQ ID NO: 11017 - DNA, 18 bp, synthetic construct
  source 1..18: mol_type = other DNA
taataagactaactgtag

SEQ ID NO: 11018 - DNA, 18 bp, synthetic construct
  source 1..18: mol_type = other DNA
taatacaaatcagtatag

SEQ ID NO: 11019 - DNA, 18 bp, synthetic construct
  source 1..18: mol_type = other DNA
taatacgacgcacaaaag

SEQ ID NO: 11020 - DNA, 18 bp, synthetic construct
  source 1..18: mol_type = other DNA
taatacgacttaccatcg

SEQ ID NO: 11021 - DNA, 18 bp, synthetic construct
  source 1..18: mol_type = other DNA
taatacgacttcctaaag

SEQ ID NO: 11022 - DNA, 18 bp, synthetic construct
  source 1..18: mol_type = other DNA
taatacgagttacaatag

SEQ ID NO: 11023 - DNA, 18 bp, synthetic construct
  source 1..18: mol_type = other DNA
taatacggctctctacag

SEQ ID NO: 11024 - DNA, 18 bp, synthetic construct
  source 1..18: mol_type = other DNA
taatacgtctgattatag

SEQ ID NO: 11025 - DNA, 18 bp, synthetic construct
  source 1..18: mol_type = other DNA
taatactactcaatagag

SEQ ID NO: 11026 - DNA, 18 bp, synthetic construct
  source 1..18: mol_type = other DNA
taataggaatcattatag

SEQ ID NO: 11027 - DNA, 18 bp, synthetic construct
  source 1..18: mol_type = other DNA
taatatgacttactatgg

SEQ ID NO: 11028 - DNA, 18 bp, synthetic construct
  source 1..18: mol_type = other DNA
taatatgagtcattatag

SEQ ID NO: 11029 - DNA, 18 bp, synthetic construct
  source 1..18: mol_type = other DNA
taatatggctcacaatag

SEQ ID NO: 11030 - DNA, 18 bp, synthetic construct
  source 1..18: mol_type = other DNA
taatatggttcactatag

SEQ ID NO: 11031 - DNA, 18 bp, synthetic construct
  source 1..18: mol_type = other DNA
taatccgacacactctag

SEQ ID NO: 11032 - DNA, 18 bp, synthetic construct
  source 1..18: mol_type = other DNA
taatcctactctctatag

SEQ ID NO: 11033 - DNA, 18 bp, synthetic construct
  source 1..18: mol_type = other DNA
taatctgactcaccatag

SEQ ID NO: 11034 - DNA, 18 bp, synthetic construct
  source 1..18: mol_type = other DNA
taatgcgactcactatta

SEQ ID NO: 11035 - DNA, 18 bp, synthetic construct
  source 1..18: mol_type = other DNA
taattccactcactgtag

SEQ ID NO: 11036 - DNA, 18 bp, synthetic construct
  source 1..18: mol_type = other DNA
taattggaatcactatag

SEQ ID NO: 11037 - DNA, 18 bp, synthetic construct
  source 1..18: mol_type = other DNA
tactaatactcactatag

SEQ ID NO: 11038 - DNA, 18 bp, synthetic construct
  source 1..18: mol_type = other DNA
tactaccactcacaatag

SEQ ID NO: 11039 - DNA, 18 bp, synthetic construct
  source 1..18: mol_type = other DNA
tactactacgcactatag

SEQ ID NO: 11040 - DNA, 18 bp, synthetic construct
  source 1..18: mol_type = other DNA
tagtacgtctcactgtag

SEQ ID NO: 11041 - DNA, 18 bp, synthetic construct
  source 1..18: mol_type = other DNA
tcaaacgactcaccatag

SEQ ID NO: 11042 - DNA, 18 bp, synthetic construct
  source 1..18: mol_type = other DNA
tcatacgtgtcactatag

SEQ ID NO: 11043 - DNA, 18 bp, synthetic construct
  source 1..18: mol_type = other DNA
tgatacgacacactatcg

SEQ ID NO: 11044 - DNA, 18 bp, synthetic construct
  source 1..18: mol_type = other DNA
ttacatgactcactatag

SEQ ID NO: 11045 - DNA, 18 bp, synthetic construct
  source 1..18: mol_type = other DNA
ttatacccctcactatag

SEQ ID NO: 11046 - DNA, 18 bp, synthetic construct
  source 1..18: mol_type = other DNA
ttctacgactcactatgg

SEQ ID NO: 11047 - DNA, 18 bp, synthetic construct
  source 1..18: mol_type = other DNA
tataacgactcattatag

SEQ ID NO: 11048 - DNA, 18 bp, synthetic construct
  source 1..18: mol_type = other DNA
aaatacgactaacaatag

SEQ ID NO: 11049 - DNA, 18 bp, synthetic construct
  source 1..18: mol_type = other DNA
caaaaccactcactatag

SEQ ID NO: 11050 - DNA, 18 bp, synthetic construct
  source 1..18: mol_type = other DNA
taacacgaatcactttag

SEQ ID NO: 11051 - DNA, 18 bp, synthetic construct
  source 1..18: mol_type = other DNA
taacacttctcactatag

SEQ ID NO: 11052 - DNA, 18 bp, synthetic construct
  source 1..18: mol_type = other DNA
taatacgaataactattg

SEQ ID NO: 11053 - DNA, 18 bp, synthetic construct
  source 1..18: mol_type = other DNA
tattacgacagactatag

SEQ ID NO: 11054 - DNA, 18 bp, synthetic construct
  source 1..18: mol_type = other DNA
tattacgagtctctatag

SEQ ID NO: 11055 - DNA, 18 bp, synthetic construct
  source 1..18: mol_type = other DNA
tcacacgactcacaatag

SEQ ID NO: 11056 - DNA, 18 bp, synthetic construct
  source 1..18: mol_type = other DNA
tcatacgtttcactatag

SEQ ID NO: 11057 - DNA, 18 bp, synthetic construct
  source 1..18: mol_type = other DNA
tgattcgacttactatag

SEQ ID NO: 11058 - DNA, 18 bp, synthetic construct
  source 1..18: mol_type = other DNA
taatacgtatcacaatag

SEQ ID NO: 11059 - DNA, 18 bp, synthetic construct
  source 1..18: mol_type = other DNA
ttaaacgacacactatag

SEQ ID NO: 11060 - DNA, 18 bp, synthetic construct
  source 1..18: mol_type = other DNA
taattagattcactatag

SEQ ID NO: 11061 - DNA, 18 bp, synthetic construct
  source 1..18: mol_type = other DNA
taaaaccacacactatag

SEQ ID NO: 11062 - DNA, 18 bp, synthetic construct
  source 1..18: mol_type = other DNA
taacacgtcacactatag

SEQ ID NO: 11063 - DNA, 18 bp, synthetic construct
  source 1..18: mol_type = other DNA
taatacaacttactaaag

SEQ ID NO: 11064 - DNA, 18 bp, synthetic construct
  source 1..18: mol_type = other DNA
tacttcgactcattatag

SEQ ID NO: 11065 - DNA, 18 bp, synthetic construct
  source 1..18: mol_type = other DNA
tattaccactctctatag

SEQ ID NO: 11066 - DNA, 18 bp, synthetic construct
  source 1..18: mol_type = other DNA
tgatacgtcacactatag

SEQ ID NO: 11067 - DNA, 18 bp, synthetic construct
  source 1..18: mol_type = other DNA
aaaaacgacgcactatag

SEQ ID NO: 11068 - DNA, 18 bp, synthetic construct
  source 1..18: mol_type = other DNA
aaatacgactcattctag

SEQ ID NO: 11069 - DNA, 18 bp, synthetic construct
  source 1..18: mol_type = other DNA
caatacgattaactatag

SEQ ID NO: 11070 - DNA, 18 bp, synthetic construct
  source 1..18: mol_type = other DNA
gaaaacgactcactttag

SEQ ID NO: 11071 - DNA, 18 bp, synthetic construct
  source 1..18: mol_type = other DNA
taacacgactctccatag

SEQ ID NO: 11072 - DNA, 18 bp, synthetic construct
  source 1..18: mol_type = other DNA
taacactattcactatag

SEQ ID NO: 11073 - DNA, 18 bp, synthetic construct
  source 1..18: mol_type = other DNA
taagacgtctaactatag

SEQ ID NO: 11074 - DNA, 18 bp, synthetic construct
  source 1..18: mol_type = other DNA
taataagacttaccatag

SEQ ID NO: 11075 - DNA, 18 bp, synthetic construct
  source 1..18: mol_type = other DNA
taataagatccactatag

SEQ ID NO: 11076 - DNA, 18 bp, synthetic construct
  source 1..18: mol_type = other DNA
taataagattcaccatag

SEQ ID NO: 11077 - DNA, 18 bp, synthetic construct
  source 1..18: mol_type = other DNA
taatacaactcacgaaag

SEQ ID NO: 11078 - DNA, 18 bp, synthetic construct
  source 1..18: mol_type = other DNA
taatacgacgcattattg

SEQ ID NO: 11079 - DNA, 18 bp, synthetic construct
  source 1..18: mol_type = other DNA
taatacgacttactctcg

SEQ ID NO: 11080 - DNA, 18 bp, synthetic construct
  source 1..18: mol_type = other DNA
taatacgcctcacaattg

SEQ ID NO: 11081 - DNA, 18 bp, synthetic construct
  source 1..18: mol_type = other DNA
taatactaatcactacag

SEQ ID NO: 11082 - DNA, 18 bp, synthetic construct
  source 1..18: mol_type = other DNA
taatactactccttatag

SEQ ID NO: 11083 - DNA, 18 bp, synthetic construct
  source 1..18: mol_type = other DNA
taatactagtcacaatag

SEQ ID NO: 11084 - DNA, 18 bp, synthetic construct
  source 1..18: mol_type = other DNA
taatagaacacactatag

SEQ ID NO: 11085 - DNA, 18 bp, synthetic construct
  source 1..18: mol_type = other DNA
taataggactccctaaag

SEQ ID NO: 11086 - DNA, 18 bp, synthetic construct
  source 1..18: mol_type = other DNA
taatctgactcactttag

SEQ ID NO: 11087 - DNA, 18 bp, synthetic construct
  source 1..18: mol_type = other DNA
taatgcgacccactattg

SEQ ID NO: 11088 - DNA, 18 bp, synthetic construct
  source 1..18: mol_type = other DNA
taatgcgactcattctag

SEQ ID NO: 11089 - DNA, 18 bp, synthetic construct
  source 1..18: mol_type = other DNA
taattcgagtcaccatag

SEQ ID NO: 11090 - DNA, 18 bp, synthetic construct
  source 1..18: mol_type = other DNA
tactacctctcactatag

SEQ ID NO: 11091 - DNA, 18 bp, synthetic construct
  source 1..18: mol_type = other DNA
tactacgactctctgtag

SEQ ID NO: 11092 - DNA, 18 bp, synthetic construct
  source 1..18: mol_type = other DNA
tactacgtctcattatag

SEQ ID NO: 11093 - DNA, 18 bp, synthetic construct
  source 1..18: mol_type = other DNA
tactgcgactaactatag

SEQ ID NO: 11094 - DNA, 18 bp, synthetic construct
  source 1..18: mol_type = other DNA
tcaaacgactccctatag

SEQ ID NO: 11095 - DNA, 18 bp, synthetic construct
  source 1..18: mol_type = other DNA
tgatacgaataactatag

SEQ ID NO: 11096 - DNA, 18 bp, synthetic construct
  source 1..18: mol_type = other DNA
tgatactacacactatag

SEQ ID NO: 11097 - DNA, 18 bp, synthetic construct
  source 1..18: mol_type = other DNA
tgttacggctcactatag

SEQ ID NO: 11098 - DNA, 18 bp, synthetic construct
  source 1..18: mol_type = other DNA
ttatacgactcatgatag

SEQ ID NO: 11099 - DNA, 18 bp, synthetic construct
  source 1..18: mol_type = other DNA
ttatacgagccactatag

SEQ ID NO: 11100 - DNA, 18 bp, synthetic construct
  source 1..18: mol_type = other DNA
ttatacgagtcagtatag

SEQ ID NO: 11101 - DNA, 18 bp, synthetic construct
  source 1..18: mol_type = other DNA
ttatacggttcactatag

SEQ ID NO: 11102 - DNA, 18 bp, synthetic construct
  source 1..18: mol_type = other DNA
taatactactctctaaag

SEQ ID NO: 11103 - DNA, 18 bp, synthetic construct
  source 1..18: mol_type = other DNA
taatttgactcacaatag

SEQ ID NO: 11104 - DNA, 18 bp, synthetic construct
  source 1..18: mol_type = other DNA
aaatacgtgtcactatag

SEQ ID NO: 11105 - DNA, 18 bp, synthetic construct
  source 1..18: mol_type = other DNA
taaaatgaatcactatag

SEQ ID NO: 11106 - DNA, 18 bp, synthetic construct
  source 1..18: mol_type = other DNA
taatacgaatcactgttg

SEQ ID NO: 11107 - DNA, 18 bp, synthetic construct
  source 1..18: mol_type = other DNA
taatacgacaaacaatag

SEQ ID NO: 11108 - DNA, 18 bp, synthetic construct
  source 1..18: mol_type = other DNA
taatacgagtcaataaag

SEQ ID NO: 11109 - DNA, 18 bp, synthetic construct
  source 1..18: mol_type = other DNA
taatatgactatctatag

SEQ ID NO: 11110 - DNA, 18 bp, synthetic construct
  source 1..18: mol_type = other DNA
tattacgcctaactatag

SEQ ID NO: 11111 - DNA, 18 bp, synthetic construct
  source 1..18: mol_type = other DNA
taacacgactcacttaag

SEQ ID NO: 11112 - DNA, 18 bp, synthetic construct
  source 1..18: mol_type = other DNA
taatacgtctcacaattg

SEQ ID NO: 11113 - DNA, 18 bp, synthetic construct
  source 1..18: mol_type = other DNA
taatacgacaatctatag

SEQ ID NO: 11114 - DNA, 18 bp, synthetic construct
  source 1..18: mol_type = other DNA
taatacgattcaatttag

SEQ ID NO: 11115 - DNA, 18 bp, synthetic construct
  source 1..18: mol_type = other DNA
taattcgacacactttag

SEQ ID NO: 11116 - DNA, 18 bp, synthetic construct
  source 1..18: mol_type = other DNA
taatactactcattttag

SEQ ID NO: 11117 - DNA, 18 bp, synthetic construct
  source 1..18: mol_type = other DNA
ttatacgactaactttag

SEQ ID NO: 11118 - DNA, 18 bp, synthetic construct
  source 1..18: mol_type = other DNA
ttatatgactcacaatag

SEQ ID NO: 11119 - DNA, 18 bp, synthetic construct
  source 1..18: mol_type = other DNA
aaatacgattcattatag

SEQ ID NO: 11120 - DNA, 18 bp, synthetic construct
  source 1..18: mol_type = other DNA
taatacaactcaaaatag

SEQ ID NO: 11121 - DNA, 18 bp, synthetic construct
  source 1..18: mol_type = other DNA
taattagacttactatag

SEQ ID NO: 11122 - DNA, 18 bp, synthetic construct
  source 1..18: mol_type = other DNA
caatacgacactctatag

SEQ ID NO: 11123 - DNA, 18 bp, synthetic construct
  source 1..18: mol_type = other DNA
taacacgactcaataaag

SEQ ID NO: 11124 - DNA, 18 bp, synthetic construct
  source 1..18: mol_type = other DNA
taacatgactcacaatag

SEQ ID NO: 11125 - DNA, 18 bp, synthetic construct
  source 1..18: mol_type = other DNA
taatactactcacaacag

SEQ ID NO: 11126 - DNA, 18 bp, synthetic construct
  source 1..18: mol_type = other DNA
ttataccacttactatag

SEQ ID NO: 11127 - DNA, 18 bp, synthetic construct
  source 1..18: mol_type = other DNA
aaataccactcactatcg

SEQ ID NO: 11128 - DNA, 18 bp, synthetic construct
  source 1..18: mol_type = other DNA
gaatacgactcacaaaag

SEQ ID NO: 11129 - DNA, 18 bp, synthetic construct
  source 1..18: mol_type = other DNA
taaaacgactcattgtag

SEQ ID NO: 11130 - DNA, 18 bp, synthetic construct
  source 1..18: mol_type = other DNA
taaaacgacttactatgg

SEQ ID NO: 11131 - DNA, 18 bp, synthetic construct
  source 1..18: mol_type = other DNA
taaaacgattcgctatag

SEQ ID NO: 11132 - DNA, 18 bp, synthetic construct
  source 1..18: mol_type = other DNA
taacaggtctcactatag

SEQ ID NO: 11133 - DNA, 18 bp, synthetic construct
  source 1..18: mol_type = other DNA
taataagacttactatgg

SEQ ID NO: 11134 - DNA, 18 bp, synthetic construct
  source 1..18: mol_type = other DNA
taataccactcacaatcg

SEQ ID NO: 11135 - DNA, 18 bp, synthetic construct
  source 1..18: mol_type = other DNA
taatacctctcaccatag

SEQ ID NO: 11136 - DNA, 18 bp, synthetic construct
  source 1..18: mol_type = other DNA
taatacgaaacactatcg

SEQ ID NO: 11137 - DNA, 18 bp, synthetic construct
  source 1..18: mol_type = other DNA
taatacgaataaccatag

SEQ ID NO: 11138 - DNA, 18 bp, synthetic construct
  source 1..18: mol_type = other DNA
taatacgaattgctatag

SEQ ID NO: 11139 - DNA, 18 bp, synthetic construct
  source 1..18: mol_type = other DNA
taatacgactcaatgtcg

SEQ ID NO: 11140 - DNA, 18 bp, synthetic construct
  source 1..18: mol_type = other DNA
taatacgacttaccttag

SEQ ID NO: 11141 - DNA, 18 bp, synthetic construct
  source 1..18: mol_type = other DNA
taatacgactttctacag

SEQ ID NO: 11142 - DNA, 18 bp, synthetic construct
  source 1..18: mol_type = other DNA
taatacgactttctagag

SEQ ID NO: 11143 - DNA, 18 bp, synthetic construct
  source 1..18: mol_type = other DNA
taatacgcttaactatag

SEQ ID NO: 11144 - DNA, 18 bp, synthetic construct
  source 1..18: mol_type = other DNA
taatacggctaactaaag

SEQ ID NO: 11145 - DNA, 18 bp, synthetic construct
  source 1..18: mol_type = other DNA
taatacgtctcggtatag

SEQ ID NO: 11146 - DNA, 18 bp, synthetic construct
  source 1..18: mol_type = other DNA
taatactactagctatag

SEQ ID NO: 11147 - DNA, 18 bp, synthetic construct
  source 1..18: mol_type = other DNA
taataggactcataatag

SEQ ID NO: 11148 - DNA, 18 bp, synthetic construct
  source 1..18: mol_type = other DNA
taatatgactcattctag

SEQ ID NO: 11149 - DNA, 18 bp, synthetic construct
  source 1..18: mol_type = other DNA
taatattactcgctatag

SEQ ID NO: 11150 - DNA, 18 bp, synthetic construct
  source 1..18: mol_type = other DNA
taatggaactcactatag

SEQ ID NO: 11151 - DNA, 18 bp, synthetic construct
  source 1..18: mol_type = other DNA
taattcgattcagtatag

SEQ ID NO: 11152 - DNA, 18 bp, synthetic construct
  source 1..18: mol_type = other DNA
taattggactcaatatag

SEQ ID NO: 11153 - DNA, 18 bp, synthetic construct
  source 1..18: mol_type = other DNA
tactacaactcattatag

SEQ ID NO: 11154 - DNA, 18 bp, synthetic construct
  source 1..18: mol_type = other DNA
tagtacgactcacaacag

SEQ ID NO: 11155 - DNA, 18 bp, synthetic construct
  source 1..18: mol_type = other DNA
tagtatgactcactttag

SEQ ID NO: 11156 - DNA, 18 bp, synthetic construct
  source 1..18: mol_type = other DNA
tattacgcctcgctatag

SEQ ID NO: 11157 - DNA, 18 bp, synthetic construct
  source 1..18: mol_type = other DNA
tattaggagtcactatag

SEQ ID NO: 11158 - DNA, 18 bp, synthetic construct
  source 1..18: mol_type = other DNA
tcatagtactcactatag

SEQ ID NO: 11159 - DNA, 18 bp, synthetic construct
  source 1..18: mol_type = other DNA
tcatataactcactatag

SEQ ID NO: 11160 - DNA, 18 bp, synthetic construct
  source 1..18: mol_type = other DNA
ttacacgactcactatcg

SEQ ID NO: 11161 - DNA, 18 bp, synthetic construct
  source 1..18: mol_type = other DNA
ttatacgattcaatatag

SEQ ID NO: 11162 - DNA, 18 bp, synthetic construct
  source 1..18: mol_type = other DNA
taatataacacactatag

SEQ ID NO: 11163 - DNA, 18 bp, synthetic construct
  source 1..18: mol_type = other DNA
taatattattcactatag

SEQ ID NO: 11164 - DNA, 18 bp, synthetic construct
  source 1..18: mol_type = other DNA
taaatcgactctctatag

SEQ ID NO: 11165 - DNA, 18 bp, synthetic construct
  source 1..18: mol_type = other DNA
aaataagacttactatag

SEQ ID NO: 11166 - DNA, 18 bp, synthetic construct
  source 1..18: mol_type = other DNA
taaaacgattccctatag

SEQ ID NO: 11167 - DNA, 18 bp, synthetic construct
  source 1..18: mol_type = other DNA
taatacgactcccaaaag

SEQ ID NO: 11168 - DNA, 18 bp, synthetic construct
  source 1..18: mol_type = other DNA
taatacgtcccattatag

SEQ ID NO: 11169 - DNA, 18 bp, synthetic construct
  source 1..18: mol_type = other DNA
taatatgactcaatttag

SEQ ID NO: 11170 - DNA, 18 bp, synthetic construct
  source 1..18: mol_type = other DNA
taattcgactcatcatag

SEQ ID NO: 11171 - DNA, 18 bp, synthetic construct
  source 1..18: mol_type = other DNA
ttataagactaactatag

SEQ ID NO: 11172 - DNA, 18 bp, synthetic construct
  source 1..18: mol_type = other DNA
ttatacgactcaatacag

SEQ ID NO: 11173 - DNA, 18 bp, synthetic construct
  source 1..18: mol_type = other DNA
ttatactactcagtatag

SEQ ID NO: 11174 - DNA, 18 bp, synthetic construct
  source 1..18: mol_type = other DNA
taattcgactcaataaag

SEQ ID NO: 11175 - DNA, 18 bp, synthetic construct
  source 1..18: mol_type = other DNA
tatttcgaatcactatag

SEQ ID NO: 11176 - DNA, 18 bp, synthetic construct
  source 1..18: mol_type = other DNA
taaaactactaactatag

SEQ ID NO: 11177 - DNA, 18 bp, synthetic construct
  source 1..18: mol_type = other DNA
taatccgactcacattag

SEQ ID NO: 11178 - DNA, 18 bp, synthetic construct
  source 1..18: mol_type = other DNA
ttatacgacacactctag

SEQ ID NO: 11179 - DNA, 18 bp, synthetic construct
  source 1..18: mol_type = other DNA
ttatacgtctcagtatag

SEQ ID NO: 11180 - DNA, 18 bp, synthetic construct
  source 1..18: mol_type = other DNA
aaatacgactcactaatg

SEQ ID NO: 11181 - DNA, 18 bp, synthetic construct
  source 1..18: mol_type = other DNA
tattaagaatcactatag

SEQ ID NO: 11182 - DNA, 18 bp, synthetic construct
  source 1..18: mol_type = other DNA
aaatacgaccctctatag

SEQ ID NO: 11183 - DNA, 18 bp, synthetic construct
  source 1..18: mol_type = other DNA
taataccacttactattg

SEQ ID NO: 11184 - DNA, 18 bp, synthetic construct
  source 1..18: mol_type = other DNA
taatacgaccttctatag

SEQ ID NO: 11185 - DNA, 18 bp, synthetic construct
  source 1..18: mol_type = other DNA
taatacgattcaccttag

SEQ ID NO: 11186 - DNA, 18 bp, synthetic construct
  source 1..18: mol_type = other DNA
taatatgaattactatag

SEQ ID NO: 11187 - DNA, 18 bp, synthetic construct
  source 1..18: mol_type = other DNA
tattacgactaaccatag

SEQ ID NO: 11188 - DNA, 18 bp, synthetic construct
  source 1..18: mol_type = other DNA
tattactactcactatgg

SEQ ID NO: 11189 - DNA, 18 bp, synthetic construct
  source 1..18: mol_type = other DNA
aaatacgactaactgtag

SEQ ID NO: 11190 - DNA, 18 bp, synthetic construct
  source 1..18: mol_type = other DNA
aaatacgactacctatag

SEQ ID NO: 11191 - DNA, 18 bp, synthetic construct
  source 1..18: mol_type = other DNA
aaatacgactcaatatgg

SEQ ID NO: 11192 - DNA, 18 bp, synthetic construct
  source 1..18: mol_type = other DNA
aaatgcgactgactatag

SEQ ID NO: 11193 - DNA, 18 bp, synthetic construct
  source 1..18: mol_type = other DNA
agatacgactcaatatag

SEQ ID NO: 11194 - DNA, 18 bp, synthetic construct
  source 1..18: mol_type = other DNA
agatacgactcactttag

SEQ ID NO: 11195 - DNA, 18 bp, synthetic construct
  source 1..18: mol_type = other DNA
caatacaagtcactatag

SEQ ID NO: 11196 - DNA, 18 bp, synthetic construct
  source 1..18: mol_type = other DNA
caatatgactcactatcg

SEQ ID NO: 11197 - DNA, 18 bp, synthetic construct
  source 1..18: mol_type = other DNA
caatatgtctcactatag

SEQ ID NO: 11198 - DNA, 18 bp, synthetic construct
  source 1..18: mol_type = other DNA
caattcgattcactatag

SEQ ID NO: 11199 - DNA, 18 bp, synthetic construct
  source 1..18: mol_type = other DNA
taacaagactcattatag

SEQ ID NO: 11200 - DNA, 18 bp, synthetic construct
  source 1..18: mol_type = other DNA
taataacactcactgtag

SEQ ID NO: 11201 - DNA, 18 bp, synthetic construct
  source 1..18: mol_type = other DNA
taataagactcaatatgg

SEQ ID NO: 11202 - DNA, 18 bp, synthetic construct
  source 1..18: mol_type = other DNA
taataagactcaatgtag

SEQ ID NO: 11203 - DNA, 18 bp, synthetic construct
  source 1..18: mol_type = other DNA
taatacgacgctctaaag

SEQ ID NO: 11204 - DNA, 18 bp, synthetic construct
  source 1..18: mol_type = other DNA
taatacgactaagtaaag

SEQ ID NO: 11205 - DNA, 18 bp, synthetic construct
  source 1..18: mol_type = other DNA
taatacgactcataagag

SEQ ID NO: 11206 - DNA, 18 bp, synthetic construct
  source 1..18: mol_type = other DNA
taatacgactgtctacag

SEQ ID NO: 11207 - DNA, 18 bp, synthetic construct
  source 1..18: mol_type = other DNA
taataggacacactatcg

SEQ ID NO: 11208 - DNA, 18 bp, synthetic construct
  source 1..18: mol_type = other DNA
taatatgcttcactatag

SEQ ID NO: 11209 - DNA, 18 bp, synthetic construct
  source 1..18: mol_type = other DNA
taatattactccctatag

SEQ ID NO: 11210 - DNA, 18 bp, synthetic construct
  source 1..18: mol_type = other DNA
taatgcgactaacaatag

SEQ ID NO: 11211 - DNA, 18 bp, synthetic construct
  source 1..18: mol_type = other DNA
taccactactcactatag

SEQ ID NO: 11212 - DNA, 18 bp, synthetic construct
  source 1..18: mol_type = other DNA
tactatgacacactatag

SEQ ID NO: 11213 - DNA, 18 bp, synthetic construct
  source 1..18: mol_type = other DNA
tactccaactcactatag

SEQ ID NO: 11214 - DNA, 18 bp, synthetic construct
  source 1..18: mol_type = other DNA
tagaacgactcactacag

SEQ ID NO: 11215 - DNA, 18 bp, synthetic construct
  source 1..18: mol_type = other DNA
tagtacgactcaaaatag

SEQ ID NO: 11216 - DNA, 18 bp, synthetic construct
  source 1..18: mol_type = other DNA
tagtacgactccctattg

SEQ ID NO: 11217 - DNA, 18 bp, synthetic construct
  source 1..18: mol_type = other DNA
tagtatgactcactacag

SEQ ID NO: 11218 - DNA, 18 bp, synthetic construct
  source 1..18: mol_type = other DNA
tagtccgactctctatag

SEQ ID NO: 11219 - DNA, 18 bp, synthetic construct
  source 1..18: mol_type = other DNA
tattaccactcactacag

SEQ ID NO: 11220 - DNA, 18 bp, synthetic construct
  source 1..18: mol_type = other DNA
tcatacaactaactatag

SEQ ID NO: 11221 - DNA, 18 bp, synthetic construct
  source 1..18: mol_type = other DNA
tcatacgactaattatag

SEQ ID NO: 11222 - DNA, 18 bp, synthetic construct
  source 1..18: mol_type = other DNA
tcatacgattcactatgg

SEQ ID NO: 11223 - DNA, 18 bp, synthetic construct
  source 1..18: mol_type = other DNA
tcctaagactcactatag

SEQ ID NO: 11224 - DNA, 18 bp, synthetic construct
  source 1..18: mol_type = other DNA
tcttaagactcactatag

SEQ ID NO: 11225 - DNA, 18 bp, synthetic construct
  source 1..18: mol_type = other DNA
tgctaagactcactatag

SEQ ID NO: 11226 - DNA, 18 bp, synthetic construct
  source 1..18: mol_type = other DNA
ttacacgactcaccatag

SEQ ID NO: 11227 - DNA, 18 bp, synthetic construct
  source 1..18: mol_type = other DNA
taatactaatcacaatag

SEQ ID NO: 11228 - DNA, 18 bp, synthetic construct
  source 1..18: mol_type = other DNA
taattcaattcactatag

SEQ ID NO: 11229 - DNA, 18 bp, synthetic construct
  source 1..18: mol_type = other DNA
tattacgacttactttag

SEQ ID NO: 11230 - DNA, 18 bp, synthetic construct
  source 1..18: mol_type = other DNA
aaataagattcactatag

SEQ ID NO: 11231 - DNA, 18 bp, synthetic construct
  source 1..18: mol_type = other DNA
acatactactcactatag

SEQ ID NO: 11232 - DNA, 18 bp, synthetic construct
  source 1..18: mol_type = other DNA
taacacgattcactttag

SEQ ID NO: 11233 - DNA, 18 bp, synthetic construct
  source 1..18: mol_type = other DNA
taataatattcactatag

SEQ ID NO: 11234 - DNA, 18 bp, synthetic construct
  source 1..18: mol_type = other DNA
taatacgattcagtttag

SEQ ID NO: 11235 - DNA, 18 bp, synthetic construct
  source 1..18: mol_type = other DNA
taatacgtcacactctag

SEQ ID NO: 11236 - DNA, 18 bp, synthetic construct
  source 1..18: mol_type = other DNA
aaattcgactctctatag

SEQ ID NO: 11237 - DNA, 18 bp, synthetic construct
  source 1..18: mol_type = other DNA
aaatacgtctcaatatag

SEQ ID NO: 11238 - DNA, 18 bp, synthetic construct
  source 1..18: mol_type = other DNA
aaattcgactcaatatag

SEQ ID NO: 11239 - DNA, 18 bp, synthetic construct
  source 1..18: mol_type = other DNA
taatacaactcaatttag

SEQ ID NO: 11240 - DNA, 18 bp, synthetic construct
  source 1..18: mol_type = other DNA
taatacaatttactatag

SEQ ID NO: 11241 - DNA, 18 bp, synthetic construct
  source 1..18: mol_type = other DNA
taatacgatttactaaag

SEQ ID NO: 11242 - DNA, 18 bp, synthetic construct
  source 1..18: mol_type = other DNA
taatacttttcactatag

SEQ ID NO: 11243 - DNA, 18 bp, synthetic construct
  source 1..18: mol_type = other DNA
taataagacttactttag

SEQ ID NO: 11244 - DNA, 18 bp, synthetic construct
  source 1..18: mol_type = other DNA
taatacgacttacttcag

SEQ ID NO: 11245 - DNA, 18 bp, synthetic construct
  source 1..18: mol_type = other DNA
ttatacgaattactatag

SEQ ID NO: 11246 - DNA, 18 bp, synthetic construct
  source 1..18: mol_type = other DNA
tattacgactcacaaaag

SEQ ID NO: 11247 - DNA, 18 bp, synthetic construct
  source 1..18: mol_type = other DNA
ctatacgactcactattg

SEQ ID NO: 11248 - DNA, 18 bp, synthetic construct
  source 1..18: mol_type = other DNA
taataagtctcacaatag

SEQ ID NO: 11249 - DNA, 18 bp, synthetic construct
  source 1..18: mol_type = other DNA
taatacgacttataatag

SEQ ID NO: 11250 - DNA, 18 bp, synthetic construct
  source 1..18: mol_type = other DNA
taatacttctcactgtag

SEQ ID NO: 11251 - DNA, 18 bp, synthetic construct
  source 1..18: mol_type = other DNA
taattcgaatcactaaag

SEQ ID NO: 11252 - DNA, 18 bp, synthetic construct
  source 1..18: mol_type = other DNA
tcattctactcactatag

SEQ ID NO: 11253 - DNA, 18 bp, synthetic construct
  source 1..18: mol_type = other DNA
aaataccattcactatag

SEQ ID NO: 11254 - DNA, 18 bp, synthetic construct
  source 1..18: mol_type = other DNA
aaatgcgattcactatag

SEQ ID NO: 11255 - DNA, 18 bp, synthetic construct
  source 1..18: mol_type = other DNA
aactatgactcactatag

SEQ ID NO: 11256 - DNA, 18 bp, synthetic construct
  source 1..18: mol_type = other DNA
caatacgactccctattg

SEQ ID NO: 11257 - DNA, 18 bp, synthetic construct
  source 1..18: mol_type = other DNA
caatacgattcaccatag

SEQ ID NO: 11258 - DNA, 18 bp, synthetic construct
  source 1..18: mol_type = other DNA
taactcgaatcactatag

SEQ ID NO: 11259 - DNA, 18 bp, synthetic construct
  source 1..18: mol_type = other DNA
taataagactctctatgg

SEQ ID NO: 11260 - DNA, 18 bp, synthetic construct
  source 1..18: mol_type = other DNA
taatacaactaaatatag

SEQ ID NO: 11261 - DNA, 18 bp, synthetic construct
  source 1..18: mol_type = other DNA
taataccattcacgatag

SEQ ID NO: 11262 - DNA, 18 bp, synthetic construct
  source 1..18: mol_type = other DNA
taatacgactagctttag

SEQ ID NO: 11263 - DNA, 18 bp, synthetic construct
  source 1..18: mol_type = other DNA
taatacgactcatttgag

SEQ ID NO: 11264 - DNA, 18 bp, synthetic construct
  source 1..18: mol_type = other DNA
taatacgatccattatag

SEQ ID NO: 11265 - DNA, 18 bp, synthetic construct
  source 1..18: mol_type = other DNA
taatacgcctctccatag

SEQ ID NO: 11266 - DNA, 18 bp, synthetic construct
  source 1..18: mol_type = other DNA
taatacgtccaactatag

SEQ ID NO: 11267 - DNA, 18 bp, synthetic construct
  source 1..18: mol_type = other DNA
taatacgtgtccctatag

SEQ ID NO: 11268 - DNA, 18 bp, synthetic construct
  source 1..18: mol_type = other DNA
taatactacacactatgg

SEQ ID NO: 11269 - DNA, 18 bp, synthetic construct
  source 1..18: mol_type = other DNA
taatagtactcactaaag

SEQ ID NO: 11270 - DNA, 18 bp, synthetic construct
  source 1..18: mol_type = other DNA
taatataactcaccatag

SEQ ID NO: 11271 - DNA, 18 bp, synthetic construct
  source 1..18: mol_type = other DNA
taatatgacttagtatag

SEQ ID NO: 11272 - DNA, 18 bp, synthetic construct
  source 1..18: mol_type = other DNA
taattcgattcactagag

SEQ ID NO: 11273 - DNA, 18 bp, synthetic construct
  source 1..18: mol_type = other DNA
taattctcctcactatag

SEQ ID NO: 11274 - DNA, 18 bp, synthetic construct
  source 1..18: mol_type = other DNA
tactacgactcgctttag

SEQ ID NO: 11275 - DNA, 18 bp, synthetic construct
  source 1..18: mol_type = other DNA
tgatacgactcaaaatag

SEQ ID NO: 11276 - DNA, 18 bp, synthetic construct
  source 1..18: mol_type = other DNA
taatacaacttactattg

SEQ ID NO: 11277 - DNA, 18 bp, synthetic construct
  source 1..18: mol_type = other DNA
tattatgactcactattg

SEQ ID NO: 11278 - DNA, 18 bp, synthetic construct
  source 1..18: mol_type = other DNA
aaacacgactcactaaag

SEQ ID NO: 11279 - DNA, 18 bp, synthetic construct
  source 1..18: mol_type = other DNA
aaacactactcactatag

SEQ ID NO: 11280 - DNA, 18 bp, synthetic construct
  source 1..18: mol_type = other DNA
taataagtcccactatag

SEQ ID NO: 11281 - DNA, 18 bp, synthetic construct
  source 1..18: mol_type = other DNA
taatacaattcactaaag

SEQ ID NO: 11282 - DNA, 18 bp, synthetic construct
  source 1..18: mol_type = other DNA
taatacctctcactaaag

SEQ ID NO: 11283 - DNA, 18 bp, synthetic construct
  source 1..18: mol_type = other DNA
taatacgagtcacaattg

SEQ ID NO: 11284 - DNA, 18 bp, synthetic construct
  source 1..18: mol_type = other DNA
taatacgagtcacttaag

SEQ ID NO: 11285 - DNA, 18 bp, synthetic construct
  source 1..18: mol_type = other DNA
taatatcactcactattg

SEQ ID NO: 11286 - DNA, 18 bp, synthetic construct
  source 1..18: mol_type = other DNA
tagtacgtcacactatag

SEQ ID NO: 11287 - DNA, 18 bp, synthetic construct
  source 1..18: mol_type = other DNA
ttatacggcacactatag

SEQ ID NO: 11288 - DNA, 18 bp, synthetic construct
  source 1..18: mol_type = other DNA
taatactacactctatag

SEQ ID NO: 11289 - DNA, 18 bp, synthetic construct
  source 1..18: mol_type = other DNA
aaatacgacttacaatag

SEQ ID NO: 11290 - DNA, 18 bp, synthetic construct
  source 1..18: mol_type = other DNA
aattacgactaactatag

SEQ ID NO: 11291 - DNA, 18 bp, synthetic construct
  source 1..18: mol_type = other DNA
aaatacgaatcattatag

SEQ ID NO: 11292 - DNA, 18 bp, synthetic construct
  source 1..18: mol_type = other DNA
taatactacacattatag

SEQ ID NO: 11293 - DNA, 18 bp, synthetic construct
  source 1..18: mol_type = other DNA
taataggtctctctatag

SEQ ID NO: 11294 - DNA, 18 bp, synthetic construct
  source 1..18: mol_type = other DNA
tattacgagtcactattg

SEQ ID NO: 11295 - DNA, 18 bp, synthetic construct
  source 1..18: mol_type = other DNA
aaatacgtcccactatag

SEQ ID NO: 11296 - DNA, 18 bp, synthetic construct
  source 1..18: mol_type = other DNA
aagtatgactcactatag

SEQ ID NO: 11297 - DNA, 18 bp, synthetic construct
  source 1..18: mol_type = other DNA
caatataactcactatag

SEQ ID NO: 11298 - DNA, 18 bp, synthetic construct
  source 1..18: mol_type = other DNA
taaaacgactcatcatag

SEQ ID NO: 11299 - DNA, 18 bp, synthetic construct
  source 1..18: mol_type = other DNA
taaaaggactcaatatag

SEQ ID NO: 11300 - DNA, 18 bp, synthetic construct
  source 1..18: mol_type = other DNA
taacacggctcactttag

SEQ ID NO: 11301 - DNA, 18 bp, synthetic construct
  source 1..18: mol_type = other DNA
taactcgactcactattg

SEQ ID NO: 11302 - DNA, 18 bp, synthetic construct
  source 1..18: mol_type = other DNA
taagactactcactaaag

SEQ ID NO: 11303 - DNA, 18 bp, synthetic construct
  source 1..18: mol_type = other DNA
taagatgattcactatag

SEQ ID NO: 11304 - DNA, 18 bp, synthetic construct
  source 1..18: mol_type = other DNA
taataaaactcactgtag

SEQ ID NO: 11305 - DNA, 18 bp, synthetic construct
  source 1..18: mol_type = other DNA
taataccactaattatag

SEQ ID NO: 11306 - DNA, 18 bp, synthetic construct
  source 1..18: mol_type = other DNA
taataccactcactactg

SEQ ID NO: 11307 - DNA, 18 bp, synthetic construct
  source 1..18: mol_type = other DNA
taatacgaatcaccatcg

SEQ ID NO: 11308 - DNA, 18 bp, synthetic construct
  source 1..18: mol_type = other DNA
taatacgacaccctatgg

SEQ ID NO: 11309 - DNA, 18 bp, synthetic construct
  source 1..18: mol_type = other DNA
taatactactgactattg

SEQ ID NO: 11310 - DNA, 18 bp, synthetic construct
  source 1..18: mol_type = other DNA
taataggatttactatag

SEQ ID NO: 11311 - DNA, 18 bp, synthetic construct
  source 1..18: mol_type = other DNA
taatatgaccaactatag

SEQ ID NO: 11312 - DNA, 18 bp, synthetic construct
  source 1..18: mol_type = other DNA
taatctaactcactatag

SEQ ID NO: 11313 - DNA, 18 bp, synthetic construct
  source 1..18: mol_type = other DNA
taatgcgacatactatag

SEQ ID NO: 11314 - DNA, 18 bp, synthetic construct
  source 1..18: mol_type = other DNA
taattcgaatgactatag

SEQ ID NO: 11315 - DNA, 18 bp, synthetic construct
  source 1..18: mol_type = other DNA
tactaagactcacaatag

SEQ ID NO: 11316 - DNA, 18 bp, synthetic construct
  source 1..18: mol_type = other DNA
tactacgactcattgtag

SEQ ID NO: 11317 - DNA, 18 bp, synthetic construct
  source 1..18: mol_type = other DNA
tactacgactccttatag

SEQ ID NO: 11318 - DNA, 18 bp, synthetic construct
  source 1..18: mol_type = other DNA
tactccgactcactaaag

SEQ ID NO: 11319 - DNA, 18 bp, synthetic construct
  source 1..18: mol_type = other DNA
tagaacgattcactatag

SEQ ID NO: 11320 - DNA, 18 bp, synthetic construct
  source 1..18: mol_type = other DNA
tagtaccactcactattg

SEQ ID NO: 11321 - DNA, 18 bp, synthetic construct
  source 1..18: mol_type = other DNA
tagtacgaatcacaatag

SEQ ID NO: 11322 - DNA, 18 bp, synthetic construct
  source 1..18: mol_type = other DNA
tattacggttcactatag

SEQ ID NO: 11323 - DNA, 18 bp, synthetic construct
  source 1..18: mol_type = other DNA
tcactcgactcactatag

SEQ ID NO: 11324 - DNA, 18 bp, synthetic construct
  source 1..18: mol_type = other DNA
tcatacgactcactgttg

SEQ ID NO: 11325 - DNA, 18 bp, synthetic construct
  source 1..18: mol_type = other DNA
tcatactactaactatag

SEQ ID NO: 11326 - DNA, 18 bp, synthetic construct
  source 1..18: mol_type = other DNA
tcattcgactcactatgg

SEQ ID NO: 11327 - DNA, 18 bp, synthetic construct
  source 1..18: mol_type = other DNA
tcctacgactcactaaag

SEQ ID NO: 11328 - DNA, 18 bp, synthetic construct
  source 1..18: mol_type = other DNA
tgatacgactcgttatag

SEQ ID NO: 11329 - DNA, 18 bp, synthetic construct
  source 1..18: mol_type = other DNA
tgctacgactctctatag

SEQ ID NO: 11330 - DNA, 18 bp, synthetic construct
  source 1..18: mol_type = other DNA
tgttacgagtcactatag

SEQ ID NO: 11331 - DNA, 18 bp, synthetic construct
  source 1..18: mol_type = other DNA
ttacacgactcaatatag

SEQ ID NO: 11332 - DNA, 18 bp, synthetic construct
  source 1..18: mol_type = other DNA
ttatacaactccctatag

SEQ ID NO: 11333 - DNA, 18 bp, synthetic construct
  source 1..18: mol_type = other DNA
ttataccactcactatcg

SEQ ID NO: 11334 - DNA, 18 bp, synthetic construct
  source 1..18: mol_type = other DNA
ttatgcgactccctatag

SEQ ID NO: 11335 - DNA, 18 bp, synthetic construct
  source 1..18: mol_type = other DNA
taaaacgatttactatag

SEQ ID NO: 11336 - DNA, 18 bp, synthetic construct
  source 1..18: mol_type = other DNA
taaaacgactcactttcg

SEQ ID NO: 11337 - DNA, 18 bp, synthetic construct
  source 1..18: mol_type = other DNA
taatacgaaaaactatag

SEQ ID NO: 11338 - DNA, 18 bp, synthetic construct
  source 1..18: mol_type = other DNA
taatacgacacattttag

SEQ ID NO: 11339 - DNA, 18 bp, synthetic construct
  source 1..18: mol_type = other DNA
tcatactactcactttag

SEQ ID NO: 11340 - DNA, 18 bp, synthetic construct
  source 1..18: mol_type = other DNA
ttatacgactctttatag

SEQ ID NO: 11341 - DNA, 18 bp, synthetic construct
  source 1..18: mol_type = other DNA
taatacttcttactatag

SEQ ID NO: 11342 - DNA, 18 bp, synthetic construct
  source 1..18: mol_type = other DNA
tattactacacactatag

SEQ ID NO: 11343 - DNA, 18 bp, synthetic construct
  source 1..18: mol_type = other DNA
ttatacgacacacaatag

SEQ ID NO: 11344 - DNA, 18 bp, synthetic construct
  source 1..18: mol_type = other DNA
taataagactcattaaag

SEQ ID NO: 11345 - DNA, 18 bp, synthetic construct
  source 1..18: mol_type = other DNA
taatacaattcaatatag

SEQ ID NO: 11346 - DNA, 18 bp, synthetic construct
  source 1..18: mol_type = other DNA
aaatacgactaactatcg

SEQ ID NO: 11347 - DNA, 18 bp, synthetic construct
  source 1..18: mol_type = other DNA
caatacgtctcactatgg

SEQ ID NO: 11348 - DNA, 18 bp, synthetic construct
  source 1..18: mol_type = other DNA
cattacgactcagtatag

SEQ ID NO: 11349 - DNA, 18 bp, synthetic construct
  source 1..18: mol_type = other DNA
taacacgactcattattg

SEQ ID NO: 11350 - DNA, 18 bp, synthetic construct
  source 1..18: mol_type = other DNA
taataatactccctatag

SEQ ID NO: 11351 - DNA, 18 bp, synthetic construct
  source 1..18: mol_type = other DNA
taataccacccactattg

SEQ ID NO: 11352 - DNA, 18 bp, synthetic construct
  source 1..18: mol_type = other DNA
taataccaccctctatag

SEQ ID NO: 11353 - DNA, 18 bp, synthetic construct
  source 1..18: mol_type = other DNA
taataccactcaatctag

SEQ ID NO: 11354 - DNA, 18 bp, synthetic construct
  source 1..18: mol_type = other DNA
taataccacttactttag

SEQ ID NO: 11355 - DNA, 18 bp, synthetic construct
  source 1..18: mol_type = other DNA
taatacgacacattatgg

SEQ ID NO: 11356 - DNA, 18 bp, synthetic construct
  source 1..18: mol_type = other DNA
taatacgactcagactag

SEQ ID NO: 11357 - DNA, 18 bp, synthetic construct
  source 1..18: mol_type = other DNA
taatacgactgattattg

SEQ ID NO: 11358 - DNA, 18 bp, synthetic construct
  source 1..18: mol_type = other DNA
taatacgacttacagtag

SEQ ID NO: 11359 - DNA, 18 bp, synthetic construct
  source 1..18: mol_type = other DNA
taatacgcctccctattg

SEQ ID NO: 11360 - DNA, 18 bp, synthetic construct
  source 1..18: mol_type = other DNA
taataggactcaccttag

SEQ ID NO: 11361 - DNA, 18 bp, synthetic construct
  source 1..18: mol_type = other DNA
taatatcacttactatag

SEQ ID NO: 11362 - DNA, 18 bp, synthetic construct
  source 1..18: mol_type = other DNA
taatccaactcactaaag

SEQ ID NO: 11363 - DNA, 18 bp, synthetic construct
  source 1..18: mol_type = other DNA
taatgagacacactatag

SEQ ID NO: 11364 - DNA, 18 bp, synthetic construct
  source 1..18: mol_type = other DNA
taattccactcactatgg

SEQ ID NO: 11365 - DNA, 18 bp, synthetic construct
  source 1..18: mol_type = other DNA
tactactattcactatag

SEQ ID NO: 11366 - DNA, 18 bp, synthetic construct
  source 1..18: mol_type = other DNA
tacttcgattcactatag

SEQ ID NO: 11367 - DNA, 18 bp, synthetic construct
  source 1..18: mol_type = other DNA
tagtacgaatcaatatag

SEQ ID NO: 11368 - DNA, 18 bp, synthetic construct
  source 1..18: mol_type = other DNA
tagtacgaattactatag

SEQ ID NO: 11369 - DNA, 18 bp, synthetic construct
  source 1..18: mol_type = other DNA
tattaccactcactctag

SEQ ID NO: 11370 - DNA, 18 bp, synthetic construct
  source 1..18: mol_type = other DNA
tattacgactcaatatgg

SEQ ID NO: 11371 - DNA, 18 bp, synthetic construct
  source 1..18: mol_type = other DNA
tcataggactcactaaag

SEQ ID NO: 11372 - DNA, 18 bp, synthetic construct
  source 1..18: mol_type = other DNA
tgttacgaatcactatag

SEQ ID NO: 11373 - DNA, 18 bp, synthetic construct
  source 1..18: mol_type = other DNA
ttatacgacaccctatag

SEQ ID NO: 11374 - DNA, 18 bp, synthetic construct
  source 1..18: mol_type = other DNA
ttatacgcctgactatag

SEQ ID NO: 11375 - DNA, 18 bp, synthetic construct
  source 1..18: mol_type = other DNA
ttatacgactttctatag

SEQ ID NO: 11376 - DNA, 18 bp, synthetic construct
  source 1..18: mol_type = other DNA
taataatactcactaaag

SEQ ID NO: 11377 - DNA, 18 bp, synthetic construct
  source 1..18: mol_type = other DNA
taatacgtctctctaaag

SEQ ID NO: 11378 - DNA, 18 bp, synthetic construct
  source 1..18: mol_type = other DNA
taatacgacatactttag

SEQ ID NO: 11379 - DNA, 18 bp, synthetic construct
  source 1..18: mol_type = other DNA
taatatgtcttactatag

SEQ ID NO: 11380 - DNA, 18 bp, synthetic construct
  source 1..18: mol_type = other DNA
tcatacttctcactatag

SEQ ID NO: 11381 - DNA, 18 bp, synthetic construct
  source 1..18: mol_type = other DNA
ttatccgactcacaatag

SEQ ID NO: 11382 - DNA, 18 bp, synthetic construct
  source 1..18: mol_type = other DNA
ttatacgtctcattatag

SEQ ID NO: 11383 - DNA, 18 bp, synthetic construct
  source 1..18: mol_type = other DNA
taaaaagacttactatag

SEQ ID NO: 11384 - DNA, 18 bp, synthetic construct
  source 1..18: mol_type = other DNA
taaaacgactcacaacag

SEQ ID NO: 11385 - DNA, 18 bp, synthetic construct
  source 1..18: mol_type = other DNA
taatactactcacagtag

SEQ ID NO: 11386 - DNA, 18 bp, synthetic construct
  source 1..18: mol_type = other DNA
tagtacgattcactaaag

SEQ ID NO: 11387 - DNA, 18 bp, synthetic construct
  source 1..18: mol_type = other DNA
ttacacgacacactatag

SEQ ID NO: 11388 - DNA, 18 bp, synthetic construct
  source 1..18: mol_type = other DNA
ttatactacccactatag

SEQ ID NO: 11389 - DNA, 18 bp, synthetic construct
  source 1..18: mol_type = other DNA
ttatacgatttactatag

SEQ ID NO: 11390 - DNA, 18 bp, synthetic construct
  source 1..18: mol_type = other DNA
taaaactacacactatag

SEQ ID NO: 11391 - DNA, 18 bp, synthetic construct
  source 1..18: mol_type = other DNA
taatacaactctttatag

SEQ ID NO: 11392 - DNA, 18 bp, synthetic construct
  source 1..18: mol_type = other DNA
taattcgacttacaatag

SEQ ID NO: 11393 - DNA, 18 bp, synthetic construct
  source 1..18: mol_type = other DNA
taatccgactcacaaaag

SEQ ID NO: 11394 - DNA, 18 bp, synthetic construct
  source 1..18: mol_type = other DNA
tcatacgactcactttcg

SEQ ID NO: 11395 - DNA, 18 bp, synthetic construct
  source 1..18: mol_type = other DNA
aaatacgacccgctatag

SEQ ID NO: 11396 - DNA, 18 bp, synthetic construct
  source 1..18: mol_type = other DNA
aaatacgagtctctatag

SEQ ID NO: 11397 - DNA, 18 bp, synthetic construct
  source 1..18: mol_type = other DNA
aaatctgactcactatag

SEQ ID NO: 11398 - DNA, 18 bp, synthetic construct
  source 1..18: mol_type = other DNA
caacacgacttactatag

SEQ ID NO: 11399 - DNA, 18 bp, synthetic construct
  source 1..18: mol_type = other DNA
taaaaagactcactatgg

SEQ ID NO: 11400 - DNA, 18 bp, synthetic construct
  source 1..18: mol_type = other DNA
taagacgactctctttag

SEQ ID NO: 11401 - DNA, 18 bp, synthetic construct
  source 1..18: mol_type = other DNA
taataccactctctctag

SEQ ID NO: 11402 - DNA, 18 bp, synthetic construct
  source 1..18: mol_type = other DNA
taatacgattcaccacag

SEQ ID NO: 11403 - DNA, 18 bp, synthetic construct
  source 1..18: mol_type = other DNA
taatacgcctccatatag

SEQ ID NO: 11404 - DNA, 18 bp, synthetic construct
  source 1..18: mol_type = other DNA
taatatgactcacaatcg

SEQ ID NO: 11405 - DNA, 18 bp, synthetic construct
  source 1..18: mol_type = other DNA
taatatgactcccaatag

SEQ ID NO: 11406 - DNA, 18 bp, synthetic construct
  source 1..18: mol_type = other DNA
taatatgactgactaaag

SEQ ID NO: 11407 - DNA, 18 bp, synthetic construct
  source 1..18: mol_type = other DNA
taatccgacttactttag

SEQ ID NO: 11408 - DNA, 18 bp, synthetic construct
  source 1..18: mol_type = other DNA
taatcctactcattatag

SEQ ID NO: 11409 - DNA, 18 bp, synthetic construct
  source 1..18: mol_type = other DNA
taatctgactcactattg

SEQ ID NO: 11410 - DNA, 18 bp, synthetic construct
  source 1..18: mol_type = other DNA
taattcgaatcaccatag

SEQ ID NO: 11411 - DNA, 18 bp, synthetic construct
  source 1..18: mol_type = other DNA
taattcgactaactacag

SEQ ID NO: 11412 - DNA, 18 bp, synthetic construct
  source 1..18: mol_type = other DNA
taattggattcactatag

SEQ ID NO: 11413 - DNA, 18 bp, synthetic construct
  source 1..18: mol_type = other DNA
taatttgactcactatgg

SEQ ID NO: 11414 - DNA, 18 bp, synthetic construct
  source 1..18: mol_type = other DNA
tactacgactcactttgg

SEQ ID NO: 11415 - DNA, 18 bp, synthetic construct
  source 1..18: mol_type = other DNA
tactacgacttattatag

SEQ ID NO: 11416 - DNA, 18 bp, synthetic construct
  source 1..18: mol_type = other DNA
tattacgactcgttatag

SEQ ID NO: 11417 - DNA, 18 bp, synthetic construct
  source 1..18: mol_type = other DNA
tattacgattcactgtag

SEQ ID NO: 11418 - DNA, 18 bp, synthetic construct
  source 1..18: mol_type = other DNA
tcatacgacatactatag

SEQ ID NO: 11419 - DNA, 18 bp, synthetic construct
  source 1..18: mol_type = other DNA
tgatacgactccctaaag

SEQ ID NO: 11420 - DNA, 18 bp, synthetic construct
  source 1..18: mol_type = other DNA
ttataggacttactatag

SEQ ID NO: 11421 - DNA, 18 bp, synthetic construct
  source 1..18: mol_type = other DNA
ttatcggactcactatag

SEQ ID NO: 11422 - DNA, 18 bp, synthetic construct
  source 1..18: mol_type = other DNA
ttatgcgaatcactatag

SEQ ID NO: 11423 - DNA, 18 bp, synthetic construct
  source 1..18: mol_type = other DNA
taatactattcactattg

SEQ ID NO: 11424 - DNA, 18 bp, synthetic construct
  source 1..18: mol_type = other DNA
aaatacgacacactaaag

SEQ ID NO: 11425 - DNA, 18 bp, synthetic construct
  source 1..18: mol_type = other DNA
taaaacgaatctctatag

SEQ ID NO: 11426 - DNA, 18 bp, synthetic construct
  source 1..18: mol_type = other DNA
taatacgtgtcacaatag

SEQ ID NO: 11427 - DNA, 18 bp, synthetic construct
  source 1..18: mol_type = other DNA
tattacgtcacactatag

SEQ ID NO: 11428 - DNA, 18 bp, synthetic construct
  source 1..18: mol_type = other DNA
taatacgtcttacaatag

SEQ ID NO: 11429 - DNA, 18 bp, synthetic construct
  source 1..18: mol_type = other DNA
taatacgacacaccaaag

SEQ ID NO: 11430 - DNA, 18 bp, synthetic construct
  source 1..18: mol_type = other DNA
tcaaaagactcactatag

SEQ ID NO: 11431 - DNA, 18 bp, synthetic construct
  source 1..18: mol_type = other DNA
aaatatgactcactattg

SEQ ID NO: 11432 - DNA, 18 bp, synthetic construct
  source 1..18: mol_type = other DNA
taataagacttactattg

SEQ ID NO: 11433 - DNA, 18 bp, synthetic construct
  source 1..18: mol_type = other DNA
taataattctcactatag

SEQ ID NO: 11434 - DNA, 18 bp, synthetic construct
  source 1..18: mol_type = other DNA
taatacctctctctatag

SEQ ID NO: 11435 - DNA, 18 bp, synthetic construct
  source 1..18: mol_type = other DNA
taatacgattcaataaag

SEQ ID NO: 11436 - DNA, 18 bp, synthetic construct
  source 1..18: mol_type = other DNA
taatactgctcactattg

SEQ ID NO: 11437 - DNA, 18 bp, synthetic construct
  source 1..18: mol_type = other DNA
tagtacgacacactaaag

SEQ ID NO: 11438 - DNA, 18 bp, synthetic construct
  source 1..18: mol_type = other DNA
tatgacgactcactttag

SEQ ID NO: 11439 - DNA, 18 bp, synthetic construct
  source 1..18: mol_type = other DNA
tcatacgactctttatag

SEQ ID NO: 11440 - DNA, 18 bp, synthetic construct
  source 1..18: mol_type = other DNA
aaatacgactccccatag

SEQ ID NO: 11441 - DNA, 18 bp, synthetic construct
  source 1..18: mol_type = other DNA
aaatacgccacactatag

SEQ ID NO: 11442 - DNA, 18 bp, synthetic construct
  source 1..18: mol_type = other DNA
aaattcgactgactatag

SEQ ID NO: 11443 - DNA, 18 bp, synthetic construct
  source 1..18: mol_type = other DNA
taaaacgattgactatag

SEQ ID NO: 11444 - DNA, 18 bp, synthetic construct
  source 1..18: mol_type = other DNA
taacaagactctctatag

SEQ ID NO: 11445 - DNA, 18 bp, synthetic construct
  source 1..18: mol_type = other DNA
taactcgcctcactatag

SEQ ID NO: 11446 - DNA, 18 bp, synthetic construct
  source 1..18: mol_type = other DNA
taagacgtctcactattg

SEQ ID NO: 11447 - DNA, 18 bp, synthetic construct
  source 1..18: mol_type = other DNA
taataagactcgatatag

SEQ ID NO: 11448 - DNA, 18 bp, synthetic construct
  source 1..18: mol_type = other DNA
taataccatccactatag

SEQ ID NO: 11449 - DNA, 18 bp, synthetic construct
  source 1..18: mol_type = other DNA
taatacgacaccctctag

SEQ ID NO: 11450 - DNA, 18 bp, synthetic construct
  source 1..18: mol_type = other DNA
taatacgactgactaacg

SEQ ID NO: 11451 - DNA, 18 bp, synthetic construct
  source 1..18: mol_type = other DNA
taatacgattccctatgg

SEQ ID NO: 11452 - DNA, 18 bp, synthetic construct
  source 1..18: mol_type = other DNA
taatacgcctcaataaag

SEQ ID NO: 11453 - DNA, 18 bp, synthetic construct
  source 1..18: mol_type = other DNA
taatacgtctcagaatag

SEQ ID NO: 11454 - DNA, 18 bp, synthetic construct
  source 1..18: mol_type = other DNA
taataggacacacaatag

SEQ ID NO: 11455 - DNA, 18 bp, synthetic construct
  source 1..18: mol_type = other DNA
taataggtcacactatag

SEQ ID NO: 11456 - DNA, 18 bp, synthetic construct
  source 1..18: mol_type = other DNA
taatattacccactatag

SEQ ID NO: 11457 - DNA, 18 bp, synthetic construct
  source 1..18: mol_type = other DNA
taatccgtctaactatag

SEQ ID NO: 11458 - DNA, 18 bp, synthetic construct
  source 1..18: mol_type = other DNA
taattccacccactatag

SEQ ID NO: 11459 - DNA, 18 bp, synthetic construct
  source 1..18: mol_type = other DNA
tactacgactcaatatgg

SEQ ID NO: 11460 - DNA, 18 bp, synthetic construct
  source 1..18: mol_type = other DNA
tactacgactcacttcag

SEQ ID NO: 11461 - DNA, 18 bp, synthetic construct
  source 1..18: mol_type = other DNA
tagtaccactcactttag

SEQ ID NO: 11462 - DNA, 18 bp, synthetic construct
  source 1..18: mol_type = other DNA
tatgacgactcactatcg

SEQ ID NO: 11463 - DNA, 18 bp, synthetic construct
  source 1..18: mol_type = other DNA
tcatacgacccactattg

SEQ ID NO: 11464 - DNA, 18 bp, synthetic construct
  source 1..18: mol_type = other DNA
tcatactactcaatatag

SEQ ID NO: 11465 - DNA, 18 bp, synthetic construct
  source 1..18: mol_type = other DNA
tgatacaaatcactatag

SEQ ID NO: 11466 - DNA, 18 bp, synthetic construct
  source 1..18: mol_type = other DNA
ttatacgacttactgtag

SEQ ID NO: 11467 - DNA, 18 bp, synthetic construct
  source 1..18: mol_type = other DNA
aaatacgattcactttag

SEQ ID NO: 11468 - DNA, 18 bp, synthetic construct
  source 1..18: mol_type = other DNA
ttatacgtcacactatag

SEQ ID NO: 11469 - DNA, 18 bp, synthetic construct
  source 1..18: mol_type = other DNA
taatactactatctatag

SEQ ID NO: 11470 - DNA, 18 bp, synthetic construct
  source 1..18: mol_type = other DNA
taaatcgacacactatag

SEQ ID NO: 11471 - DNA, 18 bp, synthetic construct
  source 1..18: mol_type = other DNA
taataagacacaatatag

SEQ ID NO: 11472 - DNA, 18 bp, synthetic construct
  source 1..18: mol_type = other DNA
taataccacacactttag

SEQ ID NO: 11473 - DNA, 18 bp, synthetic construct
  source 1..18: mol_type = other DNA
taatacgacacaatacag

SEQ ID NO: 11474 - DNA, 18 bp, synthetic construct
  source 1..18: mol_type = other DNA
taatattacacactatag

SEQ ID NO: 11475 - DNA, 18 bp, synthetic construct
  source 1..18: mol_type = other DNA
taatacgtcactctatag

SEQ ID NO: 11476 - DNA, 18 bp, synthetic construct
  source 1..18: mol_type = other DNA
caatacatctcactatag

SEQ ID NO: 11477 - DNA, 18 bp, synthetic construct
  source 1..18: mol_type = other DNA
taataccactcacttaag

SEQ ID NO: 11478 - DNA, 18 bp, synthetic construct
  source 1..18: mol_type = other DNA
taatacgattcaccaaag

SEQ ID NO: 11479 - DNA, 18 bp, synthetic construct
  source 1..18: mol_type = other DNA
tattacgactcattatcg

SEQ ID NO: 11480 - DNA, 18 bp, synthetic construct
  source 1..18: mol_type = other DNA
aaatacgacccacaatag

SEQ ID NO: 11481 - DNA, 18 bp, synthetic construct
  source 1..18: mol_type = other DNA
aaattcgactcactagag

SEQ ID NO: 11482 - DNA, 18 bp, synthetic construct
  source 1..18: mol_type = other DNA
caatacgacagactatag

SEQ ID NO: 11483 - DNA, 18 bp, synthetic construct
  source 1..18: mol_type = other DNA
ctataccactcactatag

SEQ ID NO: 11484 - DNA, 18 bp, synthetic construct
  source 1..18: mol_type = other DNA
taacacgactaactaaag

SEQ ID NO: 11485 - DNA, 18 bp, synthetic construct
  source 1..18: mol_type = other DNA
taatacaattaactatag

SEQ ID NO: 11486 - DNA, 18 bp, synthetic construct
  source 1..18: mol_type = other DNA
taatacgattaactacag

SEQ ID NO: 11487 - DNA, 18 bp, synthetic construct
  source 1..18: mol_type = other DNA
taatacgattcactccag

SEQ ID NO: 11488 - DNA, 18 bp, synthetic construct
  source 1..18: mol_type = other DNA
taatatgactaattatag

SEQ ID NO: 11489 - DNA, 18 bp, synthetic construct
  source 1..18: mol_type = other DNA
taatgccactaactatag

SEQ ID NO: 11490 - DNA, 18 bp, synthetic construct
  source 1..18: mol_type = other DNA
tagaaagactcactatag

SEQ ID NO: 11491 - DNA, 18 bp, synthetic construct
  source 1..18: mol_type = other DNA
tattacgactgacaatag

SEQ ID NO: 11492 - DNA, 18 bp, synthetic construct
  source 1..18: mol_type = other DNA
tattccgactcactatgg

SEQ ID NO: 11493 - DNA, 18 bp, synthetic construct
  source 1..18: mol_type = other DNA
tcatacgactcaccttag

SEQ ID NO: 11494 - DNA, 18 bp, synthetic construct
  source 1..18: mol_type = other DNA
tcatccgattcactatag

SEQ ID NO: 11495 - DNA, 18 bp, synthetic construct
  source 1..18: mol_type = other DNA
tgatacgattcaatatag

SEQ ID NO: 11496 - DNA, 18 bp, synthetic construct
  source 1..18: mol_type = other DNA
ttatacgacccactgtag

SEQ ID NO: 11497 - DNA, 18 bp, synthetic construct
  source 1..18: mol_type = other DNA
ttatacgacccattatag

SEQ ID NO: 11498 - DNA, 18 bp, synthetic construct
  source 1..18: mol_type = other DNA
ttatgccactcactatag

SEQ ID NO: 11499 - DNA, 18 bp, synthetic construct
  source 1..18: mol_type = other DNA
taatacgactttctttag

SEQ ID NO: 11500 - DNA, 18 bp, synthetic construct
  source 1..18: mol_type = other DNA
tataacgactaactatag

SEQ ID NO: 11501 - DNA, 18 bp, synthetic construct
  source 1..18: mol_type = other DNA
aattacgactcattatag

SEQ ID NO: 11502 - DNA, 18 bp, synthetic construct
  source 1..18: mol_type = other DNA
aaataagactcacaatag

SEQ ID NO: 11503 - DNA, 18 bp, synthetic construct
  source 1..18: mol_type = other DNA
taaaacaactcaatatag

SEQ ID NO: 11504 - DNA, 18 bp, synthetic construct
  source 1..18: mol_type = other DNA
taatacgattcactttgg

SEQ ID NO: 11505 - DNA, 18 bp, synthetic construct
  source 1..18: mol_type = other DNA
taatacgacactcaatag

SEQ ID NO: 11506 - DNA, 18 bp, synthetic construct
  source 1..18: mol_type = other DNA
taaaacgacacactaaag

SEQ ID NO: 11507 - DNA, 18 bp, synthetic construct
  source 1..18: mol_type = other DNA
taaaacgacactctatag

SEQ ID NO: 11508 - DNA, 18 bp, synthetic construct
  source 1..18: mol_type = other DNA
taatacaacacactattg

SEQ ID NO: 11509 - DNA, 18 bp, synthetic construct
  source 1..18: mol_type = other DNA
taatactactttctatag

SEQ ID NO: 11510 - DNA, 18 bp, synthetic construct
  source 1..18: mol_type = other DNA
aaatacgactcattattg

SEQ ID NO: 11511 - DNA, 18 bp, synthetic construct
  source 1..18: mol_type = other DNA
taatacgacacacaatcg

SEQ ID NO: 11512 - DNA, 18 bp, synthetic construct
  source 1..18: mol_type = other DNA
taatacgacacactcaag

SEQ ID NO: 11513 - DNA, 18 bp, synthetic construct
  source 1..18: mol_type = other DNA
aaagacgactcactttag

SEQ ID NO: 11514 - DNA, 18 bp, synthetic construct
  source 1..18: mol_type = other DNA
acatacgcctcactatag

SEQ ID NO: 11515 - DNA, 18 bp, synthetic construct
  source 1..18: mol_type = other DNA
caataagacacactatag

SEQ ID NO: 11516 - DNA, 18 bp, synthetic construct
  source 1..18: mol_type = other DNA
caatacgactaactaaag

SEQ ID NO: 11517 - DNA, 18 bp, synthetic construct
  source 1..18: mol_type = other DNA
caatacgactctctacag

SEQ ID NO: 11518 - DNA, 18 bp, synthetic construct
  source 1..18: mol_type = other DNA
caatatgacacactatag

SEQ ID NO: 11519 - DNA, 18 bp, synthetic construct
  source 1..18: mol_type = other DNA
taaaacgactcattctag

SEQ ID NO: 11520 - DNA, 18 bp, synthetic construct
  source 1..18: mol_type = other DNA
taaaatgactccctatag

SEQ ID NO: 11521 - DNA, 18 bp, synthetic construct
  source 1..18: mol_type = other DNA
taataatactcgctatag

SEQ ID NO: 11522 - DNA, 18 bp, synthetic construct
  source 1..18: mol_type = other DNA
taatacaactagctatag

SEQ ID NO: 11523 - DNA, 18 bp, synthetic construct
  source 1..18: mol_type = other DNA
taatacaactcaccatgg

SEQ ID NO: 11524 - DNA, 18 bp, synthetic construct
  source 1..18: mol_type = other DNA
taatacgaaccattatag

SEQ ID NO: 11525 - DNA, 18 bp, synthetic construct
  source 1..18: mol_type = other DNA
taatacgattcactctcg

SEQ ID NO: 11526 - DNA, 18 bp, synthetic construct
  source 1..18: mol_type = other DNA
taatacgtctccctgtag

SEQ ID NO: 11527 - DNA, 18 bp, synthetic construct
  source 1..18: mol_type = other DNA
taatattactcaccatag

SEQ ID NO: 11528 - DNA, 18 bp, synthetic construct
  source 1..18: mol_type = other DNA
taattcggctcaatatag

SEQ ID NO: 11529 - DNA, 18 bp, synthetic construct
  source 1..18: mol_type = other DNA
tactacgactctatatag

SEQ ID NO: 11530 - DNA, 18 bp, synthetic construct
  source 1..18: mol_type = other DNA
tagtacgacacaccatag

SEQ ID NO: 11531 - DNA, 18 bp, synthetic construct
  source 1..18: mol_type = other DNA
tattaccactcgctatag

SEQ ID NO: 11532 - DNA, 18 bp, synthetic construct
  source 1..18: mol_type = other DNA
tcataagattcactatag

SEQ ID NO: 11533 - DNA, 18 bp, synthetic construct
  source 1..18: mol_type = other DNA
tcataatactcactatag

SEQ ID NO: 11534 - DNA, 18 bp, synthetic construct
  source 1..18: mol_type = other DNA
tcttatgactcactatag

SEQ ID NO: 11535 - DNA, 18 bp, synthetic construct
  source 1..18: mol_type = other DNA
tgatacgactaactattg

SEQ ID NO: 11536 - DNA, 18 bp, synthetic construct
  source 1..18: mol_type = other DNA
tgattcgactcaatatag

SEQ ID NO: 11537 - DNA, 18 bp, synthetic construct
  source 1..18: mol_type = other DNA
taattcgactcattttag

SEQ ID NO: 11538 - DNA, 18 bp, synthetic construct
  source 1..18: mol_type = other DNA
taaaacgacacacaatag

SEQ ID NO: 11539 - DNA, 18 bp, synthetic construct
  source 1..18: mol_type = other DNA
aaaaacgactaactatag

SEQ ID NO: 11540 - DNA, 18 bp, synthetic construct
  source 1..18: mol_type = other DNA
taataatactcattatag

SEQ ID NO: 11541 - DNA, 18 bp, synthetic construct
  source 1..18: mol_type = other DNA
taatattactcaatatag

SEQ ID NO: 11542 - DNA, 18 bp, synthetic construct
  source 1..18: mol_type = other DNA
taatccgattctctatag

SEQ ID NO: 11543 - DNA, 18 bp, synthetic construct
  source 1..18: mol_type = other DNA
ttatccgacacactatag

SEQ ID NO: 11544 - DNA, 18 bp, synthetic construct
  source 1..18: mol_type = other DNA
taaaacgtatcactatag

SEQ ID NO: 11545 - DNA, 18 bp, synthetic construct
  source 1..18: mol_type = other DNA
taatacgatttactttag

SEQ ID NO: 11546 - DNA, 18 bp, synthetic construct
  source 1..18: mol_type = other DNA
taatacgattctatatag

SEQ ID NO: 11547 - DNA, 18 bp, synthetic construct
  source 1..18: mol_type = other DNA
taatacgcttcacaatag

SEQ ID NO: 11548 - DNA, 18 bp, synthetic construct
  source 1..18: mol_type = other DNA
taatacggctcacttttg

SEQ ID NO: 11549 - DNA, 18 bp, synthetic construct
  source 1..18: mol_type = other DNA
taatactactctttatag

SEQ ID NO: 11550 - DNA, 18 bp, synthetic construct
  source 1..18: mol_type = other DNA
taatattactcacaatag

SEQ ID NO: 11551 - DNA, 18 bp, synthetic construct
  source 1..18: mol_type = other DNA
tcatacgacttactttag

SEQ ID NO: 11552 - DNA, 18 bp, synthetic construct
  source 1..18: mol_type = other DNA
ttataccactcacaatag

SEQ ID NO: 11553 - DNA, 18 bp, synthetic construct
  source 1..18: mol_type = other DNA
aaatacaacccactatag

SEQ ID NO: 11554 - DNA, 18 bp, synthetic construct
  source 1..18: mol_type = other DNA
caatacgactaacaatag

SEQ ID NO: 11555 - DNA, 18 bp, synthetic construct
  source 1..18: mol_type = other DNA
caatacgagtcactattg

SEQ ID NO: 11556 - DNA, 18 bp, synthetic construct
  source 1..18: mol_type = other DNA
taaaccgactcaatatag

SEQ ID NO: 11557 - DNA, 18 bp, synthetic construct
  source 1..18: mol_type = other DNA
taacacgtctcactgtag

SEQ ID NO: 11558 - DNA, 18 bp, synthetic construct
  source 1..18: mol_type = other DNA
taacttgactcactatag

SEQ ID NO: 11559 - DNA, 18 bp, synthetic construct
  source 1..18: mol_type = other DNA
taataagacttattatag

SEQ ID NO: 11560 - DNA, 18 bp, synthetic construct
  source 1..18: mol_type = other DNA
taataagcctcacaatag

SEQ ID NO: 11561 - DNA, 18 bp, synthetic construct
  source 1..18: mol_type = other DNA
taatacaactaactatcg

SEQ ID NO: 11562 - DNA, 18 bp, synthetic construct
  source 1..18: mol_type = other DNA
taatacagttcactatag

SEQ ID NO: 11563 - DNA, 18 bp, synthetic construct
  source 1..18: mol_type = other DNA
taataccactcactttcg

SEQ ID NO: 11564 - DNA, 18 bp, synthetic construct
  source 1..18: mol_type = other DNA
taatacgacacagaatag

SEQ ID NO: 11565 - DNA, 18 bp, synthetic construct
  source 1..18: mol_type = other DNA
taatacgacccacttcag

SEQ ID NO: 11566 - DNA, 18 bp, synthetic construct
  source 1..18: mol_type = other DNA
taatacgacccataatag

SEQ ID NO: 11567 - DNA, 18 bp, synthetic construct
  source 1..18: mol_type = other DNA
taatacgactccccattg

SEQ ID NO: 11568 - DNA, 18 bp, synthetic construct
  source 1..18: mol_type = other DNA
taatacgattccatatag

SEQ ID NO: 11569 - DNA, 18 bp, synthetic construct
  source 1..18: mol_type = other DNA
taatagcattcactatag

SEQ ID NO: 11570 - DNA, 18 bp, synthetic construct
  source 1..18: mol_type = other DNA
taataggagtcacaatag

SEQ ID NO: 11571 - DNA, 18 bp, synthetic construct
  source 1..18: mol_type = other DNA
taatatgactcgcaatag

SEQ ID NO: 11572 - DNA, 18 bp, synthetic construct
  source 1..18: mol_type = other DNA
taatccgaatctctatag

SEQ ID NO: 11573 - DNA, 18 bp, synthetic construct
  source 1..18: mol_type = other DNA
tactactactcacaatag

SEQ ID NO: 11574 - DNA, 18 bp, synthetic construct
  source 1..18: mol_type = other DNA
tagaacgaatcactatag

SEQ ID NO: 11575 - DNA, 18 bp, synthetic construct
  source 1..18: mol_type = other DNA
tagtatgactctctatag

SEQ ID NO: 11576 - DNA, 18 bp, synthetic construct
  source 1..18: mol_type = other DNA
tatcacaactcactatag

SEQ ID NO: 11577 - DNA, 18 bp, synthetic construct
  source 1..18: mol_type = other DNA
tcacacaactcactatag

SEQ ID NO: 11578 - DNA, 18 bp, synthetic construct
  source 1..18: mol_type = other DNA
aaatactactcacaatag

SEQ ID NO: 11579 - DNA, 18 bp, synthetic construct
  source 1..18: mol_type = other DNA
taatacgacttacattag

SEQ ID NO: 11580 - DNA, 18 bp, synthetic construct
  source 1..18: mol_type = other DNA
tattactactcattatag

SEQ ID NO: 11581 - DNA, 18 bp, synthetic construct
  source 1..18: mol_type = other DNA
tcatacgactctctttag

SEQ ID NO: 11582 - DNA, 18 bp, synthetic construct
  source 1..18: mol_type = other DNA
aagtacgtctcactatag

SEQ ID NO: 11583 - DNA, 18 bp, synthetic construct
  source 1..18: mol_type = other DNA
agatacgactctctatag

SEQ ID NO: 11584 - DNA, 18 bp, synthetic construct
  source 1..18: mol_type = other DNA
taaatcaactcactatag

SEQ ID NO: 11585 - DNA, 18 bp, synthetic construct
  source 1..18: mol_type = other DNA
taatacatctcactagag

SEQ ID NO: 11586 - DNA, 18 bp, synthetic construct
  source 1..18: mol_type = other DNA
taataccactcattattg

SEQ ID NO: 11587 - DNA, 18 bp, synthetic construct
  source 1..18: mol_type = other DNA
taatactatacactatag

SEQ ID NO: 11588 - DNA, 18 bp, synthetic construct
  source 1..18: mol_type = other DNA
taataagatttactatag

SEQ ID NO: 11589 - DNA, 18 bp, synthetic construct
  source 1..18: mol_type = other DNA
taatactactcacaatcg

SEQ ID NO: 11590 - DNA, 18 bp, synthetic construct
  source 1..18: mol_type = other DNA
taatatgactaactaaag

SEQ ID NO: 11591 - DNA, 18 bp, synthetic construct
  source 1..18: mol_type = other DNA
taatatgactctatatag

SEQ ID NO: 11592 - DNA, 18 bp, synthetic construct
  source 1..18: mol_type = other DNA
taatatgtatcactatag

SEQ ID NO: 11593 - DNA, 18 bp, synthetic construct
  source 1..18: mol_type = other DNA
tatttccactcactatag

SEQ ID NO: 11594 - DNA, 18 bp, synthetic construct
  source 1..18: mol_type = other DNA
aactacaactcactatag

SEQ ID NO: 11595 - DNA, 18 bp, synthetic construct
  source 1..18: mol_type = other DNA
agatacgactaactatag

SEQ ID NO: 11596 - DNA, 18 bp, synthetic construct
  source 1..18: mol_type = other DNA
cacttcgactcactatag

SEQ ID NO: 11597 - DNA, 18 bp, synthetic construct
  source 1..18: mol_type = other DNA
taaaacgaatcactacag

SEQ ID NO: 11598 - DNA, 18 bp, synthetic construct
  source 1..18: mol_type = other DNA
taaaacgacacactagag

SEQ ID NO: 11599 - DNA, 18 bp, synthetic construct
  source 1..18: mol_type = other DNA
taacacgacaccctatag

SEQ ID NO: 11600 - DNA, 18 bp, synthetic construct
  source 1..18: mol_type = other DNA
taacacgactcactttcg

SEQ ID NO: 11601 - DNA, 18 bp, synthetic construct
  source 1..18: mol_type = other DNA
taacgcgattcactatag

SEQ ID NO: 11602 - DNA, 18 bp, synthetic construct
  source 1..18: mol_type = other DNA
taatacacatcactatag

SEQ ID NO: 11603 - DNA, 18 bp, synthetic construct
  source 1..18: mol_type = other DNA
taataccaatctctatag

SEQ ID NO: 11604 - DNA, 18 bp, synthetic construct
  source 1..18: mol_type = other DNA
taataccactcgcaatag

SEQ ID NO: 11605 - DNA, 18 bp, synthetic construct
  source 1..18: mol_type = other DNA
taatacgaatctctacag

SEQ ID NO: 11606 - DNA, 18 bp, synthetic construct
  source 1..18: mol_type = other DNA
taatacgactgaccaaag

SEQ ID NO: 11607 - DNA, 18 bp, synthetic construct
  source 1..18: mol_type = other DNA
taatacgattctgtatag

SEQ ID NO: 11608 - DNA, 18 bp, synthetic construct
  source 1..18: mol_type = other DNA
taatactaataactatag

SEQ ID NO: 11609 - DNA, 18 bp, synthetic construct
  source 1..18: mol_type = other DNA
taatactactccatatag

SEQ ID NO: 11610 - DNA, 18 bp, synthetic construct
  source 1..18: mol_type = other DNA
taatagtactcactattg

SEQ ID NO: 11611 - DNA, 18 bp, synthetic construct
  source 1..18: mol_type = other DNA
taatatgacaccctatag

SEQ ID NO: 11612 - DNA, 18 bp, synthetic construct
  source 1..18: mol_type = other DNA
taatgcgactgacaatag

SEQ ID NO: 11613 - DNA, 18 bp, synthetic construct
  source 1..18: mol_type = other DNA
taatgcgacttactattg

SEQ ID NO: 11614 - DNA, 18 bp, synthetic construct
  source 1..18: mol_type = other DNA
taattcgattccctatag

SEQ ID NO: 11615 - DNA, 18 bp, synthetic construct
  source 1..18: mol_type = other DNA
tactacgaatcacaatag

SEQ ID NO: 11616 - DNA, 18 bp, synthetic construct
  source 1..18: mol_type = other DNA
tactacgactccctattg

SEQ ID NO: 11617 - DNA, 18 bp, synthetic construct
  source 1..18: mol_type = other DNA
tactacgactgtctatag

SEQ ID NO: 11618 - DNA, 18 bp, synthetic construct
  source 1..18: mol_type = other DNA
tactacgacttactttag

SEQ ID NO: 11619 - DNA, 18 bp, synthetic construct
  source 1..18: mol_type = other DNA
tattacggcttactatag

SEQ ID NO: 11620 - DNA, 18 bp, synthetic construct
  source 1..18: mol_type = other DNA
tattatgacccactatag

SEQ ID NO: 11621 - DNA, 18 bp, synthetic construct
  source 1..18: mol_type = other DNA
tgatacgtcccactatag

SEQ ID NO: 11622 - DNA, 18 bp, synthetic construct
  source 1..18: mol_type = other DNA
ttatatgaatcactatag

SEQ ID NO: 11623 - DNA, 18 bp, synthetic construct
  source 1..18: mol_type = other DNA
taatatgtctcaccatag

SEQ ID NO: 11624 - DNA, 18 bp, synthetic construct
  source 1..18: mol_type = other DNA
tgttacgacacactatag

SEQ ID NO: 11625 - DNA, 18 bp, synthetic construct
  source 1..18: mol_type = other DNA
ttatacgacacactattg

SEQ ID NO: 11626 - DNA, 18 bp, synthetic construct
  source 1..18: mol_type = other DNA
ctatacgacacactatag

SEQ ID NO: 11627 - DNA, 18 bp, synthetic construct
  source 1..18: mol_type = other DNA
taatacaactcactatta

SEQ ID NO: 11628 - DNA, 18 bp, synthetic construct
  source 1..18: mol_type = other DNA
taatacgacactctatcg

SEQ ID NO: 11629 - DNA, 18 bp, synthetic construct
  source 1..18: mol_type = other DNA
ttacacgactcacaatag

SEQ ID NO: 11630 - DNA, 18 bp, synthetic construct
  source 1..18: mol_type = other DNA
aaatacgactctcgatag

SEQ ID NO: 11631 - DNA, 18 bp, synthetic construct
  source 1..18: mol_type = other DNA
aaatactactcactatcg

SEQ ID NO: 11632 - DNA, 18 bp, synthetic construct
  source 1..18: mol_type = other DNA
aaatatgactcactatcg

SEQ ID NO: 11633 - DNA, 18 bp, synthetic construct
  source 1..18: mol_type = other DNA
caacacgactcactattg

SEQ ID NO: 11634 - DNA, 18 bp, synthetic construct
  source 1..18: mol_type = other DNA
caataccattcactatag

SEQ ID NO: 11635 - DNA, 18 bp, synthetic construct
  source 1..18: mol_type = other DNA
caatacgacccactaaag

SEQ ID NO: 11636 - DNA, 18 bp, synthetic construct
  source 1..18: mol_type = other DNA
taatacaacacactgtag

SEQ ID NO: 11637 - DNA, 18 bp, synthetic construct
  source 1..18: mol_type = other DNA
taatacaactcagaatag

SEQ ID NO: 11638 - DNA, 18 bp, synthetic construct
  source 1..18: mol_type = other DNA
taatacgactctgaatag

SEQ ID NO: 11639 - DNA, 18 bp, synthetic construct
  source 1..18: mol_type = other DNA
taatacgattcacaatgg

SEQ ID NO: 11640 - DNA, 18 bp, synthetic construct
  source 1..18: mol_type = other DNA
taatacgattcaccatcg

SEQ ID NO: 11641 - DNA, 18 bp, synthetic construct
  source 1..18: mol_type = other DNA
taatgcgacttattatag

SEQ ID NO: 11642 - DNA, 18 bp, synthetic construct
  source 1..18: mol_type = other DNA
taattcgacacactatgg

SEQ ID NO: 11643 - DNA, 18 bp, synthetic construct
  source 1..18: mol_type = other DNA
taattcgacaccctatag

SEQ ID NO: 11644 - DNA, 18 bp, synthetic construct
  source 1..18: mol_type = other DNA
tactacgactaactttag

SEQ ID NO: 11645 - DNA, 18 bp, synthetic construct
  source 1..18: mol_type = other DNA
tagtacgactcagtttag

SEQ ID NO: 11646 - DNA, 18 bp, synthetic construct
  source 1..18: mol_type = other DNA
tagtattactcactatag

SEQ ID NO: 11647 - DNA, 18 bp, synthetic construct
  source 1..18: mol_type = other DNA
tattacgacacactgtag

SEQ ID NO: 11648 - DNA, 18 bp, synthetic construct
  source 1..18: mol_type = other DNA
tcatacgacacactttag

SEQ ID NO: 11649 - DNA, 18 bp, synthetic construct
  source 1..18: mol_type = other DNA
tcatacgactcattttag

SEQ ID NO: 11650 - DNA, 18 bp, synthetic construct
  source 1..18: mol_type = other DNA
taatacgaatctctttag

SEQ ID NO: 11651 - DNA, 18 bp, synthetic construct
  source 1..18: mol_type = other DNA
taatacgtcttactattg

SEQ ID NO: 11652 - DNA, 18 bp, synthetic construct
  source 1..18: mol_type = other DNA
taatacgactatcaatag

SEQ ID NO: 11653 - DNA, 18 bp, synthetic construct
  source 1..18: mol_type = other DNA
tattacgactcaataaag

SEQ ID NO: 11654 - DNA, 18 bp, synthetic construct
  source 1..18: mol_type = other DNA
taaaacgaaacactatag

SEQ ID NO: 11655 - DNA, 18 bp, synthetic construct
  source 1..18: mol_type = other DNA
taaaacgcctctctatag

SEQ ID NO: 11656 - DNA, 18 bp, synthetic construct
  source 1..18: mol_type = other DNA
acatacgactcacaatag

SEQ ID NO: 11657 - DNA, 18 bp, synthetic construct
  source 1..18: mol_type = other DNA
taaaactaatcactatag

SEQ ID NO: 11658 - DNA, 18 bp, synthetic construct
  source 1..18: mol_type = other DNA
taatacgactcataatcg

SEQ ID NO: 11659 - DNA, 18 bp, synthetic construct
  source 1..18: mol_type = other DNA
taatacgactctcagtag

SEQ ID NO: 11660 - DNA, 18 bp, synthetic construct
  source 1..18: mol_type = other DNA
taatactactcgctaaag

SEQ ID NO: 11661 - DNA, 18 bp, synthetic construct
  source 1..18: mol_type = other DNA
taattcgatttactatag

SEQ ID NO: 11662 - DNA, 18 bp, synthetic construct
  source 1..18: mol_type = other DNA
tacaacgaatcactatag

SEQ ID NO: 11663 - DNA, 18 bp, synthetic construct
  source 1..18: mol_type = other DNA
tactactactcactttag

SEQ ID NO: 11664 - DNA, 18 bp, synthetic construct
  source 1..18: mol_type = other DNA
aaatacgacacactatcg

SEQ ID NO: 11665 - DNA, 18 bp, synthetic construct
  source 1..18: mol_type = other DNA
aaataggattcactatag

SEQ ID NO: 11666 - DNA, 18 bp, synthetic construct
  source 1..18: mol_type = other DNA
caatactactctctatag

SEQ ID NO: 11667 - DNA, 18 bp, synthetic construct
  source 1..18: mol_type = other DNA
gattacgtctcactatag

SEQ ID NO: 11668 - DNA, 18 bp, synthetic construct
  source 1..18: mol_type = other DNA
taaaaagactcaccatag

SEQ ID NO: 11669 - DNA, 18 bp, synthetic construct
  source 1..18: mol_type = other DNA
taaaacgacacactatgg

SEQ ID NO: 11670 - DNA, 18 bp, synthetic construct
  source 1..18: mol_type = other DNA
taacaagactcaatatag

SEQ ID NO: 11671 - DNA, 18 bp, synthetic construct
  source 1..18: mol_type = other DNA
taagacaactcactattg

SEQ ID NO: 11672 - DNA, 18 bp, synthetic construct
  source 1..18: mol_type = other DNA
taataagactccttatag

SEQ ID NO: 11673 - DNA, 18 bp, synthetic construct
  source 1..18: mol_type = other DNA
taatacaactcattacag

SEQ ID NO: 11674 - DNA, 18 bp, synthetic construct
  source 1..18: mol_type = other DNA
taatacgacttattatcg

SEQ ID NO: 11675 - DNA, 18 bp, synthetic construct
  source 1..18: mol_type = other DNA
taataggacacactaaag

SEQ ID NO: 11676 - DNA, 18 bp, synthetic construct
  source 1..18: mol_type = other DNA
taatccgacttacaatag

SEQ ID NO: 11677 - DNA, 18 bp, synthetic construct
  source 1..18: mol_type = other DNA
taatcctaatcactatag

SEQ ID NO: 11678 - DNA, 18 bp, synthetic construct
  source 1..18: mol_type = other DNA
tactacgactctccatag

SEQ ID NO: 11679 - DNA, 18 bp, synthetic construct
  source 1..18: mol_type = other DNA
tcatacgacacgctatag

SEQ ID NO: 11680 - DNA, 18 bp, synthetic construct
  source 1..18: mol_type = other DNA
tgacacgactcactaaag

SEQ ID NO: 11681 - DNA, 18 bp, synthetic construct
  source 1..18: mol_type = other DNA
tgatacgacacactacag

SEQ ID NO: 11682 - DNA, 18 bp, synthetic construct
  source 1..18: mol_type = other DNA
tgatacgcctctctatag

SEQ ID NO: 11683 - DNA, 18 bp, synthetic construct
  source 1..18: mol_type = other DNA
ttagacgactctctatag

SEQ ID NO: 11684 - DNA, 18 bp, synthetic construct
  source 1..18: mol_type = other DNA
taattccactcactttag

SEQ ID NO: 11685 - DNA, 18 bp, synthetic construct
  source 1..18: mol_type = other DNA
aaatacgattcaatatag

SEQ ID NO: 11686 - DNA, 18 bp, synthetic construct
  source 1..18: mol_type = other DNA
taaaacgtctcactacag

SEQ ID NO: 11687 - DNA, 18 bp, synthetic construct
  source 1..18: mol_type = other DNA
taatacgacacacaatgg

SEQ ID NO: 11688 - DNA, 18 bp, synthetic construct
  source 1..18: mol_type = other DNA
taatacgaccctctaaag

SEQ ID NO: 11689 - DNA, 18 bp, synthetic construct
  source 1..18: mol_type = other DNA
taatacaacacacaatag

SEQ ID NO: 11690 - DNA, 18 bp, synthetic construct
  source 1..18: mol_type = other DNA
taatacgacatactattg

SEQ ID NO: 11691 - DNA, 18 bp, synthetic construct
  source 1..18: mol_type = other DNA
taatatgattctctatag

SEQ ID NO: 11692 - DNA, 18 bp, synthetic construct
  source 1..18: mol_type = other DNA
ttttacgacacactatag

SEQ ID NO: 11693 - DNA, 18 bp, synthetic construct
  source 1..18: mol_type = other DNA
tagttcgacacactatag

SEQ ID NO: 11694 - DNA, 18 bp, synthetic construct
  source 1..18: mol_type = other DNA
tgatacgactcacaattg

SEQ ID NO: 11695 - DNA, 18 bp, synthetic construct
  source 1..18: mol_type = other DNA
aaatacgaatcaatatag

SEQ ID NO: 11696 - DNA, 18 bp, synthetic construct
  source 1..18: mol_type = other DNA
taaaacgactccctatcg

SEQ ID NO: 11697 - DNA, 18 bp, synthetic construct
  source 1..18: mol_type = other DNA
taacatgactcactaaag

SEQ ID NO: 11698 - DNA, 18 bp, synthetic construct
  source 1..18: mol_type = other DNA
taatacaattcactatcg

SEQ ID NO: 11699 - DNA, 18 bp, synthetic construct
  source 1..18: mol_type = other DNA
taatacgactccccttag

SEQ ID NO: 11700 - DNA, 18 bp, synthetic construct
  source 1..18: mol_type = other DNA
taatacgattcattatcg

SEQ ID NO: 11701 - DNA, 18 bp, synthetic construct
  source 1..18: mol_type = other DNA
taatacgatttactacag

SEQ ID NO: 11702 - DNA, 18 bp, synthetic construct
  source 1..18: mol_type = other DNA
taatactgcttactatag

SEQ ID NO: 11703 - DNA, 18 bp, synthetic construct
  source 1..18: mol_type = other DNA
taatagtattcactatag

SEQ ID NO: 11704 - DNA, 18 bp, synthetic construct
  source 1..18: mol_type = other DNA
taatatgacacactatgg

SEQ ID NO: 11705 - DNA, 18 bp, synthetic construct
  source 1..18: mol_type = other DNA
taatgctactcattatag

SEQ ID NO: 11706 - DNA, 18 bp, synthetic construct
  source 1..18: mol_type = other DNA
taattcgattcaccatag

SEQ ID NO: 11707 - DNA, 18 bp, synthetic construct
  source 1..18: mol_type = other DNA
tacaacgactcgctatag

SEQ ID NO: 11708 - DNA, 18 bp, synthetic construct
  source 1..18: mol_type = other DNA
tactacgacacaatatag

SEQ ID NO: 11709 - DNA, 18 bp, synthetic construct
  source 1..18: mol_type = other DNA
tactacgacacactttag

SEQ ID NO: 11710 - DNA, 18 bp, synthetic construct
  source 1..18: mol_type = other DNA
tattacgacccaatatag

SEQ ID NO: 11711 - DNA, 18 bp, synthetic construct
  source 1..18: mol_type = other DNA
tcatacgactcacttcag

SEQ ID NO: 11712 - DNA, 18 bp, synthetic construct
  source 1..18: mol_type = other DNA
tcatatgactcactttag

SEQ ID NO: 11713 - DNA, 18 bp, synthetic construct
  source 1..18: mol_type = other DNA
ttatacgacccactatgg

SEQ ID NO: 11714 - DNA, 18 bp, synthetic construct
  source 1..18: mol_type = other DNA
ttataggactaactatag

SEQ ID NO: 11715 - DNA, 18 bp, synthetic construct
  source 1..18: mol_type = other DNA
taattagacacactatag

SEQ ID NO: 11716 - DNA, 18 bp, synthetic construct
  source 1..18: mol_type = other DNA
aaataccactcactaaag

SEQ ID NO: 11717 - DNA, 18 bp, synthetic construct
  source 1..18: mol_type = other DNA
acattcgactcactatag

SEQ ID NO: 11718 - DNA, 18 bp, synthetic construct
  source 1..18: mol_type = other DNA
taataagactcataatag

SEQ ID NO: 11719 - DNA, 18 bp, synthetic construct
  source 1..18: mol_type = other DNA
taataccaatcactttag

SEQ ID NO: 11720 - DNA, 18 bp, synthetic construct
  source 1..18: mol_type = other DNA
taatttgacttactatag

SEQ ID NO: 11721 - DNA, 18 bp, synthetic construct
  source 1..18: mol_type = other DNA
tattaccactcattatag

SEQ ID NO: 11722 - DNA, 18 bp, synthetic construct
  source 1..18: mol_type = other DNA
taattcgattcacaatag

SEQ ID NO: 11723 - DNA, 18 bp, synthetic construct
  source 1..18: mol_type = other DNA
taatacgacttattattg

SEQ ID NO: 11724 - DNA, 18 bp, synthetic construct
  source 1..18: mol_type = other DNA
taattccactcactaaag

SEQ ID NO: 11725 - DNA, 18 bp, synthetic construct
  source 1..18: mol_type = other DNA
taatactactcacttaag

SEQ ID NO: 11726 - DNA, 18 bp, synthetic construct
  source 1..18: mol_type = other DNA
taatacttctcacaatag

SEQ ID NO: 11727 - DNA, 18 bp, synthetic construct
  source 1..18: mol_type = other DNA
taatacgacactctaaag

SEQ ID NO: 11728 - DNA, 18 bp, synthetic construct
  source 1..18: mol_type = other DNA
taaaacgacttactaaag

SEQ ID NO: 11729 - DNA, 18 bp, synthetic construct
  source 1..18: mol_type = other DNA
taataatactcactattg

SEQ ID NO: 11730 - DNA, 18 bp, synthetic construct
  source 1..18: mol_type = other DNA
aaatacgattcactaaag

SEQ ID NO: 11731 - DNA, 18 bp, synthetic construct
  source 1..18: mol_type = other DNA
taacacgacacactttag

SEQ ID NO: 11732 - DNA, 18 bp, synthetic construct
  source 1..18: mol_type = other DNA
taactctactcactatag

SEQ ID NO: 11733 - DNA, 18 bp, synthetic construct
  source 1..18: mol_type = other DNA
taataatacacactatag

SEQ ID NO: 11734 - DNA, 18 bp, synthetic construct
  source 1..18: mol_type = other DNA
aaatccgactcactattg

SEQ ID NO: 11735 - DNA, 18 bp, synthetic construct
  source 1..18: mol_type = other DNA
taaaacgactaaatatag

SEQ ID NO: 11736 - DNA, 18 bp, synthetic construct
  source 1..18: mol_type = other DNA
taaagcaactcactatag

SEQ ID NO: 11737 - DNA, 18 bp, synthetic construct
  source 1..18: mol_type = other DNA
taataagaccaactatag

SEQ ID NO: 11738 - DNA, 18 bp, synthetic construct
  source 1..18: mol_type = other DNA
taataagattcactatcg

SEQ ID NO: 11739 - DNA, 18 bp, synthetic construct
  source 1..18: mol_type = other DNA
taatacaactcaacatag

SEQ ID NO: 11740 - DNA, 18 bp, synthetic construct
  source 1..18: mol_type = other DNA
taataccacttacaatag

SEQ ID NO: 11741 - DNA, 18 bp, synthetic construct
  source 1..18: mol_type = other DNA
taatacgaatcccaatag

SEQ ID NO: 11742 - DNA, 18 bp, synthetic construct
  source 1..18: mol_type = other DNA
taatacgaatccctaaag

SEQ ID NO: 11743 - DNA, 18 bp, synthetic construct
  source 1..18: mol_type = other DNA
taatacgactaaataaag

SEQ ID NO: 11744 - DNA, 18 bp, synthetic construct
  source 1..18: mol_type = other DNA
taatacgcctatctatag

SEQ ID NO: 11745 - DNA, 18 bp, synthetic construct
  source 1..18: mol_type = other DNA
taataggactaacaatag

SEQ ID NO: 11746 - DNA, 18 bp, synthetic construct
  source 1..18: mol_type = other DNA
taatccctctcactatag

SEQ ID NO: 11747 - DNA, 18 bp, synthetic construct
  source 1..18: mol_type = other DNA
taatccgacacacaatag

SEQ ID NO: 11748 - DNA, 18 bp, synthetic construct
  source 1..18: mol_type = other DNA
tcataggaatcactatag

SEQ ID NO: 11749 - DNA, 18 bp, synthetic construct
  source 1..18: mol_type = other DNA
taatacgtatcactattg

SEQ ID NO: 11750 - DNA, 18 bp, synthetic construct
  source 1..18: mol_type = other DNA
tattatgacacactatag

SEQ ID NO: 11751 - DNA, 18 bp, synthetic construct
  source 1..18: mol_type = other DNA
taataggtctcacaatag

SEQ ID NO: 11752 - DNA, 18 bp, synthetic construct
  source 1..18: mol_type = other DNA
tattaccacttactatag

SEQ ID NO: 11753 - DNA, 18 bp, synthetic construct
  source 1..18: mol_type = other DNA
ttatatgactcaatatag

SEQ ID NO: 11754 - DNA, 18 bp, synthetic construct
  source 1..18: mol_type = other DNA
atatacgactcattatag

SEQ ID NO: 11755 - DNA, 18 bp, synthetic construct
  source 1..18: mol_type = other DNA
aaatacgactccctttag

SEQ ID NO: 11756 - DNA, 18 bp, synthetic construct
  source 1..18: mol_type = other DNA
aaatacggctcacaatag

SEQ ID NO: 11757 - DNA, 18 bp, synthetic construct
  source 1..18: mol_type = other DNA
caacacgactctctatag

SEQ ID NO: 11758 - DNA, 18 bp, synthetic construct
  source 1..18: mol_type = other DNA
taacacgtctcattatag

SEQ ID NO: 11759 - DNA, 18 bp, synthetic construct
  source 1..18: mol_type = other DNA
taatacatctcactatcg

SEQ ID NO: 11760 - DNA, 18 bp, synthetic construct
  source 1..18: mol_type = other DNA
taatacgtgttactatag

SEQ ID NO: 11761 - DNA, 18 bp, synthetic construct
  source 1..18: mol_type = other DNA
taattcaactccctatag

SEQ ID NO: 11762 - DNA, 18 bp, synthetic construct
  source 1..18: mol_type = other DNA
tattaccactcactatcg

SEQ ID NO: 11763 - DNA, 18 bp, synthetic construct
  source 1..18: mol_type = other DNA
tcatacgactccctattg

SEQ ID NO: 11764 - DNA, 18 bp, synthetic construct
  source 1..18: mol_type = other DNA
tgatacctctcactatag

SEQ ID NO: 11765 - DNA, 18 bp, synthetic construct
  source 1..18: mol_type = other DNA
tgatacgactctttatag

SEQ ID NO: 11766 - DNA, 18 bp, synthetic construct
  source 1..18: mol_type = other DNA
ttatacgacccaccatag

SEQ ID NO: 11767 - DNA, 18 bp, synthetic construct
  source 1..18: mol_type = other DNA
ttatacgagtcaatatag

SEQ ID NO: 11768 - DNA, 18 bp, synthetic construct
  source 1..18: mol_type = other DNA
tattactactcactaaag

SEQ ID NO: 11769 - DNA, 18 bp, synthetic construct
  source 1..18: mol_type = other DNA
aaataagtctcactatag

SEQ ID NO: 11770 - DNA, 18 bp, synthetic construct
  source 1..18: mol_type = other DNA
taatacaactctccatag

SEQ ID NO: 11771 - DNA, 18 bp, synthetic construct
  source 1..18: mol_type = other DNA
taatacgaatatctatag

SEQ ID NO: 11772 - DNA, 18 bp, synthetic construct
  source 1..18: mol_type = other DNA
taatactacatactatag

SEQ ID NO: 11773 - DNA, 18 bp, synthetic construct
  source 1..18: mol_type = other DNA
taatacatttcactatag

SEQ ID NO: 11774 - DNA, 18 bp, synthetic construct
  source 1..18: mol_type = other DNA
tattacgactaactattg

SEQ ID NO: 11775 - DNA, 18 bp, synthetic construct
  source 1..18: mol_type = other DNA
aaatacgacatactatag

SEQ ID NO: 11776 - DNA, 18 bp, synthetic construct
  source 1..18: mol_type = other DNA
taatatgacttactttag

SEQ ID NO: 11777 - DNA, 18 bp, synthetic construct
  source 1..18: mol_type = other DNA
taattcaactaactatag

SEQ ID NO: 11778 - DNA, 18 bp, synthetic construct
  source 1..18: mol_type = other DNA
taattcgactcactaagg

SEQ ID NO: 11779 - DNA, 18 bp, synthetic construct
  source 1..18: mol_type = other DNA
tattacgacaaactatag

SEQ ID NO: 11780 - DNA, 18 bp, synthetic construct
  source 1..18: mol_type = other DNA
tgatacgactcacaaaag

SEQ ID NO: 11781 - DNA, 18 bp, synthetic construct
  source 1..18: mol_type = other DNA
ttatacgacccactaaag

SEQ ID NO: 11782 - DNA, 18 bp, synthetic construct
  source 1..18: mol_type = other DNA
aaatacgagtcacaatag

SEQ ID NO: 11783 - DNA, 18 bp, synthetic construct
  source 1..18: mol_type = other DNA
cactacgactctctatag

SEQ ID NO: 11784 - DNA, 18 bp, synthetic construct
  source 1..18: mol_type = other DNA
taacacgtctcactacag

SEQ ID NO: 11785 - DNA, 18 bp, synthetic construct
  source 1..18: mol_type = other DNA
taataagaatcactatgg

SEQ ID NO: 11786 - DNA, 18 bp, synthetic construct
  source 1..18: mol_type = other DNA
taatacgaatcaatatcg

SEQ ID NO: 11787 - DNA, 18 bp, synthetic construct
  source 1..18: mol_type = other DNA
taatacgaatctctctag

SEQ ID NO: 11788 - DNA, 18 bp, synthetic construct
  source 1..18: mol_type = other DNA
taatacgactcaattcag

SEQ ID NO: 11789 - DNA, 18 bp, synthetic construct
  source 1..18: mol_type = other DNA
taatacgactcatcatcg

SEQ ID NO: 11790 - DNA, 18 bp, synthetic construct
  source 1..18: mol_type = other DNA
taatactactcaatacag

SEQ ID NO: 11791 - DNA, 18 bp, synthetic construct
  source 1..18: mol_type = other DNA
taatactactcagtaaag

SEQ ID NO: 11792 - DNA, 18 bp, synthetic construct
  source 1..18: mol_type = other DNA
taatactactcattgtag

SEQ ID NO: 11793 - DNA, 18 bp, synthetic construct
  source 1..18: mol_type = other DNA
taatatgattcactacag

SEQ ID NO: 11794 - DNA, 18 bp, synthetic construct
  source 1..18: mol_type = other DNA
taccacgactcactttag

SEQ ID NO: 11795 - DNA, 18 bp, synthetic construct
  source 1..18: mol_type = other DNA
tactacgaatcactacag

SEQ ID NO: 11796 - DNA, 18 bp, synthetic construct
  source 1..18: mol_type = other DNA
tcataagactcaccatag

SEQ ID NO: 11797 - DNA, 18 bp, synthetic construct
  source 1..18: mol_type = other DNA
tcatacgatttactatag

SEQ ID NO: 11798 - DNA, 18 bp, synthetic construct
  source 1..18: mol_type = other DNA
tctcacgactcactatag

SEQ ID NO: 11799 - DNA, 18 bp, synthetic construct
  source 1..18: mol_type = other DNA
tcttacgactcactacag

SEQ ID NO: 11800 - DNA, 18 bp, synthetic construct
  source 1..18: mol_type = other DNA
taatacgtcacactttag

SEQ ID NO: 11801 - DNA, 18 bp, synthetic construct
  source 1..18: mol_type = other DNA
aattacgacttactatag

SEQ ID NO: 11802 - DNA, 18 bp, synthetic construct
  source 1..18: mol_type = other DNA
taatacgacacattaaag

SEQ ID NO: 11803 - DNA, 18 bp, synthetic construct
  source 1..18: mol_type = other DNA
taatacaactcattattg

SEQ ID NO: 11804 - DNA, 18 bp, synthetic construct
  source 1..18: mol_type = other DNA
taatacgtctttctatag

SEQ ID NO: 11805 - DNA, 18 bp, synthetic construct
  source 1..18: mol_type = other DNA
taatactactaactattg

SEQ ID NO: 11806 - DNA, 18 bp, synthetic construct
  source 1..18: mol_type = other DNA
taataagacacattatag

SEQ ID NO: 11807 - DNA, 18 bp, synthetic construct
  source 1..18: mol_type = other DNA
taataagactctttatag

SEQ ID NO: 11808 - DNA, 18 bp, synthetic construct
  source 1..18: mol_type = other DNA
ttatatgactcattatag

SEQ ID NO: 11809 - DNA, 18 bp, synthetic construct
  source 1..18: mol_type = other DNA
ttattcgactcattatag

SEQ ID NO: 11810 - DNA, 18 bp, synthetic construct
  source 1..18: mol_type = other DNA
aaatccgacacactatag

SEQ ID NO: 11811 - DNA, 18 bp, synthetic construct
  source 1..18: mol_type = other DNA
aagtacgactcactttag

SEQ ID NO: 11812 - DNA, 18 bp, synthetic construct
  source 1..18: mol_type = other DNA
agatacgattcactatag

SEQ ID NO: 11813 - DNA, 18 bp, synthetic construct
  source 1..18: mol_type = other DNA
cattacgactaactatag

SEQ ID NO: 11814 - DNA, 18 bp, synthetic construct
  source 1..18: mol_type = other DNA
taaaacgacctactatag

SEQ ID NO: 11815 - DNA, 18 bp, synthetic construct
  source 1..18: mol_type = other DNA
taacacgactcactcttg

SEQ ID NO: 11816 - DNA, 18 bp, synthetic construct
  source 1..18: mol_type = other DNA
taacacgtctcaccatag

SEQ ID NO: 11817 - DNA, 18 bp, synthetic construct
  source 1..18: mol_type = other DNA
taataacactcactttag

SEQ ID NO: 11818 - DNA, 18 bp, synthetic construct
  source 1..18: mol_type = other DNA
taataagacaccctatag

SEQ ID NO: 11819 - DNA, 18 bp, synthetic construct
  source 1..18: mol_type = other DNA
taataatactaactatag

SEQ ID NO: 11820 - DNA, 18 bp, synthetic construct
  source 1..18: mol_type = other DNA
taatacgacagactaaag

SEQ ID NO: 11821 - DNA, 18 bp, synthetic construct
  source 1..18: mol_type = other DNA
taatacgacccattaaag

SEQ ID NO: 11822 - DNA, 18 bp, synthetic construct
  source 1..18: mol_type = other DNA
taatacgattcagtctag

SEQ ID NO: 11823 - DNA, 18 bp, synthetic construct
  source 1..18: mol_type = other DNA
taatacgcctcattttag

SEQ ID NO: 11824 - DNA, 18 bp, synthetic construct
  source 1..18: mol_type = other DNA
taatatgacacactgtag

SEQ ID NO: 11825 - DNA, 18 bp, synthetic construct
  source 1..18: mol_type = other DNA
taatccgacatactatag

SEQ ID NO: 11826 - DNA, 18 bp, synthetic construct
  source 1..18: mol_type = other DNA
taatgccactcacaatag

SEQ ID NO: 11827 - DNA, 18 bp, synthetic construct
  source 1..18: mol_type = other DNA
taattcgactcactatta

SEQ ID NO: 11828 - DNA, 18 bp, synthetic construct
  source 1..18: mol_type = other DNA
tagtacgactctttatag

SEQ ID NO: 11829 - DNA, 18 bp, synthetic construct
  source 1..18: mol_type = other DNA
tagtacgagacactatag

SEQ ID NO: 11830 - DNA, 18 bp, synthetic construct
  source 1..18: mol_type = other DNA
tcatacgaatcattatag

SEQ ID NO: 11831 - DNA, 18 bp, synthetic construct
  source 1..18: mol_type = other DNA
tgaaacaactcactatag

SEQ ID NO: 11832 - DNA, 18 bp, synthetic construct
  source 1..18: mol_type = other DNA
tgaaacgacttactatag

SEQ ID NO: 11833 - DNA, 18 bp, synthetic construct
  source 1..18: mol_type = other DNA
tgatactactcactacag

SEQ ID NO: 11834 - DNA, 18 bp, synthetic construct
  source 1..18: mol_type = other DNA
ttatacgactccatatag

SEQ ID NO: 11835 - DNA, 18 bp, synthetic construct
  source 1..18: mol_type = other DNA
ttatacgactgattatag

SEQ ID NO: 11836 - DNA, 18 bp, synthetic construct
  source 1..18: mol_type = other DNA
ttatacgtcttactatag

SEQ ID NO: 11837 - DNA, 18 bp, synthetic construct
  source 1..18: mol_type = other DNA
tattactattcactatag

SEQ ID NO: 11838 - DNA, 18 bp, synthetic construct
  source 1..18: mol_type = other DNA
aattacgacacactatag

SEQ ID NO: 11839 - DNA, 18 bp, synthetic construct
  source 1..18: mol_type = other DNA
taatacgactcacattac

SEQ ID NO: 11840 - DNA, 18 bp, synthetic construct
  source 1..18: mol_type = other DNA
taataagactcattattg

SEQ ID NO: 11841 - DNA, 18 bp, synthetic construct
  source 1..18: mol_type = other DNA
taataccacactctatag

SEQ ID NO: 11842 - DNA, 18 bp, synthetic construct
  source 1..18: mol_type = other DNA
taatacgacttacttaag

SEQ ID NO: 11843 - DNA, 18 bp, synthetic construct
  source 1..18: mol_type = other DNA
aaaaacgaatcactatag

SEQ ID NO: 11844 - DNA, 18 bp, synthetic construct
  source 1..18: mol_type = other DNA
taaaacgacttactttag

SEQ ID NO: 11845 - DNA, 18 bp, synthetic construct
  source 1..18: mol_type = other DNA
tattacggctcactttag

SEQ ID NO: 11846 - DNA, 18 bp, synthetic construct
  source 1..18: mol_type = other DNA
aaatacgactcaatacag

SEQ ID NO: 11847 - DNA, 18 bp, synthetic construct
  source 1..18: mol_type = other DNA
aaatatgacccactatag

SEQ ID NO: 11848 - DNA, 18 bp, synthetic construct
  source 1..18: mol_type = other DNA
aacaacgactcactatag

SEQ ID NO: 11849 - DNA, 18 bp, synthetic construct
  source 1..18: mol_type = other DNA
caattcgactaactatag

SEQ ID NO: 11850 - DNA, 18 bp, synthetic construct
  source 1..18: mol_type = other DNA
taaaaccattcactatag

SEQ ID NO: 11851 - DNA, 18 bp, synthetic construct
  source 1..18: mol_type = other DNA
taactagactcactatag

SEQ ID NO: 11852 - DNA, 18 bp, synthetic construct
  source 1..18: mol_type = other DNA
taatacgaatcacactag

SEQ ID NO: 11853 - DNA, 18 bp, synthetic construct
  source 1..18: mol_type = other DNA
taatacgactgaccattg

SEQ ID NO: 11854 - DNA, 18 bp, synthetic construct
  source 1..18: mol_type = other DNA
taatacgagtctatatag

SEQ ID NO: 11855 - DNA, 18 bp, synthetic construct
  source 1..18: mol_type = other DNA
taatacggctcattaaag

SEQ ID NO: 11856 - DNA, 18 bp, synthetic construct
  source 1..18: mol_type = other DNA
taatcagaatcactatag

SEQ ID NO: 11857 - DNA, 18 bp, synthetic construct
  source 1..18: mol_type = other DNA
taattcgacttactctag

SEQ ID NO: 11858 - DNA, 18 bp, synthetic construct
  source 1..18: mol_type = other DNA
tcatatgacacactatag

SEQ ID NO: 11859 - DNA, 18 bp, synthetic construct
  source 1..18: mol_type = other DNA
tgatacgattaactatag

SEQ ID NO: 11860 - DNA, 18 bp, synthetic construct
  source 1..18: mol_type = other DNA
tattactactctctatag

SEQ ID NO: 11861 - DNA, 18 bp, synthetic construct
  source 1..18: mol_type = other DNA
taatatgattcactttag

SEQ ID NO: 11862 - DNA, 18 bp, synthetic construct
  source 1..18: mol_type = other DNA
taatacgttttactatag

SEQ ID NO: 11863 - DNA, 18 bp, synthetic construct
  source 1..18: mol_type = other DNA
tagtacgactcacttaag

SEQ ID NO: 11864 - DNA, 18 bp, synthetic construct
  source 1..18: mol_type = other DNA
aaatacgactcaatttag

SEQ ID NO: 11865 - DNA, 18 bp, synthetic construct
  source 1..18: mol_type = other DNA
aaatccgactcaatatag

SEQ ID NO: 11866 - DNA, 18 bp, synthetic construct
  source 1..18: mol_type = other DNA
taaaacgacttattatag

SEQ ID NO: 11867 - DNA, 18 bp, synthetic construct
  source 1..18: mol_type = other DNA
taataagacacgctatag

SEQ ID NO: 11868 - DNA, 18 bp, synthetic construct
  source 1..18: mol_type = other DNA
taatacgactaatcatag

SEQ ID NO: 11869 - DNA, 18 bp, synthetic construct
  source 1..18: mol_type = other DNA
taatacgcctcaatttag

SEQ ID NO: 11870 - DNA, 18 bp, synthetic construct
  source 1..18: mol_type = other DNA
taatacggcacactttag

SEQ ID NO: 11871 - DNA, 18 bp, synthetic construct
  source 1..18: mol_type = other DNA
taatacggctcaataaag

SEQ ID NO: 11872 - DNA, 18 bp, synthetic construct
  source 1..18: mol_type = other DNA
taatactactgactaaag

SEQ ID NO: 11873 - DNA, 18 bp, synthetic construct
  source 1..18: mol_type = other DNA
taatatgattcagtatag

SEQ ID NO: 11874 - DNA, 18 bp, synthetic construct
  source 1..18: mol_type = other DNA
tactattactcactatag

SEQ ID NO: 11875 - DNA, 18 bp, synthetic construct
  source 1..18: mol_type = other DNA
tcatacgtctcattatag

SEQ ID NO: 11876 - DNA, 18 bp, synthetic construct
  source 1..18: mol_type = other DNA
tcttacgacccactatag

SEQ ID NO: 11877 - DNA, 18 bp, synthetic construct
  source 1..18: mol_type = other DNA
ttctacgactcaccatag

SEQ ID NO: 11878 - DNA, 18 bp, synthetic construct
  source 1..18: mol_type = other DNA
ttattcgattcactatag

SEQ ID NO: 11879 - DNA, 18 bp, synthetic construct
  source 1..18: mol_type = other DNA
taaatcgactaactatag

SEQ ID NO: 11880 - DNA, 18 bp, synthetic construct
  source 1..18: mol_type = other DNA
tattacgacttaatatag

SEQ ID NO: 11881 - DNA, 18 bp, synthetic construct
  source 1..18: mol_type = other DNA
aaataggactctctatag

SEQ ID NO: 11882 - DNA, 18 bp, synthetic construct
  source 1..18: mol_type = other DNA
aaatatgactcgctatag

SEQ ID NO: 11883 - DNA, 18 bp, synthetic construct
  source 1..18: mol_type = other DNA
aattacgagtcactatag

SEQ ID NO: 11884 - DNA, 18 bp, synthetic construct
  source 1..18: mol_type = other DNA
acatacgaatcactatag

SEQ ID NO: 11885 - DNA, 18 bp, synthetic construct
  source 1..18: mol_type = other DNA
caatacgacttactaaag

SEQ ID NO: 11886 - DNA, 18 bp, synthetic construct
  source 1..18: mol_type = other DNA
taatacaagtcactattg

SEQ ID NO: 11887 - DNA, 18 bp, synthetic construct
  source 1..18: mol_type = other DNA
taatacaattccctatag

SEQ ID NO: 11888 - DNA, 18 bp, synthetic construct
  source 1..18: mol_type = other DNA
taatacgacccaacatag

SEQ ID NO: 11889 - DNA, 18 bp, synthetic construct
  source 1..18: mol_type = other DNA
taatacgactccttaaag

SEQ ID NO: 11890 - DNA, 18 bp, synthetic construct
  source 1..18: mol_type = other DNA
tattgcgacacactatag

SEQ ID NO: 11891 - DNA, 18 bp, synthetic construct
  source 1..18: mol_type = other DNA
tgacacgtctcactatag

SEQ ID NO: 11892 - DNA, 18 bp, synthetic construct
  source 1..18: mol_type = other DNA
tgttacgactcaatatag

SEQ ID NO: 11893 - DNA, 18 bp, synthetic construct
  source 1..18: mol_type = other DNA
ttatacgattcactatcg

SEQ ID NO: 11894 - DNA, 18 bp, synthetic construct
  source 1..18: mol_type = other DNA
ttatacggctcattatag

SEQ ID NO: 11895 - DNA, 18 bp, synthetic construct
  source 1..18: mol_type = other DNA
ttatactactcgctatag

SEQ ID NO: 11896 - DNA, 18 bp, synthetic construct
  source 1..18: mol_type = other DNA
taatacaattcacaatag

SEQ ID NO: 11897 - DNA, 18 bp, synthetic construct
  source 1..18: mol_type = other DNA
aaaaacgactcattatag

SEQ ID NO: 11898 - DNA, 18 bp, synthetic construct
  source 1..18: mol_type = other DNA
taacacgactcacaaaag

SEQ ID NO: 11899 - DNA, 18 bp, synthetic construct
  source 1..18: mol_type = other DNA
taattcgaattactatag

SEQ ID NO: 11900 - DNA, 18 bp, synthetic construct
  source 1..18: mol_type = other DNA
taatacgaccctcaatag

SEQ ID NO: 11901 - DNA, 18 bp, synthetic construct
  source 1..18: mol_type = other DNA
taataggactcactatta

SEQ ID NO: 11902 - DNA, 18 bp, synthetic construct
  source 1..18: mol_type = other DNA
tattacgaattactatag

SEQ ID NO: 11903 - DNA, 18 bp, synthetic construct
  source 1..18: mol_type = other DNA
ttatacgattcactctag

SEQ ID NO: 11904 - DNA, 18 bp, synthetic construct
  source 1..18: mol_type = other DNA
aaataagaatcactatag

SEQ ID NO: 11905 - DNA, 18 bp, synthetic construct
  source 1..18: mol_type = other DNA
caatatgactcacaatag

SEQ ID NO: 11906 - DNA, 18 bp, synthetic construct
  source 1..18: mol_type = other DNA
taaaacgactaactctag

SEQ ID NO: 11907 - DNA, 18 bp, synthetic construct
  source 1..18: mol_type = other DNA
taataagacccacaatag

SEQ ID NO: 11908 - DNA, 18 bp, synthetic construct
  source 1..18: mol_type = other DNA
taataagacttactctag

SEQ ID NO: 11909 - DNA, 18 bp, synthetic construct
  source 1..18: mol_type = other DNA
taatacgacacgttatag

SEQ ID NO: 11910 - DNA, 18 bp, synthetic construct
  source 1..18: mol_type = other DNA
taatacgactcaaaacag

SEQ ID NO: 11911 - DNA, 18 bp, synthetic construct
  source 1..18: mol_type = other DNA
taatacgcctctatatag

SEQ ID NO: 11912 - DNA, 18 bp, synthetic construct
  source 1..18: mol_type = other DNA
taatccgtctcaatatag

SEQ ID NO: 11913 - DNA, 18 bp, synthetic construct
  source 1..18: mol_type = other DNA
tattacacctcactatag

SEQ ID NO: 11914 - DNA, 18 bp, synthetic construct
  source 1..18: mol_type = other DNA
tcataccactcactttag

SEQ ID NO: 11915 - DNA, 18 bp, synthetic construct
  source 1..18: mol_type = other DNA
tcatacgactctctctag

SEQ ID NO: 11916 - DNA, 18 bp, synthetic construct
  source 1..18: mol_type = other DNA
tgatacgactatctatag

SEQ ID NO: 11917 - DNA, 18 bp, synthetic construct
  source 1..18: mol_type = other DNA
taatacgaatcaatattg

SEQ ID NO: 11918 - DNA, 18 bp, synthetic construct
  source 1..18: mol_type = other DNA
taatatgactaactattg

SEQ ID NO: 11919 - DNA, 18 bp, synthetic construct
  source 1..18: mol_type = other DNA
taatatgattcactaaag

SEQ ID NO: 11920 - DNA, 18 bp, synthetic construct
  source 1..18: mol_type = other DNA
tagttcgactcacaatag

SEQ ID NO: 11921 - DNA, 18 bp, synthetic construct
  source 1..18: mol_type = other DNA
ttgtacgtctcactatag

SEQ ID NO: 11922 - DNA, 18 bp, synthetic construct
  source 1..18: mol_type = other DNA
tagaacgactcacaatag

SEQ ID NO: 11923 - DNA, 18 bp, synthetic construct
  source 1..18: mol_type = other DNA
aaatacgaatccctatag

SEQ ID NO: 11924 - DNA, 18 bp, synthetic construct
  source 1..18: mol_type = other DNA
aaatccgactcactttag

SEQ ID NO: 11925 - DNA, 18 bp, synthetic construct
  source 1..18: mol_type = other DNA
aacttcgactcactatag

SEQ ID NO: 11926 - DNA, 18 bp, synthetic construct
  source 1..18: mol_type = other DNA
taaaactactgactatag

SEQ ID NO: 11927 - DNA, 18 bp, synthetic construct
  source 1..18: mol_type = other DNA
taatacaactcccaatag

SEQ ID NO: 11928 - DNA, 18 bp, synthetic construct
  source 1..18: mol_type = other DNA
taatacgacacgctaaag

SEQ ID NO: 11929 - DNA, 18 bp, synthetic construct
  source 1..18: mol_type = other DNA
taatacggctcaatttag

SEQ ID NO: 11930 - DNA, 18 bp, synthetic construct
  source 1..18: mol_type = other DNA
taataggacatactatag

SEQ ID NO: 11931 - DNA, 18 bp, synthetic construct
  source 1..18: mol_type = other DNA
taatatgaatcattatag

SEQ ID NO: 11932 - DNA, 18 bp, synthetic construct
  source 1..18: mol_type = other DNA
tagaacgactcaatatag

SEQ ID NO: 11933 - DNA, 18 bp, synthetic construct
  source 1..18: mol_type = other DNA
tgaaacgactcaatatag

SEQ ID NO: 11934 - DNA, 18 bp, synthetic construct
  source 1..18: mol_type = other DNA
ttatgcgactcattatag

SEQ ID NO: 11935 - DNA, 18 bp, synthetic construct
  source 1..18: mol_type = other DNA
aaatactactcactttag

SEQ ID NO: 11936 - DNA, 18 bp, synthetic construct
  source 1..18: mol_type = other DNA
taattcaactcaatatag

SEQ ID NO: 11937 - DNA, 18 bp, synthetic construct
  source 1..18: mol_type = other DNA
tacttcaactcactatag

SEQ ID NO: 11938 - DNA, 18 bp, synthetic construct
  source 1..18: mol_type = other DNA
tattacgaaacactatag

SEQ ID NO: 11939 - DNA, 18 bp, synthetic construct
  source 1..18: mol_type = other DNA
tgatacgactcacattag

SEQ ID NO: 11940 - DNA, 18 bp, synthetic construct
  source 1..18: mol_type = other DNA
ttatactactcactacag

SEQ ID NO: 11941 - DNA, 18 bp, synthetic construct
  source 1..18: mol_type = other DNA
ttatacaattcactatag

SEQ ID NO: 11942 - DNA, 18 bp, synthetic construct
  source 1..18: mol_type = other DNA
ttatactactcacaatag

SEQ ID NO: 11943 - DNA, 18 bp, synthetic construct
  source 1..18: mol_type = other DNA
aaatacgtatcactatag

SEQ ID NO: 11944 - DNA, 18 bp, synthetic construct
  source 1..18: mol_type = other DNA
taatactacttacaatag

SEQ ID NO: 11945 - DNA, 18 bp, synthetic construct
  source 1..18: mol_type = other DNA
tcatacgattcacaatag

SEQ ID NO: 11946 - DNA, 18 bp, synthetic construct
  source 1..18: mol_type = other DNA
aaagacgaatcactatag

SEQ ID NO: 11947 - DNA, 18 bp, synthetic construct
  source 1..18: mol_type = other DNA
aaatacgacacactatgg

SEQ ID NO: 11948 - DNA, 18 bp, synthetic construct
  source 1..18: mol_type = other DNA
taaaacgaaccactatag

SEQ ID NO: 11949 - DNA, 18 bp, synthetic construct
  source 1..18: mol_type = other DNA
taaaatgattcactatag

SEQ ID NO: 11950 - DNA, 18 bp, synthetic construct
  source 1..18: mol_type = other DNA
taataaaacttactatag

SEQ ID NO: 11951 - DNA, 18 bp, synthetic construct
  source 1..18: mol_type = other DNA
taataatactcaccatag

SEQ ID NO: 11952 - DNA, 18 bp, synthetic construct
  source 1..18: mol_type = other DNA
taatacaacacactacag

SEQ ID NO: 11953 - DNA, 18 bp, synthetic construct
  source 1..18: mol_type = other DNA
taatacaactcagtgtag

SEQ ID NO: 11954 - DNA, 18 bp, synthetic construct
  source 1..18: mol_type = other DNA
taatacagctcattatag

SEQ ID NO: 11955 - DNA, 18 bp, synthetic construct
  source 1..18: mol_type = other DNA
taatacgcctctcaatag

SEQ ID NO: 11956 - DNA, 18 bp, synthetic construct
  source 1..18: mol_type = other DNA
taataggactctcaatag

SEQ ID NO: 11957 - DNA, 18 bp, synthetic construct
  source 1..18: mol_type = other DNA
taatccaactaactatag

SEQ ID NO: 11958 - DNA, 18 bp, synthetic construct
  source 1..18: mol_type = other DNA
tacttagactcactatag

SEQ ID NO: 11959 - DNA, 18 bp, synthetic construct
  source 1..18: mol_type = other DNA
tattacgatccactatag

SEQ ID NO: 11960 - DNA, 18 bp, synthetic construct
  source 1..18: mol_type = other DNA
tcaaacgactcagtatag

SEQ ID NO: 11961 - DNA, 18 bp, synthetic construct
  source 1..18: mol_type = other DNA
ttatacgtctgactatag

SEQ ID NO: 11962 - DNA, 18 bp, synthetic construct
  source 1..18: mol_type = other DNA
taaatcgactcacaatag

SEQ ID NO: 11963 - DNA, 18 bp, synthetic construct
  source 1..18: mol_type = other DNA
aaatacgattcactattg

SEQ ID NO: 11964 - DNA, 18 bp, synthetic construct
  source 1..18: mol_type = other DNA
taataaaactctctatag

SEQ ID NO: 11965 - DNA, 18 bp, synthetic construct
  source 1..18: mol_type = other DNA
taatacctctcactattg

SEQ ID NO: 11966 - DNA, 18 bp, synthetic construct
  source 1..18: mol_type = other DNA
taatccgacactctatag

SEQ ID NO: 11967 - DNA, 18 bp, synthetic construct
  source 1..18: mol_type = other DNA
tgatatgtctcactatag

SEQ ID NO: 11968 - DNA, 18 bp, synthetic construct
  source 1..18: mol_type = other DNA
aaatacgacacactttag

SEQ ID NO: 11969 - DNA, 18 bp, synthetic construct
  source 1..18: mol_type = other DNA
aaattccactcactatag

SEQ ID NO: 11970 - DNA, 18 bp, synthetic construct
  source 1..18: mol_type = other DNA
taaaacgacaaactatag

SEQ ID NO: 11971 - DNA, 18 bp, synthetic construct
  source 1..18: mol_type = other DNA
caatatgactcattatag

SEQ ID NO: 11972 - DNA, 18 bp, synthetic construct
  source 1..18: mol_type = other DNA
cattacgactcaatatag

SEQ ID NO: 11973 - DNA, 18 bp, synthetic construct
  source 1..18: mol_type = other DNA
ctatacaactcactatag

SEQ ID NO: 11974 - DNA, 18 bp, synthetic construct
  source 1..18: mol_type = other DNA
taaaacgccttactatag

SEQ ID NO: 11975 - DNA, 18 bp, synthetic construct
  source 1..18: mol_type = other DNA
taaaaggacacactatag

SEQ ID NO: 11976 - DNA, 18 bp, synthetic construct
  source 1..18: mol_type = other DNA
taatacaacaccctatag

SEQ ID NO: 11977 - DNA, 18 bp, synthetic construct
  source 1..18: mol_type = other DNA
taatacagctcactaaag

SEQ ID NO: 11978 - DNA, 18 bp, synthetic construct
  source 1..18: mol_type = other DNA
taatacgacacaatctag

SEQ ID NO: 11979 - DNA, 18 bp, synthetic construct
  source 1..18: mol_type = other DNA
taatacgcctttctatag

SEQ ID NO: 11980 - DNA, 18 bp, synthetic construct
  source 1..18: mol_type = other DNA
taatacggctcataatag

SEQ ID NO: 11981 - DNA, 18 bp, synthetic construct
  source 1..18: mol_type = other DNA
taattcgattcactctag

SEQ ID NO: 11982 - DNA, 18 bp, synthetic construct
  source 1..18: mol_type = other DNA
taatttgactcattatag

SEQ ID NO: 11983 - DNA, 18 bp, synthetic construct
  source 1..18: mol_type = other DNA
tactacgatttactatag

SEQ ID NO: 11984 - DNA, 18 bp, synthetic construct
  source 1..18: mol_type = other DNA
tactactactcattatag

SEQ ID NO: 11985 - DNA, 18 bp, synthetic construct
  source 1..18: mol_type = other DNA
tagtacgactaacaatag

SEQ ID NO: 11986 - DNA, 18 bp, synthetic construct
  source 1..18: mol_type = other DNA
tattaagcctcactatag

SEQ ID NO: 11987 - DNA, 18 bp, synthetic construct
  source 1..18: mol_type = other DNA
tattacgactcactgcag

SEQ ID NO: 11988 - DNA, 18 bp, synthetic construct
  source 1..18: mol_type = other DNA
tcatacgactctatatag

SEQ ID NO: 11989 - DNA, 18 bp, synthetic construct
  source 1..18: mol_type = other DNA
tcatacggctcactaaag

SEQ ID NO: 11990 - DNA, 18 bp, synthetic construct
  source 1..18: mol_type = other DNA
tgatacgacttactaaag

SEQ ID NO: 11991 - DNA, 18 bp, synthetic construct
  source 1..18: mol_type = other DNA
ttatactactgactatag

SEQ ID NO: 11992 - DNA, 18 bp, synthetic construct
  source 1..18: mol_type = other DNA
taattcgacaaactatag

SEQ ID NO: 11993 - DNA, 18 bp, synthetic construct
  source 1..18: mol_type = other DNA
ttatacgattcattatag

SEQ ID NO: 11994 - DNA, 18 bp, synthetic construct
  source 1..18: mol_type = other DNA
aaatacgactcacgttag

SEQ ID NO: 11995 - DNA, 18 bp, synthetic construct
  source 1..18: mol_type = other DNA
taatacaacagactatag

SEQ ID NO: 11996 - DNA, 18 bp, synthetic construct
  source 1..18: mol_type = other DNA
taatacgaatcacttcag

SEQ ID NO: 11997 - DNA, 18 bp, synthetic construct
  source 1..18: mol_type = other DNA
taatacgacacactttcg

SEQ ID NO: 11998 - DNA, 18 bp, synthetic construct
  source 1..18: mol_type = other DNA
taatacgagtcattaaag

SEQ ID NO: 11999 - DNA, 18 bp, synthetic construct
  source 1..18: mol_type = other DNA
taatacgattcacactag

SEQ ID NO: 12000 - DNA, 18 bp, synthetic construct
  source 1..18: mol_type = other DNA
taatacgattcattgtag

SEQ ID NO: 12001 - DNA, 18 bp, synthetic construct
  source 1..18: mol_type = other DNA
taatacgccttacaatag

SEQ ID NO: 12002 - DNA, 18 bp, synthetic construct
  source 1..18: mol_type = other DNA
taatcagacacactatag

SEQ ID NO: 12003 - DNA, 18 bp, synthetic construct
  source 1..18: mol_type = other DNA
tactacgacacattatag

SEQ ID NO: 12004 - DNA, 18 bp, synthetic construct
  source 1..18: mol_type = other DNA
tactacgactcattttag

SEQ ID NO: 12005 - DNA, 18 bp, synthetic construct
  source 1..18: mol_type = other DNA
tattacgactaagtatag

SEQ ID NO: 12006 - DNA, 18 bp, synthetic construct
  source 1..18: mol_type = other DNA
tgatatgactcacaatag

SEQ ID NO: 12007 - DNA, 18 bp, synthetic construct
  source 1..18: mol_type = other DNA
ttatacgactctctagag

SEQ ID NO: 12008 - DNA, 18 bp, synthetic construct
  source 1..18: mol_type = other DNA
ttatacgacttactctag

SEQ ID NO: 12009 - DNA, 18 bp, synthetic construct
  source 1..18: mol_type = other DNA
ttttacgacccactatag

SEQ ID NO: 12010 - DNA, 18 bp, synthetic construct
  source 1..18: mol_type = other DNA
tattacgtttcactatag

SEQ ID NO: 12011 - DNA, 18 bp, synthetic construct
  source 1..18: mol_type = other DNA
taatacatcttactatag

SEQ ID NO: 12012 - DNA, 18 bp, synthetic construct
  source 1..18: mol_type = other DNA
taatattactctctatag

SEQ ID NO: 12013 - DNA, 18 bp, synthetic construct
  source 1..18: mol_type = other DNA
atatacgattcactatag

SEQ ID NO: 12014 - DNA, 18 bp, synthetic construct
  source 1..18: mol_type = other DNA
taattctactcactctag

SEQ ID NO: 12015 - DNA, 18 bp, synthetic construct
  source 1..18: mol_type = other DNA
tattcctactcactatag

SEQ ID NO: 12016 - DNA, 18 bp, synthetic construct
  source 1..18: mol_type = other DNA
tgatacgactctctaaag

SEQ ID NO: 12017 - DNA, 18 bp, synthetic construct
  source 1..18: mol_type = other DNA
taatacggcttactttag

SEQ ID NO: 12018 - DNA, 18 bp, synthetic construct
  source 1..18: mol_type = other DNA
tattacgaatcactctag

SEQ ID NO: 12019 - DNA, 18 bp, synthetic construct
  source 1..18: mol_type = other DNA
tattacgactgactaaag

SEQ ID NO: 12020 - DNA, 18 bp, synthetic construct
  source 1..18: mol_type = other DNA
tcaaacgactcaatatag

SEQ ID NO: 12021 - DNA, 18 bp, synthetic construct
  source 1..18: mol_type = other DNA
taatacgactctcaacag

SEQ ID NO: 12022 - DNA, 18 bp, synthetic construct
  source 1..18: mol_type = other DNA
tattacgactccctattg

SEQ ID NO: 12023 - DNA, 18 bp, synthetic construct
  source 1..18: mol_type = other DNA
taaaacgactatctatag

SEQ ID NO: 12024 - DNA, 18 bp, synthetic construct
  source 1..18: mol_type = other DNA
taatacgtcacacaatag

SEQ ID NO: 12025 - DNA, 18 bp, synthetic construct
  source 1..18: mol_type = other DNA
taattctactcacaatag

SEQ ID NO: 12026 - DNA, 18 bp, synthetic construct
  source 1..18: mol_type = other DNA
taatacgtctatctatag

SEQ ID NO: 12027 - DNA, 18 bp, synthetic construct
  source 1..18: mol_type = other DNA
tcatacgacttacaatag

SEQ ID NO: 12028 - DNA, 18 bp, synthetic construct
  source 1..18: mol_type = other DNA
aaataccactctctatag

SEQ ID NO: 12029 - DNA, 18 bp, synthetic construct
  source 1..18: mol_type = other DNA
taacaggactcactattg

SEQ ID NO: 12030 - DNA, 18 bp, synthetic construct
  source 1..18: mol_type = other DNA
taataagcctaactatag

SEQ ID NO: 12031 - DNA, 18 bp, synthetic construct
  source 1..18: mol_type = other DNA
taatacaactcacaatgg

SEQ ID NO: 12032 - DNA, 18 bp, synthetic construct
  source 1..18: mol_type = other DNA
taatacaactcactaagg

SEQ ID NO: 12033 - DNA, 18 bp, synthetic construct
  source 1..18: mol_type = other DNA
taatacaagtcacaatag

SEQ ID NO: 12034 - DNA, 18 bp, synthetic construct
  source 1..18: mol_type = other DNA
taatactattcactacag

SEQ ID NO: 12035 - DNA, 18 bp, synthetic construct
  source 1..18: mol_type = other DNA
taatactcttcactatag

SEQ ID NO: 12036 - DNA, 18 bp, synthetic construct
  source 1..18: mol_type = other DNA
taatatgcctaactatag

SEQ ID NO: 12037 - DNA, 18 bp, synthetic construct
  source 1..18: mol_type = other DNA
tgaaaccactcactatag

SEQ ID NO: 12038 - DNA, 18 bp, synthetic construct
  source 1..18: mol_type = other DNA
tgatacgacttactattg

SEQ ID NO: 12039 - DNA, 18 bp, synthetic construct
  source 1..18: mol_type = other DNA
ttatacgcctcattatag

SEQ ID NO: 12040 - DNA, 18 bp, synthetic construct
  source 1..18: mol_type = other DNA
taatacgacttacaaaag

SEQ ID NO: 12041 - DNA, 18 bp, synthetic construct
  source 1..18: mol_type = other DNA
taataagtttcactatag

SEQ ID NO: 12042 - DNA, 18 bp, synthetic construct
  source 1..18: mol_type = other DNA
taatacaaatcacaatag

SEQ ID NO: 12043 - DNA, 18 bp, synthetic construct
  source 1..18: mol_type = other DNA
taataccactctctaaag

SEQ ID NO: 12044 - DNA, 18 bp, synthetic construct
  source 1..18: mol_type = other DNA
caatacgactcataatag

SEQ ID NO: 12045 - DNA, 18 bp, synthetic construct
  source 1..18: mol_type = other DNA
taaaacgaccctctatag

SEQ ID NO: 12046 - DNA, 18 bp, synthetic construct
  source 1..18: mol_type = other DNA
taaaacgtctccctatag

SEQ ID NO: 12047 - DNA, 18 bp, synthetic construct
  source 1..18: mol_type = other DNA
taatacctctaactatag

SEQ ID NO: 12048 - DNA, 18 bp, synthetic construct
  source 1..18: mol_type = other DNA
taatacgaattaccatag

SEQ ID NO: 12049 - DNA, 18 bp, synthetic construct
  source 1..18: mol_type = other DNA
taatacgacacagtttag

SEQ ID NO: 12050 - DNA, 18 bp, synthetic construct
  source 1..18: mol_type = other DNA
taatacgattcactcaag

SEQ ID NO: 12051 - DNA, 18 bp, synthetic construct
  source 1..18: mol_type = other DNA
taatacgtatccctatag

SEQ ID NO: 12052 - DNA, 18 bp, synthetic construct
  source 1..18: mol_type = other DNA
taatacgtctcattgtag

SEQ ID NO: 12053 - DNA, 18 bp, synthetic construct
  source 1..18: mol_type = other DNA
taataggactctccatag

SEQ ID NO: 12054 - DNA, 18 bp, synthetic construct
  source 1..18: mol_type = other DNA
taatccgacaaactatag

SEQ ID NO: 12055 - DNA, 18 bp, synthetic construct
  source 1..18: mol_type = other DNA
taattagactccctatag

SEQ ID NO: 12056 - DNA, 18 bp, synthetic construct
  source 1..18: mol_type = other DNA
tgattcgattcactatag

SEQ ID NO: 12057 - DNA, 18 bp, synthetic construct
  source 1..18: mol_type = other DNA
caattctactcactatag

SEQ ID NO: 12058 - DNA, 18 bp, synthetic construct
  source 1..18: mol_type = other DNA
taataccattctctatag

SEQ ID NO: 12059 - DNA, 18 bp, synthetic construct
  source 1..18: mol_type = other DNA
taattcgtatcactatag

SEQ ID NO: 12060 - DNA, 18 bp, synthetic construct
  source 1..18: mol_type = other DNA
tattaagacttactatag

SEQ ID NO: 12061 - DNA, 18 bp, synthetic construct
  source 1..18: mol_type = other DNA
caatacgtctcaatatag

SEQ ID NO: 12062 - DNA, 18 bp, synthetic construct
  source 1..18: mol_type = other DNA
tactacgtctcactttag

SEQ ID NO: 12063 - DNA, 18 bp, synthetic construct
  source 1..18: mol_type = other DNA
aaatacgactaaatatag

SEQ ID NO: 12064 - DNA, 18 bp, synthetic construct
  source 1..18: mol_type = other DNA
taacacgattctctatag

SEQ ID NO: 12065 - DNA, 18 bp, synthetic construct
  source 1..18: mol_type = other DNA
taataatactcactatgg

SEQ ID NO: 12066 - DNA, 18 bp, synthetic construct
  source 1..18: mol_type = other DNA
taatacaacccactttag

SEQ ID NO: 12067 - DNA, 18 bp, synthetic construct
  source 1..18: mol_type = other DNA
taatatgattcaccatag

SEQ ID NO: 12068 - DNA, 18 bp, synthetic construct
  source 1..18: mol_type = other DNA
taatgcgattctctatag

SEQ ID NO: 12069 - DNA, 18 bp, synthetic construct
  source 1..18: mol_type = other DNA
tattaagactcactatgg

SEQ ID NO: 12070 - DNA, 18 bp, synthetic construct
  source 1..18: mol_type = other DNA
tattactacccactatag

SEQ ID NO: 12071 - DNA, 18 bp, synthetic construct
  source 1..18: mol_type = other DNA
tcttacgactcactctag

SEQ ID NO: 12072 - DNA, 18 bp, synthetic construct
  source 1..18: mol_type = other DNA
ttatacgattcgctatag

SEQ ID NO: 12073 - DNA, 18 bp, synthetic construct
  source 1..18: mol_type = other DNA
atatacgacacactatag

SEQ ID NO: 12074 - DNA, 18 bp, synthetic construct
  source 1..18: mol_type = other DNA
aaatacgacttactttag

SEQ ID NO: 12075 - DNA, 18 bp, synthetic construct
  source 1..18: mol_type = other DNA
taatgcgtcacactatag

SEQ ID NO: 12076 - DNA, 18 bp, synthetic construct
  source 1..18: mol_type = other DNA
taattcgactcaaaatag

SEQ ID NO: 12077 - DNA, 18 bp, synthetic construct
  source 1..18: mol_type = other DNA
aaatacaactcaccatag

SEQ ID NO: 12078 - DNA, 18 bp, synthetic construct
  source 1..18: mol_type = other DNA
caatacgattcacaatag

SEQ ID NO: 12079 - DNA, 18 bp, synthetic construct
  source 1..18: mol_type = other DNA
cattacgacacactatag

SEQ ID NO: 12080 - DNA, 18 bp, synthetic construct
  source 1..18: mol_type = other DNA
taacacgactcattaaag

SEQ ID NO: 12081 - DNA, 18 bp, synthetic construct
  source 1..18: mol_type = other DNA
taataagactaacaatag

SEQ ID NO: 12082 - DNA, 18 bp, synthetic construct
  source 1..18: mol_type = other DNA
taatacgacactctctag

SEQ ID NO: 12083 - DNA, 18 bp, synthetic construct
  source 1..18: mol_type = other DNA
taatatggctcactattg

SEQ ID NO: 12084 - DNA, 18 bp, synthetic construct
  source 1..18: mol_type = other DNA
taatattactaactatag

SEQ ID NO: 12085 - DNA, 18 bp, synthetic construct
  source 1..18: mol_type = other DNA
taatccgacacactaaag

SEQ ID NO: 12086 - DNA, 18 bp, synthetic construct
  source 1..18: mol_type = other DNA
taatctgtctcactatag

SEQ ID NO: 12087 - DNA, 18 bp, synthetic construct
  source 1..18: mol_type = other DNA
taattcgattcactacag

SEQ ID NO: 12088 - DNA, 18 bp, synthetic construct
  source 1..18: mol_type = other DNA
tactacaaatcactatag

SEQ ID NO: 12089 - DNA, 18 bp, synthetic construct
  source 1..18: mol_type = other DNA
tcatacgactaactaaag

SEQ ID NO: 12090 - DNA, 18 bp, synthetic construct
  source 1..18: mol_type = other DNA
tcattcgactcaatatag

SEQ ID NO: 12091 - DNA, 18 bp, synthetic construct
  source 1..18: mol_type = other DNA
tgatacgactcattaaag

SEQ ID NO: 12092 - DNA, 18 bp, synthetic construct
  source 1..18: mol_type = other DNA
tgttactactcactatag

SEQ ID NO: 12093 - DNA, 18 bp, synthetic construct
  source 1..18: mol_type = other DNA
ttatacaactcattatag

SEQ ID NO: 12094 - DNA, 18 bp, synthetic construct
  source 1..18: mol_type = other DNA
atatactactcactatag

SEQ ID NO: 12095 - DNA, 18 bp, synthetic construct
  source 1..18: mol_type = other DNA
tattacgtctcacaatag

SEQ ID NO: 12096 - DNA, 18 bp, synthetic construct
  source 1..18: mol_type = other DNA
aaaaacgacacactatag

SEQ ID NO: 12097 - DNA, 18 bp, synthetic construct
  source 1..18: mol_type = other DNA
taatacgactcccaattg

SEQ ID NO: 12098 - DNA, 18 bp, synthetic construct
  source 1..18: mol_type = other DNA
ttttacgactcattatag

SEQ ID NO: 12099 - DNA, 18 bp, synthetic construct
  source 1..18: mol_type = other DNA
taaaacgactgtctatag

SEQ ID NO: 12100 - DNA, 18 bp, synthetic construct
  source 1..18: mol_type = other DNA
taacaagtctcactatag

SEQ ID NO: 12101 - DNA, 18 bp, synthetic construct
  source 1..18: mol_type = other DNA
taatacctctcattatag

SEQ ID NO: 12102 - DNA, 18 bp, synthetic construct
  source 1..18: mol_type = other DNA
taatacgaatccatatag

SEQ ID NO: 12103 - DNA, 18 bp, synthetic construct
  source 1..18: mol_type = other DNA
taatccgactttctatag

SEQ ID NO: 12104 - DNA, 18 bp, synthetic construct
  source 1..18: mol_type = other DNA
taattcgactgtctatag

SEQ ID NO: 12105 - DNA, 18 bp, synthetic construct
  source 1..18: mol_type = other DNA
tagtaagactaactatag

SEQ ID NO: 12106 - DNA, 18 bp, synthetic construct
  source 1..18: mol_type = other DNA
tagttcgactcactaaag

SEQ ID NO: 12107 - DNA, 18 bp, synthetic construct
  source 1..18: mol_type = other DNA
tcatacgtctaactatag

SEQ ID NO: 12108 - DNA, 18 bp, synthetic construct
  source 1..18: mol_type = other DNA
tcttacgacttactatag

SEQ ID NO: 12109 - DNA, 18 bp, synthetic construct
  source 1..18: mol_type = other DNA
taattcgtcacactatag

SEQ ID NO: 12110 - DNA, 18 bp, synthetic construct
  source 1..18: mol_type = other DNA
aaatacaacacactatag

SEQ ID NO: 12111 - DNA, 18 bp, synthetic construct
  source 1..18: mol_type = other DNA
aactacgacacactatag

SEQ ID NO: 12112 - DNA, 18 bp, synthetic construct
  source 1..18: mol_type = other DNA
taaaacgacgcactaaag

SEQ ID NO: 12113 - DNA, 18 bp, synthetic construct
  source 1..18: mol_type = other DNA
taaaacgactcccaatag

SEQ ID NO: 12114 - DNA, 18 bp, synthetic construct
  source 1..18: mol_type = other DNA
taactcgactcaatatag

SEQ ID NO: 12115 - DNA, 18 bp, synthetic construct
  source 1..18: mol_type = other DNA
taataccactaactttag

SEQ ID NO: 12116 - DNA, 18 bp, synthetic construct
  source 1..18: mol_type = other DNA
taatactaccctctatag

SEQ ID NO: 12117 - DNA, 18 bp, synthetic construct
  source 1..18: mol_type = other DNA
taattcgacttaccatag

SEQ ID NO: 12118 - DNA, 18 bp, synthetic construct
  source 1..18: mol_type = other DNA
taattcgagtctctatag

SEQ ID NO: 12119 - DNA, 18 bp, synthetic construct
  source 1..18: mol_type = other DNA
tagtacgtctcaatatag

SEQ ID NO: 12120 - DNA, 18 bp, synthetic construct
  source 1..18: mol_type = other DNA
tattacgacgctctatag

SEQ ID NO: 12121 - DNA, 18 bp, synthetic construct
  source 1..18: mol_type = other DNA
ttataagactccctatag

SEQ ID NO: 12122 - DNA, 18 bp, synthetic construct
  source 1..18: mol_type = other DNA
taatacgtcacactattg

SEQ ID NO: 12123 - DNA, 18 bp, synthetic construct
  source 1..18: mol_type = other DNA
aaatacgactcaaaatag

SEQ ID NO: 12124 - DNA, 18 bp, synthetic construct
  source 1..18: mol_type = other DNA
taatacgtctctccatag

SEQ ID NO: 12125 - DNA, 18 bp, synthetic construct
  source 1..18: mol_type = other DNA
taaaacggctaactatag

SEQ ID NO: 12126 - DNA, 18 bp, synthetic construct
  source 1..18: mol_type = other DNA
taatacggcactctatag

SEQ ID NO: 12127 - DNA, 18 bp, synthetic construct
  source 1..18: mol_type = other DNA
taatacttctccctatag

SEQ ID NO: 12128 - DNA, 18 bp, synthetic construct
  source 1..18: mol_type = other DNA
taatccgatacactatag

SEQ ID NO: 12129 - DNA, 18 bp, synthetic construct
  source 1..18: mol_type = other DNA
taattctactccctatag

SEQ ID NO: 12130 - DNA, 18 bp, synthetic construct
  source 1..18: mol_type = other DNA
tattacaactcaccatag

SEQ ID NO: 12131 - DNA, 18 bp, synthetic construct
  source 1..18: mol_type = other DNA
tcatacgacaaactatag

SEQ ID NO: 12132 - DNA, 18 bp, synthetic construct
  source 1..18: mol_type = other DNA
tcatacgactcattaaag

SEQ ID NO: 12133 - DNA, 18 bp, synthetic construct
  source 1..18: mol_type = other DNA
tgatattactcactatag

SEQ ID NO: 12134 - DNA, 18 bp, synthetic construct
  source 1..18: mol_type = other DNA
aaatacgacactctatag

SEQ ID NO: 12135 - DNA, 18 bp, synthetic construct
  source 1..18: mol_type = other DNA
ttataccactcactattg

SEQ ID NO: 12136 - DNA, 18 bp, synthetic construct
  source 1..18: mol_type = other DNA
taaaatgactctctatag

SEQ ID NO: 12137 - DNA, 18 bp, synthetic construct
  source 1..18: mol_type = other DNA
taaaacaactccctatag

SEQ ID NO: 12138 - DNA, 18 bp, synthetic construct
  source 1..18: mol_type = other DNA
taacacgactcacactag

SEQ ID NO: 12139 - DNA, 18 bp, synthetic construct
  source 1..18: mol_type = other DNA
taataccacttactaaag

SEQ ID NO: 12140 - DNA, 18 bp, synthetic construct
  source 1..18: mol_type = other DNA
taatacggcacacaatag

SEQ ID NO: 12141 - DNA, 18 bp, synthetic construct
  source 1..18: mol_type = other DNA
taatactattaactatag

SEQ ID NO: 12142 - DNA, 18 bp, synthetic construct
  source 1..18: mol_type = other DNA
taattcgatccactatag

SEQ ID NO: 12143 - DNA, 18 bp, synthetic construct
  source 1..18: mol_type = other DNA
tactactacacactatag

SEQ ID NO: 12144 - DNA, 18 bp, synthetic construct
  source 1..18: mol_type = other DNA
tgatacgactcaccaaag

SEQ ID NO: 12145 - DNA, 18 bp, synthetic construct
  source 1..18: mol_type = other DNA
aaatacaactcacaatag

SEQ ID NO: 12146 - DNA, 18 bp, synthetic construct
  source 1..18: mol_type = other DNA
caataccacacactatag

SEQ ID NO: 12147 - DNA, 18 bp, synthetic construct
  source 1..18: mol_type = other DNA
caatacgaatcactattg

SEQ ID NO: 12148 - DNA, 18 bp, synthetic construct
  source 1..18: mol_type = other DNA
taaaacgactcactatta

SEQ ID NO: 12149 - DNA, 18 bp, synthetic construct
  source 1..18: mol_type = other DNA
taatacgaatcactcttg

SEQ ID NO: 12150 - DNA, 18 bp, synthetic construct
  source 1..18: mol_type = other DNA
taatacgacccacattag

SEQ ID NO: 12151 - DNA, 18 bp, synthetic construct
  source 1..18: mol_type = other DNA
taatacgactcataacag

SEQ ID NO: 12152 - DNA, 18 bp, synthetic construct
  source 1..18: mol_type = other DNA
taattcgactcagtaaag

SEQ ID NO: 12153 - DNA, 18 bp, synthetic construct
  source 1..18: mol_type = other DNA
tatcacgactcaatatag

SEQ ID NO: 12154 - DNA, 18 bp, synthetic construct
  source 1..18: mol_type = other DNA
ttatacgactcatcatag

SEQ ID NO: 12155 - DNA, 18 bp, synthetic construct
  source 1..18: mol_type = other DNA
aaatacgacacactacag

SEQ ID NO: 12156 - DNA, 18 bp, synthetic construct
  source 1..18: mol_type = other DNA
aaattcgactcactatgg

SEQ ID NO: 12157 - DNA, 18 bp, synthetic construct
  source 1..18: mol_type = other DNA
agatacgactcacaatag

SEQ ID NO: 12158 - DNA, 18 bp, synthetic construct
  source 1..18: mol_type = other DNA
ccatacgactcacaatag

SEQ ID NO: 12159 - DNA, 18 bp, synthetic construct
  source 1..18: mol_type = other DNA
taatacgtctcaccacag

SEQ ID NO: 12160 - DNA, 18 bp, synthetic construct
  source 1..18: mol_type = other DNA
taataggactctttatag

SEQ ID NO: 12161 - DNA, 18 bp, synthetic construct
  source 1..18: mol_type = other DNA
tatcacgattcactatag

SEQ ID NO: 12162 - DNA, 18 bp, synthetic construct
  source 1..18: mol_type = other DNA
ttaaacgagtcactatag

SEQ ID NO: 12163 - DNA, 18 bp, synthetic construct
  source 1..18: mol_type = other DNA
ttacacgaatcactatag

SEQ ID NO: 12164 - DNA, 18 bp, synthetic construct
  source 1..18: mol_type = other DNA
taatatgtctcactaaag

SEQ ID NO: 12165 - DNA, 18 bp, synthetic construct
  source 1..18: mol_type = other DNA
tattacgattcaatatag

SEQ ID NO: 12166 - DNA, 18 bp, synthetic construct
  source 1..18: mol_type = other DNA
taataagtctcactatgg

SEQ ID NO: 12167 - DNA, 18 bp, synthetic construct
  source 1..18: mol_type = other DNA
taatacaaccctctatag

SEQ ID NO: 12168 - DNA, 18 bp, synthetic construct
  source 1..18: mol_type = other DNA
taatacatctgactatag

SEQ ID NO: 12169 - DNA, 18 bp, synthetic construct
  source 1..18: mol_type = other DNA
taatactacccactaaag

SEQ ID NO: 12170 - DNA, 18 bp, synthetic construct
  source 1..18: mol_type = other DNA
tactacgactaactaaag

SEQ ID NO: 12171 - DNA, 18 bp, synthetic construct
  source 1..18: mol_type = other DNA
tattacgactcaatattg

SEQ ID NO: 12172 - DNA, 18 bp, synthetic construct
  source 1..18: mol_type = other DNA
taataccactctatatag

SEQ ID NO: 12173 - DNA, 18 bp, synthetic construct
  source 1..18: mol_type = other DNA
taccacgtctcactatag

SEQ ID NO: 12174 - DNA, 18 bp, synthetic construct
  source 1..18: mol_type = other DNA
tcatacgactcacaattg

SEQ ID NO: 12175 - DNA, 18 bp, synthetic construct
  source 1..18: mol_type = other DNA
taatacgaatcactgaag

SEQ ID NO: 12176 - DNA, 18 bp, synthetic construct
  source 1..18: mol_type = other DNA
taatactactcactgttg

SEQ ID NO: 12177 - DNA, 18 bp, synthetic construct
  source 1..18: mol_type = other DNA
tgatactactctctatag

SEQ ID NO: 12178 - DNA, 18 bp, synthetic construct
  source 1..18: mol_type = other DNA
taaaacgactctcaatag

SEQ ID NO: 12179 - DNA, 18 bp, synthetic construct
  source 1..18: mol_type = other DNA
taacacgactctctaaag

SEQ ID NO: 12180 - DNA, 18 bp, synthetic construct
  source 1..18: mol_type = other DNA
taatacgaaacactaaag

SEQ ID NO: 12181 - DNA, 18 bp, synthetic construct
  source 1..18: mol_type = other DNA
taatatgattcactattg

SEQ ID NO: 12182 - DNA, 18 bp, synthetic construct
  source 1..18: mol_type = other DNA
taaaacgactcactaacg

SEQ ID NO: 12183 - DNA, 18 bp, synthetic construct
  source 1..18: mol_type = other DNA
taatacaactcatcatag

SEQ ID NO: 12184 - DNA, 18 bp, synthetic construct
  source 1..18: mol_type = other DNA
taatacgaataactaaag

SEQ ID NO: 12185 - DNA, 18 bp, synthetic construct
  source 1..18: mol_type = other DNA
taatacgacacgctttag

SEQ ID NO: 12186 - DNA, 18 bp, synthetic construct
  source 1..18: mol_type = other DNA
taatacgatttgctatag

SEQ ID NO: 12187 - DNA, 18 bp, synthetic construct
  source 1..18: mol_type = other DNA
taatactactctctacag

SEQ ID NO: 12188 - DNA, 18 bp, synthetic construct
  source 1..18: mol_type = other DNA
taatactattcgctatag

SEQ ID NO: 12189 - DNA, 18 bp, synthetic construct
  source 1..18: mol_type = other DNA
tagttagactcactatag

SEQ ID NO: 12190 - DNA, 18 bp, synthetic construct
  source 1..18: mol_type = other DNA
tatttcgactgactatag

SEQ ID NO: 12191 - DNA, 18 bp, synthetic construct
  source 1..18: mol_type = other DNA
ttctacgaatcactatag

SEQ ID NO: 12192 - DNA, 18 bp, synthetic construct
  source 1..18: mol_type = other DNA
taaaacgactttctatag

SEQ ID NO: 12193 - DNA, 18 bp, synthetic construct
  source 1..18: mol_type = other DNA
ttataagacacactatag

SEQ ID NO: 12194 - DNA, 18 bp, synthetic construct
  source 1..18: mol_type = other DNA
aaatatgagtcactatag

SEQ ID NO: 12195 - DNA, 18 bp, synthetic construct
  source 1..18: mol_type = other DNA
taatacaactcaccaaag

SEQ ID NO: 12196 - DNA, 18 bp, synthetic construct
  source 1..18: mol_type = other DNA
taatacgaatcaccaaag

SEQ ID NO: 12197 - DNA, 18 bp, synthetic construct
  source 1..18: mol_type = other DNA
taatacgccttactttag

SEQ ID NO: 12198 - DNA, 18 bp, synthetic construct
  source 1..18: mol_type = other DNA
taatactaatcaatatag

SEQ ID NO: 12199 - DNA, 18 bp, synthetic construct
  source 1..18: mol_type = other DNA
tcatacaactcactattg

SEQ ID NO: 12200 - DNA, 18 bp, synthetic construct
  source 1..18: mol_type = other DNA
taatacgatacactaaag

SEQ ID NO: 12201 - DNA, 18 bp, synthetic construct
  source 1..18: mol_type = other DNA
aaatgcgactctctatag

SEQ ID NO: 12202 - DNA, 18 bp, synthetic construct
  source 1..18: mol_type = other DNA
taataagaaacactatag

SEQ ID NO: 12203 - DNA, 18 bp, synthetic construct
  source 1..18: mol_type = other DNA
taatacgatatactatag

SEQ ID NO: 12204 - DNA, 18 bp, synthetic construct
  source 1..18: mol_type = other DNA
taattctactaactatag

SEQ ID NO: 12205 - DNA, 18 bp, synthetic construct
  source 1..18: mol_type = other DNA
taatacgtcacaccatag

SEQ ID NO: 12206 - DNA, 18 bp, synthetic construct
  source 1..18: mol_type = other DNA
ttatacaactaactatag

SEQ ID NO: 12207 - DNA, 18 bp, synthetic construct
  source 1..18: mol_type = other DNA
ttatacttctcactatag

SEQ ID NO: 12208 - DNA, 18 bp, synthetic construct
  source 1..18: mol_type = other DNA
aaatacgactgactttag

SEQ ID NO: 12209 - DNA, 18 bp, synthetic construct
  source 1..18: mol_type = other DNA
taatacgactatttatag

SEQ ID NO: 12210 - DNA, 18 bp, synthetic construct
  source 1..18: mol_type = other DNA
taatacgactctttatgg

SEQ ID NO: 12211 - DNA, 18 bp, synthetic construct
  source 1..18: mol_type = other DNA
taatacgtctacctatag

SEQ ID NO: 12212 - DNA, 18 bp, synthetic construct
  source 1..18: mol_type = other DNA
taatacgtctctcgatag

SEQ ID NO: 12213 - DNA, 18 bp, synthetic construct
  source 1..18: mol_type = other DNA
taatactactgacaatag

SEQ ID NO: 12214 - DNA, 18 bp, synthetic construct
  source 1..18: mol_type = other DNA
ttacacgacttactatag

SEQ ID NO: 12215 - DNA, 18 bp, synthetic construct
  source 1..18: mol_type = other DNA
ttatacgacctactatag

SEQ ID NO: 12216 - DNA, 18 bp, synthetic construct
  source 1..18: mol_type = other DNA
taatacgtctaactttag

SEQ ID NO: 12217 - DNA, 18 bp, synthetic construct
  source 1..18: mol_type = other DNA
taatacgtcttactttag

SEQ ID NO: 12218 - DNA, 18 bp, synthetic construct
  source 1..18: mol_type = other DNA
taatatgacacactttag

SEQ ID NO: 12219 - DNA, 18 bp, synthetic construct
  source 1..18: mol_type = other DNA
taatacgattcaatattg

SEQ ID NO: 12220 - DNA, 18 bp, synthetic construct
  source 1..18: mol_type = other DNA
taatacaactaactaaag

SEQ ID NO: 12221 - DNA, 18 bp, synthetic construct
  source 1..18: mol_type = other DNA
taataccactatctatag

SEQ ID NO: 12222 - DNA, 18 bp, synthetic construct
  source 1..18: mol_type = other DNA
taatacgaataactttag

SEQ ID NO: 12223 - DNA, 18 bp, synthetic construct
  source 1..18: mol_type = other DNA
taatacgactaaccttag

SEQ ID NO: 12224 - DNA, 18 bp, synthetic construct
  source 1..18: mol_type = other DNA
taattcgacttactacag

SEQ ID NO: 12225 - DNA, 18 bp, synthetic construct
  source 1..18: mol_type = other DNA
taattctactcaatatag

SEQ ID NO: 12226 - DNA, 18 bp, synthetic construct
  source 1..18: mol_type = other DNA
tcatacgactcactgaag

SEQ ID NO: 12227 - DNA, 18 bp, synthetic construct
  source 1..18: mol_type = other DNA
ttctacgactcacaatag

SEQ ID NO: 12228 - DNA, 18 bp, synthetic construct
  source 1..18: mol_type = other DNA
taatacgattaactattg

SEQ ID NO: 12229 - DNA, 18 bp, synthetic construct
  source 1..18: mol_type = other DNA
taatacgactcatattag

SEQ ID NO: 12230 - DNA, 18 bp, synthetic construct
  source 1..18: mol_type = other DNA
aaatacgagtcactttag

SEQ ID NO: 12231 - DNA, 18 bp, synthetic construct
  source 1..18: mol_type = other DNA
taatacaactccctttag

SEQ ID NO: 12232 - DNA, 18 bp, synthetic construct
  source 1..18: mol_type = other DNA
taatacgacttaatattg

SEQ ID NO: 12233 - DNA, 18 bp, synthetic construct
  source 1..18: mol_type = other DNA
taattcgaaacactatag

SEQ ID NO: 12234 - DNA, 18 bp, synthetic construct
  source 1..18: mol_type = other DNA
tactatgtctcactatag

SEQ ID NO: 12235 - DNA, 18 bp, synthetic construct
  source 1..18: mol_type = other DNA
tagtacgagtcactattg

SEQ ID NO: 12236 - DNA, 18 bp, synthetic construct
  source 1..18: mol_type = other DNA
tcatactacttactatag

SEQ ID NO: 12237 - DNA, 18 bp, synthetic construct
  source 1..18: mol_type = other DNA
taataagacactctatag

SEQ ID NO: 12238 - DNA, 18 bp, synthetic construct
  source 1..18: mol_type = other DNA
tattacgacacacaatag

SEQ ID NO: 12239 - DNA, 18 bp, synthetic construct
  source 1..18: mol_type = other DNA
aaatacgaatctctatag

SEQ ID NO: 12240 - DNA, 18 bp, synthetic construct
  source 1..18: mol_type = other DNA
taaaacgactcgcaatag

SEQ ID NO: 12241 - DNA, 18 bp, synthetic construct
  source 1..18: mol_type = other DNA
tcataccacacactatag

SEQ ID NO: 12242 - DNA, 18 bp, synthetic construct
  source 1..18: mol_type = other DNA
caatatgattcactatag

SEQ ID NO: 12243 - DNA, 18 bp, synthetic construct
  source 1..18: mol_type = other DNA
taaaacgagtctctatag

SEQ ID NO: 12244 - DNA, 18 bp, synthetic construct
  source 1..18: mol_type = other DNA
taataccactcattaaag

SEQ ID NO: 12245 - DNA, 18 bp, synthetic construct
  source 1..18: mol_type = other DNA
taatacgactacttatag

SEQ ID NO: 12246 - DNA, 18 bp, synthetic construct
  source 1..18: mol_type = other DNA
taatacgactatccatag

SEQ ID NO: 12247 - DNA, 18 bp, synthetic construct
  source 1..18: mol_type = other DNA
taattcgattaactatag

SEQ ID NO: 12248 - DNA, 18 bp, synthetic construct
  source 1..18: mol_type = other DNA
tcatacgattcattatag

SEQ ID NO: 12249 - DNA, 18 bp, synthetic construct
  source 1..18: mol_type = other DNA
ttatacgacccactattg

SEQ ID NO: 12250 - DNA, 18 bp, synthetic construct
  source 1..18: mol_type = other DNA
aaatacgaaacactatag

SEQ ID NO: 12251 - DNA, 18 bp, synthetic construct
  source 1..18: mol_type = other DNA
taatacgaatctatatag

SEQ ID NO: 12252 - DNA, 18 bp, synthetic construct
  source 1..18: mol_type = other DNA
taatacggctcacttaag

SEQ ID NO: 12253 - DNA, 18 bp, synthetic construct
  source 1..18: mol_type = other DNA
taatacgtctaaatatag

SEQ ID NO: 12254 - DNA, 18 bp, synthetic construct
  source 1..18: mol_type = other DNA
tacttcgactctctatag

SEQ ID NO: 12255 - DNA, 18 bp, synthetic construct
  source 1..18: mol_type = other DNA
tattaagactaactatag

SEQ ID NO: 12256 - DNA, 18 bp, synthetic construct
  source 1..18: mol_type = other DNA
tattatgattcactatag

SEQ ID NO: 12257 - DNA, 18 bp, synthetic construct
  source 1..18: mol_type = other DNA
aaatacgacacacaatag

SEQ ID NO: 12258 - DNA, 18 bp, synthetic construct
  source 1..18: mol_type = other DNA
ttatagtactcactatag

SEQ ID NO: 12259 - DNA, 18 bp, synthetic construct
  source 1..18: mol_type = other DNA
taacacgacactctatag

SEQ ID NO: 12260 - DNA, 18 bp, synthetic construct
  source 1..18: mol_type = other DNA
taataccaatcacaatag

SEQ ID NO: 12261 - DNA, 18 bp, synthetic construct
  source 1..18: mol_type = other DNA
taatacggctaactattg

SEQ ID NO: 12262 - DNA, 18 bp, synthetic construct
  source 1..18: mol_type = other DNA
taatacggctctctttag

SEQ ID NO: 12263 - DNA, 18 bp, synthetic construct
  source 1..18: mol_type = other DNA
taatactactcataatag

SEQ ID NO: 12264 - DNA, 18 bp, synthetic construct
  source 1..18: mol_type = other DNA
tattatgactcactatgg

SEQ ID NO: 12265 - DNA, 18 bp, synthetic construct
  source 1..18: mol_type = other DNA
tgatacgattctctatag

SEQ ID NO: 12266 - DNA, 18 bp, synthetic construct
  source 1..18: mol_type = other DNA
ttatacgaatcactatgg

SEQ ID NO: 12267 - DNA, 18 bp, synthetic construct
  source 1..18: mol_type = other DNA
ttatccgattcactatag

SEQ ID NO: 12268 - DNA, 18 bp, synthetic construct
  source 1..18: mol_type = other DNA
taaaactactcactaaag

SEQ ID NO: 12269 - DNA, 18 bp, synthetic construct
  source 1..18: mol_type = other DNA
taaaacgtctctctatag

SEQ ID NO: 12270 - DNA, 18 bp, synthetic construct
  source 1..18: mol_type = other DNA
aaatacgactaactacag

SEQ ID NO: 12271 - DNA, 18 bp, synthetic construct
  source 1..18: mol_type = other DNA
taaaacgacacactacag

SEQ ID NO: 12272 - DNA, 18 bp, synthetic construct
  source 1..18: mol_type = other DNA
taatactactcaatatcg

SEQ ID NO: 12273 - DNA, 18 bp, synthetic construct
  source 1..18: mol_type = other DNA
taataggattcactttag

SEQ ID NO: 12274 - DNA, 18 bp, synthetic construct
  source 1..18: mol_type = other DNA
ttgtacgaatcactatag

SEQ ID NO: 12275 - DNA, 18 bp, synthetic construct
  source 1..18: mol_type = other DNA
taaaacaacttactatag

SEQ ID NO: 12276 - DNA, 18 bp, synthetic construct
  source 1..18: mol_type = other DNA
taacacgattcactaaag

SEQ ID NO: 12277 - DNA, 18 bp, synthetic construct
  source 1..18: mol_type = other DNA
taatacggctctctaaag

SEQ ID NO: 12278 - DNA, 18 bp, synthetic construct
  source 1..18: mol_type = other DNA
ttctacgtctcactatag

SEQ ID NO: 12279 - DNA, 18 bp, synthetic construct
  source 1..18: mol_type = other DNA
aaatacgattaactatag

SEQ ID NO: 12280 - DNA, 18 bp, synthetic construct
  source 1..18: mol_type = other DNA
caatacttctcactatag

SEQ ID NO: 12281 - DNA, 18 bp, synthetic construct
  source 1..18: mol_type = other DNA
taaaacgattcaatatag

SEQ ID NO: 12282 - DNA, 18 bp, synthetic construct
  source 1..18: mol_type = other DNA
taacacaactctctatag

SEQ ID NO: 12283 - DNA, 18 bp, synthetic construct
  source 1..18: mol_type = other DNA
taatatgactctctatcg

SEQ ID NO: 12284 - DNA, 18 bp, synthetic construct
  source 1..18: mol_type = other DNA
tatttcgactccctatag

SEQ ID NO: 12285 - DNA, 18 bp, synthetic construct
  source 1..18: mol_type = other DNA
tcattcgacacactatag

SEQ ID NO: 12286 - DNA, 18 bp, synthetic construct
  source 1..18: mol_type = other DNA
tcttacgactcaatatag

SEQ ID NO: 12287 - DNA, 18 bp, synthetic construct
  source 1..18: mol_type = other DNA
ttatacgagttactatag

SEQ ID NO: 12288 - DNA, 18 bp, synthetic construct
  source 1..18: mol_type = other DNA
caatacgattcactaaag

SEQ ID NO: 12289 - DNA, 18 bp, synthetic construct
  source 1..18: mol_type = other DNA
taatacgtttcactctag

SEQ ID NO: 12290 - DNA, 18 bp, synthetic construct
  source 1..18: mol_type = other DNA
taattcgacttaatatag

SEQ ID NO: 12291 - DNA, 18 bp, synthetic construct
  source 1..18: mol_type = other DNA
aaatatgattcactatag

SEQ ID NO: 12292 - DNA, 18 bp, synthetic construct
  source 1..18: mol_type = other DNA
taacacgattcacaatag

SEQ ID NO: 12293 - DNA, 18 bp, synthetic construct
  source 1..18: mol_type = other DNA
tactacgaataactatag

SEQ ID NO: 12294 - DNA, 18 bp, synthetic construct
  source 1..18: mol_type = other DNA
tatcacgactcactacag

SEQ ID NO: 12295 - DNA, 18 bp, synthetic construct
  source 1..18: mol_type = other DNA
tattactactcactttag

SEQ ID NO: 12296 - DNA, 18 bp, synthetic construct
  source 1..18: mol_type = other DNA
caataatactcactatag

SEQ ID NO: 12297 - DNA, 18 bp, synthetic construct
  source 1..18: mol_type = other DNA
taatacgtcaccctatag

SEQ ID NO: 12298 - DNA, 18 bp, synthetic construct
  source 1..18: mol_type = other DNA
taattccactcactattg

SEQ ID NO: 12299 - DNA, 18 bp, synthetic construct
  source 1..18: mol_type = other DNA
taattccactctctatag

SEQ ID NO: 12300 - DNA, 18 bp, synthetic construct
  source 1..18: mol_type = other DNA
taattcgacacagtatag

SEQ ID NO: 12301 - DNA, 18 bp, synthetic construct
  source 1..18: mol_type = other DNA
taattcgaccctctatag

SEQ ID NO: 12302 - DNA, 18 bp, synthetic construct
  source 1..18: mol_type = other DNA
tattacgactgtctatag

SEQ ID NO: 12303 - DNA, 18 bp, synthetic construct
  source 1..18: mol_type = other DNA
taatacaacactctatag

SEQ ID NO: 12304 - DNA, 18 bp, synthetic construct
  source 1..18: mol_type = other DNA
aagtacgactctctatag

SEQ ID NO: 12305 - DNA, 18 bp, synthetic construct
  source 1..18: mol_type = other DNA
taacactactcactaaag

SEQ ID NO: 12306 - DNA, 18 bp, synthetic construct
  source 1..18: mol_type = other DNA
taatacaaatcaatatag

SEQ ID NO: 12307 - DNA, 18 bp, synthetic construct
  source 1..18: mol_type = other DNA
taataccacacactattg

SEQ ID NO: 12308 - DNA, 18 bp, synthetic construct
  source 1..18: mol_type = other DNA
taatacgacataatatag

SEQ ID NO: 12309 - DNA, 18 bp, synthetic construct
  source 1..18: mol_type = other DNA
ttatacgactcaatatcg

SEQ ID NO: 12310 - DNA, 18 bp, synthetic construct
  source 1..18: mol_type = other DNA
taataagactcaaaatag

SEQ ID NO: 12311 - DNA, 18 bp, synthetic construct
  source 1..18: mol_type = other DNA
taatacaactgtctatag

SEQ ID NO: 12312 - DNA, 18 bp, synthetic construct
  source 1..18: mol_type = other DNA
taatacgtctcagtattg

SEQ ID NO: 12313 - DNA, 18 bp, synthetic construct
  source 1..18: mol_type = other DNA
taatccgaatcactattg

SEQ ID NO: 12314 - DNA, 18 bp, synthetic construct
  source 1..18: mol_type = other DNA
ttattccactcactatag

SEQ ID NO: 12315 - DNA, 18 bp, synthetic construct
  source 1..18: mol_type = other DNA
taatacgactagcaatag

SEQ ID NO: 12316 - DNA, 18 bp, synthetic construct
  source 1..18: mol_type = other DNA
tattaacactcactatag

SEQ ID NO: 12317 - DNA, 18 bp, synthetic construct
  source 1..18: mol_type = other DNA
tattatgactcattatag

SEQ ID NO: 12318 - DNA, 18 bp, synthetic construct
  source 1..18: mol_type = other DNA
ttatacgactccctaaag

SEQ ID NO: 12319 - DNA, 18 bp, synthetic construct
  source 1..18: mol_type = other DNA
aaatacgactctatatag

SEQ ID NO: 12320 - DNA, 18 bp, synthetic construct
  source 1..18: mol_type = other DNA
taaaacgattcactctag

SEQ ID NO: 12321 - DNA, 18 bp, synthetic construct
  source 1..18: mol_type = other DNA
taacacgactcaatttag

SEQ ID NO: 12322 - DNA, 18 bp, synthetic construct
  source 1..18: mol_type = other DNA
taatatgactctccatag

SEQ ID NO: 12323 - DNA, 18 bp, synthetic construct
  source 1..18: mol_type = other DNA
taattcgacttattatag

SEQ ID NO: 12324 - DNA, 18 bp, synthetic construct
  source 1..18: mol_type = other DNA
tcatacgtctcaatatag

SEQ ID NO: 12325 - DNA, 18 bp, synthetic construct
  source 1..18: mol_type = other DNA
ttatacggctctctatag

SEQ ID NO: 12326 - DNA, 18 bp, synthetic construct
  source 1..18: mol_type = other DNA
aaataagactcattatag

SEQ ID NO: 12327 - DNA, 18 bp, synthetic construct
  source 1..18: mol_type = other DNA
taatacgattcacaacag

SEQ ID NO: 12328 - DNA, 18 bp, synthetic construct
  source 1..18: mol_type = other DNA
tagtacgacttactttag

SEQ ID NO: 12329 - DNA, 18 bp, synthetic construct
  source 1..18: mol_type = other DNA
ttatacgactcaacatag

SEQ ID NO: 12330 - DNA, 18 bp, synthetic construct
  source 1..18: mol_type = other DNA
taatacgatacactttag

SEQ ID NO: 12331 - DNA, 18 bp, synthetic construct
  source 1..18: mol_type = other DNA
aaatacgactaactaaag

SEQ ID NO: 12332 - DNA, 18 bp, synthetic construct
  source 1..18: mol_type = other DNA
taaaatgacacactatag

SEQ ID NO: 12333 - DNA, 18 bp, synthetic construct
  source 1..18: mol_type = other DNA
taatacgtcttactctag

SEQ ID NO: 12334 - DNA, 18 bp, synthetic construct
  source 1..18: mol_type = other DNA
tattacgacacactatcg

SEQ ID NO: 12335 - DNA, 18 bp, synthetic construct
  source 1..18: mol_type = other DNA
tattacgacacattatag

SEQ ID NO: 12336 - DNA, 18 bp, synthetic construct
  source 1..18: mol_type = other DNA
tgatacgactcattttag

SEQ ID NO: 12337 - DNA, 18 bp, synthetic construct
  source 1..18: mol_type = other DNA
ttatacgagtcacaatag

SEQ ID NO: 12338 - DNA, 18 bp, synthetic construct
  source 1..18: mol_type = other DNA
taaaacaattcactatag

SEQ ID NO: 12339 - DNA, 18 bp, synthetic construct
  source 1..18: mol_type = other DNA
aaatgcgactcattatag

SEQ ID NO: 12340 - DNA, 18 bp, synthetic construct
  source 1..18: mol_type = other DNA
taaatcgactcaccatag

SEQ ID NO: 12341 - DNA, 18 bp, synthetic construct
  source 1..18: mol_type = other DNA
taacactactcactattg

SEQ ID NO: 12342 - DNA, 18 bp, synthetic construct
  source 1..18: mol_type = other DNA
taataagactatctatag

SEQ ID NO: 12343 - DNA, 18 bp, synthetic construct
  source 1..18: mol_type = other DNA
taataagattcactaaag

SEQ ID NO: 12344 - DNA, 18 bp, synthetic construct
  source 1..18: mol_type = other DNA
ttatacgattcactatgg

SEQ ID NO: 12345 - DNA, 18 bp, synthetic construct
  source 1..18: mol_type = other DNA
ttatacgtcccactatag

SEQ ID NO: 12346 - DNA, 18 bp, synthetic construct
  source 1..18: mol_type = other DNA
aaatacgacacattatag

SEQ ID NO: 12347 - DNA, 18 bp, synthetic construct
  source 1..18: mol_type = other DNA
taatacgactatatatag

SEQ ID NO: 12348 - DNA, 18 bp, synthetic construct
  source 1..18: mol_type = other DNA
taatacgactctatctag

SEQ ID NO: 12349 - DNA, 18 bp, synthetic construct
  source 1..18: mol_type = other DNA
taatccatctcactatag

SEQ ID NO: 12350 - DNA, 18 bp, synthetic construct
  source 1..18: mol_type = other DNA
tcatacgtctcacaatag

SEQ ID NO: 12351 - DNA, 18 bp, synthetic construct
  source 1..18: mol_type = other DNA
taatacgaatcacaaaag

SEQ ID NO: 12352 - DNA, 18 bp, synthetic construct
  source 1..18: mol_type = other DNA
taattcgattctctatag

SEQ ID NO: 12353 - DNA, 18 bp, synthetic construct
  source 1..18: mol_type = other DNA
taatacgtcacactagag

SEQ ID NO: 12354 - DNA, 18 bp, synthetic construct
  source 1..18: mol_type = other DNA
tgattcgacacactatag

SEQ ID NO: 12355 - DNA, 18 bp, synthetic construct
  source 1..18: mol_type = other DNA
ttatatgactcaccatag

SEQ ID NO: 12356 - DNA, 18 bp, synthetic construct
  source 1..18: mol_type = other DNA
ctatacgactcattatag

SEQ ID NO: 12357 - DNA, 18 bp, synthetic construct
  source 1..18: mol_type = other DNA
tacaacgactcactattg

SEQ ID NO: 12358 - DNA, 18 bp, synthetic construct
  source 1..18: mol_type = other DNA
aaatacgactctctaaag

SEQ ID NO: 12359 - DNA, 18 bp, synthetic construct
  source 1..18: mol_type = other DNA
taatacgacacattattg

SEQ ID NO: 12360 - DNA, 18 bp, synthetic construct
  source 1..18: mol_type = other DNA
taatacgattaacaatag

SEQ ID NO: 12361 - DNA, 18 bp, synthetic construct
  source 1..18: mol_type = other DNA
taatacgtctcactcttg

SEQ ID NO: 12362 - DNA, 18 bp, synthetic construct
  source 1..18: mol_type = other DNA
taataactctcactatag

SEQ ID NO: 12363 - DNA, 18 bp, synthetic construct
  source 1..18: mol_type = other DNA
taatacgacttactttcg

SEQ ID NO: 12364 - DNA, 18 bp, synthetic construct
  source 1..18: mol_type = other DNA
taatacgattcattacag

SEQ ID NO: 12365 - DNA, 18 bp, synthetic construct
  source 1..18: mol_type = other DNA
taatacgattccctttag

SEQ ID NO: 12366 - DNA, 18 bp, synthetic construct
  source 1..18: mol_type = other DNA
taatactactctccatag

SEQ ID NO: 12367 - DNA, 18 bp, synthetic construct
  source 1..18: mol_type = other DNA
ctatacgattcactatag

SEQ ID NO: 12368 - DNA, 18 bp, synthetic construct
  source 1..18: mol_type = other DNA
taatacgactaaatttag

SEQ ID NO: 12369 - DNA, 18 bp, synthetic construct
  source 1..18: mol_type = other DNA
tgatacgtctcacaatag

SEQ ID NO: 12370 - DNA, 18 bp, synthetic construct
  source 1..18: mol_type = other DNA
taataagactcacattag

SEQ ID NO: 12371 - DNA, 18 bp, synthetic construct
  source 1..18: mol_type = other DNA
taacactactcactttag

SEQ ID NO: 12372 - DNA, 18 bp, synthetic construct
  source 1..18: mol_type = other DNA
taatacgtttcactacag

SEQ ID NO: 12373 - DNA, 18 bp, synthetic construct
  source 1..18: mol_type = other DNA
taataggtttcactatag

SEQ ID NO: 12374 - DNA, 18 bp, synthetic construct
  source 1..18: mol_type = other DNA
taatatgatacactatag

SEQ ID NO: 12375 - DNA, 18 bp, synthetic construct
  source 1..18: mol_type = other DNA
tactacttctcactatag

SEQ ID NO: 12376 - DNA, 18 bp, synthetic construct
  source 1..18: mol_type = other DNA
tcaaacgactcactttag

SEQ ID NO: 12377 - DNA, 18 bp, synthetic construct
  source 1..18: mol_type = other DNA
ttatccgactcattatag

SEQ ID NO: 12378 - DNA, 18 bp, synthetic construct
  source 1..18: mol_type = other DNA
ttatacgactcattttag

SEQ ID NO: 12379 - DNA, 18 bp, synthetic construct
  source 1..18: mol_type = other DNA
taattccacttactatag

SEQ ID NO: 12380 - DNA, 18 bp, synthetic construct
  source 1..18: mol_type = other DNA
aaataagactcactattg

SEQ ID NO: 12381 - DNA, 18 bp, synthetic construct
  source 1..18: mol_type = other DNA
acatacgtctcactatag

SEQ ID NO: 12382 - DNA, 18 bp, synthetic construct
  source 1..18: mol_type = other DNA
ttatacgacacactatgg

SEQ ID NO: 12383 - DNA, 18 bp, synthetic construct
  source 1..18: mol_type = other DNA
aaatatgactcactaaag

SEQ ID NO: 12384 - DNA, 18 bp, synthetic construct
  source 1..18: mol_type = other DNA
taaaccgactcacaatag

SEQ ID NO: 12385 - DNA, 18 bp, synthetic construct
  source 1..18: mol_type = other DNA
ttatacgactaattatag

SEQ ID NO: 12386 - DNA, 18 bp, synthetic construct
  source 1..18: mol_type = other DNA
taatacatcacactatag

SEQ ID NO: 12387 - DNA, 18 bp, synthetic construct
  source 1..18: mol_type = other DNA
taactcgactctctatag

SEQ ID NO: 12388 - DNA, 18 bp, synthetic construct
  source 1..18: mol_type = other DNA
taattcgactcccaatag

SEQ ID NO: 12389 - DNA, 18 bp, synthetic construct
  source 1..18: mol_type = other DNA
taaatcgacttactatag

SEQ ID NO: 12390 - DNA, 18 bp, synthetic construct
  source 1..18: mol_type = other DNA
taatatgattcaatatag

SEQ ID NO: 12391 - DNA, 18 bp, synthetic construct
  source 1..18: mol_type = other DNA
taatccgactctcaatag

SEQ ID NO: 12392 - DNA, 18 bp, synthetic construct
  source 1..18: mol_type = other DNA
ttcttcgactcactatag

SEQ ID NO: 12393 - DNA, 18 bp, synthetic construct
  source 1..18: mol_type = other DNA
taaaacgacacattatag

SEQ ID NO: 12394 - DNA, 18 bp, synthetic construct
  source 1..18: mol_type = other DNA
tgatacgacacacaatag

SEQ ID NO: 12395 - DNA, 18 bp, synthetic construct
  source 1..18: mol_type = other DNA
taatacaattcactttag

SEQ ID NO: 12396 - DNA, 18 bp, synthetic construct
  source 1..18: mol_type = other DNA
tattacaactcattatag

SEQ ID NO: 12397 - DNA, 18 bp, synthetic construct
  source 1..18: mol_type = other DNA
tattactactcactatcg

SEQ ID NO: 12398 - DNA, 18 bp, synthetic construct
  source 1..18: mol_type = other DNA
taatacgactgactaatg

SEQ ID NO: 12399 - DNA, 18 bp, synthetic construct
  source 1..18: mol_type = other DNA
ctatactactcactatag

SEQ ID NO: 12400 - DNA, 18 bp, synthetic construct
  source 1..18: mol_type = other DNA
tataacgactcaccatag

SEQ ID NO: 12401 - DNA, 18 bp, synthetic construct
  source 1..18: mol_type = other DNA
tcttacgactctctatag

SEQ ID NO: 12402 - DNA, 18 bp, synthetic construct
  source 1..18: mol_type = other DNA
ttatactactccctatag

SEQ ID NO: 12403 - DNA, 18 bp, synthetic construct
  source 1..18: mol_type = other DNA
tattaatactcactatag

SEQ ID NO: 12404 - DNA, 18 bp, synthetic construct
  source 1..18: mol_type = other DNA
taaaatgactcattatag

SEQ ID NO: 12405 - DNA, 18 bp, synthetic construct
  source 1..18: mol_type = other DNA
ttattcgacttactatag

SEQ ID NO: 12406 - DNA, 18 bp, synthetic construct
  source 1..18: mol_type = other DNA
taatacaacatactatag

SEQ ID NO: 12407 - DNA, 18 bp, synthetic construct
  source 1..18: mol_type = other DNA
taatacgatttattatag

SEQ ID NO: 12408 - DNA, 18 bp, synthetic construct
  source 1..18: mol_type = other DNA
tattataactcactatag

SEQ ID NO: 12409 - DNA, 18 bp, synthetic construct
  source 1..18: mol_type = other DNA
tattaagactcattatag

SEQ ID NO: 12410 - DNA, 18 bp, synthetic construct
  source 1..18: mol_type = other DNA
ttataagattcactatag

SEQ ID NO: 12411 - DNA, 18 bp, synthetic construct
  source 1..18: mol_type = other DNA
ttatacgattaactatag

SEQ ID NO: 12412 - DNA, 18 bp, synthetic construct
  source 1..18: mol_type = other DNA
taatacgaaacactattg

SEQ ID NO: 12413 - DNA, 18 bp, synthetic construct
  source 1..18: mol_type = other DNA
taatacgactcacacaag

SEQ ID NO: 12414 - DNA, 18 bp, synthetic construct
  source 1..18: mol_type = other DNA
tcatacgactttctatag

SEQ ID NO: 12415 - DNA, 18 bp, synthetic construct
  source 1..18: mol_type = other DNA
taatacaaatctctatag

SEQ ID NO: 12416 - DNA, 18 bp, synthetic construct
  source 1..18: mol_type = other DNA
taatacgtcttattatag

SEQ ID NO: 12417 - DNA, 18 bp, synthetic construct
  source 1..18: mol_type = other DNA
ttacactactcactatag

SEQ ID NO: 12418 - DNA, 18 bp, synthetic construct
  source 1..18: mol_type = other DNA
aaaaactactcactatag

SEQ ID NO: 12419 - DNA, 18 bp, synthetic construct
  source 1..18: mol_type = other DNA
taatacgattcattaaag

SEQ ID NO: 12420 - DNA, 18 bp, synthetic construct
  source 1..18: mol_type = other DNA
ttgtacgactcactttag

SEQ ID NO: 12421 - DNA, 18 bp, synthetic construct
  source 1..18: mol_type = other DNA
taatacgaaacactttag

SEQ ID NO: 12422 - DNA, 18 bp, synthetic construct
  source 1..18: mol_type = other DNA
taatacgacatcctatag

SEQ ID NO: 12423 - DNA, 18 bp, synthetic construct
  source 1..18: mol_type = other DNA
taataccactctctttag

SEQ ID NO: 12424 - DNA, 18 bp, synthetic construct
  source 1..18: mol_type = other DNA
tattacgtcttactatag

SEQ ID NO: 12425 - DNA, 18 bp, synthetic construct
  source 1..18: mol_type = other DNA
aaatacgaatcacaatag

SEQ ID NO: 12426 - DNA, 18 bp, synthetic construct
  source 1..18: mol_type = other DNA
taatatgtctcacaatag

SEQ ID NO: 12427 - DNA, 18 bp, synthetic construct
  source 1..18: mol_type = other DNA
taatacaactatctatag

SEQ ID NO: 12428 - DNA, 18 bp, synthetic construct
  source 1..18: mol_type = other DNA
taaaacgaatcacaatag

SEQ ID NO: 12429 - DNA, 18 bp, synthetic construct
  source 1..18: mol_type = other DNA
tactacgtctcactaaag

SEQ ID NO: 12430 - DNA, 18 bp, synthetic construct
  source 1..18: mol_type = other DNA
taaaacgactcattttag

SEQ ID NO: 12431 - DNA, 18 bp, synthetic construct
  source 1..18: mol_type = other DNA
taataccactcacattag

SEQ ID NO: 12432 - DNA, 18 bp, synthetic construct
  source 1..18: mol_type = other DNA
taatacgacacaataaag

SEQ ID NO: 12433 - DNA, 18 bp, synthetic construct
  source 1..18: mol_type = other DNA
taataccattcactattg

SEQ ID NO: 12434 - DNA, 18 bp, synthetic construct
  source 1..18: mol_type = other DNA
aaaaacgattcactatag

SEQ ID NO: 12435 - DNA, 18 bp, synthetic construct
  source 1..18: mol_type = other DNA
taattcgactctatatag

SEQ ID NO: 12436 - DNA, 18 bp, synthetic construct
  source 1..18: mol_type = other DNA
ttatactactaactatag

SEQ ID NO: 12437 - DNA, 18 bp, synthetic construct
  source 1..18: mol_type = other DNA
taatacgactctcaatcg

SEQ ID NO: 12438 - DNA, 18 bp, synthetic construct
  source 1..18: mol_type = other DNA
tatcacgactcacaatag

SEQ ID NO: 12439 - DNA, 18 bp, synthetic construct
  source 1..18: mol_type = other DNA
tattacgattcattatag

SEQ ID NO: 12440 - DNA, 18 bp, synthetic construct
  source 1..18: mol_type = other DNA
taatacgactcataattg

SEQ ID NO: 12441 - DNA, 18 bp, synthetic construct
  source 1..18: mol_type = other DNA
taatacgtcaaactatag

SEQ ID NO: 12442 - DNA, 18 bp, synthetic construct
  source 1..18: mol_type = other DNA
ttatatgattcactatag

SEQ ID NO: 12443 - DNA, 18 bp, synthetic construct
  source 1..18: mol_type = other DNA
taatacgacaaactaaag

SEQ ID NO: 12444 - DNA, 18 bp, synthetic construct
  source 1..18: mol_type = other DNA
taatacaaatcactattg

SEQ ID NO: 12445 - DNA, 18 bp, synthetic construct
  source 1..18: mol_type = other DNA
taatacgtctcattaaag

SEQ ID NO: 12446 - DNA, 18 bp, synthetic construct
  source 1..18: mol_type = other DNA
taatacgtttcacaatag

SEQ ID NO: 12447 - DNA, 18 bp, synthetic construct
  source 1..18: mol_type = other DNA
taatacgactcactgtcc

SEQ ID NO: 12448 - DNA, 18 bp, synthetic construct
  source 1..18: mol_type = other DNA
tagtacggcgcactaaag

SEQ ID NO: 12449 - DNA, 18 bp, synthetic construct
  source 1..18: mol_type = other DNA
taataaggctcactactg

SEQ ID NO: 12450 - DNA, 18 bp, synthetic construct
  source 1..18: mol_type = other DNA
taattcgactcgccatcg

SEQ ID NO: 12451 - DNA, 18 bp, synthetic construct
  source 1..18: mol_type = other DNA
taacgagagtcactatag

SEQ ID NO: 12452 - DNA, 18 bp, synthetic construct
  source 1..18: mol_type = other DNA
ttatacgcatcactatcg

SEQ ID NO: 12453 - DNA, 18 bp, synthetic construct
  source 1..18: mol_type = other DNA
taatgcgagccactaaag

SEQ ID NO: 12454 - DNA, 18 bp, synthetic construct
  source 1..18: mol_type = other DNA
taatacaacgcgctattg

SEQ ID NO: 12455 - DNA, 18 bp, synthetic construct
  source 1..18: mol_type = other DNA
taatacgcgacactttag

SEQ ID NO: 12456 - DNA, 18 bp, synthetic construct
  source 1..18: mol_type = other DNA
taatctgactctctgtag

SEQ ID NO: 12457 - DNA, 18 bp, synthetic construct
  source 1..18: mol_type = other DNA
tgttaggactcactaaag

SEQ ID NO: 12458 - DNA, 18 bp, synthetic construct
  source 1..18: mol_type = other DNA
taaattgactcactatgg

SEQ ID NO: 12459 - DNA, 18 bp, synthetic construct
  source 1..18: mol_type = other DNA
tgatacgacttagtacag

SEQ ID NO: 12460 - DNA, 18 bp, synthetic construct
  source 1..18: mol_type = other DNA
taatatgacgcactaccg

SEQ ID NO: 12461 - DNA, 18 bp, synthetic construct
  source 1..18: mol_type = other DNA
taatacgcctctccatcg

SEQ ID NO: 12462 - DNA, 18 bp, synthetic construct
  source 1..18: mol_type = other DNA
aagtacagctcactatag

SEQ ID NO: 12463 - DNA, 18 bp, synthetic construct
  source 1..18: mol_type = other DNA
taattcgactcacggttg

SEQ ID NO: 12464 - DNA, 18 bp, synthetic construct
  source 1..18: mol_type = other DNA
taattcgactaactgcag

SEQ ID NO: 12465 - DNA, 18 bp, synthetic construct
  source 1..18: mol_type = other DNA
taatacgcgtcactactg

SEQ ID NO: 12466 - DNA, 18 bp, synthetic construct
  source 1..18: mol_type = other DNA
ttaaacgactcactaggg

SEQ ID NO: 12467 - DNA, 18 bp, synthetic construct
  source 1..18: mol_type = other DNA
tgatatgtctcactatcg

SEQ ID NO: 12468 - DNA, 18 bp, synthetic construct
  source 1..18: mol_type = other DNA
taatacaacacgctatcg

SEQ ID NO: 12469 - DNA, 18 bp, synthetic construct
  source 1..18: mol_type = other DNA
ttattcgactcgctattg

SEQ ID NO: 12470 - DNA, 18 bp, synthetic construct
  source 1..18: mol_type = other DNA
caatacgcctcgccatag

SEQ ID NO: 12471 - DNA, 18 bp, synthetic construct
  source 1..18: mol_type = other DNA
taattggactcacttcag

SEQ ID NO: 12472 - DNA, 18 bp, synthetic construct
  source 1..18: mol_type = other DNA
tactacgattcactgaag

SEQ ID NO: 12473 - DNA, 18 bp, synthetic construct
  source 1..18: mol_type = other DNA
tactactactcactccag

SEQ ID NO: 12474 - DNA, 18 bp, synthetic construct
  source 1..18: mol_type = other DNA
taattgaactcactctag

SEQ ID NO: 12475 - DNA, 18 bp, synthetic construct
  source 1..18: mol_type = other DNA
cgttacgactcactaaag

SEQ ID NO: 12476 - DNA, 18 bp, synthetic construct
  source 1..18: mol_type = other DNA
taaaacgactcaccaccg

SEQ ID NO: 12477 - DNA, 18 bp, synthetic construct
  source 1..18: mol_type = other DNA
tcgtacgactctctatcg

SEQ ID NO: 12478 - DNA, 18 bp, synthetic construct
  source 1..18: mol_type = other DNA
tgagaccactcgctatag

SEQ ID NO: 12479 - DNA, 18 bp, synthetic construct
  source 1..18: mol_type = other DNA
ttttacgactcgctatcg

SEQ ID NO: 12480 - DNA, 18 bp, synthetic construct
  source 1..18: mol_type = other DNA
ttattcgactcgccatag

SEQ ID NO: 12481 - DNA, 18 bp, synthetic construct
  source 1..18: mol_type = other DNA
taatctgactcgctatcg

SEQ ID NO: 12482 - DNA, 18 bp, synthetic construct
  source 1..18: mol_type = other DNA
taagacaactctctctag

SEQ ID NO: 12483 - DNA, 18 bp, synthetic construct
  source 1..18: mol_type = other DNA
tgatacgactaacactag

SEQ ID NO: 12484 - DNA, 18 bp, synthetic construct
  source 1..18: mol_type = other DNA
tggaacgactctctatag

SEQ ID NO: 12485 - DNA, 18 bp, synthetic construct
  source 1..18: mol_type = other DNA
tcaatcgactcactatcg

SEQ ID NO: 12486 - DNA, 18 bp, synthetic construct
  source 1..18: mol_type = other DNA
tcaatcgagtcactatag

SEQ ID NO: 12487 - DNA, 18 bp, synthetic construct
  source 1..18: mol_type = other DNA
caattcgactcgctattg

SEQ ID NO: 12488 - DNA, 18 bp, synthetic construct
  source 1..18: mol_type = other DNA
taatacaacacacactag

SEQ ID NO: 12489 - DNA, 18 bp, synthetic construct
  source 1..18: mol_type = other DNA
taattcgactagctattg

SEQ ID NO: 12490 - DNA, 18 bp, synthetic construct
  source 1..18: mol_type = other DNA
tgattcgactcgctattg

SEQ ID NO: 12491 - DNA, 18 bp, synthetic construct
  source 1..18: mol_type = other DNA
gatatcgactcactatag

SEQ ID NO: 12492 - DNA, 18 bp, synthetic construct
  source 1..18: mol_type = other DNA
tacttcgactcactaccg

SEQ ID NO: 12493 - DNA, 18 bp, synthetic construct
  source 1..18: mol_type = other DNA
taatacgaatgacaacag

SEQ ID NO: 12494 - DNA, 18 bp, synthetic construct
  source 1..18: mol_type = other DNA
taatacgcatcactaagg

SEQ ID NO: 12495 - DNA, 18 bp, synthetic construct
  source 1..18: mol_type = other DNA
taataggactcactcagg

SEQ ID NO: 12496 - DNA, 18 bp, synthetic construct
  source 1..18: mol_type = other DNA
tgattcgtcgcactatag

SEQ ID NO: 12497 - DNA, 18 bp, synthetic construct
  source 1..18: mol_type = other DNA
taattagactcgctacag

SEQ ID NO: 12498 - DNA, 18 bp, synthetic construct
  source 1..18: mol_type = other DNA
gtaaacgactcactagag

SEQ ID NO: 12499 - DNA, 18 bp, synthetic construct
  source 1..18: mol_type = other DNA
taaaacgacgctctatcg

SEQ ID NO: 12500 - DNA, 18 bp, synthetic construct
  source 1..18: mol_type = other DNA
ttaagcgactcactatcg

SEQ ID NO: 12501 - DNA, 18 bp, synthetic construct
  source 1..18: mol_type = other DNA
taaaatgactcgctatcg

SEQ ID NO: 12502 - DNA, 18 bp, synthetic construct
  source 1..18: mol_type = other DNA
ttattcgactcactaccg

SEQ ID NO: 12503 - DNA, 18 bp, synthetic construct
  source 1..18: mol_type = other DNA
taaaaagtctcactatcg

SEQ ID NO: 12504 - DNA, 18 bp, synthetic construct
  source 1..18: mol_type = other DNA
taatgcgcctcacttttg

SEQ ID NO: 12505 - DNA, 18 bp, synthetic construct
  source 1..18: mol_type = other DNA
tattacgactcgctactg

SEQ ID NO: 12506 - DNA, 18 bp, synthetic construct
  source 1..18: mol_type = other DNA
taatgcgtatcactttag

SEQ ID NO: 12507 - DNA, 18 bp, synthetic construct
  source 1..18: mol_type = other DNA
ttttacgcctcactagag

SEQ ID NO: 12508 - DNA, 18 bp, synthetic construct
  source 1..18: mol_type = other DNA
taataggtctgactattg

SEQ ID NO: 12509 - DNA, 18 bp, synthetic construct
  source 1..18: mol_type = other DNA
taatgcgactcaccaatg

SEQ ID NO: 12510 - DNA, 18 bp, synthetic construct
  source 1..18: mol_type = other DNA
taatacgtgtcactaaaa

SEQ ID NO: 12511 - DNA, 18 bp, synthetic construct
  source 1..18: mol_type = other DNA
tactacgtcaaactatag

SEQ ID NO: 12512 - DNA, 18 bp, synthetic construct
  source 1..18: mol_type = other DNA
tagtactactgactacag

SEQ ID NO: 12513 - DNA, 18 bp, synthetic construct
  source 1..18: mol_type = other DNA
taatactgctcgctattg

SEQ ID NO: 12514 - DNA, 18 bp, synthetic construct
  source 1..18: mol_type = other DNA
tattaagactcgctatcg

SEQ ID NO: 12515 - DNA, 18 bp, synthetic construct
  source 1..18: mol_type = other DNA
taatgcgcatcactattg

SEQ ID NO: 12516 - DNA, 18 bp, synthetic construct
  source 1..18: mol_type = other DNA
ctatacgactcactgaag

SEQ ID NO: 12517 - DNA, 18 bp, synthetic construct
  source 1..18: mol_type = other DNA
aaattcgactcgctattg

SEQ ID NO: 12518 - DNA, 18 bp, synthetic construct
  source 1..18: mol_type = other DNA
taaatcgactcaccatcg

SEQ ID NO: 12519 - DNA, 18 bp, synthetic construct
  source 1..18: mol_type = other DNA
taatttgcatcactatag

SEQ ID NO: 12520 - DNA, 18 bp, synthetic construct
  source 1..18: mol_type = other DNA
tgttaccactcacaatag

SEQ ID NO: 12521 - DNA, 18 bp, synthetic construct
  source 1..18: mol_type = other DNA
taaggcgactcactactg

SEQ ID NO: 12522 - DNA, 18 bp, synthetic construct
  source 1..18: mol_type = other DNA
ttacacgactcgctattg

SEQ ID NO: 12523 - DNA, 18 bp, synthetic construct
  source 1..18: mol_type = other DNA
tatcaagaatcactatag

SEQ ID NO: 12524 - DNA, 18 bp, synthetic construct
  source 1..18: mol_type = other DNA
ttttgcgactcactgtag

SEQ ID NO: 12525 - DNA, 18 bp, synthetic construct
  source 1..18: mol_type = other DNA
taaatagactcactatcg

SEQ ID NO: 12526 - DNA, 18 bp, synthetic construct
  source 1..18: mol_type = other DNA
taattcaactcactcaag

SEQ ID NO: 12527 - DNA, 18 bp, synthetic construct
  source 1..18: mol_type = other DNA
ggagaagactcactatag

SEQ ID NO: 12528 - DNA, 18 bp, synthetic construct
  source 1..18: mol_type = other DNA
taatacgactcttcgtag

SEQ ID NO: 12529 - DNA, 18 bp, synthetic construct
  source 1..18: mol_type = other DNA
tagcacgattcactttag

SEQ ID NO: 12530 - DNA, 18 bp, synthetic construct
  source 1..18: mol_type = other DNA
tagtacgtcttagtatag

SEQ ID NO: 12531 - DNA, 18 bp, synthetic construct
  source 1..18: mol_type = other DNA
tataacgactcacgctag

SEQ ID NO: 12532 - DNA, 18 bp, synthetic construct
  source 1..18: mol_type = other DNA
ttatacgaatctctgtag

SEQ ID NO: 12533 - DNA, 18 bp, synthetic construct
  source 1..18: mol_type = other DNA
taattagactcactctgg

SEQ ID NO: 12534 - DNA, 18 bp, synthetic construct
  source 1..18: mol_type = other DNA
taattggactcagtatcg

SEQ ID NO: 12535 - DNA, 18 bp, synthetic construct
  source 1..18: mol_type = other DNA
taatacggcacgcaatag

SEQ ID NO: 12536 - DNA, 18 bp, synthetic construct
  source 1..18: mol_type = other DNA
taattcgactcgatattg

SEQ ID NO: 12537 - DNA, 18 bp, synthetic construct
  source 1..18: mol_type = other DNA
taataagactagccatag

SEQ ID NO: 12538 - DNA, 18 bp, synthetic construct
  source 1..18: mol_type = other DNA
tcatgcgactcaaaatag

SEQ ID NO: 12539 - DNA, 18 bp, synthetic construct
  source 1..18: mol_type = other DNA
ctatacgactcgccatag

SEQ ID NO: 12540 - DNA, 18 bp, synthetic construct
  source 1..18: mol_type = other DNA
taataagacgcaatattg

SEQ ID NO: 12541 - DNA, 18 bp, synthetic construct
  source 1..18: mol_type = other DNA
caatacgactcaggaaag

SEQ ID NO: 12542 - DNA, 18 bp, synthetic construct
  source 1..18: mol_type = other DNA
taattcgagccactttag

SEQ ID NO: 12543 - DNA, 18 bp, synthetic construct
  source 1..18: mol_type = other DNA
ttattcgactcactactg

SEQ ID NO: 12544 - DNA, 18 bp, synthetic construct
  source 1..18: mol_type = other DNA
taatatggctcgctacag

SEQ ID NO: 12545 - DNA, 18 bp, synthetic construct
  source 1..18: mol_type = other DNA
tagtgcgtctcactatgg

SEQ ID NO: 12546 - DNA, 18 bp, synthetic construct
  source 1..18: mol_type = other DNA
ttatacaactcgctattg

SEQ ID NO: 12547 - DNA, 18 bp, synthetic construct
  source 1..18: mol_type = other DNA
taattcgtctcgctattg

SEQ ID NO: 12548 - DNA, 18 bp, synthetic construct
  source 1..18: mol_type = other DNA
taattggactcgccatag

SEQ ID NO: 12549 - DNA, 18 bp, synthetic construct
  source 1..18: mol_type = other DNA
caatacgactcgctactg

SEQ ID NO: 12550 - DNA, 18 bp, synthetic construct
  source 1..18: mol_type = other DNA
taatacgcctcgatattg

SEQ ID NO: 12551 - DNA, 18 bp, synthetic construct
  source 1..18: mol_type = other DNA
caattcgcctcactaaag

SEQ ID NO: 12552 - DNA, 18 bp, synthetic construct
  source 1..18: mol_type = other DNA
gaaatcgcctcactatag

SEQ ID NO: 12553 - DNA, 18 bp, synthetic construct
  source 1..18: mol_type = other DNA
taacaggactctctattg

SEQ ID NO: 12554 - DNA, 18 bp, synthetic construct
  source 1..18: mol_type = other DNA
taattgaactcactatcg

SEQ ID NO: 12555 - DNA, 18 bp, synthetic construct
  source 1..18: mol_type = other DNA
ttatacaactcgctgtag

SEQ ID NO: 12556 - DNA, 18 bp, synthetic construct
  source 1..18: mol_type = other DNA
ttgtacgactcactactg

SEQ ID NO: 12557 - DNA, 18 bp, synthetic construct
  source 1..18: mol_type = other DNA
aattacgactcactcgag

SEQ ID NO: 12558 - DNA, 18 bp, synthetic construct
  source 1..18: mol_type = other DNA
caatgcaactcactacag

SEQ ID NO: 12559 - DNA, 18 bp, synthetic construct
  source 1..18: mol_type = other DNA
gaaagcgactcactaaag

SEQ ID NO: 12560 - DNA, 18 bp, synthetic construct
  source 1..18: mol_type = other DNA
taatatcgctcactatcg

SEQ ID NO: 12561 - DNA, 18 bp, synthetic construct
  source 1..18: mol_type = other DNA
tagtacgactcccttaag

SEQ ID NO: 12562 - DNA, 18 bp, synthetic construct
  source 1..18: mol_type = other DNA
tattaagtgtcactatag

SEQ ID NO: 12563 - DNA, 18 bp, synthetic construct
  source 1..18: mol_type = other DNA
tattatgactccctaaag

SEQ ID NO: 12564 - DNA, 18 bp, synthetic construct
  source 1..18: mol_type = other DNA
taattcgactcgctacaa

SEQ ID NO: 12565 - DNA, 18 bp, synthetic construct
  source 1..18: mol_type = other DNA
taatatctctcgctatag

SEQ ID NO: 12566 - DNA, 18 bp, synthetic construct
  source 1..18: mol_type = other DNA
tattgcgactcaccaaag

SEQ ID NO: 12567 - DNA, 18 bp, synthetic construct
  source 1..18: mol_type = other DNA
ttattcggctcactattg

SEQ ID NO: 12568 - DNA, 18 bp, synthetic construct
  source 1..18: mol_type = other DNA
taatacacctcgctaaag

SEQ ID NO: 12569 - DNA, 18 bp, synthetic construct
  source 1..18: mol_type = other DNA
taaaataactcactctag

SEQ ID NO: 12570 - DNA, 18 bp, synthetic construct
  source 1..18: mol_type = other DNA
taatagccatcactatag

SEQ ID NO: 12571 - DNA, 18 bp, synthetic construct
  source 1..18: mol_type = other DNA
tattgcgactgtctatag

SEQ ID NO: 12572 - DNA, 18 bp, synthetic construct
  source 1..18: mol_type = other DNA
gaattcgactcactactg

SEQ ID NO: 12573 - DNA, 18 bp, synthetic construct
  source 1..18: mol_type = other DNA
taattcgtctcactgttg

SEQ ID NO: 12574 - DNA, 18 bp, synthetic construct
  source 1..18: mol_type = other DNA
tgattcgactcgctacag

SEQ ID NO: 12575 - DNA, 18 bp, synthetic construct
  source 1..18: mol_type = other DNA
taataggtgtcactttag

SEQ ID NO: 12576 - DNA, 18 bp, synthetic construct
  source 1..18: mol_type = other DNA
taattcggcccactaaag

SEQ ID NO: 12577 - DNA, 18 bp, synthetic construct
  source 1..18: mol_type = other DNA
ttatttgactcactagag

SEQ ID NO: 12578 - DNA, 18 bp, synthetic construct
  source 1..18: mol_type = other DNA
tatcgcgactcactgtag

SEQ ID NO: 12579 - DNA, 18 bp, synthetic construct
  source 1..18: mol_type = other DNA
taaaacgtctcacttgag

SEQ ID NO: 12580 - DNA, 18 bp, synthetic construct
  source 1..18: mol_type = other DNA
taatatgactcgctactg

SEQ ID NO: 12581 - DNA, 18 bp, synthetic construct
  source 1..18: mol_type = other DNA
ttacacggctcactattg

SEQ ID NO: 12582 - DNA, 18 bp, synthetic construct
  source 1..18: mol_type = other DNA
taatgctactctcgatag

SEQ ID NO: 12583 - DNA, 18 bp, synthetic construct
  source 1..18: mol_type = other DNA
ctatacgactcgctatcg

SEQ ID NO: 12584 - DNA, 18 bp, synthetic construct
  source 1..18: mol_type = other DNA
ttatgcgattcactttag

SEQ ID NO: 12585 - DNA, 18 bp, synthetic construct
  source 1..18: mol_type = other DNA
taattcaactcgctattg

SEQ ID NO: 12586 - DNA, 18 bp, synthetic construct
  source 1..18: mol_type = other DNA
taataagactcaatcttg

SEQ ID NO: 12587 - DNA, 18 bp, synthetic construct
  source 1..18: mol_type = other DNA
ttttgcgactcactaaag

SEQ ID NO: 12588 - DNA, 18 bp, synthetic construct
  source 1..18: mol_type = other DNA
tgattcgactcacaaaag

SEQ ID NO: 12589 - DNA, 18 bp, synthetic construct
  source 1..18: mol_type = other DNA
ttatacgactcgctactg

SEQ ID NO: 12590 - DNA, 18 bp, synthetic construct
  source 1..18: mol_type = other DNA
taataggactaactgttg

SEQ ID NO: 12591 - DNA, 18 bp, synthetic construct
  source 1..18: mol_type = other DNA
taatacaacagactaaag

SEQ ID NO: 12592 - DNA, 18 bp, synthetic construct
  source 1..18: mol_type = other DNA
taatacgaatcgctgttg

SEQ ID NO: 12593 - DNA, 18 bp, synthetic construct
  source 1..18: mol_type = other DNA
taatcagactcgctattg

SEQ ID NO: 12594 - DNA, 18 bp, synthetic construct
  source 1..18: mol_type = other DNA
taattcgactcactactt

SEQ ID NO: 12595 - DNA, 18 bp, synthetic construct
  source 1..18: mol_type = other DNA
tatttcgactcgctatcg

SEQ ID NO: 12596 - DNA, 18 bp, synthetic construct
  source 1..18: mol_type = other DNA
taattcgactcaaactag

SEQ ID NO: 12597 - DNA, 18 bp, synthetic construct
  source 1..18: mol_type = other DNA
taattggactcactttgg

SEQ ID NO: 12598 - DNA, 18 bp, synthetic construct
  source 1..18: mol_type = other DNA
tagaacgactcactagtg

SEQ ID NO: 12599 - DNA, 18 bp, synthetic construct
  source 1..18: mol_type = other DNA
ttgttcgactcactgtag

SEQ ID NO: 12600 - DNA, 18 bp, synthetic construct
  source 1..18: mol_type = other DNA
aaataaaactcactacag

SEQ ID NO: 12601 - DNA, 18 bp, synthetic construct
  source 1..18: mol_type = other DNA
aaatgagactcactagag

SEQ ID NO: 12602 - DNA, 18 bp, synthetic construct
  source 1..18: mol_type = other DNA
aagtacgacacaccatag

SEQ ID NO: 12603 - DNA, 18 bp, synthetic construct
  source 1..18: mol_type = other DNA
taatacgacactctctcg

SEQ ID NO: 12604 - DNA, 18 bp, synthetic construct
  source 1..18: mol_type = other DNA
taatacgactctttaccg

SEQ ID NO: 12605 - DNA, 18 bp, synthetic construct
  source 1..18: mol_type = other DNA
tagtacgaatctctctag

SEQ ID NO: 12606 - DNA, 18 bp, synthetic construct
  source 1..18: mol_type = other DNA
ttaagcgactcactctag

SEQ ID NO: 12607 - DNA, 18 bp, synthetic construct
  source 1..18: mol_type = other DNA
ttacacgactcagtaaag

SEQ ID NO: 12608 - DNA, 18 bp, synthetic construct
  source 1..18: mol_type = other DNA
ttacgcgactcactacag

SEQ ID NO: 12609 - DNA, 18 bp, synthetic construct
  source 1..18: mol_type = other DNA
ttatgcgactcactgttg

SEQ ID NO: 12610 - DNA, 18 bp, synthetic construct
  source 1..18: mol_type = other DNA
taatacgtttcaccatcg

SEQ ID NO: 12611 - DNA, 18 bp, synthetic construct
  source 1..18: mol_type = other DNA
tagcacgtctcactaaag

SEQ ID NO: 12612 - DNA, 18 bp, synthetic construct
  source 1..18: mol_type = other DNA
tcattcgactcgctaaag

SEQ ID NO: 12613 - DNA, 18 bp, synthetic construct
  source 1..18: mol_type = other DNA
ttaagcgactcactaaag

SEQ ID NO: 12614 - DNA, 18 bp, synthetic construct
  source 1..18: mol_type = other DNA
taattcgcctcactatta

SEQ ID NO: 12615 - DNA, 18 bp, synthetic construct
  source 1..18: mol_type = other DNA
taattcgtctcactactg

SEQ ID NO: 12616 - DNA, 18 bp, synthetic construct
  source 1..18: mol_type = other DNA
ttattcgactcgctaaag

SEQ ID NO: 12617 - DNA, 18 bp, synthetic construct
  source 1..18: mol_type = other DNA
tagttcgactcgctatcg

SEQ ID NO: 12618 - DNA, 18 bp, synthetic construct
  source 1..18: mol_type = other DNA
taatacgcatcactaatg

SEQ ID NO: 12619 - DNA, 18 bp, synthetic construct
  source 1..18: mol_type = other DNA
aaattcgactcaccacag

SEQ ID NO: 12620 - DNA, 18 bp, synthetic construct
  source 1..18: mol_type = other DNA
atatgcgactcactacag

SEQ ID NO: 12621 - DNA, 18 bp, synthetic construct
  source 1..18: mol_type = other DNA
taaaacaactcactctgg

SEQ ID NO: 12622 - DNA, 18 bp, synthetic construct
  source 1..18: mol_type = other DNA
taatacgaatgattatgg

SEQ ID NO: 12623 - DNA, 18 bp, synthetic construct
  source 1..18: mol_type = other DNA
taatgagacctactatag

SEQ ID NO: 12624 - DNA, 18 bp, synthetic construct
  source 1..18: mol_type = other DNA
taatgcgcctcacttaag

SEQ ID NO: 12625 - DNA, 18 bp, synthetic construct
  source 1..18: mol_type = other DNA
taaaacgactcactcatg

SEQ ID NO: 12626 - DNA, 18 bp, synthetic construct
  source 1..18: mol_type = other DNA
ttatcggactcgctatag

SEQ ID NO: 12627 - DNA, 18 bp, synthetic construct
  source 1..18: mol_type = other DNA
taataggactctcgatgg

SEQ ID NO: 12628 - DNA, 18 bp, synthetic construct
  source 1..18: mol_type = other DNA
ttttaggactcactgtag

SEQ ID NO: 12629 - DNA, 18 bp, synthetic construct
  source 1..18: mol_type = other DNA
taaaacgactcgccattg

SEQ ID NO: 12630 - DNA, 18 bp, synthetic construct
  source 1..18: mol_type = other DNA
taaaacggctcacattag

SEQ ID NO: 12631 - DNA, 18 bp, synthetic construct
  source 1..18: mol_type = other DNA
ttaaacgcatcactatag

SEQ ID NO: 12632 - DNA, 18 bp, synthetic construct
  source 1..18: mol_type = other DNA
taattagactcgccatag

SEQ ID NO: 12633 - DNA, 18 bp, synthetic construct
  source 1..18: mol_type = other DNA
tactatgactaacgatag

SEQ ID NO: 12634 - DNA, 18 bp, synthetic construct
  source 1..18: mol_type = other DNA
ttataggcatcactatag

SEQ ID NO: 12635 - DNA, 18 bp, synthetic construct
  source 1..18: mol_type = other DNA
taatgcgcctcactaatg

SEQ ID NO: 12636 - DNA, 18 bp, synthetic construct
  source 1..18: mol_type = other DNA
taattcaactcgctatcg

SEQ ID NO: 12637 - DNA, 18 bp, synthetic construct
  source 1..18: mol_type = other DNA
taatatgacttattttag

SEQ ID NO: 12638 - DNA, 18 bp, synthetic construct
  source 1..18: mol_type = other DNA
taaatcgactcgctaaag

SEQ ID NO: 12639 - DNA, 18 bp, synthetic construct
  source 1..18: mol_type = other DNA
caattcgactcgccatag

SEQ ID NO: 12640 - DNA, 18 bp, synthetic construct
  source 1..18: mol_type = other DNA
taattggactcggtatag

SEQ ID NO: 12641 - DNA, 18 bp, synthetic construct
  source 1..18: mol_type = other DNA
aaatacgagccactattg

SEQ ID NO: 12642 - DNA, 18 bp, synthetic construct
  source 1..18: mol_type = other DNA
taattggactcactccag

SEQ ID NO: 12643 - DNA, 18 bp, synthetic construct
  source 1..18: mol_type = other DNA
taatccgtgtcattatag

SEQ ID NO: 12644 - DNA, 18 bp, synthetic construct
  source 1..18: mol_type = other DNA
tgaaaagactcactctag

SEQ ID NO: 12645 - DNA, 18 bp, synthetic construct
  source 1..18: mol_type = other DNA
taattcgactcgcttaag

SEQ ID NO: 12646 - DNA, 18 bp, synthetic construct
  source 1..18: mol_type = other DNA
tgttacgactcgctattg

SEQ ID NO: 12647 - DNA, 18 bp, synthetic construct
  source 1..18: mol_type = other DNA
cattaggactcacgatag

SEQ ID NO: 12648 - DNA, 18 bp, synthetic construct
  source 1..18: mol_type = other DNA
aaattcgactcactactg

SEQ ID NO: 12649 - DNA, 18 bp, synthetic construct
  source 1..18: mol_type = other DNA
ttattcgactcgctttag

SEQ ID NO: 12650 - DNA, 18 bp, synthetic construct
  source 1..18: mol_type = other DNA
tttctcgactcactatag

SEQ ID NO: 12651 - DNA, 18 bp, synthetic construct
  source 1..18: mol_type = other DNA
taatccgcgacactatag

SEQ ID NO: 12652 - DNA, 18 bp, synthetic construct
  source 1..18: mol_type = other DNA
ttaaacgactcaatacag

SEQ ID NO: 12653 - DNA, 18 bp, synthetic construct
  source 1..18: mol_type = other DNA
ttgtaagacgcactatag

SEQ ID NO: 12654 - DNA, 18 bp, synthetic construct
  source 1..18: mol_type = other DNA
taacgcgtctcactattg

SEQ ID NO: 12655 - DNA, 18 bp, synthetic construct
  source 1..18: mol_type = other DNA
tatttggactcactctag

SEQ ID NO: 12656 - DNA, 18 bp, synthetic construct
  source 1..18: mol_type = other DNA
aaatacgcctcactactg

SEQ ID NO: 12657 - DNA, 18 bp, synthetic construct
  source 1..18: mol_type = other DNA
tattacgagccactattg

SEQ ID NO: 12658 - DNA, 18 bp, synthetic construct
  source 1..18: mol_type = other DNA
ttttacgactcactaccg

SEQ ID NO: 12659 - DNA, 18 bp, synthetic construct
  source 1..18: mol_type = other DNA
tacttcgactcgctattg

SEQ ID NO: 12660 - DNA, 18 bp, synthetic construct
  source 1..18: mol_type = other DNA
tattacgactcactctta

SEQ ID NO: 12661 - DNA, 18 bp, synthetic construct
  source 1..18: mol_type = other DNA
agatacgactcactttcg

SEQ ID NO: 12662 - DNA, 18 bp, synthetic construct
  source 1..18: mol_type = other DNA
taatataactcaccatcg

SEQ ID NO: 12663 - DNA, 18 bp, synthetic construct
  source 1..18: mol_type = other DNA
aaattctactcgctatag

SEQ ID NO: 12664 - DNA, 18 bp, synthetic construct
  source 1..18: mol_type = other DNA
aatttcgactcgctatag

SEQ ID NO: 12665 - DNA, 18 bp, synthetic construct
  source 1..18: mol_type = other DNA
caattcgactcgctaaag

SEQ ID NO: 12666 - DNA, 18 bp, synthetic construct
  source 1..18: mol_type = other DNA
taatgcgactagctattg

SEQ ID NO: 12667 - DNA, 18 bp, synthetic construct
  source 1..18: mol_type = other DNA
taattcgactcgctgaag

SEQ ID NO: 12668 - DNA, 18 bp, synthetic construct
  source 1..18: mol_type = other DNA
taattcgtctcactattt

SEQ ID NO: 12669 - DNA, 18 bp, synthetic construct
  source 1..18: mol_type = other DNA
taattcgtctcgctacag

SEQ ID NO: 12670 - DNA, 18 bp, synthetic construct
  source 1..18: mol_type = other DNA
tacttcgacgcactattg

SEQ ID NO: 12671 - DNA, 18 bp, synthetic construct
  source 1..18: mol_type = other DNA
aaatacgcctcgctacag

SEQ ID NO: 12672 - DNA, 18 bp, synthetic construct
  source 1..18: mol_type = other DNA
aatttcgactcactagag

SEQ ID NO: 12673 - DNA, 18 bp, synthetic construct
  source 1..18: mol_type = other DNA
caatgcgactcactagtg

SEQ ID NO: 12674 - DNA, 18 bp, synthetic construct
  source 1..18: mol_type = other DNA
caattagactcactagag

SEQ ID NO: 12675 - DNA, 18 bp, synthetic construct
  source 1..18: mol_type = other DNA
cattacgactcgctacag

SEQ ID NO: 12676 - DNA, 18 bp, synthetic construct
  source 1..18: mol_type = other DNA
cattccgactcgctatag

SEQ ID NO: 12677 - DNA, 18 bp, synthetic construct
  source 1..18: mol_type = other DNA
gaataagactcacaattg

SEQ ID NO: 12678 - DNA, 18 bp, synthetic construct
  source 1..18: mol_type = other DNA
taataaaactcgctatcg

SEQ ID NO: 12679 - DNA, 18 bp, synthetic construct
  source 1..18: mol_type = other DNA
taatacgagccactcttg

SEQ ID NO: 12680 - DNA, 18 bp, synthetic construct
  source 1..18: mol_type = other DNA
taataggacttgctatgg

SEQ ID NO: 12681 - DNA, 18 bp, synthetic construct
  source 1..18: mol_type = other DNA
taatccgactcgatatcg

SEQ ID NO: 12682 - DNA, 18 bp, synthetic construct
  source 1..18: mol_type = other DNA
taattaaactcactacag

SEQ ID NO: 12683 - DNA, 18 bp, synthetic construct
  source 1..18: mol_type = other DNA
taattagactcactgaag

SEQ ID NO: 12684 - DNA, 18 bp, synthetic construct
  source 1..18: mol_type = other DNA
taattcgaaccactatcg

SEQ ID NO: 12685 - DNA, 18 bp, synthetic construct
  source 1..18: mol_type = other DNA
taattcgcgtcactctag

SEQ ID NO: 12686 - DNA, 18 bp, synthetic construct
  source 1..18: mol_type = other DNA
taattggactcaaaatag

SEQ ID NO: 12687 - DNA, 18 bp, synthetic construct
  source 1..18: mol_type = other DNA
tagaacgcctcgctatag

SEQ ID NO: 12688 - DNA, 18 bp, synthetic construct
  source 1..18: mol_type = other DNA
tagttcgactctctatcg

SEQ ID NO: 12689 - DNA, 18 bp, synthetic construct
  source 1..18: mol_type = other DNA
tattaagactcgccatag

SEQ ID NO: 12690 - DNA, 18 bp, synthetic construct
  source 1..18: mol_type = other DNA
tattacggctcgctaaag

SEQ ID NO: 12691 - DNA, 18 bp, synthetic construct
  source 1..18: mol_type = other DNA
tattaggactcactcttg

SEQ ID NO: 12692 - DNA, 18 bp, synthetic construct
  source 1..18: mol_type = other DNA
tattccgactcgctatcg

SEQ ID NO: 12693 - DNA, 18 bp, synthetic construct
  source 1..18: mol_type = other DNA
tattgcgactcgctaaag

SEQ ID NO: 12694 - DNA, 18 bp, synthetic construct
  source 1..18: mol_type = other DNA
tatttcgactcactaccg

SEQ ID NO: 12695 - DNA, 18 bp, synthetic construct
  source 1..18: mol_type = other DNA
tgttacgactcaccattg

SEQ ID NO: 12696 - DNA, 18 bp, synthetic construct
  source 1..18: mol_type = other DNA
aaatacgactcactcagg

SEQ ID NO: 12697 - DNA, 18 bp, synthetic construct
  source 1..18: mol_type = other DNA
aaatgcgactcactgtcg

SEQ ID NO: 12698 - DNA, 18 bp, synthetic construct
  source 1..18: mol_type = other DNA
aattgcgactcactatcg

SEQ ID NO: 12699 - DNA, 18 bp, synthetic construct
  source 1..18: mol_type = other DNA
acctgcgactcactatag

SEQ ID NO: 12700 - DNA, 18 bp, synthetic construct
  source 1..18: mol_type = other DNA
atatgcgactcactgtag

SEQ ID NO: 12701 - DNA, 18 bp, synthetic construct
  source 1..18: mol_type = other DNA
caaagcgactcactagag

SEQ ID NO: 12702 - DNA, 18 bp, synthetic construct
  source 1..18: mol_type = other DNA
ccatacgactcagtatcg

SEQ ID NO: 12703 - DNA, 18 bp, synthetic construct
  source 1..18: mol_type = other DNA
ctataccactcactatcg

SEQ ID NO: 12704 - DNA, 18 bp, synthetic construct
  source 1..18: mol_type = other DNA
gaaaacgacttactgtag

SEQ ID NO: 12705 - DNA, 18 bp, synthetic construct
  source 1..18: mol_type = other DNA
gaataggactcagtagag

SEQ ID NO: 12706 - DNA, 18 bp, synthetic construct
  source 1..18: mol_type = other DNA
gaatgcgcctcactctag

SEQ ID NO: 12707 - DNA, 18 bp, synthetic construct
  source 1..18: mol_type = other DNA
gattgcgtctcactatag

SEQ ID NO: 12708 - DNA, 18 bp, synthetic construct
  source 1..18: mol_type = other DNA
taaaacgactcactcacg

SEQ ID NO: 12709 - DNA, 18 bp, synthetic construct
  source 1..18: mol_type = other DNA
taaaacgagtcaacatag

SEQ ID NO: 12710 - DNA, 18 bp, synthetic construct
  source 1..18: mol_type = other DNA
taaaaggactcactacgg

SEQ ID NO: 12711 - DNA, 18 bp, synthetic construct
  source 1..18: mol_type = other DNA
taacactaatcaatatag

SEQ ID NO: 12712 - DNA, 18 bp, synthetic construct
  source 1..18: mol_type = other DNA
taacatgactcagaatag

SEQ ID NO: 12713 - DNA, 18 bp, synthetic construct
  source 1..18: mol_type = other DNA
taatacaactcacattaa

SEQ ID NO: 12714 - DNA, 18 bp, synthetic construct
  source 1..18: mol_type = other DNA
taatacaacttactccag

SEQ ID NO: 12715 - DNA, 18 bp, synthetic construct
  source 1..18: mol_type = other DNA
taatacgactcattgcgg

SEQ ID NO: 12716 - DNA, 18 bp, synthetic construct
  source 1..18: mol_type = other DNA
taatacgagtcacatcag

SEQ ID NO: 12717 - DNA, 18 bp, synthetic construct
  source 1..18: mol_type = other DNA
taatacgtcccactaagg

SEQ ID NO: 12718 - DNA, 18 bp, synthetic construct
  source 1..18: mol_type = other DNA
taatactacttcctatgg

SEQ ID NO: 12719 - DNA, 18 bp, synthetic construct
  source 1..18: mol_type = other DNA
taatatgactcaccgtcg

SEQ ID NO: 12720 - DNA, 18 bp, synthetic construct
  source 1..18: mol_type = other DNA
taatcggccacactatag

SEQ ID NO: 12721 - DNA, 18 bp, synthetic construct
  source 1..18: mol_type = other DNA
taatgcgtctctctataa

SEQ ID NO: 12722 - DNA, 18 bp, synthetic construct
  source 1..18: mol_type = other DNA
taatgtgccttactatag

SEQ ID NO: 12723 - DNA, 18 bp, synthetic construct
  source 1..18: mol_type = other DNA
tagaaggacacactatag

SEQ ID NO: 12724 - DNA, 18 bp, synthetic construct
  source 1..18: mol_type = other DNA
tagtacgagttactttag

SEQ ID NO: 12725 - DNA, 18 bp, synthetic construct
  source 1..18: mol_type = other DNA
tagtatgactcactgaag

SEQ ID NO: 12726 - DNA, 18 bp, synthetic construct
  source 1..18: mol_type = other DNA
tataagaactcactatag

SEQ ID NO: 12727 - DNA, 18 bp, synthetic construct
  source 1..18: mol_type = other DNA
tatcgcgagtcactatag

SEQ ID NO: 12728 - DNA, 18 bp, synthetic construct
  source 1..18: mol_type = other DNA
tattaggactcacagtag

SEQ ID NO: 12729 - DNA, 18 bp, synthetic construct
  source 1..18: mol_type = other DNA
tcatacgactctgaatag

SEQ ID NO: 12730 - DNA, 18 bp, synthetic construct
  source 1..18: mol_type = other DNA
tcgtaccactcaatatag

SEQ ID NO: 12731 - DNA, 18 bp, synthetic construct
  source 1..18: mol_type = other DNA
tcttacgtctcactacag

SEQ ID NO: 12732 - DNA, 18 bp, synthetic construct
  source 1..18: mol_type = other DNA
tgatacgagtcagtttag

SEQ ID NO: 12733 - DNA, 18 bp, synthetic construct
  source 1..18: mol_type = other DNA
tgtcacgactcactttag

SEQ ID NO: 12734 - DNA, 18 bp, synthetic construct
  source 1..18: mol_type = other DNA
tgttacgactcagtacag

SEQ ID NO: 12735 - DNA, 18 bp, synthetic construct
  source 1..18: mol_type = other DNA
ttatacgaatcattctag

SEQ ID NO: 12736 - DNA, 18 bp, synthetic construct
  source 1..18: mol_type = other DNA
ttatacgactaagtctag

SEQ ID NO: 12737 - DNA, 18 bp, synthetic construct
  source 1..18: mol_type = other DNA
ttatacgcgtcactacag

SEQ ID NO: 12738 - DNA, 18 bp, synthetic construct
  source 1..18: mol_type = other DNA
ttatagaactcagtatag

SEQ ID NO: 12739 - DNA, 18 bp, synthetic construct
  source 1..18: mol_type = other DNA
ttatgcgactcaccaaag

SEQ ID NO: 12740 - DNA, 18 bp, synthetic construct
  source 1..18: mol_type = other DNA
ttctacaactaactatag

SEQ ID NO: 12741 - DNA, 18 bp, synthetic construct
  source 1..18: mol_type = other DNA
ttttacgactcactatga

SEQ ID NO: 12742 - DNA, 18 bp, synthetic construct
  source 1..18: mol_type = other DNA
ttttgcgactcactctag

SEQ ID NO: 12743 - DNA, 18 bp, synthetic construct
  source 1..18: mol_type = other DNA
tactacgactcagaacag

SEQ ID NO: 12744 - DNA, 18 bp, synthetic construct
  source 1..18: mol_type = other DNA
taatgcgactcactgatg

SEQ ID NO: 12745 - DNA, 18 bp, synthetic construct
  source 1..18: mol_type = other DNA
taattctactcgctattg

SEQ ID NO: 12746 - DNA, 18 bp, synthetic construct
  source 1..18: mol_type = other DNA
tgatacgaatctctagag

SEQ ID NO: 12747 - DNA, 18 bp, synthetic construct
  source 1..18: mol_type = other DNA
cactacgactttctatag

SEQ ID NO: 12748 - DNA, 18 bp, synthetic construct
  source 1..18: mol_type = other DNA
taattcgactcaatcttg

SEQ ID NO: 12749 - DNA, 18 bp, synthetic construct
  source 1..18: mol_type = other DNA
tattgcgcctcactgtag

SEQ ID NO: 12750 - DNA, 18 bp, synthetic construct
  source 1..18: mol_type = other DNA
taattagactcgctattg

SEQ ID NO: 12751 - DNA, 18 bp, synthetic construct
  source 1..18: mol_type = other DNA
ttttacgactcgctacag

SEQ ID NO: 12752 - DNA, 18 bp, synthetic construct
  source 1..18: mol_type = other DNA
aaataagactcaccctag

SEQ ID NO: 12753 - DNA, 18 bp, synthetic construct
  source 1..18: mol_type = other DNA
ttatgcgactcactaggg

SEQ ID NO: 12754 - DNA, 18 bp, synthetic construct
  source 1..18: mol_type = other DNA
aaagacggctcactattg

SEQ ID NO: 12755 - DNA, 18 bp, synthetic construct
  source 1..18: mol_type = other DNA
taaagcgcctcactttag

SEQ ID NO: 12756 - DNA, 18 bp, synthetic construct
  source 1..18: mol_type = other DNA
taagaggactctgtatag

SEQ ID NO: 12757 - DNA, 18 bp, synthetic construct
  source 1..18: mol_type = other DNA
ttataagactcactccag

SEQ ID NO: 12758 - DNA, 18 bp, synthetic construct
  source 1..18: mol_type = other DNA
ttttatgactcactagag

SEQ ID NO: 12759 - DNA, 18 bp, synthetic construct
  source 1..18: mol_type = other DNA
taatactaccctctaaag

SEQ ID NO: 12760 - DNA, 18 bp, synthetic construct
  source 1..18: mol_type = other DNA
gaattcgactcgctaaag

SEQ ID NO: 12761 - DNA, 18 bp, synthetic construct
  source 1..18: mol_type = other DNA
taattcgactcgctaccg

SEQ ID NO: 12762 - DNA, 18 bp, synthetic construct
  source 1..18: mol_type = other DNA
ttatataactcactaaag

SEQ ID NO: 12763 - DNA, 18 bp, synthetic construct
  source 1..18: mol_type = other DNA
ttattcgcctcactttag

SEQ ID NO: 12764 - DNA, 18 bp, synthetic construct
  source 1..18: mol_type = other DNA
cattaggactcactacag

SEQ ID NO: 12765 - DNA, 18 bp, synthetic construct
  source 1..18: mol_type = other DNA
taatacgtcacgccatag

SEQ ID NO: 12766 - DNA, 18 bp, synthetic construct
  source 1..18: mol_type = other DNA
taataaagctcactatcg

SEQ ID NO: 12767 - DNA, 18 bp, synthetic construct
  source 1..18: mol_type = other DNA
ttataagactcgctattg

SEQ ID NO: 12768 - DNA, 18 bp, synthetic construct
  source 1..18: mol_type = other DNA
taatacgactaacgccag

SEQ ID NO: 12769 - DNA, 18 bp, synthetic construct
  source 1..18: mol_type = other DNA
taaatcgtctcactaaag

SEQ ID NO: 12770 - DNA, 18 bp, synthetic construct
  source 1..18: mol_type = other DNA
taatacgccttaccatcg

SEQ ID NO: 12771 - DNA, 18 bp, synthetic construct
  source 1..18: mol_type = other DNA
taatccgtctgactaaag

SEQ ID NO: 12772 - DNA, 18 bp, synthetic construct
  source 1..18: mol_type = other DNA
taattcgactcgccaaag

SEQ ID NO: 12773 - DNA, 18 bp, synthetic construct
  source 1..18: mol_type = other DNA
tagtacaaatcactattg

SEQ ID NO: 12774 - DNA, 18 bp, synthetic construct
  source 1..18: mol_type = other DNA
ttatactcgtcactatag

SEQ ID NO: 12775 - DNA, 18 bp, synthetic construct
  source 1..18: mol_type = other DNA
tattacgactcatttcag

SEQ ID NO: 12776 - DNA, 18 bp, synthetic construct
  source 1..18: mol_type = other DNA
tatcacggctcactattg

SEQ ID NO: 12777 - DNA, 18 bp, synthetic construct
  source 1..18: mol_type = other DNA
taaaccgactcgctattg

SEQ ID NO: 12778 - DNA, 18 bp, synthetic construct
  source 1..18: mol_type = other DNA
tgattcgactcactactg

SEQ ID NO: 12779 - DNA, 18 bp, synthetic construct
  source 1..18: mol_type = other DNA
tattacgacatgctatag

SEQ ID NO: 12780 - DNA, 18 bp, synthetic construct
  source 1..18: mol_type = other DNA
aaattggactcactattg

SEQ ID NO: 12781 - DNA, 18 bp, synthetic construct
  source 1..18: mol_type = other DNA
ttattcgactcactagtg

SEQ ID NO: 12782 - DNA, 18 bp, synthetic construct
  source 1..18: mol_type = other DNA
taatacgtctcgttattg

SEQ ID NO: 12783 - DNA, 18 bp, synthetic construct
  source 1..18: mol_type = other DNA
taattcgactaactactg

SEQ ID NO: 12784 - DNA, 18 bp, synthetic construct
  source 1..18: mol_type = other DNA
taattctactcgctaaag

SEQ ID NO: 12785 - DNA, 18 bp, synthetic construct
  source 1..18: mol_type = other DNA
aaatgcaactcgctatag

SEQ ID NO: 12786 - DNA, 18 bp, synthetic construct
  source 1..18: mol_type = other DNA
caatgcgactcacttttg

SEQ ID NO: 12787 - DNA, 18 bp, synthetic construct
  source 1..18: mol_type = other DNA
caattcgtttcactatag

SEQ ID NO: 12788 - DNA, 18 bp, synthetic construct
  source 1..18: mol_type = other DNA
taataagtctcactactg

SEQ ID NO: 12789 - DNA, 18 bp, synthetic construct
  source 1..18: mol_type = other DNA
taattagactcactcaag

SEQ ID NO: 12790 - DNA, 18 bp, synthetic construct
  source 1..18: mol_type = other DNA
tcatatgactcactgttg

SEQ ID NO: 12791 - DNA, 18 bp, synthetic construct
  source 1..18: mol_type = other DNA
aaatccgactaactacag

SEQ ID NO: 12792 - DNA, 18 bp, synthetic construct
  source 1..18: mol_type = other DNA
cgaaacgacgcactatag

SEQ ID NO: 12793 - DNA, 18 bp, synthetic construct
  source 1..18: mol_type = other DNA
ctttaggactcactatag

SEQ ID NO: 12794 - DNA, 18 bp, synthetic construct
  source 1..18: mol_type = other DNA
taacacaactcactaacg

SEQ ID NO: 12795 - DNA, 18 bp, synthetic construct
  source 1..18: mol_type = other DNA
taacatgacgtactatag

SEQ ID NO: 12796 - DNA, 18 bp, synthetic construct
  source 1..18: mol_type = other DNA
taatacacgccactatag

SEQ ID NO: 12797 - DNA, 18 bp, synthetic construct
  source 1..18: mol_type = other DNA
taataccgctcacttcag

SEQ ID NO: 12798 - DNA, 18 bp, synthetic construct
  source 1..18: mol_type = other DNA
taatacctctcacaatcg

SEQ ID NO: 12799 - DNA, 18 bp, synthetic construct
  source 1..18: mol_type = other DNA
taatacgatccagtttag

SEQ ID NO: 12800 - DNA, 18 bp, synthetic construct
  source 1..18: mol_type = other DNA
taatcagactcacgaaag

SEQ ID NO: 12801 - DNA, 18 bp, synthetic construct
  source 1..18: mol_type = other DNA
taatctgattcactaaag

SEQ ID NO: 12802 - DNA, 18 bp, synthetic construct
  source 1..18: mol_type = other DNA
taatgcgcgtcacaatag

SEQ ID NO: 12803 - DNA, 18 bp, synthetic construct
  source 1..18: mol_type = other DNA
tactatgacatactatag

SEQ ID NO: 12804 - DNA, 18 bp, synthetic construct
  source 1..18: mol_type = other DNA
tagtacgagtcacaagag

SEQ ID NO: 12805 - DNA, 18 bp, synthetic construct
  source 1..18: mol_type = other DNA
tattgcgactcacttgag

SEQ ID NO: 12806 - DNA, 18 bp, synthetic construct
  source 1..18: mol_type = other DNA
tgataccactcattatcg

SEQ ID NO: 12807 - DNA, 18 bp, synthetic construct
  source 1..18: mol_type = other DNA
tttcgcgactcactatag

SEQ ID NO: 12808 - DNA, 18 bp, synthetic construct
  source 1..18: mol_type = other DNA
ttttaagactcactgtag

SEQ ID NO: 12809 - DNA, 18 bp, synthetic construct
  source 1..18: mol_type = other DNA
tattgcgactcacttttg

SEQ ID NO: 12810 - DNA, 18 bp, synthetic construct
  source 1..18: mol_type = other DNA
ttaaacgactcgctatcg

SEQ ID NO: 12811 - DNA, 18 bp, synthetic construct
  source 1..18: mol_type = other DNA
taaaacaactcgctattg

SEQ ID NO: 12812 - DNA, 18 bp, synthetic construct
  source 1..18: mol_type = other DNA
ttatgcgactcactactg

SEQ ID NO: 12813 - DNA, 18 bp, synthetic construct
  source 1..18: mol_type = other DNA
tcatacgaatctctaaag

SEQ ID NO: 12814 - DNA, 18 bp, synthetic construct
  source 1..18: mol_type = other DNA
tattacttctgactatag

SEQ ID NO: 12815 - DNA, 18 bp, synthetic construct
  source 1..18: mol_type = other DNA
tattgcgactcactaatg

SEQ ID NO: 12816 - DNA, 18 bp, synthetic construct
  source 1..18: mol_type = other DNA
tatttggactcactgtag

SEQ ID NO: 12817 - DNA, 18 bp, synthetic construct
  source 1..18: mol_type = other DNA
taatgtgactcactacgg

SEQ ID NO: 12818 - DNA, 18 bp, synthetic construct
  source 1..18: mol_type = other DNA
taattcgactcgctaatg

SEQ ID NO: 12819 - DNA, 18 bp, synthetic construct
  source 1..18: mol_type = other DNA
tgtttcgactcgctatag

SEQ ID NO: 12820 - DNA, 18 bp, synthetic construct
  source 1..18: mol_type = other DNA
tgaaacgaatcactttag

SEQ ID NO: 12821 - DNA, 18 bp, synthetic construct
  source 1..18: mol_type = other DNA
ttatgcgactcactcttg

SEQ ID NO: 12822 - DNA, 18 bp, synthetic construct
  source 1..18: mol_type = other DNA
taatatgactcaaaaaag

SEQ ID NO: 12823 - DNA, 18 bp, synthetic construct
  source 1..18: mol_type = other DNA
actttcgactcactatag

SEQ ID NO: 12824 - DNA, 18 bp, synthetic construct
  source 1..18: mol_type = other DNA
gaattcgactgaccatag

SEQ ID NO: 12825 - DNA, 18 bp, synthetic construct
  source 1..18: mol_type = other DNA
ttataggactcgctaaag

SEQ ID NO: 12826 - DNA, 18 bp, synthetic construct
  source 1..18: mol_type = other DNA
ttaatcgactcactctag

SEQ ID NO: 12827 - DNA, 18 bp, synthetic construct
  source 1..18: mol_type = other DNA
aaaaaggactcactctag

SEQ ID NO: 12828 - DNA, 18 bp, synthetic construct
  source 1..18: mol_type = other DNA
taatacggttaactatcg

SEQ ID NO: 12829 - DNA, 18 bp, synthetic construct
  source 1..18: mol_type = other DNA
taaaaagactcgctattg

SEQ ID NO: 12830 - DNA, 18 bp, synthetic construct
  source 1..18: mol_type = other DNA
caaaacgcatcactatag

SEQ ID NO: 12831 - DNA, 18 bp, synthetic construct
  source 1..18: mol_type = other DNA
ctatacgactcacttttg

SEQ ID NO: 12832 - DNA, 18 bp, synthetic construct
  source 1..18: mol_type = other DNA
taacacgactcgctaatg

SEQ ID NO: 12833 - DNA, 18 bp, synthetic construct
  source 1..18: mol_type = other DNA
aaattcgactcactaccg

SEQ ID NO: 12834 - DNA, 18 bp, synthetic construct
  source 1..18: mol_type = other DNA
ttattggactcactacag

SEQ ID NO: 12835 - DNA, 18 bp, synthetic construct
  source 1..18: mol_type = other DNA
aaatacaactcactttcg

SEQ ID NO: 12836 - DNA, 18 bp, synthetic construct
  source 1..18: mol_type = other DNA
taaaacgactcaccctaa

SEQ ID NO: 12837 - DNA, 18 bp, synthetic construct
  source 1..18: mol_type = other DNA
taatacgcatcagtgtag

SEQ ID NO: 12838 - DNA, 18 bp, synthetic construct
  source 1..18: mol_type = other DNA
taatcggcctcactctag

SEQ ID NO: 12839 - DNA, 18 bp, synthetic construct
  source 1..18: mol_type = other DNA
tgataggactcagtaaag

SEQ ID NO: 12840 - DNA, 18 bp, synthetic construct
  source 1..18: mol_type = other DNA
ttatgcgactcactaatg

SEQ ID NO: 12841 - DNA, 18 bp, synthetic construct
  source 1..18: mol_type = other DNA
tcattcgactcacgattg

SEQ ID NO: 12842 - DNA, 18 bp, synthetic construct
  source 1..18: mol_type = other DNA
gaaatcgactcactttag

SEQ ID NO: 12843 - DNA, 18 bp, synthetic construct
  source 1..18: mol_type = other DNA
ttttacgactcactcttg

SEQ ID NO: 12844 - DNA, 18 bp, synthetic construct
  source 1..18: mol_type = other DNA
aatagcgactcactatag

SEQ ID NO: 12845 - DNA, 18 bp, synthetic construct
  source 1..18: mol_type = other DNA
ttattcgtctcgctatag

SEQ ID NO: 12846 - DNA, 18 bp, synthetic construct
  source 1..18: mol_type = other DNA
ttttgcgactcactttag

SEQ ID NO: 12847 - DNA, 18 bp, synthetic construct
  source 1..18: mol_type = other DNA
taattcgcctcactactg

SEQ ID NO: 12848 - DNA, 18 bp, synthetic construct
  source 1..18: mol_type = other DNA
taatacgactcggtaatg

SEQ ID NO: 12849 - DNA, 18 bp, synthetic construct
  source 1..18: mol_type = other DNA
tagtacgactcactacta

SEQ ID NO: 12850 - DNA, 18 bp, synthetic construct
  source 1..18: mol_type = other DNA
tatttggactcactacag

SEQ ID NO: 12851 - DNA, 18 bp, synthetic construct
  source 1..18: mol_type = other DNA
tgttacaactcgctatag

SEQ ID NO: 12852 - DNA, 18 bp, synthetic construct
  source 1..18: mol_type = other DNA
ttatacgtctcgctatcg

SEQ ID NO: 12853 - DNA, 18 bp, synthetic construct
  source 1..18: mol_type = other DNA
tagtacgacttactaacg

SEQ ID NO: 12854 - DNA, 18 bp, synthetic construct
  source 1..18: mol_type = other DNA
tataaggagtcactatag

SEQ ID NO: 12855 - DNA, 18 bp, synthetic construct
  source 1..18: mol_type = other DNA
tattactactgaccatag

SEQ ID NO: 12856 - DNA, 18 bp, synthetic construct
  source 1..18: mol_type = other DNA
tgatacaactccctttag

SEQ ID NO: 12857 - DNA, 18 bp, synthetic construct
  source 1..18: mol_type = other DNA
ttaaacgactaactgtag

SEQ ID NO: 12858 - DNA, 18 bp, synthetic construct
  source 1..18: mol_type = other DNA
taagacaactcatcatag

SEQ ID NO: 12859 - DNA, 18 bp, synthetic construct
  source 1..18: mol_type = other DNA
taatacgccgctctatcg

SEQ ID NO: 12860 - DNA, 18 bp, synthetic construct
  source 1..18: mol_type = other DNA
tctggcgactcactatag

SEQ ID NO: 12861 - DNA, 18 bp, synthetic construct
  source 1..18: mol_type = other DNA
ttatgcgcctcactaaag

SEQ ID NO: 12862 - DNA, 18 bp, synthetic construct
  source 1..18: mol_type = other DNA
taattcgtctcgctaaag

SEQ ID NO: 12863 - DNA, 18 bp, synthetic construct
  source 1..18: mol_type = other DNA
taatatgacgtgctatag

SEQ ID NO: 12864 - DNA, 18 bp, synthetic construct
  source 1..18: mol_type = other DNA
cattacgactcgctattg

SEQ ID NO: 12865 - DNA, 18 bp, synthetic construct
  source 1..18: mol_type = other DNA
caacacatctcactatag

SEQ ID NO: 12866 - DNA, 18 bp, synthetic construct
  source 1..18: mol_type = other DNA
ttatgcgcctcacaatag

SEQ ID NO: 12867 - DNA, 18 bp, synthetic construct
  source 1..18: mol_type = other DNA
ttctacgagtcactaaag

SEQ ID NO: 12868 - DNA, 18 bp, synthetic construct
  source 1..18: mol_type = other DNA
tattgcgtctcactaaag

SEQ ID NO: 12869 - DNA, 18 bp, synthetic construct
  source 1..18: mol_type = other DNA
taaatcgacacgctatag

SEQ ID NO: 12870 - DNA, 18 bp, synthetic construct
  source 1..18: mol_type = other DNA
taataagacttattattg

SEQ ID NO: 12871 - DNA, 18 bp, synthetic construct
  source 1..18: mol_type = other DNA
taatacaactcgctaatg

SEQ ID NO: 12872 - DNA, 18 bp, synthetic construct
  source 1..18: mol_type = other DNA
tattgcgtttcactatag

SEQ ID NO: 12873 - DNA, 18 bp, synthetic construct
  source 1..18: mol_type = other DNA
tctcatgactcactatag

SEQ ID NO: 12874 - DNA, 18 bp, synthetic construct
  source 1..18: mol_type = other DNA
tgatacgactaacattag

SEQ ID NO: 12875 - DNA, 18 bp, synthetic construct
  source 1..18: mol_type = other DNA
aaaagcgactcactttag

SEQ ID NO: 12876 - DNA, 18 bp, synthetic construct
  source 1..18: mol_type = other DNA
tttaacgactcactctag

SEQ ID NO: 12877 - DNA, 18 bp, synthetic construct
  source 1..18: mol_type = other DNA
ttttacgactcaccttag

SEQ ID NO: 12878 - DNA, 18 bp, synthetic construct
  source 1..18: mol_type = other DNA
atataggactcactttag

SEQ ID NO: 12879 - DNA, 18 bp, synthetic construct
  source 1..18: mol_type = other DNA
tatttcgactcaatttag

SEQ ID NO: 12880 - DNA, 18 bp, synthetic construct
  source 1..18: mol_type = other DNA
taataagactcggtattg

SEQ ID NO: 12881 - DNA, 18 bp, synthetic construct
  source 1..18: mol_type = other DNA
taatacgactcgcttctg

SEQ ID NO: 12882 - DNA, 18 bp, synthetic construct
  source 1..18: mol_type = other DNA
ttatacgcctcacactag

SEQ ID NO: 12883 - DNA, 18 bp, synthetic construct
  source 1..18: mol_type = other DNA
taacacgactcgctactg

SEQ ID NO: 12884 - DNA, 18 bp, synthetic construct
  source 1..18: mol_type = other DNA
taaaccgactcactcttg

SEQ ID NO: 12885 - DNA, 18 bp, synthetic construct
  source 1..18: mol_type = other DNA
taatactacgcgctctag

SEQ ID NO: 12886 - DNA, 18 bp, synthetic construct
  source 1..18: mol_type = other DNA
ttatgcgactcaccattg

SEQ ID NO: 12887 - DNA, 18 bp, synthetic construct
  source 1..18: mol_type = other DNA
tgttacgagtcacaatag

SEQ ID NO: 12888 - DNA, 18 bp, synthetic construct
  source 1..18: mol_type = other DNA
tttttcgactcactgtag

SEQ ID NO: 12889 - DNA, 18 bp, synthetic construct
  source 1..18: mol_type = other DNA
ttttaggactcactttag

SEQ ID NO: 12890 - DNA, 18 bp, synthetic construct
  source 1..18: mol_type = other DNA
taataggactcacaaagg

SEQ ID NO: 12891 - DNA, 18 bp, synthetic construct
  source 1..18: mol_type = other DNA
ttattcaactcactctag

SEQ ID NO: 12892 - DNA, 18 bp, synthetic construct
  source 1..18: mol_type = other DNA
aattaggactcacgatag

SEQ ID NO: 12893 - DNA, 18 bp, synthetic construct
  source 1..18: mol_type = other DNA
tcatgcgtctcactctag

SEQ ID NO: 12894 - DNA, 18 bp, synthetic construct
  source 1..18: mol_type = other DNA
ttaaatgactcactatcg

SEQ ID NO: 12895 - DNA, 18 bp, synthetic construct
  source 1..18: mol_type = other DNA
taattggactcactactg

SEQ ID NO: 12896 - DNA, 18 bp, synthetic construct
  source 1..18: mol_type = other DNA
tgattcgactaactaaag

SEQ ID NO: 12897 - DNA, 18 bp, synthetic construct
  source 1..18: mol_type = other DNA
ctataggactcactttag

SEQ ID NO: 12898 - DNA, 18 bp, synthetic construct
  source 1..18: mol_type = other DNA
taatgcttgtcactatag

SEQ ID NO: 12899 - DNA, 18 bp, synthetic construct
  source 1..18: mol_type = other DNA
taatacgtctcacatcag

SEQ ID NO: 12900 - DNA, 18 bp, synthetic construct
  source 1..18: mol_type = other DNA
cattaagactcactattg

SEQ ID NO: 12901 - DNA, 18 bp, synthetic construct
  source 1..18: mol_type = other DNA
caattggactcactacag

SEQ ID NO: 12902 - DNA, 18 bp, synthetic construct
  source 1..18: mol_type = other DNA
ttattggactcactgtag

SEQ ID NO: 12903 - DNA, 18 bp, synthetic construct
  source 1..18: mol_type = other DNA
ttataggactcactcaag

SEQ ID NO: 12904 - DNA, 18 bp, synthetic construct
  source 1..18: mol_type = other DNA
ttatatgactcacttttg

SEQ ID NO: 12905 - DNA, 18 bp, synthetic construct
  source 1..18: mol_type = other DNA
ttatacaactcactccag

SEQ ID NO: 12906 - DNA, 18 bp, synthetic construct
  source 1..18: mol_type = other DNA
ttttaagactcactctag

SEQ ID NO: 12907 - DNA, 18 bp, synthetic construct
  source 1..18: mol_type = other DNA
ttattcgactcagtattg

SEQ ID NO: 12908 - DNA, 18 bp, synthetic construct
  source 1..18: mol_type = other DNA
tttttcgactcactacag

SEQ ID NO: 12909 - DNA, 18 bp, synthetic construct
  source 1..18: mol_type = other DNA
tttttcgactcgctatag

SEQ ID NO: 12910 - DNA, 18 bp, synthetic construct
  source 1..18: mol_type = other DNA
taatccgactcgctactg

SEQ ID NO: 12911 - DNA, 18 bp, synthetic construct
  source 1..18: mol_type = other DNA
taatttaactcactacag

SEQ ID NO: 12912 - DNA, 18 bp, synthetic construct
  source 1..18: mol_type = other DNA
taccacgactcactaatg

SEQ ID NO: 12913 - DNA, 18 bp, synthetic construct
  source 1..18: mol_type = other DNA
tattacgcctcaccattg

SEQ ID NO: 12914 - DNA, 18 bp, synthetic construct
  source 1..18: mol_type = other DNA
aaaaagaactcactatag

SEQ ID NO: 12915 - DNA, 18 bp, synthetic construct
  source 1..18: mol_type = other DNA
taaaacgagtcactccag

SEQ ID NO: 12916 - DNA, 18 bp, synthetic construct
  source 1..18: mol_type = other DNA
taaagcgcctcactacag

SEQ ID NO: 12917 - DNA, 18 bp, synthetic construct
  source 1..18: mol_type = other DNA
taagaaaactcactgtag

SEQ ID NO: 12918 - DNA, 18 bp, synthetic construct
  source 1..18: mol_type = other DNA
taatcaaacgcactatag

SEQ ID NO: 12919 - DNA, 18 bp, synthetic construct
  source 1..18: mol_type = other DNA
taattcgactcgctactg

SEQ ID NO: 12920 - DNA, 18 bp, synthetic construct
  source 1..18: mol_type = other DNA
taattcgactcgctagtg

SEQ ID NO: 12921 - DNA, 18 bp, synthetic construct
  source 1..18: mol_type = other DNA
taattcgactcgctcttg

SEQ ID NO: 12922 - DNA, 18 bp, synthetic construct
  source 1..18: mol_type = other DNA
taattcgactcggtattg

SEQ ID NO: 12923 - DNA, 18 bp, synthetic construct
  source 1..18: mol_type = other DNA
aaatacgactagctattg

SEQ ID NO: 12924 - DNA, 18 bp, synthetic construct
  source 1..18: mol_type = other DNA
taaatagactcgctatag

SEQ ID NO: 12925 - DNA, 18 bp, synthetic construct
  source 1..18: mol_type = other DNA
taacacgactcgatattg

SEQ ID NO: 12926 - DNA, 18 bp, synthetic construct
  source 1..18: mol_type = other DNA
taactcgtctcgctatag

SEQ ID NO: 12927 - DNA, 18 bp, synthetic construct
  source 1..18: mol_type = other DNA
taataaaactcgctattg

SEQ ID NO: 12928 - DNA, 18 bp, synthetic construct
  source 1..18: mol_type = other DNA
taatacgagtcgccattg

SEQ ID NO: 12929 - DNA, 18 bp, synthetic construct
  source 1..18: mol_type = other DNA
taatacgtctcgctattt

SEQ ID NO: 12930 - DNA, 18 bp, synthetic construct
  source 1..18: mol_type = other DNA
taatactcctcgctattg

SEQ ID NO: 12931 - DNA, 18 bp, synthetic construct
  source 1..18: mol_type = other DNA
taataggactcgctactg

SEQ ID NO: 12932 - DNA, 18 bp, synthetic construct
  source 1..18: mol_type = other DNA
taattagactcgctaaag

SEQ ID NO: 12933 - DNA, 18 bp, synthetic construct
  source 1..18: mol_type = other DNA
taattcgaatcacgattg

SEQ ID NO: 12934 - DNA, 18 bp, synthetic construct
  source 1..18: mol_type = other DNA
taattcgacccgccatag

SEQ ID NO: 12935 - DNA, 18 bp, synthetic construct
  source 1..18: mol_type = other DNA
taattcgactcaaaattg

SEQ ID NO: 12936 - DNA, 18 bp, synthetic construct
  source 1..18: mol_type = other DNA
taattcgactcacgtttg

SEQ ID NO: 12937 - DNA, 18 bp, synthetic construct
  source 1..18: mol_type = other DNA
taattcgactcacttgtg

SEQ ID NO: 12938 - DNA, 18 bp, synthetic construct
  source 1..18: mol_type = other DNA
taattcgactcgcgacag

SEQ ID NO: 12939 - DNA, 18 bp, synthetic construct
  source 1..18: mol_type = other DNA
taattcgactcgctacgg

SEQ ID NO: 12940 - DNA, 18 bp, synthetic construct
  source 1..18: mol_type = other DNA
taattggactcactagtg

SEQ ID NO: 12941 - DNA, 18 bp, synthetic construct
  source 1..18: mol_type = other DNA
tacttcgactcacgattg

SEQ ID NO: 12942 - DNA, 18 bp, synthetic construct
  source 1..18: mol_type = other DNA
tacttcgactccctattg

SEQ ID NO: 12943 - DNA, 18 bp, synthetic construct
  source 1..18: mol_type = other DNA
tattacgactcgctaatg

SEQ ID NO: 12944 - DNA, 18 bp, synthetic construct
  source 1..18: mol_type = other DNA
tatttcgactcgcgatag

SEQ ID NO: 12945 - DNA, 18 bp, synthetic construct
  source 1..18: mol_type = other DNA
tatttcgactcgctacag

SEQ ID NO: 12946 - DNA, 18 bp, synthetic construct
  source 1..18: mol_type = other DNA
tatttcgactcgctatac

SEQ ID NO: 12947 - DNA, 18 bp, synthetic construct
  source 1..18: mol_type = other DNA
tatttcgactcgctatat

SEQ ID NO: 12948 - DNA, 18 bp, synthetic construct
  source 1..18: mol_type = other DNA
tcattcgactcgctgtag

SEQ ID NO: 12949 - DNA, 18 bp, synthetic construct
  source 1..18: mol_type = other DNA
tcattcgtctcgctatag

SEQ ID NO: 12950 - DNA, 18 bp, synthetic construct
  source 1..18: mol_type = other DNA
ttatacggctcgctattg

SEQ ID NO: 12951 - DNA, 18 bp, synthetic construct
  source 1..18: mol_type = other DNA
ttattcgactcactattt

SEQ ID NO: 12952 - DNA, 18 bp, synthetic construct
  source 1..18: mol_type = other DNA
ttattcgactcgctatat

SEQ ID NO: 12953 - DNA, 18 bp, synthetic construct
  source 1..18: mol_type = other DNA
ttattcgactcgctatcg

SEQ ID NO: 12954 - DNA, 18 bp, synthetic construct
  source 1..18: mol_type = other DNA
aaaaacgactcactcttg

SEQ ID NO: 12955 - DNA, 18 bp, synthetic construct
  source 1..18: mol_type = other DNA
aaaaacgactcactgttg

SEQ ID NO: 12956 - DNA, 18 bp, synthetic construct
  source 1..18: mol_type = other DNA
aaaatcgactcactgtag

SEQ ID NO: 12957 - DNA, 18 bp, synthetic construct
  source 1..18: mol_type = other DNA
aaatacaactcgcaatag

SEQ ID NO: 12958 - DNA, 18 bp, synthetic construct
  source 1..18: mol_type = other DNA
aaataccacttactattg

SEQ ID NO: 12959 - DNA, 18 bp, synthetic construct
  source 1..18: mol_type = other DNA
aaatacgtctcggtatag

SEQ ID NO: 12960 - DNA, 18 bp, synthetic construct
  source 1..18: mol_type = other DNA
aaatactactcacgattg

SEQ ID NO: 12961 - DNA, 18 bp, synthetic construct
  source 1..18: mol_type = other DNA
aaattcaactcactacag

SEQ ID NO: 12962 - DNA, 18 bp, synthetic construct
  source 1..18: mol_type = other DNA
aaattcgaagcactatag

SEQ ID NO: 12963 - DNA, 18 bp, synthetic construct
  source 1..18: mol_type = other DNA
aaattcgactccctctag

SEQ ID NO: 12964 - DNA, 18 bp, synthetic construct
  source 1..18: mol_type = other DNA
aaatttgactgactatag

SEQ ID NO: 12965 - DNA, 18 bp, synthetic construct
  source 1..18: mol_type = other DNA
caaatcgacgcactatag

SEQ ID NO: 12966 - DNA, 18 bp, synthetic construct
  source 1..18: mol_type = other DNA
caataccactcacaattg

SEQ ID NO: 12967 - DNA, 18 bp, synthetic construct
  source 1..18: mol_type = other DNA
caatacgactcagtaatg

SEQ ID NO: 12968 - DNA, 18 bp, synthetic construct
  source 1..18: mol_type = other DNA
caatacgcctcacaattg

SEQ ID NO: 12969 - DNA, 18 bp, synthetic construct
  source 1..18: mol_type = other DNA
caatccgactcacttttg

SEQ ID NO: 12970 - DNA, 18 bp, synthetic construct
  source 1..18: mol_type = other DNA
caatgcgactcgctttag

SEQ ID NO: 12971 - DNA, 18 bp, synthetic construct
  source 1..18: mol_type = other DNA
caattcgacgaactatag

SEQ ID NO: 12972 - DNA, 18 bp, synthetic construct
  source 1..18: mol_type = other DNA
caattcgactcaagatag

SEQ ID NO: 12973 - DNA, 18 bp, synthetic construct
  source 1..18: mol_type = other DNA
caattcgactcaatacag

SEQ ID NO: 12974 - DNA, 18 bp, synthetic construct
  source 1..18: mol_type = other DNA
caattcgactcacaatcg

SEQ ID NO: 12975 - DNA, 18 bp, synthetic construct
  source 1..18: mol_type = other DNA
caattcgagccactatag

SEQ ID NO: 12976 - DNA, 18 bp, synthetic construct
  source 1..18: mol_type = other DNA
cattacgactcgatatag

SEQ ID NO: 12977 - DNA, 18 bp, synthetic construct
  source 1..18: mol_type = other DNA
ctatacgactcgatatag

SEQ ID NO: 12978 - DNA, 18 bp, synthetic construct
  source 1..18: mol_type = other DNA
ctatacgactcgctagag

SEQ ID NO: 12979 - DNA, 18 bp, synthetic construct
  source 1..18: mol_type = other DNA
gaatacggctcacttttg

SEQ ID NO: 12980 - DNA, 18 bp, synthetic construct
  source 1..18: mol_type = other DNA
gaatacgtctcattattg

SEQ ID NO: 12981 - DNA, 18 bp, synthetic construct
  source 1..18: mol_type = other DNA
gaatactactcactattc

SEQ ID NO: 12982 - DNA, 18 bp, synthetic construct
  source 1..18: mol_type = other DNA
gaatactgctcactattg

SEQ ID NO: 12983 - DNA, 18 bp, synthetic construct
  source 1..18: mol_type = other DNA
gaatcggactcactattg

SEQ ID NO: 12984 - DNA, 18 bp, synthetic construct
  source 1..18: mol_type = other DNA
gaattcgactcactttgg

SEQ ID NO: 12985 - DNA, 18 bp, synthetic construct
  source 1..18: mol_type = other DNA
gactacgactcgctacag

SEQ ID NO: 12986 - DNA, 18 bp, synthetic construct
  source 1..18: mol_type = other DNA
gactactactcactattg

SEQ ID NO: 12987 - DNA, 18 bp, synthetic construct
  source 1..18: mol_type = other DNA
gtaaacgactcgctatag

SEQ ID NO: 12988 - DNA, 18 bp, synthetic construct
  source 1..18: mol_type = other DNA
gtatacgactcattattg

SEQ ID NO: 12989 - DNA, 18 bp, synthetic construct
  source 1..18: mol_type = other DNA
gtatgcgactcgctatag

SEQ ID NO: 12990 - DNA, 18 bp, synthetic construct
  source 1..18: mol_type = other DNA
taaaaagactagctatag

SEQ ID NO: 12991 - DNA, 18 bp, synthetic construct
  source 1..18: mol_type = other DNA
taaaaagactcgccatag

SEQ ID NO: 12992 - DNA, 18 bp, synthetic construct
  source 1..18: mol_type = other DNA
taaagcgactcactaatg

SEQ ID NO: 12993 - DNA, 18 bp, synthetic construct
  source 1..18: mol_type = other DNA
taaagcgactcactactg

SEQ ID NO: 12994 - DNA, 18 bp, synthetic construct
  source 1..18: mol_type = other DNA
taaagcgactcactgttg

SEQ ID NO: 12995 - DNA, 18 bp, synthetic construct
  source 1..18: mol_type = other DNA
taaatcaacccactatag

SEQ ID NO: 12996 - DNA, 18 bp, synthetic construct
  source 1..18: mol_type = other DNA
taaatcgactcactatgt

SEQ ID NO: 12997 - DNA, 18 bp, synthetic construct
  source 1..18: mol_type = other DNA
taaatcgactcactctcg

SEQ ID NO: 12998 - DNA, 18 bp, synthetic construct
  source 1..18: mol_type = other DNA
taaatggactcactatgg

SEQ ID NO: 12999 - DNA, 18 bp, synthetic construct
  source 1..18: mol_type = other DNA
taaattgactcagtatag

SEQ ID NO: 13000 - DNA, 18 bp, synthetic construct
  source 1..18: mol_type = other DNA
taacacgactagttatag

SEQ ID NO: 13001 - DNA, 18 bp, synthetic construct
  source 1..18: mol_type = other DNA
taacaggacgcactattg

SEQ ID NO: 13002 - DNA, 18 bp, synthetic construct
  source 1..18: mol_type = other DNA
taactcgactaactacag

SEQ ID NO: 13003 - DNA, 18 bp, synthetic construct
  source 1..18: mol_type = other DNA
taagaagactctctattg

SEQ ID NO: 13004 - DNA, 18 bp, synthetic construct
  source 1..18: mol_type = other DNA
taagccgacttactattg

SEQ ID NO: 13005 - DNA, 18 bp, synthetic construct
  source 1..18: mol_type = other DNA
taataagacccacgattg

SEQ ID NO: 13006 - DNA, 18 bp, synthetic construct
  source 1..18: mol_type = other DNA
taataagactcaccactg

SEQ ID NO: 13007 - DNA, 18 bp, synthetic construct
  source 1..18: mol_type = other DNA
taataagactcgacatag

SEQ ID NO: 13008 - DNA, 18 bp, synthetic construct
  source 1..18: mol_type = other DNA
taataagagtcactatta

SEQ ID NO: 13009 - DNA, 18 bp, synthetic construct
  source 1..18: mol_type = other DNA
taatacaactcgcaacag

SEQ ID NO: 13010 - DNA, 18 bp, synthetic construct
  source 1..18: mol_type = other DNA
taatacaactcggtaaag

SEQ ID NO: 13011 - DNA, 18 bp, synthetic construct
  source 1..18: mol_type = other DNA
taatacatctcgctatcg

SEQ ID NO: 13012 - DNA, 18 bp, synthetic construct
  source 1..18: mol_type = other DNA
taataccacacgctttag

SEQ ID NO: 13013 - DNA, 18 bp, synthetic construct
  source 1..18: mol_type = other DNA
taataccactaactgttg

SEQ ID NO: 13014 - DNA, 18 bp, synthetic construct
  source 1..18: mol_type = other DNA
taataccactcaacattg

SEQ ID NO: 13015 - DNA, 18 bp, synthetic construct
  source 1..18: mol_type = other DNA
taataccactcgctttaa

SEQ ID NO: 13016 - DNA, 18 bp, synthetic construct
  source 1..18: mol_type = other DNA
taataccactctctgttg

SEQ ID NO: 13017 - DNA, 18 bp, synthetic construct
  source 1..18: mol_type = other DNA
taataccacttgctacag

SEQ ID NO: 13018 - DNA, 18 bp, synthetic construct
  source 1..18: mol_type = other DNA
taataccgctcaatattg

SEQ ID NO: 13019 - DNA, 18 bp, synthetic construct
  source 1..18: mol_type = other DNA
taataccgctcgatatag

SEQ ID NO: 13020 - DNA, 18 bp, synthetic construct
  source 1..18: mol_type = other DNA
taatacgaaacagtattg

SEQ ID NO: 13021 - DNA, 18 bp, synthetic construct
  source 1..18: mol_type = other DNA
taatacgaatagctacag

SEQ ID NO: 13022 - DNA, 18 bp, synthetic construct
  source 1..18: mol_type = other DNA
taatacgacccaatcttg

SEQ ID NO: 13023 - DNA, 18 bp, synthetic construct
  source 1..18: mol_type = other DNA
taatacgacgcaatattc

SEQ ID NO: 13024 - DNA, 18 bp, synthetic construct
  source 1..18: mol_type = other DNA
taatacgactagctagcg

SEQ ID NO: 13025 - DNA, 18 bp, synthetic construct
  source 1..18: mol_type = other DNA
taatacgactcaatgtta

SEQ ID NO: 13026 - DNA, 18 bp, synthetic construct
  source 1..18: mol_type = other DNA
taatacgactcacaaatc

SEQ ID NO: 13027 - DNA, 18 bp, synthetic construct
  source 1..18: mol_type = other DNA
taatacgactcctcattg

SEQ ID NO: 13028 - DNA, 18 bp, synthetic construct
  source 1..18: mol_type = other DNA
taatacgactcgataacg

SEQ ID NO: 13029 - DNA, 18 bp, synthetic construct
  source 1..18: mol_type = other DNA
taatacgactcgttttat

SEQ ID NO: 13030 - DNA, 18 bp, synthetic construct
  source 1..18: mol_type = other DNA
taatacgactctttattt

SEQ ID NO: 13031 - DNA, 18 bp, synthetic construct
  source 1..18: mol_type = other DNA
taatacgagtcagtcttg

SEQ ID NO: 13032 - DNA, 18 bp, synthetic construct
  source 1..18: mol_type = other DNA
taatacgatacactagtg

SEQ ID NO: 13033 - DNA, 18 bp, synthetic construct
  source 1..18: mol_type = other DNA
taatacgattcgccctag

SEQ ID NO: 13034 - DNA, 18 bp, synthetic construct
  source 1..18: mol_type = other DNA
taatacgattcgctaaaa

SEQ ID NO: 13035 - DNA, 18 bp, synthetic construct
  source 1..18: mol_type = other DNA
taatacgattcgtaatag

SEQ ID NO: 13036 - DNA, 18 bp, synthetic construct
  source 1..18: mol_type = other DNA
taatacgatttactagtg

SEQ ID NO: 13037 - DNA, 18 bp, synthetic construct
  source 1..18: mol_type = other DNA
taatacgcctcgttatcg

SEQ ID NO: 13038 - DNA, 18 bp, synthetic construct
  source 1..18: mol_type = other DNA
taatacgcctctctcttg

SEQ ID NO: 13039 - DNA, 18 bp, synthetic construct
  source 1..18: mol_type = other DNA
taatacgtctcaatatta

SEQ ID NO: 13040 - DNA, 18 bp, synthetic construct
  source 1..18: mol_type = other DNA
taatacgtctcactgtta

SEQ ID NO: 13041 - DNA, 18 bp, synthetic construct
  source 1..18: mol_type = other DNA
taatactactaacgattg

SEQ ID NO: 13042 - DNA, 18 bp, synthetic construct
  source 1..18: mol_type = other DNA
taatactactcactaatt

SEQ ID NO: 13043 - DNA, 18 bp, synthetic construct
  source 1..18: mol_type = other DNA
taatactactcccgattg

SEQ ID NO: 13044 - DNA, 18 bp, synthetic construct
  source 1..18: mol_type = other DNA
taataggactcaatatta

SEQ ID NO: 13045 - DNA, 18 bp, synthetic construct
  source 1..18: mol_type = other DNA
taataggactcactactt

SEQ ID NO: 13046 - DNA, 18 bp, synthetic construct
  source 1..18: mol_type = other DNA
taataggactcactggtg

SEQ ID NO: 13047 - DNA, 18 bp, synthetic construct
  source 1..18: mol_type = other DNA
taataggagtcgcaatag

SEQ ID NO: 13048 - DNA, 18 bp, synthetic construct
  source 1..18: mol_type = other DNA
taataggcttcactattg

SEQ ID NO: 13049 - DNA, 18 bp, synthetic construct
  source 1..18: mol_type = other DNA
taatagggctcactcttg

SEQ ID NO: 13050 - DNA, 18 bp, synthetic construct
  source 1..18: mol_type = other DNA
taataggtctcgccatag

SEQ ID NO: 13051 - DNA, 18 bp, synthetic construct
  source 1..18: mol_type = other DNA
taatataacacgctatag

SEQ ID NO: 13052 - DNA, 18 bp, synthetic construct
  source 1..18: mol_type = other DNA
taatatgactaagtattg

SEQ ID NO: 13053 - DNA, 18 bp, synthetic construct
  source 1..18: mol_type = other DNA
taatatgactcactctta

SEQ ID NO: 13054 - DNA, 18 bp, synthetic construct
  source 1..18: mol_type = other DNA
taatatgactcgcttcag

SEQ ID NO: 13055 - DNA, 18 bp, synthetic construct
  source 1..18: mol_type = other DNA
taatatgactgacttttg

SEQ ID NO: 13056 - DNA, 18 bp, synthetic construct
  source 1..18: mol_type = other DNA
taatatgagtgactattg

SEQ ID NO: 13057 - DNA, 18 bp, synthetic construct
  source 1..18: mol_type = other DNA
taatatgagttgctatag

SEQ ID NO: 13058 - DNA, 18 bp, synthetic construct
  source 1..18: mol_type = other DNA
taatatgtctcactatta

SEQ ID NO: 13059 - DNA, 18 bp, synthetic construct
  source 1..18: mol_type = other DNA
taatccgacacactactg

SEQ ID NO: 13060 - DNA, 18 bp, synthetic construct
  source 1..18: mol_type = other DNA
taatccgactcacaatta

SEQ ID NO: 13061 - DNA, 18 bp, synthetic construct
  source 1..18: mol_type = other DNA
taatccgactcgctacaa

SEQ ID NO: 13062 - DNA, 18 bp, synthetic construct
  source 1..18: mol_type = other DNA
taatccgcctcactactg

SEQ ID NO: 13063 - DNA, 18 bp, synthetic construct
  source 1..18: mol_type = other DNA
taatccggctcaatattg

SEQ ID NO: 13064 - DNA, 18 bp, synthetic construct
  source 1..18: mol_type = other DNA
taatccggcttactattg

SEQ ID NO: 13065 - DNA, 18 bp, synthetic construct
  source 1..18: mol_type = other DNA
taatgccactcgctacag

SEQ ID NO: 13066 - DNA, 18 bp, synthetic construct
  source 1..18: mol_type = other DNA
taatgcgaatcgctctag

SEQ ID NO: 13067 - DNA, 18 bp, synthetic construct
  source 1..18: mol_type = other DNA
taatgcgacacacttttg

SEQ ID NO: 13068 - DNA, 18 bp, synthetic construct
  source 1..18: mol_type = other DNA
taatgcgactaactcttg

SEQ ID NO: 13069 - DNA, 18 bp, synthetic construct
  source 1..18: mol_type = other DNA
taatgcgactcaacattg

SEQ ID NO: 13070 - DNA, 18 bp, synthetic construct
  source 1..18: mol_type = other DNA
taatgcgactcaatgttg

SEQ ID NO: 13071 - DNA, 18 bp, synthetic construct
  source 1..18: mol_type = other DNA
taatgcgactcaccagtg

SEQ ID NO: 13072 - DNA, 18 bp, synthetic construct
  source 1..18: mol_type = other DNA
taatgcgactcattatta

SEQ ID NO: 13073 - DNA, 18 bp, synthetic construct
  source 1..18: mol_type = other DNA
taatgcgactcgcactag

SEQ ID NO: 13074 - DNA, 18 bp, synthetic construct
  source 1..18: mol_type = other DNA
taatgcgacttgctaaag

SEQ ID NO: 13075 - DNA, 18 bp, synthetic construct
  source 1..18: mol_type = other DNA
taattagactcacaagag

SEQ ID NO: 13076 - DNA, 18 bp, synthetic construct
  source 1..18: mol_type = other DNA
taattagactcaccacag

SEQ ID NO: 13077 - DNA, 18 bp, synthetic construct
  source 1..18: mol_type = other DNA
taattagactcacggtag

SEQ ID NO: 13078 - DNA, 18 bp, synthetic construct
  source 1..18: mol_type = other DNA
taattagattcactataa

SEQ ID NO: 13079 - DNA, 18 bp, synthetic construct
  source 1..18: mol_type = other DNA
taattcaacgccctatag

SEQ ID NO: 13080 - DNA, 18 bp, synthetic construct
  source 1..18: mol_type = other DNA
taattcaactcactttat

SEQ ID NO: 13081 - DNA, 18 bp, synthetic construct
  source 1..18: mol_type = other DNA
taattcaacttactataa

SEQ ID NO: 13082 - DNA, 18 bp, synthetic construct
  source 1..18: mol_type = other DNA
taattccaatcattatag

SEQ ID NO: 13083 - DNA, 18 bp, synthetic construct
  source 1..18: mol_type = other DNA
taattccactcaccagag

SEQ ID NO: 13084 - DNA, 18 bp, synthetic construct
  source 1..18: mol_type = other DNA
taattccactcaccatcg

SEQ ID NO: 13085 - DNA, 18 bp, synthetic construct
  source 1..18: mol_type = other DNA
taattcgaaacaccatag

SEQ ID NO: 13086 - DNA, 18 bp, synthetic construct
  source 1..18: mol_type = other DNA
taattcgacacactaccg

SEQ ID NO: 13087 - DNA, 18 bp, synthetic construct
  source 1..18: mol_type = other DNA
taattcgacccactctgg

SEQ ID NO: 13088 - DNA, 18 bp, synthetic construct
  source 1..18: mol_type = other DNA
taattcgactaactcgag

SEQ ID NO: 13089 - DNA, 18 bp, synthetic construct
  source 1..18: mol_type = other DNA
taattcgactaagtgtag

SEQ ID NO: 13090 - DNA, 18 bp, synthetic construct
  source 1..18: mol_type = other DNA
taattcgactcaccaccg

SEQ ID NO: 13091 - DNA, 18 bp, synthetic construct
  source 1..18: mol_type = other DNA
taattcgactcagtttcg

SEQ ID NO: 13092 - DNA, 18 bp, synthetic construct
  source 1..18: mol_type = other DNA
taattcgactccatctag

SEQ ID NO: 13093 - DNA, 18 bp, synthetic construct
  source 1..18: mol_type = other DNA
taattcgactccgtctag

SEQ ID NO: 13094 - DNA, 18 bp, synthetic construct
  source 1..18: mol_type = other DNA
taattcgactctctaaac

SEQ ID NO: 13095 - DNA, 18 bp, synthetic construct
  source 1..18: mol_type = other DNA
taattcgactctctaccg

SEQ ID NO: 13096 - DNA, 18 bp, synthetic construct
  source 1..18: mol_type = other DNA
taattcgagtcacgttag

SEQ ID NO: 13097 - DNA, 18 bp, synthetic construct
  source 1..18: mol_type = other DNA
taattcgattcactgtgg

SEQ ID NO: 13098 - DNA, 18 bp, synthetic construct
  source 1..18: mol_type = other DNA
taattcgcaacactatag

SEQ ID NO: 13099 - DNA, 18 bp, synthetic construct
  source 1..18: mol_type = other DNA
taattcggctcactacat

SEQ ID NO: 13100 - DNA, 18 bp, synthetic construct
  source 1..18: mol_type = other DNA
taattcgtcgcactttag

SEQ ID NO: 13101 - DNA, 18 bp, synthetic construct
  source 1..18: mol_type = other DNA
taattctgctcactatcg

SEQ ID NO: 13102 - DNA, 18 bp, synthetic construct
  source 1..18: mol_type = other DNA
taattggactaaccatag

SEQ ID NO: 13103 - DNA, 18 bp, synthetic construct
  source 1..18: mol_type = other DNA
taattggactcacactag

SEQ ID NO: 13104 - DNA, 18 bp, synthetic construct
  source 1..18: mol_type = other DNA
taattggactcacgctag

SEQ ID NO: 13105 - DNA, 18 bp, synthetic construct
  source 1..18: mol_type = other DNA
taattggacttactatgg

SEQ ID NO: 13106 - DNA, 18 bp, synthetic construct
  source 1..18: mol_type = other DNA
taatttgaatcactctag

SEQ ID NO: 13107 - DNA, 18 bp, synthetic construct
  source 1..18: mol_type = other DNA
taatttgacgctctatag

SEQ ID NO: 13108 - DNA, 18 bp, synthetic construct
  source 1..18: mol_type = other DNA
taatttgactcaagatag

SEQ ID NO: 13109 - DNA, 18 bp, synthetic construct
  source 1..18: mol_type = other DNA
taatttgactcacaacag

SEQ ID NO: 13110 - DNA, 18 bp, synthetic construct
  source 1..18: mol_type = other DNA
taatttgactcactttgg

SEQ ID NO: 13111 - DNA, 18 bp, synthetic construct
  source 1..18: mol_type = other DNA
taatttgactctcgatag

SEQ ID NO: 13112 - DNA, 18 bp, synthetic construct
  source 1..18: mol_type = other DNA
taatttgattcaccatag

SEQ ID NO: 13113 - DNA, 18 bp, synthetic construct
  source 1..18: mol_type = other DNA
tacaccgactcgctatag

SEQ ID NO: 13114 - DNA, 18 bp, synthetic construct
  source 1..18: mol_type = other DNA
tacatcgactcactagag

SEQ ID NO: 13115 - DNA, 18 bp, synthetic construct
  source 1..18: mol_type = other DNA
tactaagactcactatta

SEQ ID NO: 13116 - DNA, 18 bp, synthetic construct
  source 1..18: mol_type = other DNA
tactacgactcaatgttg

SEQ ID NO: 13117 - DNA, 18 bp, synthetic construct
  source 1..18: mol_type = other DNA
tactacgactgacgattg

SEQ ID NO: 13118 - DNA, 18 bp, synthetic construct
  source 1..18: mol_type = other DNA
tactatgactcgctaaag

SEQ ID NO: 13119 - DNA, 18 bp, synthetic construct
  source 1..18: mol_type = other DNA
tacttagagtcactatag

SEQ ID NO: 13120 - DNA, 18 bp, synthetic construct
  source 1..18: mol_type = other DNA
tacttcgacgctctatag

SEQ ID NO: 13121 - DNA, 18 bp, synthetic construct
  source 1..18: mol_type = other DNA
tacttcgactaagtatag

SEQ ID NO: 13122 - DNA, 18 bp, synthetic construct
  source 1..18: mol_type = other DNA
tactttgactcactctag

SEQ ID NO: 13123 - DNA, 18 bp, synthetic construct
  source 1..18: mol_type = other DNA
tagtacaactcactatta

SEQ ID NO: 13124 - DNA, 18 bp, synthetic construct
  source 1..18: mol_type = other DNA
tagtacgactcaccaatg

SEQ ID NO: 13125 - DNA, 18 bp, synthetic construct
  source 1..18: mol_type = other DNA
tagtacgactcaggattg

SEQ ID NO: 13126 - DNA, 18 bp, synthetic construct
  source 1..18: mol_type = other DNA
tagtatgactcactactg

SEQ ID NO: 13127 - DNA, 18 bp, synthetic construct
  source 1..18: mol_type = other DNA
tagtattactcgctatag

SEQ ID NO: 13128 - DNA, 18 bp, synthetic construct
  source 1..18: mol_type = other DNA
tagttcgacacactagag

SEQ ID NO: 13129 - DNA, 18 bp, synthetic construct
  source 1..18: mol_type = other DNA
tagttcgactcaccagag

SEQ ID NO: 13130 - DNA, 18 bp, synthetic construct
  source 1..18: mol_type = other DNA
tagttcgaggcactatag

SEQ ID NO: 13131 - DNA, 18 bp, synthetic construct
  source 1..18: mol_type = other DNA
tagttggactcactctag

SEQ ID NO: 13132 - DNA, 18 bp, synthetic construct
  source 1..18: mol_type = other DNA
tatatcgactcactatat

SEQ ID NO: 13133 - DNA, 18 bp, synthetic construct
  source 1..18: mol_type = other DNA
tattacgaatcgcgatag

SEQ ID NO: 13134 - DNA, 18 bp, synthetic construct
  source 1..18: mol_type = other DNA
tattacgacacggtatag

SEQ ID NO: 13135 - DNA, 18 bp, synthetic construct
  source 1..18: mol_type = other DNA
tattacgactcaccactg

SEQ ID NO: 13136 - DNA, 18 bp, synthetic construct
  source 1..18: mol_type = other DNA
tattacgactcgctaacg

SEQ ID NO: 13137 - DNA, 18 bp, synthetic construct
  source 1..18: mol_type = other DNA
tattaggactaactattg

SEQ ID NO: 13138 - DNA, 18 bp, synthetic construct
  source 1..18: mol_type = other DNA
tattaggactgactattg

SEQ ID NO: 13139 - DNA, 18 bp, synthetic construct
  source 1..18: mol_type = other DNA
tattccgactcacgattg

SEQ ID NO: 13140 - DNA, 18 bp, synthetic construct
  source 1..18: mol_type = other DNA
tatttagactcactaaag

SEQ ID NO: 13141 - DNA, 18 bp, synthetic construct
  source 1..18: mol_type = other DNA
tatttcaacccactatag

SEQ ID NO: 13142 - DNA, 18 bp, synthetic construct
  source 1..18: mol_type = other DNA
tatttcgagtcactctag

SEQ ID NO: 13143 - DNA, 18 bp, synthetic construct
  source 1..18: mol_type = other DNA
tcaggcgactcactattg

SEQ ID NO: 13144 - DNA, 18 bp, synthetic construct
  source 1..18: mol_type = other DNA
tcatacgactcaggattg

SEQ ID NO: 13145 - DNA, 18 bp, synthetic construct
  source 1..18: mol_type = other DNA
tcatacgactcgacatag

SEQ ID NO: 13146 - DNA, 18 bp, synthetic construct
  source 1..18: mol_type = other DNA
tcatacgagacactattg

SEQ ID NO: 13147 - DNA, 18 bp, synthetic construct
  source 1..18: mol_type = other DNA
tcatacgagtcgcaatag

SEQ ID NO: 13148 - DNA, 18 bp, synthetic construct
  source 1..18: mol_type = other DNA
tcattcgactcagtaaag

SEQ ID NO: 13149 - DNA, 18 bp, synthetic construct
  source 1..18: mol_type = other DNA
tcgtacgactcaatattg

SEQ ID NO: 13150 - DNA, 18 bp, synthetic construct
  source 1..18: mol_type = other DNA
tgacacgactcagtattg

SEQ ID NO: 13151 - DNA, 18 bp, synthetic construct
  source 1..18: mol_type = other DNA
tgatacaattcgctatag

SEQ ID NO: 13152 - DNA, 18 bp, synthetic construct
  source 1..18: mol_type = other DNA
tgatacgactcaatactg

SEQ ID NO: 13153 - DNA, 18 bp, synthetic construct
  source 1..18: mol_type = other DNA
tgataggactcactagtg

SEQ ID NO: 13154 - DNA, 18 bp, synthetic construct
  source 1..18: mol_type = other DNA
tgatatgactcactactg

SEQ ID NO: 13155 - DNA, 18 bp, synthetic construct
  source 1..18: mol_type = other DNA
tgatgcaactcactattg

SEQ ID NO: 13156 - DNA, 18 bp, synthetic construct
  source 1..18: mol_type = other DNA
tgatgccactcactattg

SEQ ID NO: 13157 - DNA, 18 bp, synthetic construct
  source 1..18: mol_type = other DNA
tgatgcgactcactatta

SEQ ID NO: 13158 - DNA, 18 bp, synthetic construct
  source 1..18: mol_type = other DNA
tgattcgacttcctatag

SEQ ID NO: 13159 - DNA, 18 bp, synthetic construct
  source 1..18: mol_type = other DNA
tgattcgcgtcactatag

SEQ ID NO: 13160 - DNA, 18 bp, synthetic construct
  source 1..18: mol_type = other DNA
tgattcggctcaccatag

SEQ ID NO: 13161 - DNA, 18 bp, synthetic construct
  source 1..18: mol_type = other DNA
tgattggactcactatgg

SEQ ID NO: 13162 - DNA, 18 bp, synthetic construct
  source 1..18: mol_type = other DNA
tgctacgactcactgttg

SEQ ID NO: 13163 - DNA, 18 bp, synthetic construct
  source 1..18: mol_type = other DNA
tgttacgactggctatag

SEQ ID NO: 13164 - DNA, 18 bp, synthetic construct
  source 1..18: mol_type = other DNA
tgttacgacttgctatag

SEQ ID NO: 13165 - DNA, 18 bp, synthetic construct
  source 1..18: mol_type = other DNA
tgtttcgactcacgatag

SEQ ID NO: 13166 - DNA, 18 bp, synthetic construct
  source 1..18: mol_type = other DNA
ttacgcgactcactattg

SEQ ID NO: 13167 - DNA, 18 bp, synthetic construct
  source 1..18: mol_type = other DNA
ttataagactcgctaaag

SEQ ID NO: 13168 - DNA, 18 bp, synthetic construct
  source 1..18: mol_type = other DNA
ttataagactcgctacag

SEQ ID NO: 13169 - DNA, 18 bp, synthetic construct
  source 1..18: mol_type = other DNA
ttataccactcgctatcg

SEQ ID NO: 13170 - DNA, 18 bp, synthetic construct
  source 1..18: mol_type = other DNA
ttatacccctcactattg

SEQ ID NO: 13171 - DNA, 18 bp, synthetic construct
  source 1..18: mol_type = other DNA
ttatacgacacactatta

SEQ ID NO: 13172 - DNA, 18 bp, synthetic construct
  source 1..18: mol_type = other DNA
ttatacgactcacttttc

SEQ ID NO: 13173 - DNA, 18 bp, synthetic construct
  source 1..18: mol_type = other DNA
ttatacgactcgttacag

SEQ ID NO: 13174 - DNA, 18 bp, synthetic construct
  source 1..18: mol_type = other DNA
ttatacgagtcagtattg

SEQ ID NO: 13175 - DNA, 18 bp, synthetic construct
  source 1..18: mol_type = other DNA
ttatacgattcgccatag

SEQ ID NO: 13176 - DNA, 18 bp, synthetic construct
  source 1..18: mol_type = other DNA
ttatacggctcactagtg

SEQ ID NO: 13177 - DNA, 18 bp, synthetic construct
  source 1..18: mol_type = other DNA
ttatactactcgctatcg

SEQ ID NO: 13178 - DNA, 18 bp, synthetic construct
  source 1..18: mol_type = other DNA
ttataggactcgatatag

SEQ ID NO: 13179 - DNA, 18 bp, synthetic construct
  source 1..18: mol_type = other DNA
ttatatgactcactagtg

SEQ ID NO: 13180 - DNA, 18 bp, synthetic construct
  source 1..18: mol_type = other DNA
ttatatggctcactattg

SEQ ID NO: 13181 - DNA, 18 bp, synthetic construct
  source 1..18: mol_type = other DNA
ttatgcgactggctatag

SEQ ID NO: 13182 - DNA, 18 bp, synthetic construct
  source 1..18: mol_type = other DNA
ttatgcgagtcgctatag

SEQ ID NO: 13183 - DNA, 18 bp, synthetic construct
  source 1..18: mol_type = other DNA
ttatgcgtctcactattg

SEQ ID NO: 13184 - DNA, 18 bp, synthetic construct
  source 1..18: mol_type = other DNA
ttattcaactcagtatag

SEQ ID NO: 13185 - DNA, 18 bp, synthetic construct
  source 1..18: mol_type = other DNA
ttattcgactcactctcg

SEQ ID NO: 13186 - DNA, 18 bp, synthetic construct
  source 1..18: mol_type = other DNA
ttattcgactcactgtcg

SEQ ID NO: 13187 - DNA, 18 bp, synthetic construct
  source 1..18: mol_type = other DNA
ttattcgcctcactatat

SEQ ID NO: 13188 - DNA, 18 bp, synthetic construct
  source 1..18: mol_type = other DNA
ttattcgcctcactgtag

SEQ ID NO: 13189 - DNA, 18 bp, synthetic construct
  source 1..18: mol_type = other DNA
ttcttcgactcactatgg

SEQ ID NO: 13190 - DNA, 18 bp, synthetic construct
  source 1..18: mol_type = other DNA
ttcttcggctcactatag

SEQ ID NO: 13191 - DNA, 18 bp, synthetic construct
  source 1..18: mol_type = other DNA
ttgtaagactcgctatag

SEQ ID NO: 13192 - DNA, 18 bp, synthetic construct
  source 1..18: mol_type = other DNA
ttttacggctcgctatag

SEQ ID NO: 13193 - DNA, 18 bp, synthetic construct
  source 1..18: mol_type = other DNA
aaaaaccacccactatag

SEQ ID NO: 13194 - DNA, 18 bp, synthetic construct
  source 1..18: mol_type = other DNA
aaaaacgagtcactacag

SEQ ID NO: 13195 - DNA, 18 bp, synthetic construct
  source 1..18: mol_type = other DNA
aaaagcgactcacgatag

SEQ ID NO: 13196 - DNA, 18 bp, synthetic construct
  source 1..18: mol_type = other DNA
aaaagcgactcactctag

SEQ ID NO: 13197 - DNA, 18 bp, synthetic construct
  source 1..18: mol_type = other DNA
aaacacgactccctctag

SEQ ID NO: 13198 - DNA, 18 bp, synthetic construct
  source 1..18: mol_type = other DNA
aaagacgaatcactatcg

SEQ ID NO: 13199 - DNA, 18 bp, synthetic construct
  source 1..18: mol_type = other DNA
aaataagacgcacaatag

SEQ ID NO: 13200 - DNA, 18 bp, synthetic construct
  source 1..18: mol_type = other DNA
aaataagactcactaaac

SEQ ID NO: 13201 - DNA, 18 bp, synthetic construct
  source 1..18: mol_type = other DNA
aaataagagtcactttag

SEQ ID NO: 13202 - DNA, 18 bp, synthetic construct
  source 1..18: mol_type = other DNA
aaatacaactcacgttag

SEQ ID NO: 13203 - DNA, 18 bp, synthetic construct
  source 1..18: mol_type = other DNA
aaatacaactctctatcg

SEQ ID NO: 13204 - DNA, 18 bp, synthetic construct
  source 1..18: mol_type = other DNA
aaatacatctccctatag

SEQ ID NO: 13205 - DNA, 18 bp, synthetic construct
  source 1..18: mol_type = other DNA
aaatacgaatcacaagag

SEQ ID NO: 13206 - DNA, 18 bp, synthetic construct
  source 1..18: mol_type = other DNA
aaatacgaattacgatag

SEQ ID NO: 13207 - DNA, 18 bp, synthetic construct
  source 1..18: mol_type = other DNA
aaatacgacacactggag

SEQ ID NO: 13208 - DNA, 18 bp, synthetic construct
  source 1..18: mol_type = other DNA
aaatacgaccacctatag

SEQ ID NO: 13209 - DNA, 18 bp, synthetic construct
  source 1..18: mol_type = other DNA
aaatacgacgcattatcg

SEQ ID NO: 13210 - DNA, 18 bp, synthetic construct
  source 1..18: mol_type = other DNA
aaatacgatacactatgg

SEQ ID NO: 13211 - DNA, 18 bp, synthetic construct
  source 1..18: mol_type = other DNA
aaatactactgactaaag

SEQ ID NO: 13212 - DNA, 18 bp, synthetic construct
  source 1..18: mol_type = other DNA
aaatactcgtcactatag

SEQ ID NO: 13213 - DNA, 18 bp, synthetic construct
  source 1..18: mol_type = other DNA
aaatagaactcaatatag

SEQ ID NO: 13214 - DNA, 18 bp, synthetic construct
  source 1..18: mol_type = other DNA
aaatagcattcactatag

SEQ ID NO: 13215 - DNA, 18 bp, synthetic construct
  source 1..18: mol_type = other DNA
aaataggactcactagcg

SEQ ID NO: 13216 - DNA, 18 bp, synthetic construct
  source 1..18: mol_type = other DNA
aaataggactctctctag

SEQ ID NO: 13217 - DNA, 18 bp, synthetic construct
  source 1..18: mol_type = other DNA
aaatataacgcactatag

SEQ ID NO: 13218 - DNA, 18 bp, synthetic construct
  source 1..18: mol_type = other DNA
aaatatcactcactaaag

SEQ ID NO: 13219 - DNA, 18 bp, synthetic construct
  source 1..18: mol_type = other DNA
aaatattagtcactatag

SEQ ID NO: 13220 - DNA, 18 bp, synthetic construct
  source 1..18: mol_type = other DNA
aaatcaggctcactatag

SEQ ID NO: 13221 - DNA, 18 bp, synthetic construct
  source 1..18: mol_type = other DNA
aaatccgactcaatctag

SEQ ID NO: 13222 - DNA, 18 bp, synthetic construct
  source 1..18: mol_type = other DNA
aaatccgactcattgtag

SEQ ID NO: 13223 - DNA, 18 bp, synthetic construct
  source 1..18: mol_type = other DNA
aaatgagagtcactatag

SEQ ID NO: 13224 - DNA, 18 bp, synthetic construct
  source 1..18: mol_type = other DNA
aaatgcgactcaataaag

SEQ ID NO: 13225 - DNA, 18 bp, synthetic construct
  source 1..18: mol_type = other DNA
aaatgcgactcaatacag

SEQ ID NO: 13226 - DNA, 18 bp, synthetic construct
  source 1..18: mol_type = other DNA
aaatgcgactcaccctag

SEQ ID NO: 13227 - DNA, 18 bp, synthetic construct
  source 1..18: mol_type = other DNA
aaatgcgactcagtacag

SEQ ID NO: 13228 - DNA, 18 bp, synthetic construct
  source 1..18: mol_type = other DNA
aaatgcgacttactacag

SEQ ID NO: 13229 - DNA, 18 bp, synthetic construct
  source 1..18: mol_type = other DNA
aaatgggactcactctag

SEQ ID NO: 13230 - DNA, 18 bp, synthetic construct
  source 1..18: mol_type = other DNA
aacaacgactcactctag

SEQ ID NO: 13231 - DNA, 18 bp, synthetic construct
  source 1..18: mol_type = other DNA
aactaagattcactatag

SEQ ID NO: 13232 - DNA, 18 bp, synthetic construct
  source 1..18: mol_type = other DNA
aactacgactcaccaaag

SEQ ID NO: 13233 - DNA, 18 bp, synthetic construct
  source 1..18: mol_type = other DNA
aactacgattgactatag

SEQ ID NO: 13234 - DNA, 18 bp, synthetic construct
  source 1..18: mol_type = other DNA
aactacggctcactaaag

SEQ ID NO: 13235 - DNA, 18 bp, synthetic construct
  source 1..18: mol_type = other DNA
aactactactcactttag

SEQ ID NO: 13236 - DNA, 18 bp, synthetic construct
  source 1..18: mol_type = other DNA
aaggaccactcactatag

SEQ ID NO: 13237 - DNA, 18 bp, synthetic construct
  source 1..18: mol_type = other DNA
aaggacgactcactttag

SEQ ID NO: 13238 - DNA, 18 bp, synthetic construct
  source 1..18: mol_type = other DNA
aagtacgactccatatag

SEQ ID NO: 13239 - DNA, 18 bp, synthetic construct
  source 1..18: mol_type = other DNA
aagtccggctcactatag

SEQ ID NO: 13240 - DNA, 18 bp, synthetic construct
  source 1..18: mol_type = other DNA
aattacgactaactgtag

SEQ ID NO: 13241 - DNA, 18 bp, synthetic construct
  source 1..18: mol_type = other DNA
aattatgcctcactatag

SEQ ID NO: 13242 - DNA, 18 bp, synthetic construct
  source 1..18: mol_type = other DNA
acatatgacacactatag

SEQ ID NO: 13243 - DNA, 18 bp, synthetic construct
  source 1..18: mol_type = other DNA
agatacaactcactgtag

SEQ ID NO: 13244 - DNA, 18 bp, synthetic construct
  source 1..18: mol_type = other DNA
agatacgagtcactatcg

SEQ ID NO: 13245 - DNA, 18 bp, synthetic construct
  source 1..18: mol_type = other DNA
agatacggcacactatag

SEQ ID NO: 13246 - DNA, 18 bp, synthetic construct
  source 1..18: mol_type = other DNA
agctacgactcattatag

SEQ ID NO: 13247 - DNA, 18 bp, synthetic construct
  source 1..18: mol_type = other DNA
atatacaactcactagag

SEQ ID NO: 13248 - DNA, 18 bp, synthetic construct
  source 1..18: mol_type = other DNA
atatgctactcactatag

SEQ ID NO: 13249 - DNA, 18 bp, synthetic construct
  source 1..18: mol_type = other DNA
atatgggactcactatag

SEQ ID NO: 13250 - DNA, 18 bp, synthetic construct
  source 1..18: mol_type = other DNA
atctacgactcagtatag

SEQ ID NO: 13251 - DNA, 18 bp, synthetic construct
  source 1..18: mol_type = other DNA
caaaacgacttcctatag

SEQ ID NO: 13252 - DNA, 18 bp, synthetic construct
  source 1..18: mol_type = other DNA
caaaatgactcactgtag

SEQ ID NO: 13253 - DNA, 18 bp, synthetic construct
  source 1..18: mol_type = other DNA
caaagcgactcactttag

SEQ ID NO: 13254 - DNA, 18 bp, synthetic construct
  source 1..18: mol_type = other DNA
caacaagactcactaaag

SEQ ID NO: 13255 - DNA, 18 bp, synthetic construct
  source 1..18: mol_type = other DNA
caacacgactaactatcg

SEQ ID NO: 13256 - DNA, 18 bp, synthetic construct
  source 1..18: mol_type = other DNA
caacaggactcactttag

SEQ ID NO: 13257 - DNA, 18 bp, synthetic construct
  source 1..18: mol_type = other DNA
caagaggagtcactatag

SEQ ID NO: 13258 - DNA, 18 bp, synthetic construct
  source 1..18: mol_type = other DNA
caataagactcagtaaag

SEQ ID NO: 13259 - DNA, 18 bp, synthetic construct
  source 1..18: mol_type = other DNA
caatacaactcactttgg

SEQ ID NO: 13260 - DNA, 18 bp, synthetic construct
  source 1..18: mol_type = other DNA
caataccactaactaaag

SEQ ID NO: 13261 - DNA, 18 bp, synthetic construct
  source 1..18: mol_type = other DNA
caatacgacacagtacag

SEQ ID NO: 13262 - DNA, 18 bp, synthetic construct
  source 1..18: mol_type = other DNA
caatacgacccatcatag

SEQ ID NO: 13263 - DNA, 18 bp, synthetic construct
  source 1..18: mol_type = other DNA
caatacgactcaggttag

SEQ ID NO: 13264 - DNA, 18 bp, synthetic construct
  source 1..18: mol_type = other DNA
caatacgactcatcatat

SEQ ID NO: 13265 - DNA, 18 bp, synthetic construct
  source 1..18: mol_type = other DNA
caatacgactccctttcg

SEQ ID NO: 13266 - DNA, 18 bp, synthetic construct
  source 1..18: mol_type = other DNA
caatacgacttactttgg

SEQ ID NO: 13267 - DNA, 18 bp, synthetic construct
  source 1..18: mol_type = other DNA
caatacgattaattatag

SEQ ID NO: 13268 - DNA, 18 bp, synthetic construct
  source 1..18: mol_type = other DNA
caatacgcgtcactacag

SEQ ID NO: 13269 - DNA, 18 bp, synthetic construct
  source 1..18: mol_type = other DNA
caatacggctcactaggg

SEQ ID NO: 13270 - DNA, 18 bp, synthetic construct
  source 1..18: mol_type = other DNA
caatacgtcccactaaag

SEQ ID NO: 13271 - DNA, 18 bp, synthetic construct
  source 1..18: mol_type = other DNA
caatacgtctcaacatag

SEQ ID NO: 13272 - DNA, 18 bp, synthetic construct
  source 1..18: mol_type = other DNA
caatacgtctcactgcag

SEQ ID NO: 13273 - DNA, 18 bp, synthetic construct
  source 1..18: mol_type = other DNA
caatacgtctcactttac

SEQ ID NO: 13274 - DNA, 18 bp, synthetic construct
  source 1..18: mol_type = other DNA
caatacgtctcaggatag

SEQ ID NO: 13275 - DNA, 18 bp, synthetic construct
  source 1..18: mol_type = other DNA
caatacgtctcagtaaag

SEQ ID NO: 13276 - DNA, 18 bp, synthetic construct
  source 1..18: mol_type = other DNA
caataggactgactttag

SEQ ID NO: 13277 - DNA, 18 bp, synthetic construct
  source 1..18: mol_type = other DNA
caatagggctcattatag

SEQ ID NO: 13278 - DNA, 18 bp, synthetic construct
  source 1..18: mol_type = other DNA
caatccgattcacaatag

SEQ ID NO: 13279 - DNA, 18 bp, synthetic construct
  source 1..18: mol_type = other DNA
caatccgattccctatag

SEQ ID NO: 13280 - DNA, 18 bp, synthetic construct
  source 1..18: mol_type = other DNA
caatgcgattcactaaag

SEQ ID NO: 13281 - DNA, 18 bp, synthetic construct
  source 1..18: mol_type = other DNA
caatgcgtctctctatag

SEQ ID NO: 13282 - DNA, 18 bp, synthetic construct
  source 1..18: mol_type = other DNA
cactacggctcactatcg

SEQ ID NO: 13283 - DNA, 18 bp, synthetic construct
  source 1..18: mol_type = other DNA
cagtacgacccactctag

SEQ ID NO: 13284 - DNA, 18 bp, synthetic construct
  source 1..18: mol_type = other DNA
cagtacgcatcactatag

SEQ ID NO: 13285 - DNA, 18 bp, synthetic construct
  source 1..18: mol_type = other DNA
cagtccgactcaccatag

SEQ ID NO: 13286 - DNA, 18 bp, synthetic construct
  source 1..18: mol_type = other DNA
cattacgactcattacag

SEQ ID NO: 13287 - DNA, 18 bp, synthetic construct
  source 1..18: mol_type = other DNA
cattccgactcactatcg

SEQ ID NO: 13288 - DNA, 18 bp, synthetic construct
  source 1..18: mol_type = other DNA
ccataagactcactttag

SEQ ID NO: 13289 - DNA, 18 bp, synthetic construct
  source 1..18: mol_type = other DNA
ccatacgactccctttag

SEQ ID NO: 13290 - DNA, 18 bp, synthetic construct
  source 1..18: mol_type = other DNA
cgataccaatcactatag

SEQ ID NO: 13291 - DNA, 18 bp, synthetic construct
  source 1..18: mol_type = other DNA
ctatacgactcacactag

SEQ ID NO: 13292 - DNA, 18 bp, synthetic construct
  source 1..18: mol_type = other DNA
ctatacgatccactatag

SEQ ID NO: 13293 - DNA, 18 bp, synthetic construct
  source 1..18: mol_type = other DNA
ctatactacgcactatag

SEQ ID NO: 13294 - DNA, 18 bp, synthetic construct
  source 1..18: mol_type = other DNA
ctataggactcactctag

SEQ ID NO: 13295 - DNA, 18 bp, synthetic construct
  source 1..18: mol_type = other DNA
ctatgggactcactatag

SEQ ID NO: 13296 - DNA, 18 bp, synthetic construct
  source 1..18: mol_type = other DNA
gaaaacgcatcactatag

SEQ ID NO: 13297 - DNA, 18 bp, synthetic construct
  source 1..18: mol_type = other DNA
gaataagacccactacag

SEQ ID NO: 13298 - DNA, 18 bp, synthetic construct
  source 1..18: mol_type = other DNA
gaatacaactatctatag

SEQ ID NO: 13299 - DNA, 18 bp, synthetic construct
  source 1..18: mol_type = other DNA
gaatacgactcaaaaaag

SEQ ID NO: 13300 - DNA, 18 bp, synthetic construct
  source 1..18: mol_type = other DNA
gaatatgactcactgaag

SEQ ID NO: 13301 - DNA, 18 bp, synthetic construct
  source 1..18: mol_type = other DNA
gattacgtcacactatag

SEQ ID NO: 13302 - DNA, 18 bp, synthetic construct
  source 1..18: mol_type = other DNA
gattactattcactatag

SEQ ID NO: 13303 - DNA, 18 bp, synthetic construct
  source 1..18: mol_type = other DNA
gattatgacacactatag

SEQ ID NO: 13304 - DNA, 18 bp, synthetic construct
  source 1..18: mol_type = other DNA
gcatacggctcactttag

SEQ ID NO: 13305 - DNA, 18 bp, synthetic construct
  source 1..18: mol_type = other DNA
ggataggattcactatag

SEQ ID NO: 13306 - DNA, 18 bp, synthetic construct
  source 1..18: mol_type = other DNA
gtatacgactcactctcg

SEQ ID NO: 13307 - DNA, 18 bp, synthetic construct
  source 1..18: mol_type = other DNA
gtatgcgacccactatag

SEQ ID NO: 13308 - DNA, 18 bp, synthetic construct
  source 1..18: mol_type = other DNA
gtatgcgactcactacag

SEQ ID NO: 13309 - DNA, 18 bp, synthetic construct
  source 1..18: mol_type = other DNA
gtttacgactaactatag

SEQ ID NO: 13310 - DNA, 18 bp, synthetic construct
  source 1..18: mol_type = other DNA
taaaacaacttactgtag

SEQ ID NO: 13311 - DNA, 18 bp, synthetic construct
  source 1..18: mol_type = other DNA
taaaaccactaactgtag

SEQ ID NO: 13312 - DNA, 18 bp, synthetic construct
  source 1..18: mol_type = other DNA
taaaaccactcaaaatag

SEQ ID NO: 13313 - DNA, 18 bp, synthetic construct
  source 1..18: mol_type = other DNA
taaaaccgctcactaaag

SEQ ID NO: 13314 - DNA, 18 bp, synthetic construct
  source 1..18: mol_type = other DNA
taaaacgactcacggcag

SEQ ID NO: 13315 - DNA, 18 bp, synthetic construct
  source 1..18: mol_type = other DNA
taaaacgactcactgacg

SEQ ID NO: 13316 - DNA, 18 bp, synthetic construct
  source 1..18: mol_type = other DNA
taaaacgactcactgccg

SEQ ID NO: 13317 - DNA, 18 bp, synthetic construct
  source 1..18: mol_type = other DNA
taaaacgactcataagag

SEQ ID NO: 13318 - DNA, 18 bp, synthetic construct
  source 1..18: mol_type = other DNA
taaaacgactcccaatcg

SEQ ID NO: 13319 - DNA, 18 bp, synthetic construct
  source 1..18: mol_type = other DNA
taaaacgactctccagag

SEQ ID NO: 13320 - DNA, 18 bp, synthetic construct
  source 1..18: mol_type = other DNA
taaaacgagttaccatag

SEQ ID NO: 13321 - DNA, 18 bp, synthetic construct
  source 1..18: mol_type = other DNA
taaaacgtctcagtataa

SEQ ID NO: 13322 - DNA, 18 bp, synthetic construct
  source 1..18: mol_type = other DNA
taaaactactcactctcg

SEQ ID NO: 13323 - DNA, 18 bp, synthetic construct
  source 1..18: mol_type = other DNA
taaaactcctcactacag

SEQ ID NO: 13324 - DNA, 18 bp, synthetic construct
  source 1..18: mol_type = other DNA
taaaaggaaccactatag

SEQ ID NO: 13325 - DNA, 18 bp, synthetic construct
  source 1..18: mol_type = other DNA
taaaatgaatcaatatag

SEQ ID NO: 13326 - DNA, 18 bp, synthetic construct
  source 1..18: mol_type = other DNA
taaaatgactgactctag

SEQ ID NO: 13327 - DNA, 18 bp, synthetic construct
  source 1..18: mol_type = other DNA
taaaccgacttactatcg

SEQ ID NO: 13328 - DNA, 18 bp, synthetic construct
  source 1..18: mol_type = other DNA
taaaccgtctcactatcg

SEQ ID NO: 13329 - DNA, 18 bp, synthetic construct
  source 1..18: mol_type = other DNA
taaacttactcactatag

SEQ ID NO: 13330 - DNA, 18 bp, synthetic construct
  source 1..18: mol_type = other DNA
taaagagactcactctag

SEQ ID NO: 13331 - DNA, 18 bp, synthetic construct
  source 1..18: mol_type = other DNA
taaagcaactcagtatag

SEQ ID NO: 13332 - DNA, 18 bp, synthetic construct
  source 1..18: mol_type = other DNA
taaagcgactcactaacg

SEQ ID NO: 13333 - DNA, 18 bp, synthetic construct
  source 1..18: mol_type = other DNA
taaagcgactcactatcc

SEQ ID NO: 13334 - DNA, 18 bp, synthetic construct
  source 1..18: mol_type = other DNA
taaagcgtatcactatag

SEQ ID NO: 13335 - DNA, 18 bp, synthetic construct
  source 1..18: mol_type = other DNA
taaagtgactcaccatag

SEQ ID NO: 13336 - DNA, 18 bp, synthetic construct
  source 1..18: mol_type = other DNA
taacaactctcactatag

SEQ ID NO: 13337 - DNA, 18 bp, synthetic construct
  source 1..18: mol_type = other DNA
taacaagacgcactttag

SEQ ID NO: 13338 - DNA, 18 bp, synthetic construct
  source 1..18: mol_type = other DNA
taacaagactcccgatag

SEQ ID NO: 13339 - DNA, 18 bp, synthetic construct
  source 1..18: mol_type = other DNA
taacacaactcaagatag

SEQ ID NO: 13340 - DNA, 18 bp, synthetic construct
  source 1..18: mol_type = other DNA
taacacacctcacaatag

SEQ ID NO: 13341 - DNA, 18 bp, synthetic construct
  source 1..18: mol_type = other DNA
taacaccactcactcaag

SEQ ID NO: 13342 - DNA, 18 bp, synthetic construct
  source 1..18: mol_type = other DNA
taacacgacaaactctag

SEQ ID NO: 13343 - DNA, 18 bp, synthetic construct
  source 1..18: mol_type = other DNA
taacacgaccctctatcg

SEQ ID NO: 13344 - DNA, 18 bp, synthetic construct
  source 1..18: mol_type = other DNA
taacacgactaactcaag

SEQ ID NO: 13345 - DNA, 18 bp, synthetic construct
  source 1..18: mol_type = other DNA
taacacgactcactcacg

SEQ ID NO: 13346 - DNA, 18 bp, synthetic construct
  source 1..18: mol_type = other DNA
taacacgactcacttaaa

SEQ ID NO: 13347 - DNA, 18 bp, synthetic construct
  source 1..18: mol_type = other DNA
taacacgactcctaatag

SEQ ID NO: 13348 - DNA, 18 bp, synthetic construct
  source 1..18: mol_type = other DNA
taacacgattcaatatcg

SEQ ID NO: 13349 - DNA, 18 bp, synthetic construct
  source 1..18: mol_type = other DNA
taacacgattctcgatag

SEQ ID NO: 13350 - DNA, 18 bp, synthetic construct
  source 1..18: mol_type = other DNA
taacacgcctcacagtag

SEQ ID NO: 13351 - DNA, 18 bp, synthetic construct
  source 1..18: mol_type = other DNA
taacacgtctccctagag

SEQ ID NO: 13352 - DNA, 18 bp, synthetic construct
  source 1..18: mol_type = other DNA
taacacgtgttactatag

SEQ ID NO: 13353 - DNA, 18 bp, synthetic construct
  source 1..18: mol_type = other DNA
taacaggactcaataaag

SEQ ID NO: 13354 - DNA, 18 bp, synthetic construct
  source 1..18: mol_type = other DNA
taacaggactcagtaaag

SEQ ID NO: 13355 - DNA, 18 bp, synthetic construct
  source 1..18: mol_type = other DNA
taacatgactccctttag

SEQ ID NO: 13356 - DNA, 18 bp, synthetic construct
  source 1..18: mol_type = other DNA
taacatgagtccctatag

SEQ ID NO: 13357 - DNA, 18 bp, synthetic construct
  source 1..18: mol_type = other DNA
taacccaactcacaatag

SEQ ID NO: 13358 - DNA, 18 bp, synthetic construct
  source 1..18: mol_type = other DNA
taacccgacacacaatag

SEQ ID NO: 13359 - DNA, 18 bp, synthetic construct
  source 1..18: mol_type = other DNA
taacctgactctctatag

SEQ ID NO: 13360 - DNA, 18 bp, synthetic construct
  source 1..18: mol_type = other DNA
taacgcgactcacaatgg

SEQ ID NO: 13361 - DNA, 18 bp, synthetic construct
  source 1..18: mol_type = other DNA
taagacaacccactttag

SEQ ID NO: 13362 - DNA, 18 bp, synthetic construct
  source 1..18: mol_type = other DNA
taagacgacatactttag

SEQ ID NO: 13363 - DNA, 18 bp, synthetic construct
  source 1..18: mol_type = other DNA
taagacgacgcagcatag

SEQ ID NO: 13364 - DNA, 18 bp, synthetic construct
  source 1..18: mol_type = other DNA
taagacgataccctatag

SEQ ID NO: 13365 - DNA, 18 bp, synthetic construct
  source 1..18: mol_type = other DNA
taagacgtctcattatgg

SEQ ID NO: 13366 - DNA, 18 bp, synthetic construct
  source 1..18: mol_type = other DNA
taagacgtctctccatag

SEQ ID NO: 13367 - DNA, 18 bp, synthetic construct
  source 1..18: mol_type = other DNA
taagaggacccactttag

SEQ ID NO: 13368 - DNA, 18 bp, synthetic construct
  source 1..18: mol_type = other DNA
taagccgacttcctatag

SEQ ID NO: 13369 - DNA, 18 bp, synthetic construct
  source 1..18: mol_type = other DNA
taaggcgacttacaatag

SEQ ID NO: 13370 - DNA, 18 bp, synthetic construct
  source 1..18: mol_type = other DNA
taataacactcaatatgg

SEQ ID NO: 13371 - DNA, 18 bp, synthetic construct
  source 1..18: mol_type = other DNA
taataagactcaaactag

SEQ ID NO: 13372 - DNA, 18 bp, synthetic construct
  source 1..18: mol_type = other DNA
taataagactcacaaccg

SEQ ID NO: 13373 - DNA, 18 bp, synthetic construct
  source 1..18: mol_type = other DNA
taataagactcacaccag

SEQ ID NO: 13374 - DNA, 18 bp, synthetic construct
  source 1..18: mol_type = other DNA
taataagactcactgaaa

SEQ ID NO: 13375 - DNA, 18 bp, synthetic construct
  source 1..18: mol_type = other DNA
taataagactcatcaaag

SEQ ID NO: 13376 - DNA, 18 bp, synthetic construct
  source 1..18: mol_type = other DNA
taataagactcattttgg

SEQ ID NO: 13377 - DNA, 18 bp, synthetic construct
  source 1..18: mol_type = other DNA
taataagactctatataa

SEQ ID NO: 13378 - DNA, 18 bp, synthetic construct
  source 1..18: mol_type = other DNA
taataagactctccatcg

SEQ ID NO: 13379 - DNA, 18 bp, synthetic construct
  source 1..18: mol_type = other DNA
taataagactctccttag

SEQ ID NO: 13380 - DNA, 18 bp, synthetic construct
  source 1..18: mol_type = other DNA
taataagactgagtatcg

SEQ ID NO: 13381 - DNA, 18 bp, synthetic construct
  source 1..18: mol_type = other DNA
taataagagtcaataaag

SEQ ID NO: 13382 - DNA, 18 bp, synthetic construct
  source 1..18: mol_type = other DNA
taataagagttaatatag

SEQ ID NO: 13383 - DNA, 18 bp, synthetic construct
  source 1..18: mol_type = other DNA
taataagccacactatgg

SEQ ID NO: 13384 - DNA, 18 bp, synthetic construct
  source 1..18: mol_type = other DNA
taataagcttcactaaag

SEQ ID NO: 13385 - DNA, 18 bp, synthetic construct
  source 1..18: mol_type = other DNA
taataagtctcacgttag

SEQ ID NO: 13386 - DNA, 18 bp, synthetic construct
  source 1..18: mol_type = other DNA
taataagtctgagtatag

SEQ ID NO: 13387 - DNA, 18 bp, synthetic construct
  source 1..18: mol_type = other DNA
taataatagtcaccatag

SEQ ID NO: 13388 - DNA, 18 bp, synthetic construct
  source 1..18: mol_type = other DNA
taatacaaatcacgctag

SEQ ID NO: 13389 - DNA, 18 bp, synthetic construct
  source 1..18: mol_type = other DNA
taatacaacacacggtag

SEQ ID NO: 13390 - DNA, 18 bp, synthetic construct
  source 1..18: mol_type = other DNA
taatacaacacactgcag

SEQ ID NO: 13391 - DNA, 18 bp, synthetic construct
  source 1..18: mol_type = other DNA
taatacaactacctatcg

SEQ ID NO: 13392 - DNA, 18 bp, synthetic construct
  source 1..18: mol_type = other DNA
taatacaactcacaacaa

SEQ ID NO: 13393 - DNA, 18 bp, synthetic construct
  source 1..18: mol_type = other DNA
taatacaactgacaacag

SEQ ID NO: 13394 - DNA, 18 bp, synthetic construct
  source 1..18: mol_type = other DNA
taatacaactgaccctag

SEQ ID NO: 13395 - DNA, 18 bp, synthetic construct
  source 1..18: mol_type = other DNA
taatacaagtaactaaag

SEQ ID NO: 13396 - DNA, 18 bp, synthetic construct
  source 1..18: mol_type = other DNA
taatacacgtcactacag

SEQ ID NO: 13397 - DNA, 18 bp, synthetic construct
  source 1..18: mol_type = other DNA
taatacagcccactttag

SEQ ID NO: 13398 - DNA, 18 bp, synthetic construct
  source 1..18: mol_type = other DNA
taataccacatactacag

SEQ ID NO: 13399 - DNA, 18 bp, synthetic construct
  source 1..18: mol_type = other DNA
taataccactacatatag

SEQ ID NO: 13400 - DNA, 18 bp, synthetic construct
  source 1..18: mol_type = other DNA
taataccactctctaagg

SEQ ID NO: 13401 - DNA, 18 bp, synthetic construct
  source 1..18: mol_type = other DNA
taataccccacactacag

SEQ ID NO: 13402 - DNA, 18 bp, synthetic construct
  source 1..18: mol_type = other DNA
taataccgctaactacag

SEQ ID NO: 13403 - DNA, 18 bp, synthetic construct
  source 1..18: mol_type = other DNA
taataccgctcaccaaag

SEQ ID NO: 13404 - DNA, 18 bp, synthetic construct
  source 1..18: mol_type = other DNA
taatacctctcactttcg

SEQ ID NO: 13405 - DNA, 18 bp, synthetic construct
  source 1..18: mol_type = other DNA
taatacgaataaccatcg

SEQ ID NO: 13406 - DNA, 18 bp, synthetic construct
  source 1..18: mol_type = other DNA
taatacgaatcacccaag

SEQ ID NO: 13407 - DNA, 18 bp, synthetic construct
  source 1..18: mol_type = other DNA
taatacgaatcatcctag

SEQ ID NO: 13408 - DNA, 18 bp, synthetic construct
  source 1..18: mol_type = other DNA
taatacgaatctgaatag

SEQ ID NO: 13409 - DNA, 18 bp, synthetic construct
  source 1..18: mol_type = other DNA
taatacgaatctgtataa

SEQ ID NO: 13410 - DNA, 18 bp, synthetic construct
  source 1..18: mol_type = other DNA
taatacgaatgcctttag

SEQ ID NO: 13411 - DNA, 18 bp, synthetic construct
  source 1..18: mol_type = other DNA
taatacgaattattgtag

SEQ ID NO: 13412 - DNA, 18 bp, synthetic construct
  source 1..18: mol_type = other DNA
taatacgacacacactat

SEQ ID NO: 13413 - DNA, 18 bp, synthetic construct
  source 1..18: mol_type = other DNA
taatacgacactgcatag

SEQ ID NO: 13414 - DNA, 18 bp, synthetic construct
  source 1..18: mol_type = other DNA
taatacgacactgtctag

SEQ ID NO: 13415 - DNA, 18 bp, synthetic construct
  source 1..18: mol_type = other DNA
taatacgacagaccatgg

SEQ ID NO: 13416 - DNA, 18 bp, synthetic construct
  source 1..18: mol_type = other DNA
taatacgacatacaataa

SEQ ID NO: 13417 - DNA, 18 bp, synthetic construct
  source 1..18: mol_type = other DNA
taatacgaccctttgtag

SEQ ID NO: 13418 - DNA, 18 bp, synthetic construct
  source 1..18: mol_type = other DNA
taatacgaccgacttgag

SEQ ID NO: 13419 - DNA, 18 bp, synthetic construct
  source 1..18: mol_type = other DNA
taatacgacgctttatcg

SEQ ID NO: 13420 - DNA, 18 bp, synthetic construct
  source 1..18: mol_type = other DNA
taatacgactaacaaaat

SEQ ID NO: 13421 - DNA, 18 bp, synthetic construct
  source 1..18: mol_type = other DNA
taatacgactaacagtcg

SEQ ID NO: 13422 - DNA, 18 bp, synthetic construct
  source 1..18: mol_type = other DNA
taatacgactaactgaac

SEQ ID NO: 13423 - DNA, 18 bp, synthetic construct
  source 1..18: mol_type = other DNA
taatacgactaactgacg

SEQ ID NO: 13424 - DNA, 18 bp, synthetic construct
  source 1..18: mol_type = other DNA
taatacgactaactgtgc

SEQ ID NO: 13425 - DNA, 18 bp, synthetic construct
  source 1..18: mol_type = other DNA
taatacgactatccataa

SEQ ID NO: 13426 - DNA, 18 bp, synthetic construct
  source 1..18: mol_type = other DNA
taatacgactcaatcacg

SEQ ID NO: 13427 - DNA, 18 bp, synthetic construct
  source 1..18: mol_type = other DNA
taatacgactcaattaac

SEQ ID NO: 13428 - DNA, 18 bp, synthetic construct
  source 1..18: mol_type = other DNA
taatacgactcacgcccg

SEQ ID NO: 13429 - DNA, 18 bp, synthetic construct
  source 1..18: mol_type = other DNA
taatacgactcagttaat

SEQ ID NO: 13430 - DNA, 18 bp, synthetic construct
  source 1..18: mol_type = other DNA
taatacgactctcgggag

SEQ ID NO: 13431 - DNA, 18 bp, synthetic construct
  source 1..18: mol_type = other DNA
taatacgactctctaaca

SEQ ID NO: 13432 - DNA, 18 bp, synthetic construct
  source 1..18: mol_type = other DNA
taatacgactctctgtgc

SEQ ID NO: 13433 - DNA, 18 bp, synthetic construct
  source 1..18: mol_type = other DNA
taatacgactgtctccag

SEQ ID NO: 13434 - DNA, 18 bp, synthetic construct
  source 1..18: mol_type = other DNA
taatacgacttaccgcag

SEQ ID NO: 13435 - DNA, 18 bp, synthetic construct
  source 1..18: mol_type = other DNA
taatacgacttcggatag

SEQ ID NO: 13436 - DNA, 18 bp, synthetic construct
  source 1..18: mol_type = other DNA
taatacgactttttagag

SEQ ID NO: 13437 - DNA, 18 bp, synthetic construct
  source 1..18: mol_type = other DNA
taatacgagcaacaatag

SEQ ID NO: 13438 - DNA, 18 bp, synthetic construct
  source 1..18: mol_type = other DNA
taatacgagccacagtag

SEQ ID NO: 13439 - DNA, 18 bp, synthetic construct
  source 1..18: mol_type = other DNA
taatacgagctaccatag

SEQ ID NO: 13440 - DNA, 18 bp, synthetic construct
  source 1..18: mol_type = other DNA
taatacgagggactgtag

SEQ ID NO: 13441 - DNA, 18 bp, synthetic construct
  source 1..18: mol_type = other DNA
taatacgatacattgtag

SEQ ID NO: 13442 - DNA, 18 bp, synthetic construct
  source 1..18: mol_type = other DNA
taatacgattcacagcag

SEQ ID NO: 13443 - DNA, 18 bp, synthetic construct
  source 1..18: mol_type = other DNA
taatacgattcactcgcg

SEQ ID NO: 13444 - DNA, 18 bp, synthetic construct
  source 1..18: mol_type = other DNA
taatacgattccttacag

SEQ ID NO: 13445 - DNA, 18 bp, synthetic construct
  source 1..18: mol_type = other DNA
taatacgatttagtatcg

SEQ ID NO: 13446 - DNA, 18 bp, synthetic construct
  source 1..18: mol_type = other DNA
taatacgcatccatatag

SEQ ID NO: 13447 - DNA, 18 bp, synthetic construct
  source 1..18: mol_type = other DNA
taatacgcatctctacag

SEQ ID NO: 13448 - DNA, 18 bp, synthetic construct
  source 1..18: mol_type = other DNA
taatacgccgcaccacag

SEQ ID NO: 13449 - DNA, 18 bp, synthetic construct
  source 1..18: mol_type = other DNA
taatacgcctcaccaacg

SEQ ID NO: 13450 - DNA, 18 bp, synthetic construct
  source 1..18: mol_type = other DNA
taatacgcctcactgagg

SEQ ID NO: 13451 - DNA, 18 bp, synthetic construct
  source 1..18: mol_type = other DNA
taatacgccttagaatag

SEQ ID NO: 13452 - DNA, 18 bp, synthetic construct
  source 1..18: mol_type = other DNA
taatacgcgacactatcg

SEQ ID NO: 13453 - DNA, 18 bp, synthetic construct
  source 1..18: mol_type = other DNA
taatacgcttcacgttag

SEQ ID NO: 13454 - DNA, 18 bp, synthetic construct
  source 1..18: mol_type = other DNA
taatacggataagtatag

SEQ ID NO: 13455 - DNA, 18 bp, synthetic construct
  source 1..18: mol_type = other DNA
taatacggcccactgaag

SEQ ID NO: 13456 - DNA, 18 bp, synthetic construct
  source 1..18: mol_type = other DNA
taatacggccctttatag

SEQ ID NO: 13457 - DNA, 18 bp, synthetic construct
  source 1..18: mol_type = other DNA
taatacggctacctgtag

SEQ ID NO: 13458 - DNA, 18 bp, synthetic construct
  source 1..18: mol_type = other DNA
taatacggctcactcagg

SEQ ID NO: 13459 - DNA, 18 bp, synthetic construct
  source 1..18: mol_type = other DNA
taatacggctcagcttag

SEQ ID NO: 13460 - DNA, 18 bp, synthetic construct
  source 1..18: mol_type = other DNA
taatacggcttagcatag

SEQ ID NO: 13461 - DNA, 18 bp, synthetic construct
  source 1..18: mol_type = other DNA
taatacgtatgactacag

SEQ ID NO: 13462 - DNA, 18 bp, synthetic construct
  source 1..18: mol_type = other DNA
taatacgtcgcactttgg

SEQ ID NO: 13463 - DNA, 18 bp, synthetic construct
  source 1..18: mol_type = other DNA
taatacgtctcactttcc

SEQ ID NO: 13464 - DNA, 18 bp, synthetic construct
  source 1..18: mol_type = other DNA
taatacgtctcagtgtac

SEQ ID NO: 13465 - DNA, 18 bp, synthetic construct
  source 1..18: mol_type = other DNA
taatacgtctcataatac

SEQ ID NO: 13466 - DNA, 18 bp, synthetic construct
  source 1..18: mol_type = other DNA
taatacgtctcattgtcg

SEQ ID NO: 13467 - DNA, 18 bp, synthetic construct
  source 1..18: mol_type = other DNA
taatacgtctccccctag

SEQ ID NO: 13468 - DNA, 18 bp, synthetic construct
  source 1..18: mol_type = other DNA
taatacgtctctctatca

SEQ ID NO: 13469 - DNA, 18 bp, synthetic construct
  source 1..18: mol_type = other DNA
taatacgtctgattatcg

SEQ ID NO: 13470 - DNA, 18 bp, synthetic construct
  source 1..18: mol_type = other DNA
taatacgtttcactttaa

SEQ ID NO: 13471 - DNA, 18 bp, synthetic construct
  source 1..18: mol_type = other DNA
taatactaatgactatcg

SEQ ID NO: 13472 - DNA, 18 bp, synthetic construct
  source 1..18: mol_type = other DNA
taatactacagagtatag

SEQ ID NO: 13473 - DNA, 18 bp, synthetic construct
  source 1..18: mol_type = other DNA
taatactacgccctacag

SEQ ID NO: 13474 - DNA, 18 bp, synthetic construct
  source 1..18: mol_type = other DNA
taatactactcagcaaag

SEQ ID NO: 13475 - DNA, 18 bp, synthetic construct
  source 1..18: mol_type = other DNA
taatactagtctttatag

SEQ ID NO: 13476 - DNA, 18 bp, synthetic construct
  source 1..18: mol_type = other DNA
taatactccccactttag

SEQ ID NO: 13477 - DNA, 18 bp, synthetic construct
  source 1..18: mol_type = other DNA
taatactgctacctatag

SEQ ID NO: 13478 - DNA, 18 bp, synthetic construct
  source 1..18: mol_type = other DNA
taatactgctccttatag

SEQ ID NO: 13479 - DNA, 18 bp, synthetic construct
  source 1..18: mol_type = other DNA
taatacttctcactaaaa

SEQ ID NO: 13480 - DNA, 18 bp, synthetic construct
  source 1..18: mol_type = other DNA
taatagaaatcaccatag

SEQ ID NO: 13481 - DNA, 18 bp, synthetic construct
  source 1..18: mol_type = other DNA
taatagaactcaccttag

SEQ ID NO: 13482 - DNA, 18 bp, synthetic construct
  source 1..18: mol_type = other DNA
taatagaactctctctag

SEQ ID NO: 13483 - DNA, 18 bp, synthetic construct
  source 1..18: mol_type = other DNA
taatagaactgactaaag

SEQ ID NO: 13484 - DNA, 18 bp, synthetic construct
  source 1..18: mol_type = other DNA
taatagcagccactatag

SEQ ID NO: 13485 - DNA, 18 bp, synthetic construct
  source 1..18: mol_type = other DNA
taataggaacctctatag

SEQ ID NO: 13486 - DNA, 18 bp, synthetic construct
  source 1..18: mol_type = other DNA
taataggaatgattatag

SEQ ID NO: 13487 - DNA, 18 bp, synthetic construct
  source 1..18: mol_type = other DNA
taataggaccttctatag

SEQ ID NO: 13488 - DNA, 18 bp, synthetic construct
  source 1..18: mol_type = other DNA
taataggactcaaggtag

SEQ ID NO: 13489 - DNA, 18 bp, synthetic construct
  source 1..18: mol_type = other DNA
taataggactcacttaat

SEQ ID NO: 13490 - DNA, 18 bp, synthetic construct
  source 1..18: mol_type = other DNA
taataggactcattctcg

SEQ ID NO: 13491 - DNA, 18 bp, synthetic construct
  source 1..18: mol_type = other DNA
taataggattctatatag

SEQ ID NO: 13492 - DNA, 18 bp, synthetic construct
  source 1..18: mol_type = other DNA
taataggcctcaccaaag

SEQ ID NO: 13493 - DNA, 18 bp, synthetic construct
  source 1..18: mol_type = other DNA
taatagtactccctttag

SEQ ID NO: 13494 - DNA, 18 bp, synthetic construct
  source 1..18: mol_type = other DNA
taatagtcctcacgatag

SEQ ID NO: 13495 - DNA, 18 bp, synthetic construct
  source 1..18: mol_type = other DNA
taatataactcactctcg

SEQ ID NO: 13496 - DNA, 18 bp, synthetic construct
  source 1..18: mol_type = other DNA
taatataactccctgtag

SEQ ID NO: 13497 - DNA, 18 bp, synthetic construct
  source 1..18: mol_type = other DNA
taatatagctcactacag

SEQ ID NO: 13498 - DNA, 18 bp, synthetic construct
  source 1..18: mol_type = other DNA
taatatcactcactctgg

SEQ ID NO: 13499 - DNA, 18 bp, synthetic construct
  source 1..18: mol_type = other DNA
taatatcattgactatag

SEQ ID NO: 13500 - DNA, 18 bp, synthetic construct
  source 1..18: mol_type = other DNA
taatatgaatcaccctag

SEQ ID NO: 13501 - DNA, 18 bp, synthetic construct
  source 1..18: mol_type = other DNA
taatatgaatctctgtag

SEQ ID NO: 13502 - DNA, 18 bp, synthetic construct
  source 1..18: mol_type = other DNA
taatatgaatgaatatag

SEQ ID NO: 13503 - DNA, 18 bp, synthetic construct
  source 1..18: mol_type = other DNA
taatatgacagagtatag

SEQ ID NO: 13504 - DNA, 18 bp, synthetic construct
  source 1..18: mol_type = other DNA
taatatgaccctctatcg

SEQ ID NO: 13505 - DNA, 18 bp, synthetic construct
  source 1..18: mol_type = other DNA
taatatgacggtctatag

SEQ ID NO: 13506 - DNA, 18 bp, synthetic construct
  source 1..18: mol_type = other DNA
taatatgactcaagttag

SEQ ID NO: 13507 - DNA, 18 bp, synthetic construct
  source 1..18: mol_type = other DNA
taatatgactccatgtag

SEQ ID NO: 13508 - DNA, 18 bp, synthetic construct
  source 1..18: mol_type = other DNA
taatatgactctcgatcg

SEQ ID NO: 13509 - DNA, 18 bp, synthetic construct
  source 1..18: mol_type = other DNA
taatatgactctctgtcg

SEQ ID NO: 13510 - DNA, 18 bp, synthetic construct
  source 1..18: mol_type = other DNA
taatatgactctttctag

SEQ ID NO: 13511 - DNA, 18 bp, synthetic construct
  source 1..18: mol_type = other DNA
taatatgacttagtacag

SEQ ID NO: 13512 - DNA, 18 bp, synthetic construct
  source 1..18: mol_type = other DNA
taatatgagtcatgatag

SEQ ID NO: 13513 - DNA, 18 bp, synthetic construct
  source 1..18: mol_type = other DNA
taatatgatgcaccatag

SEQ ID NO: 13514 - DNA, 18 bp, synthetic construct
  source 1..18: mol_type = other DNA
taatatgcatcaatatag

SEQ ID NO: 13515 - DNA, 18 bp, synthetic construct
  source 1..18: mol_type = other DNA
taatatgcctaagtatag

SEQ ID NO: 13516 - DNA, 18 bp, synthetic construct
  source 1..18: mol_type = other DNA
taatatgcctcacgttag

SEQ ID NO: 13517 - DNA, 18 bp, synthetic construct
  source 1..18: mol_type = other DNA
taatatgcctcactgtcg

SEQ ID NO: 13518 - DNA, 18 bp, synthetic construct
  source 1..18: mol_type = other DNA
taatatgcttcactctag

SEQ ID NO: 13519 - DNA, 18 bp, synthetic construct
  source 1..18: mol_type = other DNA
taatattacgctctatag

SEQ ID NO: 13520 - DNA, 18 bp, synthetic construct
  source 1..18: mol_type = other DNA
taatattactcaatatcg

SEQ ID NO: 13521 - DNA, 18 bp, synthetic construct
  source 1..18: mol_type = other DNA
taatattactcactccag

SEQ ID NO: 13522 - DNA, 18 bp, synthetic construct
  source 1..18: mol_type = other DNA
taatattacttactagag

SEQ ID NO: 13523 - DNA, 18 bp, synthetic construct
  source 1..18: mol_type = other DNA
taatccaactcactgcag

SEQ ID NO: 13524 - DNA, 18 bp, synthetic construct
  source 1..18: mol_type = other DNA
taatcccaatcactatcg

SEQ ID NO: 13525 - DNA, 18 bp, synthetic construct
  source 1..18: mol_type = other DNA
taatccgaaccactatgg

SEQ ID NO: 13526 - DNA, 18 bp, synthetic construct
  source 1..18: mol_type = other DNA
taatccgaatcaatttag

SEQ ID NO: 13527 - DNA, 18 bp, synthetic construct
  source 1..18: mol_type = other DNA
taatccgaccccctatcg

SEQ ID NO: 13528 - DNA, 18 bp, synthetic construct
  source 1..18: mol_type = other DNA
taatccgactaacagtag

SEQ ID NO: 13529 - DNA, 18 bp, synthetic construct
  source 1..18: mol_type = other DNA
taatccgactcactgacg

SEQ ID NO: 13530 - DNA, 18 bp, synthetic construct
  source 1..18: mol_type = other DNA
taatccgactgacaaaag

SEQ ID NO: 13531 - DNA, 18 bp, synthetic construct
  source 1..18: mol_type = other DNA
taatccgacttactctcg

SEQ ID NO: 13532 - DNA, 18 bp, synthetic construct
  source 1..18: mol_type = other DNA
taatccgagtctctacag

SEQ ID NO: 13533 - DNA, 18 bp, synthetic construct
  source 1..18: mol_type = other DNA
taatccgatgcacaatag

SEQ ID NO: 13534 - DNA, 18 bp, synthetic construct
  source 1..18: mol_type = other DNA
taatccgcctcaataaag

SEQ ID NO: 13535 - DNA, 18 bp, synthetic construct
  source 1..18: mol_type = other DNA
taatccgcctcactctcg

SEQ ID NO: 13536 - DNA, 18 bp, synthetic construct
  source 1..18: mol_type = other DNA
taatccgtatcactttag

SEQ ID NO: 13537 - DNA, 18 bp, synthetic construct
  source 1..18: mol_type = other DNA
taatccgtctcactctcg

SEQ ID NO: 13538 - DNA, 18 bp, synthetic construct
  source 1..18: mol_type = other DNA
taatccgtctcactgtaa

SEQ ID NO: 13539 - DNA, 18 bp, synthetic construct
  source 1..18: mol_type = other DNA
taatcctagacactatag

SEQ ID NO: 13540 - DNA, 18 bp, synthetic construct
  source 1..18: mol_type = other DNA
taatcggactcaatacag

SEQ ID NO: 13541 - DNA, 18 bp, synthetic construct
  source 1..18: mol_type = other DNA
taatcggactcaatatcg

SEQ ID NO: 13542 - DNA, 18 bp, synthetic construct
  source 1..18: mol_type = other DNA
taatctaactcactatgg

SEQ ID NO: 13543 - DNA, 18 bp, synthetic construct
  source 1..18: mol_type = other DNA
taatgagaatgactatag

SEQ ID NO: 13544 - DNA, 18 bp, synthetic construct
  source 1..18: mol_type = other DNA
taatgatcctcactatag

SEQ ID NO: 13545 - DNA, 18 bp, synthetic construct
  source 1..18: mol_type = other DNA
taatgcaacacattatag

SEQ ID NO: 13546 - DNA, 18 bp, synthetic construct
  source 1..18: mol_type = other DNA
taatgcaactcactctgg

SEQ ID NO: 13547 - DNA, 18 bp, synthetic construct
  source 1..18: mol_type = other DNA
taatgcagttcactatag

SEQ ID NO: 13548 - DNA, 18 bp, synthetic construct
  source 1..18: mol_type = other DNA
taatgccaatcaatatag

SEQ ID NO: 13549 - DNA, 18 bp, synthetic construct
  source 1..18: mol_type = other DNA
taatgcgactaactcaag

SEQ ID NO: 13550 - DNA, 18 bp, synthetic construct
  source 1..18: mol_type = other DNA
taatgcgactaacttaag

SEQ ID NO: 13551 - DNA, 18 bp, synthetic construct
  source 1..18: mol_type = other DNA
taatgcgactcagaaaag

SEQ ID NO: 13552 - DNA, 18 bp, synthetic construct
  source 1..18: mol_type = other DNA
taatgcgactcattccag

SEQ ID NO: 13553 - DNA, 18 bp, synthetic construct
  source 1..18: mol_type = other DNA
taatgcgactctcaatcg

SEQ ID NO: 13554 - DNA, 18 bp, synthetic construct
  source 1..18: mol_type = other DNA
taatgcgactgtcaatag

SEQ ID NO: 13555 - DNA, 18 bp, synthetic construct
  source 1..18: mol_type = other DNA
taatgcgacttcctaaag

SEQ ID NO: 13556 - DNA, 18 bp, synthetic construct
  source 1..18: mol_type = other DNA
taatgcgattcaacatag

SEQ ID NO: 13557 - DNA, 18 bp, synthetic construct
  source 1..18: mol_type = other DNA
taatgcgatttattatag

SEQ ID NO: 13558 - DNA, 18 bp, synthetic construct
  source 1..18: mol_type = other DNA
taatgcgtataactatag

SEQ ID NO: 13559 - DNA, 18 bp, synthetic construct
  source 1..18: mol_type = other DNA
taatgcgtatcactaaag

SEQ ID NO: 13560 - DNA, 18 bp, synthetic construct
  source 1..18: mol_type = other DNA
taatgctacttacgatag

SEQ ID NO: 13561 - DNA, 18 bp, synthetic construct
  source 1..18: mol_type = other DNA
taatgggactaactaaag

SEQ ID NO: 13562 - DNA, 18 bp, synthetic construct
  source 1..18: mol_type = other DNA
taatgggactaattatag

SEQ ID NO: 13563 - DNA, 18 bp, synthetic construct
  source 1..18: mol_type = other DNA
taatgggactcaccacag

SEQ ID NO: 13564 - DNA, 18 bp, synthetic construct
  source 1..18: mol_type = other DNA
taatgggactcactaccg

SEQ ID NO: 13565 - DNA, 18 bp, synthetic construct
  source 1..18: mol_type = other DNA
taatgggactcagaatag

SEQ ID NO: 13566 - DNA, 18 bp, synthetic construct
  source 1..18: mol_type = other DNA
taatgtgactcactcaag

SEQ ID NO: 13567 - DNA, 18 bp, synthetic construct
  source 1..18: mol_type = other DNA
tacaacaactcattatag

SEQ ID NO: 13568 - DNA, 18 bp, synthetic construct
  source 1..18: mol_type = other DNA
tacaacgacgctctatag

SEQ ID NO: 13569 - DNA, 18 bp, synthetic construct
  source 1..18: mol_type = other DNA
tacaacggctcactgtag

SEQ ID NO: 13570 - DNA, 18 bp, synthetic construct
  source 1..18: mol_type = other DNA
taccacgcctcaatatag

SEQ ID NO: 13571 - DNA, 18 bp, synthetic construct
  source 1..18: mol_type = other DNA
taccacgtctcactatcg

SEQ ID NO: 13572 - DNA, 18 bp, synthetic construct
  source 1..18: mol_type = other DNA
taccgcgactcactagag

SEQ ID NO: 13573 - DNA, 18 bp, synthetic construct
  source 1..18: mol_type = other DNA
tactaagactcaatatcg

SEQ ID NO: 13574 - DNA, 18 bp, synthetic construct
  source 1..18: mol_type = other DNA
tactacaacacactatcg

SEQ ID NO: 13575 - DNA, 18 bp, synthetic construct
  source 1..18: mol_type = other DNA
tactacaacccactatcg

SEQ ID NO: 13576 - DNA, 18 bp, synthetic construct
  source 1..18: mol_type = other DNA
tactacaacccattatag

SEQ ID NO: 13577 - DNA, 18 bp, synthetic construct
  source 1..18: mol_type = other DNA
tactacgaaacactagag

SEQ ID NO: 13578 - DNA, 18 bp, synthetic construct
  source 1..18: mol_type = other DNA
tactacgacacacaagag

SEQ ID NO: 13579 - DNA, 18 bp, synthetic construct
  source 1..18: mol_type = other DNA
tactacgacaccctttag

SEQ ID NO: 13580 - DNA, 18 bp, synthetic construct
  source 1..18: mol_type = other DNA
tactacgactcacatgag

SEQ ID NO: 13581 - DNA, 18 bp, synthetic construct
  source 1..18: mol_type = other DNA
tactacgactcacccaag

SEQ ID NO: 13582 - DNA, 18 bp, synthetic construct
  source 1..18: mol_type = other DNA
tactacgagacagtatag

SEQ ID NO: 13583 - DNA, 18 bp, synthetic construct
  source 1..18: mol_type = other DNA
tactacggcacacaatag

SEQ ID NO: 13584 - DNA, 18 bp, synthetic construct
  source 1..18: mol_type = other DNA
tactacggcacattatag

SEQ ID NO: 13585 - DNA, 18 bp, synthetic construct
  source 1..18: mol_type = other DNA
tactacgtctcaccatcg

SEQ ID NO: 13586 - DNA, 18 bp, synthetic construct
  source 1..18: mol_type = other DNA
tactacgtctcactacgg

SEQ ID NO: 13587 - DNA, 18 bp, synthetic construct
  source 1..18: mol_type = other DNA
tactactacgcactgtag

SEQ ID NO: 13588 - DNA, 18 bp, synthetic construct
  source 1..18: mol_type = other DNA
tactaggactcactaacg

SEQ ID NO: 13589 - DNA, 18 bp, synthetic construct
  source 1..18: mol_type = other DNA
tactaggactcactgaag

SEQ ID NO: 13590 - DNA, 18 bp, synthetic construct
  source 1..18: mol_type = other DNA
tactaggcctcactaaag

SEQ ID NO: 13591 - DNA, 18 bp, synthetic construct
  source 1..18: mol_type = other DNA
tactatgactcaccatcg

SEQ ID NO: 13592 - DNA, 18 bp, synthetic construct
  source 1..18: mol_type = other DNA
tactattactcactagag

SEQ ID NO: 13593 - DNA, 18 bp, synthetic construct
  source 1..18: mol_type = other DNA
tactccgacacactatgg

SEQ ID NO: 13594 - DNA, 18 bp, synthetic construct
  source 1..18: mol_type = other DNA
tactccgactctatatag

SEQ ID NO: 13595 - DNA, 18 bp, synthetic construct
  source 1..18: mol_type = other DNA
tactgcgacgcaccatag

SEQ ID NO: 13596 - DNA, 18 bp, synthetic construct
  source 1..18: mol_type = other DNA
tactgcgattcactaaag

SEQ ID NO: 13597 - DNA, 18 bp, synthetic construct
  source 1..18: mol_type = other DNA
tactgctactcactaaag

SEQ ID NO: 13598 - DNA, 18 bp, synthetic construct
  source 1..18: mol_type = other DNA
tagaaagactcactgtag

SEQ ID NO: 13599 - DNA, 18 bp, synthetic construct
  source 1..18: mol_type = other DNA
tagaacaactcactacag

SEQ ID NO: 13600 - DNA, 18 bp, synthetic construct
  source 1..18: mol_type = other DNA
tagaacgactcaatacag

SEQ ID NO: 13601 - DNA, 18 bp, synthetic construct
  source 1..18: mol_type = other DNA
tagaacgactgacaatag

SEQ ID NO: 13602 - DNA, 18 bp, synthetic construct
  source 1..18: mol_type = other DNA
tagaacgcctcactaaag

SEQ ID NO: 13603 - DNA, 18 bp, synthetic construct
  source 1..18: mol_type = other DNA
tagaaggactcactagag

SEQ ID NO: 13604 - DNA, 18 bp, synthetic construct
  source 1..18: mol_type = other DNA
taggatgacgcactatag

SEQ ID NO: 13605 - DNA, 18 bp, synthetic construct
  source 1..18: mol_type = other DNA
tagtacaactcacgacag

SEQ ID NO: 13606 - DNA, 18 bp, synthetic construct
  source 1..18: mol_type = other DNA
tagtacgacgcactcaag

SEQ ID NO: 13607 - DNA, 18 bp, synthetic construct
  source 1..18: mol_type = other DNA
tagtacgactaaataaag

SEQ ID NO: 13608 - DNA, 18 bp, synthetic construct
  source 1..18: mol_type = other DNA
tagtacgactcattaacg

SEQ ID NO: 13609 - DNA, 18 bp, synthetic construct
  source 1..18: mol_type = other DNA
tagtacgactccgtacag

SEQ ID NO: 13610 - DNA, 18 bp, synthetic construct
  source 1..18: mol_type = other DNA
tagtacgactctatatcg

SEQ ID NO: 13611 - DNA, 18 bp, synthetic construct
  source 1..18: mol_type = other DNA
tagtacgactctctcaag

SEQ ID NO: 13612 - DNA, 18 bp, synthetic construct
  source 1..18: mol_type = other DNA
tagtacgactctctgaag

SEQ ID NO: 13613 - DNA, 18 bp, synthetic construct
  source 1..18: mol_type = other DNA
tagtacgtcgcaatatag

SEQ ID NO: 13614 - DNA, 18 bp, synthetic construct
  source 1..18: mol_type = other DNA
tagtactgttcactatag

SEQ ID NO: 13615 - DNA, 18 bp, synthetic construct
  source 1..18: mol_type = other DNA
tagtaggactcaatgtag

SEQ ID NO: 13616 - DNA, 18 bp, synthetic construct
  source 1..18: mol_type = other DNA
tagtatgactctctttag

SEQ ID NO: 13617 - DNA, 18 bp, synthetic construct
  source 1..18: mol_type = other DNA
tagtgcgactcactaacg

SEQ ID NO: 13618 - DNA, 18 bp, synthetic construct
  source 1..18: mol_type = other DNA
tataacgaatcactataa

SEQ ID NO: 13619 - DNA, 18 bp, synthetic construct
  source 1..18: mol_type = other DNA
tataacgactcactctaa

SEQ ID NO: 13620 - DNA, 18 bp, synthetic construct
  source 1..18: mol_type = other DNA
tataacgactcagtatgg

SEQ ID NO: 13621 - DNA, 18 bp, synthetic construct
  source 1..18: mol_type = other DNA
tataacgcgtcactatag

SEQ ID NO: 13622 - DNA, 18 bp, synthetic construct
  source 1..18: mol_type = other DNA
tatagcgactcactatcg

SEQ ID NO: 13623 - DNA, 18 bp, synthetic construct
  source 1..18: mol_type = other DNA
tatcacgacccaatatag

SEQ ID NO: 13624 - DNA, 18 bp, synthetic construct
  source 1..18: mol_type = other DNA
tatcacgactcactctcg

SEQ ID NO: 13625 - DNA, 18 bp, synthetic construct
  source 1..18: mol_type = other DNA
tatcacgactcatgatag

SEQ ID NO: 13626 - DNA, 18 bp, synthetic construct
  source 1..18: mol_type = other DNA
tatcacgagacactatag

SEQ ID NO: 13627 - DNA, 18 bp, synthetic construct
  source 1..18: mol_type = other DNA
tatcaggactcacaatag

SEQ ID NO: 13628 - DNA, 18 bp, synthetic construct
  source 1..18: mol_type = other DNA
tatcgcgactcactttag

SEQ ID NO: 13629 - DNA, 18 bp, synthetic construct
  source 1..18: mol_type = other DNA
tatgacgacttactatcg

SEQ ID NO: 13630 - DNA, 18 bp, synthetic construct
  source 1..18: mol_type = other DNA
tatgacgacttactctag

SEQ ID NO: 13631 - DNA, 18 bp, synthetic construct
  source 1..18: mol_type = other DNA
tatgactacgcactatag

SEQ ID NO: 13632 - DNA, 18 bp, synthetic construct
  source 1..18: mol_type = other DNA
tattaagacgcaatatag

SEQ ID NO: 13633 - DNA, 18 bp, synthetic construct
  source 1..18: mol_type = other DNA
tattacaactaactacag

SEQ ID NO: 13634 - DNA, 18 bp, synthetic construct
  source 1..18: mol_type = other DNA
tattaccacttactgtag

SEQ ID NO: 13635 - DNA, 18 bp, synthetic construct
  source 1..18: mol_type = other DNA
tattacgacccaccacag

SEQ ID NO: 13636 - DNA, 18 bp, synthetic construct
  source 1..18: mol_type = other DNA
tattacgacccagtataa

SEQ ID NO: 13637 - DNA, 18 bp, synthetic construct
  source 1..18: mol_type = other DNA
tattacgacgcaacatag

SEQ ID NO: 13638 - DNA, 18 bp, synthetic construct
  source 1..18: mol_type = other DNA
tattacgactcaatttat

SEQ ID NO: 13639 - DNA, 18 bp, synthetic construct
  source 1..18: mol_type = other DNA
tattacgactcacaagcg

SEQ ID NO: 13640 - DNA, 18 bp, synthetic construct
  source 1..18: mol_type = other DNA
tattacgactcacaaggg

SEQ ID NO: 13641 - DNA, 18 bp, synthetic construct
  source 1..18: mol_type = other DNA
tattacgactcactcggg

SEQ ID NO: 13642 - DNA, 18 bp, synthetic construct
  source 1..18: mol_type = other DNA
tattacgactcagcgtag

SEQ ID NO: 13643 - DNA, 18 bp, synthetic construct
  source 1..18: mol_type = other DNA
tattacgactcagtaagg

SEQ ID NO: 13644 - DNA, 18 bp, synthetic construct
  source 1..18: mol_type = other DNA
tattacgactgattatgg

SEQ ID NO: 13645 - DNA, 18 bp, synthetic construct
  source 1..18: mol_type = other DNA
tattacgattcactatca

SEQ ID NO: 13646 - DNA, 18 bp, synthetic construct
  source 1..18: mol_type = other DNA
tattacgcatcactaaag

SEQ ID NO: 13647 - DNA, 18 bp, synthetic construct
  source 1..18: mol_type = other DNA
tattacgcctcactaacg

SEQ ID NO: 13648 - DNA, 18 bp, synthetic construct
  source 1..18: mol_type = other DNA
tattacgcctcactctcg

SEQ ID NO: 13649 - DNA, 18 bp, synthetic construct
  source 1..18: mol_type = other DNA
tattacgcctcactgcag

SEQ ID NO: 13650 - DNA, 18 bp, synthetic construct
  source 1..18: mol_type = other DNA
tattacgcctcactgtcg

SEQ ID NO: 13651 - DNA, 18 bp, synthetic construct
  source 1..18: mol_type = other DNA
tattacgcctgtctatag

SEQ ID NO: 13652 - DNA, 18 bp, synthetic construct
  source 1..18: mol_type = other DNA
tattacggatcactctag

SEQ ID NO: 13653 - DNA, 18 bp, synthetic construct
  source 1..18: mol_type = other DNA
tattacgtctcactagcg

SEQ ID NO: 13654 - DNA, 18 bp, synthetic construct
  source 1..18: mol_type = other DNA
tattacgtctctctataa

SEQ ID NO: 13655 - DNA, 18 bp, synthetic construct
  source 1..18: mol_type = other DNA
tattactgctaactatag

SEQ ID NO: 13656 - DNA, 18 bp, synthetic construct
  source 1..18: mol_type = other DNA
tattagaactcactgtag

SEQ ID NO: 13657 - DNA, 18 bp, synthetic construct
  source 1..18: mol_type = other DNA
tattaggactcagtacag

SEQ ID NO: 13658 - DNA, 18 bp, synthetic construct
  source 1..18: mol_type = other DNA
tattaggactctgtatag

SEQ ID NO: 13659 - DNA, 18 bp, synthetic construct
  source 1..18: mol_type = other DNA
tattaggagtcacaatag

SEQ ID NO: 13660 - DNA, 18 bp, synthetic construct
  source 1..18: mol_type = other DNA
tattaggattcactatgg

SEQ ID NO: 13661 - DNA, 18 bp, synthetic construct
  source 1..18: mol_type = other DNA
tattatgacccactatcg

SEQ ID NO: 13662 - DNA, 18 bp, synthetic construct
  source 1..18: mol_type = other DNA
tattatgactcactatca

SEQ ID NO: 13663 - DNA, 18 bp, synthetic construct
  source 1..18: mol_type = other DNA
tattatgactcagtgtag

SEQ ID NO: 13664 - DNA, 18 bp, synthetic construct
  source 1..18: mol_type = other DNA
tattatgagtcactctag

SEQ ID NO: 13665 - DNA, 18 bp, synthetic construct
  source 1..18: mol_type = other DNA
tattccgacccaatatag

SEQ ID NO: 13666 - DNA, 18 bp, synthetic construct
  source 1..18: mol_type = other DNA
tattccgactcaatgtag

SEQ ID NO: 13667 - DNA, 18 bp, synthetic construct
  source 1..18: mol_type = other DNA
tattccgactcaccatcg

SEQ ID NO: 13668 - DNA, 18 bp, synthetic construct
  source 1..18: mol_type = other DNA
tattgcgactaactctag

SEQ ID NO: 13669 - DNA, 18 bp, synthetic construct
  source 1..18: mol_type = other DNA
tattgcgaggcactatag

SEQ ID NO: 13670 - DNA, 18 bp, synthetic construct
  source 1..18: mol_type = other DNA
tcagacttctcactatag

SEQ ID NO: 13671 - DNA, 18 bp, synthetic construct
  source 1..18: mol_type = other DNA
tcaggctactcactatag

SEQ ID NO: 13672 - DNA, 18 bp, synthetic construct
  source 1..18: mol_type = other DNA
tcataagactcaccaaag

SEQ ID NO: 13673 - DNA, 18 bp, synthetic construct
  source 1..18: mol_type = other DNA
tcatacaattcaatatag

SEQ ID NO: 13674 - DNA, 18 bp, synthetic construct
  source 1..18: mol_type = other DNA
tcataccacttactacag

SEQ ID NO: 13675 - DNA, 18 bp, synthetic construct
  source 1..18: mol_type = other DNA
tcatacctctcactatcg

SEQ ID NO: 13676 - DNA, 18 bp, synthetic construct
  source 1..18: mol_type = other DNA
tcatacgaatcacaatcg

SEQ ID NO: 13677 - DNA, 18 bp, synthetic construct
  source 1..18: mol_type = other DNA
tcatacgaatctctgtag

SEQ ID NO: 13678 - DNA, 18 bp, synthetic construct
  source 1..18: mol_type = other DNA
tcatacgacactctatcg

SEQ ID NO: 13679 - DNA, 18 bp, synthetic construct
  source 1..18: mol_type = other DNA
tcatacgactctcgttag

SEQ ID NO: 13680 - DNA, 18 bp, synthetic construct
  source 1..18: mol_type = other DNA
tcatacggatcattatag

SEQ ID NO: 13681 - DNA, 18 bp, synthetic construct
  source 1..18: mol_type = other DNA
tcatacgtcttactagag

SEQ ID NO: 13682 - DNA, 18 bp, synthetic construct
  source 1..18: mol_type = other DNA
tcatactacttactatcg

SEQ ID NO: 13683 - DNA, 18 bp, synthetic construct
  source 1..18: mol_type = other DNA
tcatactgctcaatatag

SEQ ID NO: 13684 - DNA, 18 bp, synthetic construct
  source 1..18: mol_type = other DNA
tcataggaatcaatatag

SEQ ID NO: 13685 - DNA, 18 bp, synthetic construct
  source 1..18: mol_type = other DNA
tcataggacacattatag

SEQ ID NO: 13686 - DNA, 18 bp, synthetic construct
  source 1..18: mol_type = other DNA
tcatatgacacactatgg

SEQ ID NO: 13687 - DNA, 18 bp, synthetic construct
  source 1..18: mol_type = other DNA
tcatattactgactatag

SEQ ID NO: 13688 - DNA, 18 bp, synthetic construct
  source 1..18: mol_type = other DNA
tcatccgacttacaatag

SEQ ID NO: 13689 - DNA, 18 bp, synthetic construct
  source 1..18: mol_type = other DNA
tcctacgaatcacgatag

SEQ ID NO: 13690 - DNA, 18 bp, synthetic construct
  source 1..18: mol_type = other DNA
tcctacgactcactgtgg

SEQ ID NO: 13691 - DNA, 18 bp, synthetic construct
  source 1..18: mol_type = other DNA
tcctactactcactatgg

SEQ ID NO: 13692 - DNA, 18 bp, synthetic construct
  source 1..18: mol_type = other DNA
tcgtaccactctctatag

SEQ ID NO: 13693 - DNA, 18 bp, synthetic construct
  source 1..18: mol_type = other DNA
tcgtacgactcataatag

SEQ ID NO: 13694 - DNA, 18 bp, synthetic construct
  source 1..18: mol_type = other DNA
tcgtacgtcgcactatag

SEQ ID NO: 13695 - DNA, 18 bp, synthetic construct
  source 1..18: mol_type = other DNA
tcgtatgactcactaaag

SEQ ID NO: 13696 - DNA, 18 bp, synthetic construct
  source 1..18: mol_type = other DNA
tcgtccgactcaatatag

SEQ ID NO: 13697 - DNA, 18 bp, synthetic construct
  source 1..18: mol_type = other DNA
tctcgcgactcactatag

SEQ ID NO: 13698 - DNA, 18 bp, synthetic construct
  source 1..18: mol_type = other DNA
tcttacgaccgactatag

SEQ ID NO: 13699 - DNA, 18 bp, synthetic construct
  source 1..18: mol_type = other DNA
tcttacgagtcactaaag

SEQ ID NO: 13700 - DNA, 18 bp, synthetic construct
  source 1..18: mol_type = other DNA
tcttccgactcactaaag

SEQ ID NO: 13701 - DNA, 18 bp, synthetic construct
  source 1..18: mol_type = other DNA
tgaaacaacttactatag

SEQ ID NO: 13702 - DNA, 18 bp, synthetic construct
  source 1..18: mol_type = other DNA
tgaaacgactcactgtcg

SEQ ID NO: 13703 - DNA, 18 bp, synthetic construct
  source 1..18: mol_type = other DNA
tgaaactactcagtatag

SEQ ID NO: 13704 - DNA, 18 bp, synthetic construct
  source 1..18: mol_type = other DNA
tgaaccgactcactacag

SEQ ID NO: 13705 - DNA, 18 bp, synthetic construct
  source 1..18: mol_type = other DNA
tgagacgaatcaatatag

SEQ ID NO: 13706 - DNA, 18 bp, synthetic construct
  source 1..18: mol_type = other DNA
tgagacgactcaataaag

SEQ ID NO: 13707 - DNA, 18 bp, synthetic construct
  source 1..18: mol_type = other DNA
tgataaggctcactttag

SEQ ID NO: 13708 - DNA, 18 bp, synthetic construct
  source 1..18: mol_type = other DNA
tgatacaacccactacag

SEQ ID NO: 13709 - DNA, 18 bp, synthetic construct
  source 1..18: mol_type = other DNA
tgatacaactcaccatcg

SEQ ID NO: 13710 - DNA, 18 bp, synthetic construct
  source 1..18: mol_type = other DNA
tgatacaactccctgtag

SEQ ID NO: 13711 - DNA, 18 bp, synthetic construct
  source 1..18: mol_type = other DNA
tgatacaagtcactacag

SEQ ID NO: 13712 - DNA, 18 bp, synthetic construct
  source 1..18: mol_type = other DNA
tgataccacgcactacag

SEQ ID NO: 13713 - DNA, 18 bp, synthetic construct
  source 1..18: mol_type = other DNA
tgataccactcacttgag

SEQ ID NO: 13714 - DNA, 18 bp, synthetic construct
  source 1..18: mol_type = other DNA
tgatacccctcactaaag

SEQ ID NO: 13715 - DNA, 18 bp, synthetic construct
  source 1..18: mol_type = other DNA
tgataccgctcactaaag

SEQ ID NO: 13716 - DNA, 18 bp, synthetic construct
  source 1..18: mol_type = other DNA
tgatacgactctacatag

SEQ ID NO: 13717 - DNA, 18 bp, synthetic construct
  source 1..18: mol_type = other DNA
tgatacgactctctccag

SEQ ID NO: 13718 - DNA, 18 bp, synthetic construct
  source 1..18: mol_type = other DNA
tgatacgagtcactgtgg

SEQ ID NO: 13719 - DNA, 18 bp, synthetic construct
  source 1..18: mol_type = other DNA
tgatacgtgtcactacag

SEQ ID NO: 13720 - DNA, 18 bp, synthetic construct
  source 1..18: mol_type = other DNA
tgatactactccctctag

SEQ ID NO: 13721 - DNA, 18 bp, synthetic construct
  source 1..18: mol_type = other DNA
tgatactacttagtatag

SEQ ID NO: 13722 - DNA, 18 bp, synthetic construct
  source 1..18: mol_type = other DNA
tgatacttctcactacag

SEQ ID NO: 13723 - DNA, 18 bp, synthetic construct
  source 1..18: mol_type = other DNA
tgatatgacatactatag

SEQ ID NO: 13724 - DNA, 18 bp, synthetic construct
  source 1..18: mol_type = other DNA
tgatgcgactctctatgg

SEQ ID NO: 13725 - DNA, 18 bp, synthetic construct
  source 1..18: mol_type = other DNA
tgatgttactcactatag

SEQ ID NO: 13726 - DNA, 18 bp, synthetic construct
  source 1..18: mol_type = other DNA
tgctactactcacaatag

SEQ ID NO: 13727 - DNA, 18 bp, synthetic construct
  source 1..18: mol_type = other DNA
tggtacgactcacattag

SEQ ID NO: 13728 - DNA, 18 bp, synthetic construct
  source 1..18: mol_type = other DNA
tggtacgacttattatag

SEQ ID NO: 13729 - DNA, 18 bp, synthetic construct
  source 1..18: mol_type = other DNA
tgtcacgactgactatag

SEQ ID NO: 13730 - DNA, 18 bp, synthetic construct
  source 1..18: mol_type = other DNA
tgtcaggactcactatag

SEQ ID NO: 13731 - DNA, 18 bp, synthetic construct
  source 1..18: mol_type = other DNA
tgttaagacacactatag

SEQ ID NO: 13732 - DNA, 18 bp, synthetic construct
  source 1..18: mol_type = other DNA
tgttacgactcactccag

SEQ ID NO: 13733 - DNA, 18 bp, synthetic construct
  source 1..18: mol_type = other DNA
tgttacgactcactgtcg

SEQ ID NO: 13734 - DNA, 18 bp, synthetic construct
  source 1..18: mol_type = other DNA
tgttacggctcactttag

SEQ ID NO: 13735 - DNA, 18 bp, synthetic construct
  source 1..18: mol_type = other DNA
tgttacgtctcaccatag

SEQ ID NO: 13736 - DNA, 18 bp, synthetic construct
  source 1..18: mol_type = other DNA
tgttgcgactcactctag

SEQ ID NO: 13737 - DNA, 18 bp, synthetic construct
  source 1..18: mol_type = other DNA
ttaaaagcctcactatag

SEQ ID NO: 13738 - DNA, 18 bp, synthetic construct
  source 1..18: mol_type = other DNA
ttaaacgacccaatatag

SEQ ID NO: 13739 - DNA, 18 bp, synthetic construct
  source 1..18: mol_type = other DNA
ttaaacgactcactttgg

SEQ ID NO: 13740 - DNA, 18 bp, synthetic construct
  source 1..18: mol_type = other DNA
ttaaacgcctcactctag

SEQ ID NO: 13741 - DNA, 18 bp, synthetic construct
  source 1..18: mol_type = other DNA
ttaaacgtctcactataa

SEQ ID NO: 13742 - DNA, 18 bp, synthetic construct
  source 1..18: mol_type = other DNA
ttaaatgactcactataa

SEQ ID NO: 13743 - DNA, 18 bp, synthetic construct
  source 1..18: mol_type = other DNA
ttacaccactcactgtag

SEQ ID NO: 13744 - DNA, 18 bp, synthetic construct
  source 1..18: mol_type = other DNA
ttacaggacttactatag

SEQ ID NO: 13745 - DNA, 18 bp, synthetic construct
  source 1..18: mol_type = other DNA
ttacatgactcactatcg

SEQ ID NO: 13746 - DNA, 18 bp, synthetic construct
  source 1..18: mol_type = other DNA
ttagacgactcactgaag

SEQ ID NO: 13747 - DNA, 18 bp, synthetic construct
  source 1..18: mol_type = other DNA
ttagacggctctctatag

SEQ ID NO: 13748 - DNA, 18 bp, synthetic construct
  source 1..18: mol_type = other DNA
ttataagactcactacaa

SEQ ID NO: 13749 - DNA, 18 bp, synthetic construct
  source 1..18: mol_type = other DNA
ttataagactcattctag

SEQ ID NO: 13750 - DNA, 18 bp, synthetic construct
  source 1..18: mol_type = other DNA
ttataagattccctatag

SEQ ID NO: 13751 - DNA, 18 bp, synthetic construct
  source 1..18: mol_type = other DNA
ttatacaactctctataa

SEQ ID NO: 13752 - DNA, 18 bp, synthetic construct
  source 1..18: mol_type = other DNA
ttatacacctcactctag

SEQ ID NO: 13753 - DNA, 18 bp, synthetic construct
  source 1..18: mol_type = other DNA
ttataccactcactgtcg

SEQ ID NO: 13754 - DNA, 18 bp, synthetic construct
  source 1..18: mol_type = other DNA
ttatacgaagtactatag

SEQ ID NO: 13755 - DNA, 18 bp, synthetic construct
  source 1..18: mol_type = other DNA
ttatacgaatgattatag

SEQ ID NO: 13756 - DNA, 18 bp, synthetic construct
  source 1..18: mol_type = other DNA
ttatacgaccaaatatag

SEQ ID NO: 13757 - DNA, 18 bp, synthetic construct
  source 1..18: mol_type = other DNA
ttatacgacccagtttag

SEQ ID NO: 13758 - DNA, 18 bp, synthetic construct
  source 1..18: mol_type = other DNA
ttatacgactaactgtcg

SEQ ID NO: 13759 - DNA, 18 bp, synthetic construct
  source 1..18: mol_type = other DNA
ttatacgactcactaaca

SEQ ID NO: 13760 - DNA, 18 bp, synthetic construct
  source 1..18: mol_type = other DNA
ttatacgactcactaacc

SEQ ID NO: 13761 - DNA, 18 bp, synthetic construct
  source 1..18: mol_type = other DNA
ttatacgactcagtctcg

SEQ ID NO: 13762 - DNA, 18 bp, synthetic construct
  source 1..18: mol_type = other DNA
ttatacgcctaacaatag

SEQ ID NO: 13763 - DNA, 18 bp, synthetic construct
  source 1..18: mol_type = other DNA
ttatacgcctcacttcag

SEQ ID NO: 13764 - DNA, 18 bp, synthetic construct
  source 1..18: mol_type = other DNA
ttatacgcgtcacaatag

SEQ ID NO: 13765 - DNA, 18 bp, synthetic construct
  source 1..18: mol_type = other DNA
ttatacgtgtcacgatag

SEQ ID NO: 13766 - DNA, 18 bp, synthetic construct
  source 1..18: mol_type = other DNA
ttatagaactcaccatag

SEQ ID NO: 13767 - DNA, 18 bp, synthetic construct
  source 1..18: mol_type = other DNA
ttataggactcaatatgg

SEQ ID NO: 13768 - DNA, 18 bp, synthetic construct
  source 1..18: mol_type = other DNA
ttatatgactcactggag

SEQ ID NO: 13769 - DNA, 18 bp, synthetic construct
  source 1..18: mol_type = other DNA
ttatatggatcactatag

SEQ ID NO: 13770 - DNA, 18 bp, synthetic construct
  source 1..18: mol_type = other DNA
ttatccgacccactctag

SEQ ID NO: 13771 - DNA, 18 bp, synthetic construct
  source 1..18: mol_type = other DNA
ttatccgacgctctatag

SEQ ID NO: 13772 - DNA, 18 bp, synthetic construct
  source 1..18: mol_type = other DNA
ttatccgactcattagag

SEQ ID NO: 13773 - DNA, 18 bp, synthetic construct
  source 1..18: mol_type = other DNA
ttatccgactccctatgg

SEQ ID NO: 13774 - DNA, 18 bp, synthetic construct
  source 1..18: mol_type = other DNA
ttatccgagtcaccatag

SEQ ID NO: 13775 - DNA, 18 bp, synthetic construct
  source 1..18: mol_type = other DNA
ttatccgcctcaccatag

SEQ ID NO: 13776 - DNA, 18 bp, synthetic construct
  source 1..18: mol_type = other DNA
ttatgcgactcactgaag

SEQ ID NO: 13777 - DNA, 18 bp, synthetic construct
  source 1..18: mol_type = other DNA
ttatgcgccccactatag

SEQ ID NO: 13778 - DNA, 18 bp, synthetic construct
  source 1..18: mol_type = other DNA
ttatgtgactcactctag

SEQ ID NO: 13779 - DNA, 18 bp, synthetic construct
  source 1..18: mol_type = other DNA
ttctacaacgcactatag

SEQ ID NO: 13780 - DNA, 18 bp, synthetic construct
  source 1..18: mol_type = other DNA
ttctacgtctcactgtag

SEQ ID NO: 13781 - DNA, 18 bp, synthetic construct
  source 1..18: mol_type = other DNA
ttgtacgactcattatcg

SEQ ID NO: 13782 - DNA, 18 bp, synthetic construct
  source 1..18: mol_type = other DNA
ttgtctgactcactatag

SEQ ID NO: 13783 - DNA, 18 bp, synthetic construct
  source 1..18: mol_type = other DNA
ttttaagactcacgatag

SEQ ID NO: 13784 - DNA, 18 bp, synthetic construct
  source 1..18: mol_type = other DNA
ttttacgaagcactatag

SEQ ID NO: 13785 - DNA, 18 bp, synthetic construct
  source 1..18: mol_type = other DNA
ttttacgactcactatct

SEQ ID NO: 13786 - DNA, 18 bp, synthetic construct
  source 1..18: mol_type = other DNA
ttttacgactcactccag

SEQ ID NO: 13787 - DNA, 18 bp, synthetic construct
  source 1..18: mol_type = other DNA
ttttacgagtcactatat

SEQ ID NO: 13788 - DNA, 18 bp, synthetic construct
  source 1..18: mol_type = other DNA
ttttatgcctcactatag

SEQ ID NO: 13789 - DNA, 18 bp, synthetic construct
  source 1..18: mol_type = other DNA
ttttgcgcctcactatag

SEQ ID NO: 13790 - DNA, 18 bp, synthetic construct
  source 1..18: mol_type = other DNA
taaatggactctctatag

SEQ ID NO: 13791 - DNA, 18 bp, synthetic construct
  source 1..18: mol_type = other DNA
caaaacgtctcactaaag

SEQ ID NO: 13792 - DNA, 18 bp, synthetic construct
  source 1..18: mol_type = other DNA
ttatgcgactcacttaag

SEQ ID NO: 13793 - DNA, 18 bp, synthetic construct
  source 1..18: mol_type = other DNA
aaattcgactcgctttag

SEQ ID NO: 13794 - DNA, 18 bp, synthetic construct
  source 1..18: mol_type = other DNA
ttattggactcactctag

SEQ ID NO: 13795 - DNA, 18 bp, synthetic construct
  source 1..18: mol_type = other DNA
taattagactcactgcag

SEQ ID NO: 13796 - DNA, 18 bp, synthetic construct
  source 1..18: mol_type = other DNA
ttattggactcactattg

SEQ ID NO: 13797 - DNA, 18 bp, synthetic construct
  source 1..18: mol_type = other DNA
tatatcgactcactaaag

SEQ ID NO: 13798 - DNA, 18 bp, synthetic construct
  source 1..18: mol_type = other DNA
aaataggactcacttcag

SEQ ID NO: 13799 - DNA, 18 bp, synthetic construct
  source 1..18: mol_type = other DNA
ctttatgactcactatag

SEQ ID NO: 13800 - DNA, 18 bp, synthetic construct
  source 1..18: mol_type = other DNA
tactacgtatctctatag

SEQ ID NO: 13801 - DNA, 18 bp, synthetic construct
  source 1..18: mol_type = other DNA
tatcatgactcactatgg

SEQ ID NO: 13802 - DNA, 18 bp, synthetic construct
  source 1..18: mol_type = other DNA
taatactactagttatag

SEQ ID NO: 13803 - DNA, 18 bp, synthetic construct
  source 1..18: mol_type = other DNA
aagtacgcgtcactatag

SEQ ID NO: 13804 - DNA, 18 bp, synthetic construct
  source 1..18: mol_type = other DNA
tttcacgactcactctag

SEQ ID NO: 13805 - DNA, 18 bp, synthetic construct
  source 1..18: mol_type = other DNA
taattggactcgctattg

SEQ ID NO: 13806 - DNA, 18 bp, synthetic construct
  source 1..18: mol_type = other DNA
ttattcgcctcactaaag

SEQ ID NO: 13807 - DNA, 18 bp, synthetic construct
  source 1..18: mol_type = other DNA
taaaccgcatcactatag

SEQ ID NO: 13808 - DNA, 18 bp, synthetic construct
  source 1..18: mol_type = other DNA
tgttacgactcactttgg

SEQ ID NO: 13809 - DNA, 18 bp, synthetic construct
  source 1..18: mol_type = other DNA
tagaacgtctcactctag

SEQ ID NO: 13810 - DNA, 18 bp, synthetic construct
  source 1..18: mol_type = other DNA
ttatatgactcatgatag

SEQ ID NO: 13811 - DNA, 18 bp, synthetic construct
  source 1..18: mol_type = other DNA
ttttgcgactcaccatag

SEQ ID NO: 13812 - DNA, 18 bp, synthetic construct
  source 1..18: mol_type = other DNA
taatgcgtctcgctattg

SEQ ID NO: 13813 - DNA, 18 bp, synthetic construct
  source 1..18: mol_type = other DNA
caattcaactcactacag

SEQ ID NO: 13814 - DNA, 18 bp, synthetic construct
  source 1..18: mol_type = other DNA
taaaatgtctcactttag

SEQ ID NO: 13815 - DNA, 18 bp, synthetic construct
  source 1..18: mol_type = other DNA
taatacaacagcctatag

SEQ ID NO: 13816 - DNA, 18 bp, synthetic construct
  source 1..18: mol_type = other DNA
aattacgactcgctatcg

SEQ ID NO: 13817 - DNA, 18 bp, synthetic construct
  source 1..18: mol_type = other DNA
ttaagcgactcactacag

SEQ ID NO: 13818 - DNA, 18 bp, synthetic construct
  source 1..18: mol_type = other DNA
tatttcgactcaccatcg

SEQ ID NO: 13819 - DNA, 18 bp, synthetic construct
  source 1..18: mol_type = other DNA
ttatgcgactcacttcag

SEQ ID NO: 13820 - DNA, 18 bp, synthetic construct
  source 1..18: mol_type = other DNA
aaatgcgcctcactattg

SEQ ID NO: 13821 - DNA, 18 bp, synthetic construct
  source 1..18: mol_type = other DNA
taataaaactcacaagag

SEQ ID NO: 13822 - DNA, 18 bp, synthetic construct
  source 1..18: mol_type = other DNA
taatataactctctacag

SEQ ID NO: 13823 - DNA, 18 bp, synthetic construct
  source 1..18: mol_type = other DNA
tattaggactcactcaag

SEQ ID NO: 13824 - DNA, 18 bp, synthetic construct
  source 1..18: mol_type = other DNA
ctttgcgactcactatag

SEQ ID NO: 13825 - DNA, 18 bp, synthetic construct
  source 1..18: mol_type = other DNA
ttatgcgtctcactaaag

SEQ ID NO: 13826 - DNA, 18 bp, synthetic construct
  source 1..18: mol_type = other DNA
ttatatgactcgctacag

SEQ ID NO: 13827 - DNA, 18 bp, synthetic construct
  source 1..18: mol_type = other DNA
ttttacgcctcactgtag

SEQ ID NO: 13828 - DNA, 18 bp, synthetic construct
  source 1..18: mol_type = other DNA
ttttgcgactcactagag

SEQ ID NO: 13829 - DNA, 18 bp, synthetic construct
  source 1..18: mol_type = other DNA
taaatcgactcgctattg

SEQ ID NO: 13830 - DNA, 18 bp, synthetic construct
  source 1..18: mol_type = other DNA
aaatcagactcactatcg

SEQ ID NO: 13831 - DNA, 18 bp, synthetic construct
  source 1..18: mol_type = other DNA
taattcgtctcaccattg

SEQ ID NO: 13832 - DNA, 18 bp, synthetic construct
  source 1..18: mol_type = other DNA
taaaacgtcgcactacag

SEQ ID NO: 13833 - DNA, 18 bp, synthetic construct
  source 1..18: mol_type = other DNA
taatcgaactcactttag

SEQ ID NO: 13834 - DNA, 18 bp, synthetic construct
  source 1..18: mol_type = other DNA
taattcgcatcactattg

SEQ ID NO: 13835 - DNA, 18 bp, synthetic construct
  source 1..18: mol_type = other DNA
taaatagactcactacag

SEQ ID NO: 13836 - DNA, 18 bp, synthetic construct
  source 1..18: mol_type = other DNA
taataaaactcaccaaag

SEQ ID NO: 13837 - DNA, 18 bp, synthetic construct
  source 1..18: mol_type = other DNA
gaatgcgactcacactag

SEQ ID NO: 13838 - DNA, 18 bp, synthetic construct
  source 1..18: mol_type = other DNA
tatatcgactcactctag

SEQ ID NO: 13839 - DNA, 18 bp, synthetic construct
  source 1..18: mol_type = other DNA
ttattcgtctcacgatag

SEQ ID NO: 13840 - DNA, 18 bp, synthetic construct
  source 1..18: mol_type = other DNA
ttaaacgactcgctattg

SEQ ID NO: 13841 - DNA, 18 bp, synthetic construct
  source 1..18: mol_type = other DNA
agattcgactcactatcg

SEQ ID NO: 13842 - DNA, 18 bp, synthetic construct
  source 1..18: mol_type = other DNA
caatatgactcactcttg

SEQ ID NO: 13843 - DNA, 18 bp, synthetic construct
  source 1..18: mol_type = other DNA
gtattcgactcactctag

SEQ ID NO: 13844 - DNA, 18 bp, synthetic construct
  source 1..18: mol_type = other DNA
taatacgactcacctctg

SEQ ID NO: 13845 - DNA, 18 bp, synthetic construct
  source 1..18: mol_type = other DNA
taattcggttcactaaag

SEQ ID NO: 13846 - DNA, 18 bp, synthetic construct
  source 1..18: mol_type = other DNA
aaaaacgactccctttag

SEQ ID NO: 13847 - DNA, 18 bp, synthetic construct
  source 1..18: mol_type = other DNA
ctatacgactcactaagg

SEQ ID NO: 13848 - DNA, 18 bp, synthetic construct
  source 1..18: mol_type = other DNA
taaaatgagacactatag

SEQ ID NO: 13849 - DNA, 18 bp, synthetic construct
  source 1..18: mol_type = other DNA
taatacgtttcactcgag

SEQ ID NO: 13850 - DNA, 18 bp, synthetic construct
  source 1..18: mol_type = other DNA
taatgcgtctctctctag

SEQ ID NO: 13851 - DNA, 18 bp, synthetic construct
  source 1..18: mol_type = other DNA
tcaaacgactaactacag

SEQ ID NO: 13852 - DNA, 18 bp, synthetic construct
  source 1..18: mol_type = other DNA
tgatacgagccactagag

SEQ ID NO: 13853 - DNA, 18 bp, synthetic construct
  source 1..18: mol_type = other DNA
cttttcgactcactatag

SEQ ID NO: 13854 - DNA, 18 bp, synthetic construct
  source 1..18: mol_type = other DNA
aaacgcgactcactaaag

SEQ ID NO: 13855 - DNA, 18 bp, synthetic construct
  source 1..18: mol_type = other DNA
tattacgactcagttttg

SEQ ID NO: 13856 - DNA, 18 bp, synthetic construct
  source 1..18: mol_type = other DNA
taattcagctcgctatag

SEQ ID NO: 13857 - DNA, 18 bp, synthetic construct
  source 1..18: mol_type = other DNA
aaaaacgactcactactg

SEQ ID NO: 13858 - DNA, 18 bp, synthetic construct
  source 1..18: mol_type = other DNA
caattagactcactacag

SEQ ID NO: 13859 - DNA, 18 bp, synthetic construct
  source 1..18: mol_type = other DNA
aaatacgactcaattgag

SEQ ID NO: 13860 - DNA, 18 bp, synthetic construct
  source 1..18: mol_type = other DNA
atttacgactcagtatag

SEQ ID NO: 13861 - DNA, 18 bp, synthetic construct
  source 1..18: mol_type = other DNA
taatgcgactcacaccag

SEQ ID NO: 13862 - DNA, 18 bp, synthetic construct
  source 1..18: mol_type = other DNA
tagtatgactcacttgag

SEQ ID NO: 13863 - DNA, 18 bp, synthetic construct
  source 1..18: mol_type = other DNA
taatgcgactcacttatg

SEQ ID NO: 13864 - DNA, 18 bp, synthetic construct
  source 1..18: mol_type = other DNA
taatacgactctgttcag

SEQ ID NO: 13865 - DNA, 18 bp, synthetic construct
  source 1..18: mol_type = other DNA
aaataagactcagtatcg

SEQ ID NO: 13866 - DNA, 18 bp, synthetic construct
  source 1..18: mol_type = other DNA
ctatacaactcactacag

SEQ ID NO: 13867 - DNA, 18 bp, synthetic construct
  source 1..18: mol_type = other DNA
taattcgactcacttctg

SEQ ID NO: 13868 - DNA, 18 bp, synthetic construct
  source 1..18: mol_type = other DNA
tttaacgcctcactatag

SEQ ID NO: 13869 - DNA, 18 bp, synthetic construct
  source 1..18: mol_type = other DNA
aaatgcgactcgctaaag

SEQ ID NO: 13870 - DNA, 18 bp, synthetic construct
  source 1..18: mol_type = other DNA
taaatagcctcactatag

SEQ ID NO: 13871 - DNA, 18 bp, synthetic construct
  source 1..18: mol_type = other DNA
aattccgactcactgtag

SEQ ID NO: 13872 - DNA, 18 bp, synthetic construct
  source 1..18: mol_type = other DNA
atataggactcacgatag

SEQ ID NO: 13873 - DNA, 18 bp, synthetic construct
  source 1..18: mol_type = other DNA
tattagaactcactttag

SEQ ID NO: 13874 - DNA, 18 bp, synthetic construct
  source 1..18: mol_type = other DNA
tattctaactcactatag

SEQ ID NO: 13875 - DNA, 18 bp, synthetic construct
  source 1..18: mol_type = other DNA
taaaatgactcgctattg

SEQ ID NO: 13876 - DNA, 18 bp, synthetic construct
  source 1..18: mol_type = other DNA
taattcgactcgctcaag

SEQ ID NO: 13877 - DNA, 18 bp, synthetic construct
  source 1..18: mol_type = other DNA
taatttgactccctattg

SEQ ID NO: 13878 - DNA, 18 bp, synthetic construct
  source 1..18: mol_type = other DNA
caaattgactcactatag

SEQ ID NO: 13879 - DNA, 18 bp, synthetic construct
  source 1..18: mol_type = other DNA
tattacgactcagtaatg

SEQ ID NO: 13880 - DNA, 18 bp, synthetic construct
  source 1..18: mol_type = other DNA
ttatacaactcgctatcg

SEQ ID NO: 13881 - DNA, 18 bp, synthetic construct
  source 1..18: mol_type = other DNA
ttatcggactcactattg

SEQ ID NO: 13882 - DNA, 18 bp, synthetic construct
  source 1..18: mol_type = other DNA
caatagaactctctatag

SEQ ID NO: 13883 - DNA, 18 bp, synthetic construct
  source 1..18: mol_type = other DNA
cgaaacgactcacgatag

SEQ ID NO: 13884 - DNA, 18 bp, synthetic construct
  source 1..18: mol_type = other DNA
taaaatgacgcactttag

SEQ ID NO: 13885 - DNA, 18 bp, synthetic construct
  source 1..18: mol_type = other DNA
taatactgttcactttag

SEQ ID NO: 13886 - DNA, 18 bp, synthetic construct
  source 1..18: mol_type = other DNA
tatcaggactcactacag

SEQ ID NO: 13887 - DNA, 18 bp, synthetic construct
  source 1..18: mol_type = other DNA
ttatgttactcactatag

SEQ ID NO: 13888 - DNA, 18 bp, synthetic construct
  source 1..18: mol_type = other DNA
ttttacgactcactttcg

SEQ ID NO: 13889 - DNA, 18 bp, synthetic construct
  source 1..18: mol_type = other DNA
ttaagcgactcactttag

SEQ ID NO: 13890 - DNA, 18 bp, synthetic construct
  source 1..18: mol_type = other DNA
taattggactcgctaaag

SEQ ID NO: 13891 - DNA, 18 bp, synthetic construct
  source 1..18: mol_type = other DNA
taatacgtatcgctaaag

SEQ ID NO: 13892 - DNA, 18 bp, synthetic construct
  source 1..18: mol_type = other DNA
tcttacgactcgctatcg

SEQ ID NO: 13893 - DNA, 18 bp, synthetic construct
  source 1..18: mol_type = other DNA
ttatacgcatcactattg

SEQ ID NO: 13894 - DNA, 18 bp, synthetic construct
  source 1..18: mol_type = other DNA
taatacaactcacttagg

SEQ ID NO: 13895 - DNA, 18 bp, synthetic construct
  source 1..18: mol_type = other DNA
caatacaactctctaaag

SEQ ID NO: 13896 - DNA, 18 bp, synthetic construct
  source 1..18: mol_type = other DNA
taactggactcactattg

SEQ ID NO: 13897 - DNA, 18 bp, synthetic construct
  source 1..18: mol_type = other DNA
taattgaactcactttag

SEQ ID NO: 13898 - DNA, 18 bp, synthetic construct
  source 1..18: mol_type = other DNA
ctatgcgactcactaaag

SEQ ID NO: 13899 - DNA, 18 bp, synthetic construct
  source 1..18: mol_type = other DNA
tataacaactcactctag

SEQ ID NO: 13900 - DNA, 18 bp, synthetic construct
  source 1..18: mol_type = other DNA
ttaaacgactcacttttg

SEQ ID NO: 13901 - DNA, 18 bp, synthetic construct
  source 1..18: mol_type = other DNA
taattcgactcgcttttg

SEQ ID NO: 13902 - DNA, 18 bp, synthetic construct
  source 1..18: mol_type = other DNA
aattacggctcgctatag

SEQ ID NO: 13903 - DNA, 18 bp, synthetic construct
  source 1..18: mol_type = other DNA
taatataactcgctatcg

SEQ ID NO: 13904 - DNA, 18 bp, synthetic construct
  source 1..18: mol_type = other DNA
taattcggatcaccatag

SEQ ID NO: 13905 - DNA, 18 bp, synthetic construct
  source 1..18: mol_type = other DNA
tattgcgcctcactattg

SEQ ID NO: 13906 - DNA, 18 bp, synthetic construct
  source 1..18: mol_type = other DNA
aaatgcgactcactgaag

SEQ ID NO: 13907 - DNA, 18 bp, synthetic construct
  source 1..18: mol_type = other DNA
taatacaactcactgccg

SEQ ID NO: 13908 - DNA, 18 bp, synthetic construct
  source 1..18: mol_type = other DNA
tagtacgacactctatcg

SEQ ID NO: 13909 - DNA, 18 bp, synthetic construct
  source 1..18: mol_type = other DNA
taatgcgcctcaccattg

SEQ ID NO: 13910 - DNA, 18 bp, synthetic construct
  source 1..18: mol_type = other DNA
taatataactctctaaag

SEQ ID NO: 13911 - DNA, 18 bp, synthetic construct
  source 1..18: mol_type = other DNA
tattagaactcactacag

SEQ ID NO: 13912 - DNA, 18 bp, synthetic construct
  source 1..18: mol_type = other DNA
ttatacggctctctattg

SEQ ID NO: 13913 - DNA, 18 bp, synthetic construct
  source 1..18: mol_type = other DNA
taattcgtctcgctgtag

SEQ ID NO: 13914 - DNA, 18 bp, synthetic construct
  source 1..18: mol_type = other DNA
taattaaactcactctag

SEQ ID NO: 13915 - DNA, 18 bp, synthetic construct
  source 1..18: mol_type = other DNA
tacaacgtctcactctag

SEQ ID NO: 13916 - DNA, 18 bp, synthetic construct
  source 1..18: mol_type = other DNA
ttattgcactcactatag

SEQ ID NO: 13917 - DNA, 18 bp, synthetic construct
  source 1..18: mol_type = other DNA
ttattcgactcacttcag

SEQ ID NO: 13918 - DNA, 18 bp, synthetic construct
  source 1..18: mol_type = other DNA
atatgcgactcaccatag

SEQ ID NO: 13919 - DNA, 18 bp, synthetic construct
  source 1..18: mol_type = other DNA
tataacaactcactatgg

SEQ ID NO: 13920 - DNA, 18 bp, synthetic construct
  source 1..18: mol_type = other DNA
ttatgcgactcactcaag

SEQ ID NO: 13921 - DNA, 18 bp, synthetic construct
  source 1..18: mol_type = other DNA
taaatcgcctcactaaag

SEQ ID NO: 13922 - DNA, 18 bp, synthetic construct
  source 1..18: mol_type = other DNA
aaaagcgactcactattg

SEQ ID NO: 13923 - DNA, 18 bp, synthetic construct
  source 1..18: mol_type = other DNA
taatatgcatcactattg

SEQ ID NO: 13924 - DNA, 18 bp, synthetic construct
  source 1..18: mol_type = other DNA
ttaaacgtctcactaaag

SEQ ID NO: 13925 - DNA, 18 bp, synthetic construct
  source 1..18: mol_type = other DNA
taatgcaactcactactg

SEQ ID NO: 13926 - DNA, 18 bp, synthetic construct
  source 1..18: mol_type = other DNA
ttttgcgactcactattg

SEQ ID NO: 13927 - DNA, 18 bp, synthetic construct
  source 1..18: mol_type = other DNA
taatacgcctcacttagg

SEQ ID NO: 13928 - DNA, 18 bp, synthetic construct
  source 1..18: mol_type = other DNA
taattcgaatcgctattg

SEQ ID NO: 13929 - DNA, 18 bp, synthetic construct
  source 1..18: mol_type = other DNA
taatacgaatcgatattg

SEQ ID NO: 13930 - DNA, 18 bp, synthetic construct
  source 1..18: mol_type = other DNA
taattcgacgcaatattg

SEQ ID NO: 13931 - DNA, 18 bp, synthetic construct
  source 1..18: mol_type = other DNA
taattcgactagctctag

SEQ ID NO: 13932 - DNA, 18 bp, synthetic construct
  source 1..18: mol_type = other DNA
taattcgattcgcaatag

SEQ ID NO: 13933 - DNA, 18 bp, synthetic construct
  source 1..18: mol_type = other DNA
taattggactcactgttg

SEQ ID NO: 13934 - DNA, 18 bp, synthetic construct
  source 1..18: mol_type = other DNA
tcattcgactcaccattg

SEQ ID NO: 13935 - DNA, 18 bp, synthetic construct
  source 1..18: mol_type = other DNA
tcattcgagtcgctatag

SEQ ID NO: 13936 - DNA, 18 bp, synthetic construct
  source 1..18: mol_type = other DNA
atattcgacccactatag

SEQ ID NO: 13937 - DNA, 18 bp, synthetic construct
  source 1..18: mol_type = other DNA
caaaacgactcgctttag

SEQ ID NO: 13938 - DNA, 18 bp, synthetic construct
  source 1..18: mol_type = other DNA
caataccacccactattg

SEQ ID NO: 13939 - DNA, 18 bp, synthetic construct
  source 1..18: mol_type = other DNA
taacaggactcgctctag

SEQ ID NO: 13940 - DNA, 18 bp, synthetic construct
  source 1..18: mol_type = other DNA
taataagactcactttta

SEQ ID NO: 13941 - DNA, 18 bp, synthetic construct
  source 1..18: mol_type = other DNA
taataagactctccattg

SEQ ID NO: 13942 - DNA, 18 bp, synthetic construct
  source 1..18: mol_type = other DNA
taatacatctcactgttg

SEQ ID NO: 13943 - DNA, 18 bp, synthetic construct
  source 1..18: mol_type = other DNA
taatacgacacgtgatag

SEQ ID NO: 13944 - DNA, 18 bp, synthetic construct
  source 1..18: mol_type = other DNA
taatacgtctctctatta

SEQ ID NO: 13945 - DNA, 18 bp, synthetic construct
  source 1..18: mol_type = other DNA
taataggactcgttaaag

SEQ ID NO: 13946 - DNA, 18 bp, synthetic construct
  source 1..18: mol_type = other DNA
taattcgactccctcaag

SEQ ID NO: 13947 - DNA, 18 bp, synthetic construct
  source 1..18: mol_type = other DNA
taattcgcctcactgaag

SEQ ID NO: 13948 - DNA, 18 bp, synthetic construct
  source 1..18: mol_type = other DNA
taattctactctgtatag

SEQ ID NO: 13949 - DNA, 18 bp, synthetic construct
  source 1..18: mol_type = other DNA
taattgaacgcactatag

SEQ ID NO: 13950 - DNA, 18 bp, synthetic construct
  source 1..18: mol_type = other DNA
tattacgactcactaata

SEQ ID NO: 13951 - DNA, 18 bp, synthetic construct
  source 1..18: mol_type = other DNA
ttattggactcacgatag

SEQ ID NO: 13952 - DNA, 18 bp, synthetic construct
  source 1..18: mol_type = other DNA
aaatacgaaccactagag

SEQ ID NO: 13953 - DNA, 18 bp, synthetic construct
  source 1..18: mol_type = other DNA
aaatacgactaatcatag

SEQ ID NO: 13954 - DNA, 18 bp, synthetic construct
  source 1..18: mol_type = other DNA
aaatacgagacactgtag

SEQ ID NO: 13955 - DNA, 18 bp, synthetic construct
  source 1..18: mol_type = other DNA
aaatacgatgcacaatag

SEQ ID NO: 13956 - DNA, 18 bp, synthetic construct
  source 1..18: mol_type = other DNA
aaatactagtgactatag

SEQ ID NO: 13957 - DNA, 18 bp, synthetic construct
  source 1..18: mol_type = other DNA
aaatcggactcactatcg

SEQ ID NO: 13958 - DNA, 18 bp, synthetic construct
  source 1..18: mol_type = other DNA
aagcacgactcactaaag

SEQ ID NO: 13959 - DNA, 18 bp, synthetic construct
  source 1..18: mol_type = other DNA
aattctgactcactatag

SEQ ID NO: 13960 - DNA, 18 bp, synthetic construct
  source 1..18: mol_type = other DNA
caatacaactctctctag

SEQ ID NO: 13961 - DNA, 18 bp, synthetic construct
  source 1..18: mol_type = other DNA
caatacacctcagtatag

SEQ ID NO: 13962 - DNA, 18 bp, synthetic construct
  source 1..18: mol_type = other DNA
caatacgaagctctatag

SEQ ID NO: 13963 - DNA, 18 bp, synthetic construct
  source 1..18: mol_type = other DNA
caatacgactcacttagg

SEQ ID NO: 13964 - DNA, 18 bp, synthetic construct
  source 1..18: mol_type = other DNA
caatacgcgtcactaaag

SEQ ID NO: 13965 - DNA, 18 bp, synthetic construct
  source 1..18: mol_type = other DNA
cattacaacttactatag

SEQ ID NO: 13966 - DNA, 18 bp, synthetic construct
  source 1..18: mol_type = other DNA
cattgcaactcactatag

SEQ ID NO: 13967 - DNA, 18 bp, synthetic construct
  source 1..18: mol_type = other DNA
cgatacgactcactgtcg

SEQ ID NO: 13968 - DNA, 18 bp, synthetic construct
  source 1..18: mol_type = other DNA
ctatacgactctcgatag

SEQ ID NO: 13969 - DNA, 18 bp, synthetic construct
  source 1..18: mol_type = other DNA
ctatacgactgattatag

SEQ ID NO: 13970 - DNA, 18 bp, synthetic construct
  source 1..18: mol_type = other DNA
gaatccgattcacaatag

SEQ ID NO: 13971 - DNA, 18 bp, synthetic construct
  source 1..18: mol_type = other DNA
taaaacgacataccatag

SEQ ID NO: 13972 - DNA, 18 bp, synthetic construct
  source 1..18: mol_type = other DNA
taaagagactcactttag

SEQ ID NO: 13973 - DNA, 18 bp, synthetic construct
  source 1..18: mol_type = other DNA
taaagcgactcacaacag

SEQ ID NO: 13974 - DNA, 18 bp, synthetic construct
  source 1..18: mol_type = other DNA
taacacgaaatactatag

SEQ ID NO: 13975 - DNA, 18 bp, synthetic construct
  source 1..18: mol_type = other DNA
taacacgactatttatag

SEQ ID NO: 13976 - DNA, 18 bp, synthetic construct
  source 1..18: mol_type = other DNA
taataaaactcactaagg

SEQ ID NO: 13977 - DNA, 18 bp, synthetic construct
  source 1..18: mol_type = other DNA
taataagacacactcaag

SEQ ID NO: 13978 - DNA, 18 bp, synthetic construct
  source 1..18: mol_type = other DNA
taatacaacactcgatag

SEQ ID NO: 13979 - DNA, 18 bp, synthetic construct
  source 1..18: mol_type = other DNA
taatacaattgactgtag

SEQ ID NO: 13980 - DNA, 18 bp, synthetic construct
  source 1..18: mol_type = other DNA
taataccgctaagtatag

SEQ ID NO: 13981 - DNA, 18 bp, synthetic construct
  source 1..18: mol_type = other DNA
taatacgaatacctatcg

SEQ ID NO: 13982 - DNA, 18 bp, synthetic construct
  source 1..18: mol_type = other DNA
taatacgactacatgtag

SEQ ID NO: 13983 - DNA, 18 bp, synthetic construct
  source 1..18: mol_type = other DNA
taatacgactcaaccaag

SEQ ID NO: 13984 - DNA, 18 bp, synthetic construct
  source 1..18: mol_type = other DNA
taatacgcatcaatatgg

SEQ ID NO: 13985 - DNA, 18 bp, synthetic construct
  source 1..18: mol_type = other DNA
taatactacacactgcag

SEQ ID NO: 13986 - DNA, 18 bp, synthetic construct
  source 1..18: mol_type = other DNA
taatactacagactctag

SEQ ID NO: 13987 - DNA, 18 bp, synthetic construct
  source 1..18: mol_type = other DNA
taatagaactcaacatag

SEQ ID NO: 13988 - DNA, 18 bp, synthetic construct
  source 1..18: mol_type = other DNA
taataggtctctctagag

SEQ ID NO: 13989 - DNA, 18 bp, synthetic construct
  source 1..18: mol_type = other DNA
taatatacctcactaaag

SEQ ID NO: 13990 - DNA, 18 bp, synthetic construct
  source 1..18: mol_type = other DNA
taatcagattcactgtag

SEQ ID NO: 13991 - DNA, 18 bp, synthetic construct
  source 1..18: mol_type = other DNA
taatccgactccctttcg

SEQ ID NO: 13992 - DNA, 18 bp, synthetic construct
  source 1..18: mol_type = other DNA
taatccgcctcactttgg

SEQ ID NO: 13993 - DNA, 18 bp, synthetic construct
  source 1..18: mol_type = other DNA
taatccgtctcaccaaag

SEQ ID NO: 13994 - DNA, 18 bp, synthetic construct
  source 1..18: mol_type = other DNA
taatgcaactcactaacg

SEQ ID NO: 13995 - DNA, 18 bp, synthetic construct
  source 1..18: mol_type = other DNA
taatgcgccacactacag

SEQ ID NO: 13996 - DNA, 18 bp, synthetic construct
  source 1..18: mol_type = other DNA
taatgctactcacaatgg

SEQ ID NO: 13997 - DNA, 18 bp, synthetic construct
  source 1..18: mol_type = other DNA
tactaccactccgtatag

SEQ ID NO: 13998 - DNA, 18 bp, synthetic construct
  source 1..18: mol_type = other DNA
tactatgacttactctag

SEQ ID NO: 13999 - DNA, 18 bp, synthetic construct
  source 1..18: mol_type = other DNA
tagtacgcctcactaagg

SEQ ID NO: 14000 - DNA, 18 bp, synthetic construct
  source 1..18: mol_type = other DNA
tagtactacttactacag

SEQ ID NO: 14001 - DNA, 18 bp, synthetic construct
  source 1..18: mol_type = other DNA
tatcccaactcactatag

SEQ ID NO: 14002 - DNA, 18 bp, synthetic construct
  source 1..18: mol_type = other DNA
tattccgactcattttag

SEQ ID NO: 14003 - DNA, 18 bp, synthetic construct
  source 1..18: mol_type = other DNA
tcagacgattcactacag

SEQ ID NO: 14004 - DNA, 18 bp, synthetic construct
  source 1..18: mol_type = other DNA
tcataagtctcactaaag

SEQ ID NO: 14005 - DNA, 18 bp, synthetic construct
  source 1..18: mol_type = other DNA
tcatacgcctcacaatgg

SEQ ID NO: 14006 - DNA, 18 bp, synthetic construct
  source 1..18: mol_type = other DNA
tcatacgtctcacgctag

SEQ ID NO: 14007 - DNA, 18 bp, synthetic construct
  source 1..18: mol_type = other DNA
tgacatgactcagtatag

SEQ ID NO: 14008 - DNA, 18 bp, synthetic construct
  source 1..18: mol_type = other DNA
ttagacgactcaccaaag

SEQ ID NO: 14009 - DNA, 18 bp, synthetic construct
  source 1..18: mol_type = other DNA
ttatatgactcactgtgg

SEQ ID NO: 14010 - DNA, 18 bp, synthetic construct
  source 1..18: mol_type = other DNA
ttatccgacgcactctag

SEQ ID NO: 14011 - DNA, 18 bp, synthetic construct
  source 1..18: mol_type = other DNA
ttatcggactcactacag

SEQ ID NO: 14012 - DNA, 18 bp, synthetic construct
  source 1..18: mol_type = other DNA
aattgcgactcactaaag

SEQ ID NO: 14013 - DNA, 18 bp, synthetic construct
  source 1..18: mol_type = other DNA
taattggtctcactaaag

SEQ ID NO: 14014 - DNA, 18 bp, synthetic construct
  source 1..18: mol_type = other DNA
tgattcaactcactacag

SEQ ID NO: 14015 - DNA, 18 bp, synthetic construct
  source 1..18: mol_type = other DNA
ctattcaactcactatag

SEQ ID NO: 14016 - DNA, 18 bp, synthetic construct
  source 1..18: mol_type = other DNA
tgatatcactcactttag

SEQ ID NO: 14017 - DNA, 18 bp, synthetic construct
  source 1..18: mol_type = other DNA
tataaggactcactaaag

SEQ ID NO: 14018 - DNA, 18 bp, synthetic construct
  source 1..18: mol_type = other DNA
aagttcgactcactttag

SEQ ID NO: 14019 - DNA, 18 bp, synthetic construct
  source 1..18: mol_type = other DNA
taattaaactcactttag

SEQ ID NO: 14020 - DNA, 18 bp, synthetic construct
  source 1..18: mol_type = other DNA
ttaatcgactcactgtag

SEQ ID NO: 14021 - DNA, 18 bp, synthetic construct
  source 1..18: mol_type = other DNA
taattagactcactcttg

SEQ ID NO: 14022 - DNA, 18 bp, synthetic construct
  source 1..18: mol_type = other DNA
gtatgcgactcactaaag

SEQ ID NO: 14023 - DNA, 18 bp, synthetic construct
  source 1..18: mol_type = other DNA
taataggactcacctaag

SEQ ID NO: 14024 - DNA, 18 bp, synthetic construct
  source 1..18: mol_type = other DNA
tgttacaactcactaaag

SEQ ID NO: 14025 - DNA, 18 bp, synthetic construct
  source 1..18: mol_type = other DNA
ttatgcgtctcactagag

SEQ ID NO: 14026 - DNA, 18 bp, synthetic construct
  source 1..18: mol_type = other DNA
aattacgactcgctattg

SEQ ID NO: 14027 - DNA, 18 bp, synthetic construct
  source 1..18: mol_type = other DNA
taatgcgactcactcatg

SEQ ID NO: 14028 - DNA, 18 bp, synthetic construct
  source 1..18: mol_type = other DNA
tagtacgatccactaaag

SEQ ID NO: 14029 - DNA, 18 bp, synthetic construct
  source 1..18: mol_type = other DNA
aaatataactcactatgg

SEQ ID NO: 14030 - DNA, 18 bp, synthetic construct
  source 1..18: mol_type = other DNA
tatagcgactcactaaag

SEQ ID NO: 14031 - DNA, 18 bp, synthetic construct
  source 1..18: mol_type = other DNA
tggaacgactcactacag

SEQ ID NO: 14032 - DNA, 18 bp, synthetic construct
  source 1..18: mol_type = other DNA
ttatacgactcacttagg

SEQ ID NO: 14033 - DNA, 18 bp, synthetic construct
  source 1..18: mol_type = other DNA
taatactcctctctgtag

SEQ ID NO: 14034 - DNA, 18 bp, synthetic construct
  source 1..18: mol_type = other DNA
ttataggtctcactctag

SEQ ID NO: 14035 - DNA, 18 bp, synthetic construct
  source 1..18: mol_type = other DNA
ttatgcgtctcactttag

SEQ ID NO: 14036 - DNA, 18 bp, synthetic construct
  source 1..18: mol_type = other DNA
caactcgactcactattg

SEQ ID NO: 14037 - DNA, 18 bp, synthetic construct
  source 1..18: mol_type = other DNA
taattcgtctcacgctag

SEQ ID NO: 14038 - DNA, 18 bp, synthetic construct
  source 1..18: mol_type = other DNA
tattccgactcacttaag

SEQ ID NO: 14039 - DNA, 18 bp, synthetic construct
  source 1..18: mol_type = other DNA
ttatacgactcaataacg

SEQ ID NO: 14040 - DNA, 18 bp, synthetic construct
  source 1..18: mol_type = other DNA
tatttcgactcaccattg

SEQ ID NO: 14041 - DNA, 18 bp, synthetic construct
  source 1..18: mol_type = other DNA
ttaatcgcctcactatag

SEQ ID NO: 14042 - DNA, 18 bp, synthetic construct
  source 1..18: mol_type = other DNA
taatccggcacactattg

SEQ ID NO: 14043 - DNA, 18 bp, synthetic construct
  source 1..18: mol_type = other DNA
caaagcgactcactaaag

SEQ ID NO: 14044 - DNA, 18 bp, synthetic construct
  source 1..18: mol_type = other DNA
ttatacgtctcactaagg

SEQ ID NO: 14045 - DNA, 18 bp, synthetic construct
  source 1..18: mol_type = other DNA
taatactacttgctattg

SEQ ID NO: 14046 - DNA, 18 bp, synthetic construct
  source 1..18: mol_type = other DNA
tatttcgactcgctaaag

SEQ ID NO: 14047 - DNA, 18 bp, synthetic construct
  source 1..18: mol_type = other DNA
tgtttcgactcactattg

SEQ ID NO: 14048 - DNA, 18 bp, synthetic construct
  source 1..18: mol_type = other DNA
taatgccacacactattg

SEQ ID NO: 14049 - DNA, 18 bp, synthetic construct
  source 1..18: mol_type = other DNA
taatatgtgtcactaaag

SEQ ID NO: 14050 - DNA, 18 bp, synthetic construct
  source 1..18: mol_type = other DNA
tattagtactcaccatag

SEQ ID NO: 14051 - DNA, 18 bp, synthetic construct
  source 1..18: mol_type = other DNA
tatttcggctcactattg

SEQ ID NO: 14052 - DNA, 18 bp, synthetic construct
  source 1..18: mol_type = other DNA
tattgcgactcacttcag

SEQ ID NO: 14053 - DNA, 18 bp, synthetic construct
  source 1..18: mol_type = other DNA
aaattcgactcgctaaag

SEQ ID NO: 14054 - DNA, 18 bp, synthetic construct
  source 1..18: mol_type = other DNA
caattcgactcgctatcg

SEQ ID NO: 14055 - DNA, 18 bp, synthetic construct
  source 1..18: mol_type = other DNA
taattcggcttactattg

SEQ ID NO: 14056 - DNA, 18 bp, synthetic construct
  source 1..18: mol_type = other DNA
tatttcgactcgctagag

SEQ ID NO: 14057 - DNA, 18 bp, synthetic construct
  source 1..18: mol_type = other DNA
aaattggactcactatcg

SEQ ID NO: 14058 - DNA, 18 bp, synthetic construct
  source 1..18: mol_type = other DNA
caatacgactctctcttg

SEQ ID NO: 14059 - DNA, 18 bp, synthetic construct
  source 1..18: mol_type = other DNA
caatacgactgattattg

SEQ ID NO: 14060 - DNA, 18 bp, synthetic construct
  source 1..18: mol_type = other DNA
caattcgatccactatag

SEQ ID NO: 14061 - DNA, 18 bp, synthetic construct
  source 1..18: mol_type = other DNA
ccatacgactcgctttag

SEQ ID NO: 14062 - DNA, 18 bp, synthetic construct
  source 1..18: mol_type = other DNA
taatacgatttactgttg

SEQ ID NO: 14063 - DNA, 18 bp, synthetic construct
  source 1..18: mol_type = other DNA
taatatgtgtcactattg

SEQ ID NO: 14064 - DNA, 18 bp, synthetic construct
  source 1..18: mol_type = other DNA
taatttggctcactatgg

SEQ ID NO: 14065 - DNA, 18 bp, synthetic construct
  source 1..18: mol_type = other DNA
ttatgcgactcgctaaag

SEQ ID NO: 14066 - DNA, 18 bp, synthetic construct
  source 1..18: mol_type = other DNA
ttattcgcctcactatcg

SEQ ID NO: 14067 - DNA, 18 bp, synthetic construct
  source 1..18: mol_type = other DNA
ttctacgactcactaatg

SEQ ID NO: 14068 - DNA, 18 bp, synthetic construct
  source 1..18: mol_type = other DNA
tttttcgacgcactatag

SEQ ID NO: 14069 - DNA, 18 bp, synthetic construct
  source 1..18: mol_type = other DNA
atttacgactcactagag

SEQ ID NO: 14070 - DNA, 18 bp, synthetic construct
  source 1..18: mol_type = other DNA
ctatacgactcactgcag

SEQ ID NO: 14071 - DNA, 18 bp, synthetic construct
  source 1..18: mol_type = other DNA
taatagacgtcactatag

SEQ ID NO: 14072 - DNA, 18 bp, synthetic construct
  source 1..18: mol_type = other DNA
tactacgtcccactctag

SEQ ID NO: 14073 - DNA, 18 bp, synthetic construct
  source 1..18: mol_type = other DNA
tagtccgagacactatag

SEQ ID NO: 14074 - DNA, 18 bp, synthetic construct
  source 1..18: mol_type = other DNA
tcataagtctcaatatag

SEQ ID NO: 14075 - DNA, 18 bp, synthetic construct
  source 1..18: mol_type = other DNA
tcatacgagtccttatag

SEQ ID NO: 14076 - DNA, 18 bp, synthetic construct
  source 1..18: mol_type = other DNA
tgttacgcctcactctag

SEQ ID NO: 14077 - DNA, 18 bp, synthetic construct
  source 1..18: mol_type = other DNA
ttatcggactcacaatag

SEQ ID NO: 14078 - DNA, 18 bp, synthetic construct
  source 1..18: mol_type = other DNA
ttttacgaccgactatag

SEQ ID NO: 14079 - DNA, 18 bp, synthetic construct
  source 1..18: mol_type = other DNA
ttttacgacttactgtag

SEQ ID NO: 14080 - DNA, 18 bp, synthetic construct
  source 1..18: mol_type = other DNA
tattatgactctctgtag

SEQ ID NO: 14081 - DNA, 18 bp, synthetic construct
  source 1..18: mol_type = other DNA
taatgcgactcacatcag

SEQ ID NO: 14082 - DNA, 18 bp, synthetic construct
  source 1..18: mol_type = other DNA
tgttacgcctcactttag

SEQ ID NO: 14083 - DNA, 18 bp, synthetic construct
  source 1..18: mol_type = other DNA
ttttacgtctcaccatag

SEQ ID NO: 14084 - DNA, 18 bp, synthetic construct
  source 1..18: mol_type = other DNA
ttttacgactcgctattg

SEQ ID NO: 14085 - DNA, 18 bp, synthetic construct
  source 1..18: mol_type = other DNA
taaacgaactcactatag

SEQ ID NO: 14086 - DNA, 18 bp, synthetic construct
  source 1..18: mol_type = other DNA
taatacgtctcgctactg

SEQ ID NO: 14087 - DNA, 18 bp, synthetic construct
  source 1..18: mol_type = other DNA
taaaccgactcactactg

SEQ ID NO: 14088 - DNA, 18 bp, synthetic construct
  source 1..18: mol_type = other DNA
taatacaactcagtaatg

SEQ ID NO: 14089 - DNA, 18 bp, synthetic construct
  source 1..18: mol_type = other DNA
tataacgcctcactacag

SEQ ID NO: 14090 - DNA, 18 bp, synthetic construct
  source 1..18: mol_type = other DNA
agatgcgactcactaaag

SEQ ID NO: 14091 - DNA, 18 bp, synthetic construct
  source 1..18: mol_type = other DNA
taattcgactcgcaattg

SEQ ID NO: 14092 - DNA, 18 bp, synthetic construct
  source 1..18: mol_type = other DNA
aaattcaactcgctatag

SEQ ID NO: 14093 - DNA, 18 bp, synthetic construct
  source 1..18: mol_type = other DNA
tatttggactcgctatag

SEQ ID NO: 14094 - DNA, 18 bp, synthetic construct
  source 1..18: mol_type = other DNA
taatagaactcgctaaag

SEQ ID NO: 14095 - DNA, 18 bp, synthetic construct
  source 1..18: mol_type = other DNA
taattcgtctcagtacag

SEQ ID NO: 14096 - DNA, 18 bp, synthetic construct
  source 1..18: mol_type = other DNA
aagtaggactcacaatag

SEQ ID NO: 14097 - DNA, 18 bp, synthetic construct
  source 1..18: mol_type = other DNA
taaaccgtctcactaaag

SEQ ID NO: 14098 - DNA, 18 bp, synthetic construct
  source 1..18: mol_type = other DNA
taatgagtctcactctag

SEQ ID NO: 14099 - DNA, 18 bp, synthetic construct
  source 1..18: mol_type = other DNA
ttaaaggactcactatgg

SEQ ID NO: 14100 - DNA, 18 bp, synthetic construct
  source 1..18: mol_type = other DNA
ttatcagtctcactatag

SEQ ID NO: 14101 - DNA, 18 bp, synthetic construct
  source 1..18: mol_type = other DNA
tattacgcctcgctattg

SEQ ID NO: 14102 - DNA, 18 bp, synthetic construct
  source 1..18: mol_type = other DNA
aattaggactcactaaag

SEQ ID NO: 14103 - DNA, 18 bp, synthetic construct
  source 1..18: mol_type = other DNA
taataggtctcactcttg

SEQ ID NO: 14104 - DNA, 18 bp, synthetic construct
  source 1..18: mol_type = other DNA
ttatacgactcaccactg

SEQ ID NO: 14105 - DNA, 18 bp, synthetic construct
  source 1..18: mol_type = other DNA
taatacgtcgcacattag

SEQ ID NO: 14106 - DNA, 18 bp, synthetic construct
  source 1..18: mol_type = other DNA
ttatacaactcactcaag

SEQ ID NO: 14107 - DNA, 18 bp, synthetic construct
  source 1..18: mol_type = other DNA
ttatacgactcgatattg

SEQ ID NO: 14108 - DNA, 18 bp, synthetic construct
  source 1..18: mol_type = other DNA
taattagactcacactag

SEQ ID NO: 14109 - DNA, 18 bp, synthetic construct
  source 1..18: mol_type = other DNA
ttatacgactcgctaccg

SEQ ID NO: 14110 - DNA, 18 bp, synthetic construct
  source 1..18: mol_type = other DNA
aaatacaactctctttag

SEQ ID NO: 14111 - DNA, 18 bp, synthetic construct
  source 1..18: mol_type = other DNA
taatgcgcatcactgtag

SEQ ID NO: 14112 - DNA, 18 bp, synthetic construct
  source 1..18: mol_type = other DNA
tattaggactcaccctag

SEQ ID NO: 14113 - DNA, 18 bp, synthetic construct
  source 1..18: mol_type = other DNA
ctatacgcctcactaaag

SEQ ID NO: 14114 - DNA, 18 bp, synthetic construct
  source 1..18: mol_type = other DNA
ttattcgactcacactag

SEQ ID NO: 14115 - DNA, 18 bp, synthetic construct
  source 1..18: mol_type = other DNA
tagttcgactcactaatg

SEQ ID NO: 14116 - DNA, 18 bp, synthetic construct
  source 1..18: mol_type = other DNA
aaattcgactcacaatcg

SEQ ID NO: 14117 - DNA, 18 bp, synthetic construct
  source 1..18: mol_type = other DNA
aaataggactcactctgg

SEQ ID NO: 14118 - DNA, 18 bp, synthetic construct
  source 1..18: mol_type = other DNA
tgttgcgactcactaaag

SEQ ID NO: 14119 - DNA, 18 bp, synthetic construct
  source 1..18: mol_type = other DNA
ttaaacgtctcactatcg

SEQ ID NO: 14120 - DNA, 18 bp, synthetic construct
  source 1..18: mol_type = other DNA
tgattcgactctctttag

SEQ ID NO: 14121 - DNA, 18 bp, synthetic construct
  source 1..18: mol_type = other DNA
caattagactcactttag

SEQ ID NO: 14122 - DNA, 18 bp, synthetic construct
  source 1..18: mol_type = other DNA
taaaacgcctcactgttg

SEQ ID NO: 14123 - DNA, 18 bp, synthetic construct
  source 1..18: mol_type = other DNA
taattcaactcgctacag

SEQ ID NO: 14124 - DNA, 18 bp, synthetic construct
  source 1..18: mol_type = other DNA
atttacgactcactgtag

SEQ ID NO: 14125 - DNA, 18 bp, synthetic construct
  source 1..18: mol_type = other DNA
tattagaactcactaaag

SEQ ID NO: 14126 - DNA, 18 bp, synthetic construct
  source 1..18: mol_type = other DNA
taaatcgactctgtatag

SEQ ID NO: 14127 - DNA, 18 bp, synthetic construct
  source 1..18: mol_type = other DNA
acttaggactcactatag

SEQ ID NO: 14128 - DNA, 18 bp, synthetic construct
  source 1..18: mol_type = other DNA
ccatacgacactctatag

SEQ ID NO: 14129 - DNA, 18 bp, synthetic construct
  source 1..18: mol_type = other DNA
ttttaggactcactaaag

SEQ ID NO: 14130 - DNA, 18 bp, synthetic construct
  source 1..18: mol_type = other DNA
atattcgactcactattg

SEQ ID NO: 14131 - DNA, 18 bp, synthetic construct
  source 1..18: mol_type = other DNA
ttatacgtctcgctattg

SEQ ID NO: 14132 - DNA, 18 bp, synthetic construct
  source 1..18: mol_type = other DNA
taaaacgactcactcctg

SEQ ID NO: 14133 - DNA, 18 bp, synthetic construct
  source 1..18: mol_type = other DNA
taaagcgtctcactattg

SEQ ID NO: 14134 - DNA, 18 bp, synthetic construct
  source 1..18: mol_type = other DNA
ttttacgtctcactacag

SEQ ID NO: 14135 - DNA, 18 bp, synthetic construct
  source 1..18: mol_type = other DNA
ctatacgactcactcttg

SEQ ID NO: 14136 - DNA, 18 bp, synthetic construct
  source 1..18: mol_type = other DNA
taatacgcctcacttatg

SEQ ID NO: 14137 - DNA, 18 bp, synthetic construct
  source 1..18: mol_type = other DNA
ttttacgactcacactag

SEQ ID NO: 14138 - DNA, 18 bp, synthetic construct
  source 1..18: mol_type = other DNA
taatttgtctcactacag

SEQ ID NO: 14139 - DNA, 18 bp, synthetic construct
  source 1..18: mol_type = other DNA
tattacgtcccactttag

SEQ ID NO: 14140 - DNA, 18 bp, synthetic construct
  source 1..18: mol_type = other DNA
taataagactcactgatg

SEQ ID NO: 14141 - DNA, 18 bp, synthetic construct
  source 1..18: mol_type = other DNA
taataagactcagaattg

SEQ ID NO: 14142 - DNA, 18 bp, synthetic construct
  source 1..18: mol_type = other DNA
ttaaacgactcgctgtag

SEQ ID NO: 14143 - DNA, 18 bp, synthetic construct
  source 1..18: mol_type = other DNA
taatgcaattctctatag

SEQ ID NO: 14144 - DNA, 18 bp, synthetic construct
  source 1..18: mol_type = other DNA
caatacgactcgcttttg

SEQ ID NO: 14145 - DNA, 18 bp, synthetic construct
  source 1..18: mol_type = other DNA
taaaacgactcgatattg

SEQ ID NO: 14146 - DNA, 18 bp, synthetic construct
  source 1..18: mol_type = other DNA
taaagcgactcgctattg

SEQ ID NO: 14147 - DNA, 18 bp, synthetic construct
  source 1..18: mol_type = other DNA
taaatagactcactattg

SEQ ID NO: 14148 - DNA, 18 bp, synthetic construct
  source 1..18: mol_type = other DNA
taactcgactcggtatag

SEQ ID NO: 14149 - DNA, 18 bp, synthetic construct
  source 1..18: mol_type = other DNA
taagtcgactcactactg

SEQ ID NO: 14150 - DNA, 18 bp, synthetic construct
  source 1..18: mol_type = other DNA
taataagactcgttattg

SEQ ID NO: 14151 - DNA, 18 bp, synthetic construct
  source 1..18: mol_type = other DNA
taatacgactagccattg

SEQ ID NO: 14152 - DNA, 18 bp, synthetic construct
  source 1..18: mol_type = other DNA
taatacgactagctactg

SEQ ID NO: 14153 - DNA, 18 bp, synthetic construct
  source 1..18: mol_type = other DNA
taatacgtcccgctattg

SEQ ID NO: 14154 - DNA, 18 bp, synthetic construct
  source 1..18: mol_type = other DNA
taatactaatcgctattg

SEQ ID NO: 14155 - DNA, 18 bp, synthetic construct
  source 1..18: mol_type = other DNA
taataggactcgctaatg

SEQ ID NO: 14156 - DNA, 18 bp, synthetic construct
  source 1..18: mol_type = other DNA
taatccgactcggtattg

SEQ ID NO: 14157 - DNA, 18 bp, synthetic construct
  source 1..18: mol_type = other DNA
taatgcgactcgccattg

SEQ ID NO: 14158 - DNA, 18 bp, synthetic construct
  source 1..18: mol_type = other DNA
taatgcggctcgctattg

SEQ ID NO: 14159 - DNA, 18 bp, synthetic construct
  source 1..18: mol_type = other DNA
taattagactcgctataa

SEQ ID NO: 14160 - DNA, 18 bp, synthetic construct
  source 1..18: mol_type = other DNA
taattcgactaactcttg

SEQ ID NO: 14161 - DNA, 18 bp, synthetic construct
  source 1..18: mol_type = other DNA
taattcgactagctttag

SEQ ID NO: 14162 - DNA, 18 bp, synthetic construct
  source 1..18: mol_type = other DNA
taattcgactcgataaag

SEQ ID NO: 14163 - DNA, 18 bp, synthetic construct
  source 1..18: mol_type = other DNA
taattcgactcgctaaaa

SEQ ID NO: 14164 - DNA, 18 bp, synthetic construct
  source 1..18: mol_type = other DNA
taattcgactcgttttag

SEQ ID NO: 14165 - DNA, 18 bp, synthetic construct
  source 1..18: mol_type = other DNA
taattcgactgactcttg

SEQ ID NO: 14166 - DNA, 18 bp, synthetic construct
  source 1..18: mol_type = other DNA
tactacgactcgcaattg

SEQ ID NO: 14167 - DNA, 18 bp, synthetic construct
  source 1..18: mol_type = other DNA
tactacgactcgcttttg

SEQ ID NO: 14168 - DNA, 18 bp, synthetic construct
  source 1..18: mol_type = other DNA
tatttcgactcactattc

SEQ ID NO: 14169 - DNA, 18 bp, synthetic construct
  source 1..18: mol_type = other DNA
tgattcgactcgatatag

SEQ ID NO: 14170 - DNA, 18 bp, synthetic construct
  source 1..18: mol_type = other DNA
tgattcgtctcgctatag

SEQ ID NO: 14171 - DNA, 18 bp, synthetic construct
  source 1..18: mol_type = other DNA
ttattcaactcgctatag

SEQ ID NO: 14172 - DNA, 18 bp, synthetic construct
  source 1..18: mol_type = other DNA
aaataccactcactcttg

SEQ ID NO: 14173 - DNA, 18 bp, synthetic construct
  source 1..18: mol_type = other DNA
aaataccactcgctttag

SEQ ID NO: 14174 - DNA, 18 bp, synthetic construct
  source 1..18: mol_type = other DNA
aaatacgactcgctcaag

SEQ ID NO: 14175 - DNA, 18 bp, synthetic construct
  source 1..18: mol_type = other DNA
aaatacggctggctatag

SEQ ID NO: 14176 - DNA, 18 bp, synthetic construct
  source 1..18: mol_type = other DNA
aaatacgtctcgctatcg

SEQ ID NO: 14177 - DNA, 18 bp, synthetic construct
  source 1..18: mol_type = other DNA
aaataggactcagtattg

SEQ ID NO: 14178 - DNA, 18 bp, synthetic construct
  source 1..18: mol_type = other DNA
aaatcagactcactattg

SEQ ID NO: 14179 - DNA, 18 bp, synthetic construct
  source 1..18: mol_type = other DNA
aaatgcgactcgctacag

SEQ ID NO: 14180 - DNA, 18 bp, synthetic construct
  source 1..18: mol_type = other DNA
aaattcgactcaatgtag

SEQ ID NO: 14181 - DNA, 18 bp, synthetic construct
  source 1..18: mol_type = other DNA
aaattcgactgaccatag

SEQ ID NO: 14182 - DNA, 18 bp, synthetic construct
  source 1..18: mol_type = other DNA
aaattctacgcactatag

SEQ ID NO: 14183 - DNA, 18 bp, synthetic construct
  source 1..18: mol_type = other DNA
aaatttgactcactatcg

SEQ ID NO: 14184 - DNA, 18 bp, synthetic construct
  source 1..18: mol_type = other DNA
agaaacgactcactattg

SEQ ID NO: 14185 - DNA, 18 bp, synthetic construct
  source 1..18: mol_type = other DNA
agatacgcctcactattg

SEQ ID NO: 14186 - DNA, 18 bp, synthetic construct
  source 1..18: mol_type = other DNA
caaaacgactgactattg

SEQ ID NO: 14187 - DNA, 18 bp, synthetic construct
  source 1..18: mol_type = other DNA
caagacgactcacttttg

SEQ ID NO: 14188 - DNA, 18 bp, synthetic construct
  source 1..18: mol_type = other DNA
caataagactcactcttg

SEQ ID NO: 14189 - DNA, 18 bp, synthetic construct
  source 1..18: mol_type = other DNA
caatatgactcgctttag

SEQ ID NO: 14190 - DNA, 18 bp, synthetic construct
  source 1..18: mol_type = other DNA
caattagactaactatag

SEQ ID NO: 14191 - DNA, 18 bp, synthetic construct
  source 1..18: mol_type = other DNA
caattcgattcactgtag

SEQ ID NO: 14192 - DNA, 18 bp, synthetic construct
  source 1..18: mol_type = other DNA
caattcgcatcactatag

SEQ ID NO: 14193 - DNA, 18 bp, synthetic construct
  source 1..18: mol_type = other DNA
caattgaactcactatag

SEQ ID NO: 14194 - DNA, 18 bp, synthetic construct
  source 1..18: mol_type = other DNA
caattggactcactaaag

SEQ ID NO: 14195 - DNA, 18 bp, synthetic construct
  source 1..18: mol_type = other DNA
caattggactcactatgg

SEQ ID NO: 14196 - DNA, 18 bp, synthetic construct
  source 1..18: mol_type = other DNA
cactacgactcgctctag

SEQ ID NO: 14197 - DNA, 18 bp, synthetic construct
  source 1..18: mol_type = other DNA
cagtaagactcactattg

SEQ ID NO: 14198 - DNA, 18 bp, synthetic construct
  source 1..18: mol_type = other DNA
catttcgactcactgtag

SEQ ID NO: 14199 - DNA, 18 bp, synthetic construct
  source 1..18: mol_type = other DNA
gaaaacaactcactattg

SEQ ID NO: 14200 - DNA, 18 bp, synthetic construct
  source 1..18: mol_type = other DNA
gaatatgagtcactattg

SEQ ID NO: 14201 - DNA, 18 bp, synthetic construct
  source 1..18: mol_type = other DNA
gaattagactcactttag

SEQ ID NO: 14202 - DNA, 18 bp, synthetic construct
  source 1..18: mol_type = other DNA
gaatttgactcactctag

SEQ ID NO: 14203 - DNA, 18 bp, synthetic construct
  source 1..18: mol_type = other DNA
gattacgacgcgctatag

SEQ ID NO: 14204 - DNA, 18 bp, synthetic construct
  source 1..18: mol_type = other DNA
gtattcgactcactatcg

SEQ ID NO: 14205 - DNA, 18 bp, synthetic construct
  source 1..18: mol_type = other DNA
gtattcgactcactatgg

SEQ ID NO: 14206 - DNA, 18 bp, synthetic construct
  source 1..18: mol_type = other DNA
taaaaagactcactagtg

SEQ ID NO: 14207 - DNA, 18 bp, synthetic construct
  source 1..18: mol_type = other DNA
taaaacgaatcaccattg

SEQ ID NO: 14208 - DNA, 18 bp, synthetic construct
  source 1..18: mol_type = other DNA
taaaacgaatcgctatgg

SEQ ID NO: 14209 - DNA, 18 bp, synthetic construct
  source 1..18: mol_type = other DNA
taaaacgacccgcaatag

SEQ ID NO: 14210 - DNA, 18 bp, synthetic construct
  source 1..18: mol_type = other DNA
taaaacgacgcgctataa

SEQ ID NO: 14211 - DNA, 18 bp, synthetic construct
  source 1..18: mol_type = other DNA
taaaacgactcaccactg

SEQ ID NO: 14212 - DNA, 18 bp, synthetic construct
  source 1..18: mol_type = other DNA
taaaacgactcactgctg

SEQ ID NO: 14213 - DNA, 18 bp, synthetic construct
  source 1..18: mol_type = other DNA
taaaacgactcgatacag

SEQ ID NO: 14214 - DNA, 18 bp, synthetic construct
  source 1..18: mol_type = other DNA
taaaacgactggctaaag

SEQ ID NO: 14215 - DNA, 18 bp, synthetic construct
  source 1..18: mol_type = other DNA
taaaacgcctcactatta

SEQ ID NO: 14216 - DNA, 18 bp, synthetic construct
  source 1..18: mol_type = other DNA
taaaatgcctcgctatag

SEQ ID NO: 14217 - DNA, 18 bp, synthetic construct
  source 1..18: mol_type = other DNA
taaaccgactcaccattg

SEQ ID NO: 14218 - DNA, 18 bp, synthetic construct
  source 1..18: mol_type = other DNA
taaatagactcactaaag

SEQ ID NO: 14219 - DNA, 18 bp, synthetic construct
  source 1..18: mol_type = other DNA
taaatcgacgctctatag

SEQ ID NO: 14220 - DNA, 18 bp, synthetic construct
  source 1..18: mol_type = other DNA
taaatcgactcacgaaag

SEQ ID NO: 14221 - DNA, 18 bp, synthetic construct
  source 1..18: mol_type = other DNA
taaatcgactcactaacg

SEQ ID NO: 14222 - DNA, 18 bp, synthetic construct
  source 1..18: mol_type = other DNA
taaatcgactcagcatag

SEQ ID NO: 14223 - DNA, 18 bp, synthetic construct
  source 1..18: mol_type = other DNA
taaatcgtctgactatag

SEQ ID NO: 14224 - DNA, 18 bp, synthetic construct
  source 1..18: mol_type = other DNA
taaatctactcactctag

SEQ ID NO: 14225 - DNA, 18 bp, synthetic construct
  source 1..18: mol_type = other DNA
taaattgactcactatcg

SEQ ID NO: 14226 - DNA, 18 bp, synthetic construct
  source 1..18: mol_type = other DNA
taacacaactcactatta

SEQ ID NO: 14227 - DNA, 18 bp, synthetic construct
  source 1..18: mol_type = other DNA
taacacaactcgctatcg

SEQ ID NO: 14228 - DNA, 18 bp, synthetic construct
  source 1..18: mol_type = other DNA
taacacgactctatattg

SEQ ID NO: 14229 - DNA, 18 bp, synthetic construct
  source 1..18: mol_type = other DNA
taacatgacacgctatag

SEQ ID NO: 14230 - DNA, 18 bp, synthetic construct
  source 1..18: mol_type = other DNA
taactagacttactatag

SEQ ID NO: 14231 - DNA, 18 bp, synthetic construct
  source 1..18: mol_type = other DNA
taagaggactcggtatag

SEQ ID NO: 14232 - DNA, 18 bp, synthetic construct
  source 1..18: mol_type = other DNA
taagttgacacactatag

SEQ ID NO: 14233 - DNA, 18 bp, synthetic construct
  source 1..18: mol_type = other DNA
taatacaacctactattg

SEQ ID NO: 14234 - DNA, 18 bp, synthetic construct
  source 1..18: mol_type = other DNA
taatacaactcaatcttg

SEQ ID NO: 14235 - DNA, 18 bp, synthetic construct
  source 1..18: mol_type = other DNA
taatacaactcgttatcg

SEQ ID NO: 14236 - DNA, 18 bp, synthetic construct
  source 1..18: mol_type = other DNA
taatacaactggcaatag

SEQ ID NO: 14237 - DNA, 18 bp, synthetic construct
  source 1..18: mol_type = other DNA
taatacaactggctacag

SEQ ID NO: 14238 - DNA, 18 bp, synthetic construct
  source 1..18: mol_type = other DNA
taataccacagactattg

SEQ ID NO: 14239 - DNA, 18 bp, synthetic construct
  source 1..18: mol_type = other DNA
taatacgaataagtattg

SEQ ID NO: 14240 - DNA, 18 bp, synthetic construct
  source 1..18: mol_type = other DNA
taatacgacactctatta

SEQ ID NO: 14241 - DNA, 18 bp, synthetic construct
  source 1..18: mol_type = other DNA
taatacgactcacttctt

SEQ ID NO: 14242 - DNA, 18 bp, synthetic construct
  source 1..18: mol_type = other DNA
taatacgactccaaattg

SEQ ID NO: 14243 - DNA, 18 bp, synthetic construct
  source 1..18: mol_type = other DNA
taatacgactccctaata

SEQ ID NO: 14244 - DNA, 18 bp, synthetic construct
  source 1..18: mol_type = other DNA
taatacgactccctgatg

SEQ ID NO: 14245 - DNA, 18 bp, synthetic construct
  source 1..18: mol_type = other DNA
taatacgactcgatctcg

SEQ ID NO: 14246 - DNA, 18 bp, synthetic construct
  source 1..18: mol_type = other DNA
taatacgactctccatta

SEQ ID NO: 14247 - DNA, 18 bp, synthetic construct
  source 1..18: mol_type = other DNA
taatacgactctctttta

SEQ ID NO: 14248 - DNA, 18 bp, synthetic construct
  source 1..18: mol_type = other DNA
taatacgactgaccaatg

SEQ ID NO: 14249 - DNA, 18 bp, synthetic construct
  source 1..18: mol_type = other DNA
taatacgagttgttatag

SEQ ID NO: 14250 - DNA, 18 bp, synthetic construct
  source 1..18: mol_type = other DNA
taatacgattagctaaag

SEQ ID NO: 14251 - DNA, 18 bp, synthetic construct
  source 1..18: mol_type = other DNA
taatacgattcactgttc

SEQ ID NO: 14252 - DNA, 18 bp, synthetic construct
  source 1..18: mol_type = other DNA
taatacgatttgctatcg

SEQ ID NO: 14253 - DNA, 18 bp, synthetic construct
  source 1..18: mol_type = other DNA
taatacgcctggctacag

SEQ ID NO: 14254 - DNA, 18 bp, synthetic construct
  source 1..18: mol_type = other DNA
taatacgccttactactg

SEQ ID NO: 14255 - DNA, 18 bp, synthetic construct
  source 1..18: mol_type = other DNA
taatacggctcgatagag

SEQ ID NO: 14256 - DNA, 18 bp, synthetic construct
  source 1..18: mol_type = other DNA
taatacgtcccactaatg

SEQ ID NO: 14257 - DNA, 18 bp, synthetic construct
  source 1..18: mol_type = other DNA
taatacgtctaggtatag

SEQ ID NO: 14258 - DNA, 18 bp, synthetic construct
  source 1..18: mol_type = other DNA
taatactaccggctatag

SEQ ID NO: 14259 - DNA, 18 bp, synthetic construct
  source 1..18: mol_type = other DNA
taatactactcactttta

SEQ ID NO: 14260 - DNA, 18 bp, synthetic construct
  source 1..18: mol_type = other DNA
taatactagtcgctctag

SEQ ID NO: 14261 - DNA, 18 bp, synthetic construct
  source 1..18: mol_type = other DNA
taatacttctcggtatag

SEQ ID NO: 14262 - DNA, 18 bp, synthetic construct
  source 1..18: mol_type = other DNA
taatagaacacactattg

SEQ ID NO: 14263 - DNA, 18 bp, synthetic construct
  source 1..18: mol_type = other DNA
taataggaatcgcaatag

SEQ ID NO: 14264 - DNA, 18 bp, synthetic construct
  source 1..18: mol_type = other DNA
taataggacacagtattg

SEQ ID NO: 14265 - DNA, 18 bp, synthetic construct
  source 1..18: mol_type = other DNA
taataggactcactcatg

SEQ ID NO: 14266 - DNA, 18 bp, synthetic construct
  source 1..18: mol_type = other DNA
taatagtactcaatattg

SEQ ID NO: 14267 - DNA, 18 bp, synthetic construct
  source 1..18: mol_type = other DNA
taatatgactcactcgtg

SEQ ID NO: 14268 - DNA, 18 bp, synthetic construct
  source 1..18: mol_type = other DNA
taatatgtctcgctacag

SEQ ID NO: 14269 - DNA, 18 bp, synthetic construct
  source 1..18: mol_type = other DNA
taatcagactcactatta

SEQ ID NO: 14270 - DNA, 18 bp, synthetic construct
  source 1..18: mol_type = other DNA
taatccacctcactattg

SEQ ID NO: 14271 - DNA, 18 bp, synthetic construct
  source 1..18: mol_type = other DNA
taatccgacccgctacag

SEQ ID NO: 14272 - DNA, 18 bp, synthetic construct
  source 1..18: mol_type = other DNA
taatccgactcagtatta

SEQ ID NO: 14273 - DNA, 18 bp, synthetic construct
  source 1..18: mol_type = other DNA
taatccgtctcgctaaag

SEQ ID NO: 14274 - DNA, 18 bp, synthetic construct
  source 1..18: mol_type = other DNA
taatctgactcgctgtag

SEQ ID NO: 14275 - DNA, 18 bp, synthetic construct
  source 1..18: mol_type = other DNA
taatgcaactcactagtg

SEQ ID NO: 14276 - DNA, 18 bp, synthetic construct
  source 1..18: mol_type = other DNA
taatgcgaatcactaatg

SEQ ID NO: 14277 - DNA, 18 bp, synthetic construct
  source 1..18: mol_type = other DNA
taatgcgactcgatatcg

SEQ ID NO: 14278 - DNA, 18 bp, synthetic construct
  source 1..18: mol_type = other DNA
taatgcgactctctgttg

SEQ ID NO: 14279 - DNA, 18 bp, synthetic construct
  source 1..18: mol_type = other DNA
taatgcgattcactcttg

SEQ ID NO: 14280 - DNA, 18 bp, synthetic construct
  source 1..18: mol_type = other DNA
taatgcgcctcactatta

SEQ ID NO: 14281 - DNA, 18 bp, synthetic construct
  source 1..18: mol_type = other DNA
taattaaactcacgatag

SEQ ID NO: 14282 - DNA, 18 bp, synthetic construct
  source 1..18: mol_type = other DNA
taattagagtcactacag

SEQ ID NO: 14283 - DNA, 18 bp, synthetic construct
  source 1..18: mol_type = other DNA
taattagagtcattatag

SEQ ID NO: 14284 - DNA, 18 bp, synthetic construct
  source 1..18: mol_type = other DNA
taattccacttactacag

SEQ ID NO: 14285 - DNA, 18 bp, synthetic construct
  source 1..18: mol_type = other DNA
taattcgaatcacaatcg

SEQ ID NO: 14286 - DNA, 18 bp, synthetic construct
  source 1..18: mol_type = other DNA
taattcgaattacgatag

SEQ ID NO: 14287 - DNA, 18 bp, synthetic construct
  source 1..18: mol_type = other DNA
taattcgacagactatcg

SEQ ID NO: 14288 - DNA, 18 bp, synthetic construct
  source 1..18: mol_type = other DNA
taattcgacccagtaaag

SEQ ID NO: 14289 - DNA, 18 bp, synthetic construct
  source 1..18: mol_type = other DNA
taattcgacgcactaagg

SEQ ID NO: 14290 - DNA, 18 bp, synthetic construct
  source 1..18: mol_type = other DNA
taattcgactaactagcg

SEQ ID NO: 14291 - DNA, 18 bp, synthetic construct
  source 1..18: mol_type = other DNA
taattcgactaacttgag

SEQ ID NO: 14292 - DNA, 18 bp, synthetic construct
  source 1..18: mol_type = other DNA
taattcgactaattatcg

SEQ ID NO: 14293 - DNA, 18 bp, synthetic construct
  source 1..18: mol_type = other DNA
taattcgactcaacatgg

SEQ ID NO: 14294 - DNA, 18 bp, synthetic construct
  source 1..18: mol_type = other DNA
taattcgactcaccaacg

SEQ ID NO: 14295 - DNA, 18 bp, synthetic construct
  source 1..18: mol_type = other DNA
taattcgactcacccaag

SEQ ID NO: 14296 - DNA, 18 bp, synthetic construct
  source 1..18: mol_type = other DNA
taattcgactcagtcaag

SEQ ID NO: 14297 - DNA, 18 bp, synthetic construct
  source 1..18: mol_type = other DNA
taattcgactccccacag

SEQ ID NO: 14298 - DNA, 18 bp, synthetic construct
  source 1..18: mol_type = other DNA
taattcgactctctatca

SEQ ID NO: 14299 - DNA, 18 bp, synthetic construct
  source 1..18: mol_type = other DNA
taattcgactgacagtag

SEQ ID NO: 14300 - DNA, 18 bp, synthetic construct
  source 1..18: mol_type = other DNA
taattcgagttactatcg

SEQ ID NO: 14301 - DNA, 18 bp, synthetic construct
  source 1..18: mol_type = other DNA
taattcgcaccactatag

SEQ ID NO: 14302 - DNA, 18 bp, synthetic construct
  source 1..18: mol_type = other DNA
taattcgcatcaatatag

SEQ ID NO: 14303 - DNA, 18 bp, synthetic construct
  source 1..18: mol_type = other DNA
taattcgccctactatag

SEQ ID NO: 14304 - DNA, 18 bp, synthetic construct
  source 1..18: mol_type = other DNA
taattcgtctcactaccg

SEQ ID NO: 14305 - DNA, 18 bp, synthetic construct
  source 1..18: mol_type = other DNA
taattcgtctccctgtag

SEQ ID NO: 14306 - DNA, 18 bp, synthetic construct
  source 1..18: mol_type = other DNA
taattctactcactacgg

SEQ ID NO: 14307 - DNA, 18 bp, synthetic construct
  source 1..18: mol_type = other DNA
taattctactcactagcg

SEQ ID NO: 14308 - DNA, 18 bp, synthetic construct
  source 1..18: mol_type = other DNA
taattctactccccatag

SEQ ID NO: 14309 - DNA, 18 bp, synthetic construct
  source 1..18: mol_type = other DNA
taattctagtcactatgg

SEQ ID NO: 14310 - DNA, 18 bp, synthetic construct
  source 1..18: mol_type = other DNA
taattggactcactgtcg

SEQ ID NO: 14311 - DNA, 18 bp, synthetic construct
  source 1..18: mol_type = other DNA
taatttaactcactgtag

SEQ ID NO: 14312 - DNA, 18 bp, synthetic construct
  source 1..18: mol_type = other DNA
taatttcactcaccatag

SEQ ID NO: 14313 - DNA, 18 bp, synthetic construct
  source 1..18: mol_type = other DNA
taatttgactcaccataa

SEQ ID NO: 14314 - DNA, 18 bp, synthetic construct
  source 1..18: mol_type = other DNA
taatttgactcactagcg

SEQ ID NO: 14315 - DNA, 18 bp, synthetic construct
  source 1..18: mol_type = other DNA
taatttgactcatgatag

SEQ ID NO: 14316 - DNA, 18 bp, synthetic construct
  source 1..18: mol_type = other DNA
taatttgacttaatatag

SEQ ID NO: 14317 - DNA, 18 bp, synthetic construct
  source 1..18: mol_type = other DNA
tactacgacacgctagag

SEQ ID NO: 14318 - DNA, 18 bp, synthetic construct
  source 1..18: mol_type = other DNA
tactacgactcactcatg

SEQ ID NO: 14319 - DNA, 18 bp, synthetic construct
  source 1..18: mol_type = other DNA
tactacgcctcacttttg

SEQ ID NO: 14320 - DNA, 18 bp, synthetic construct
  source 1..18: mol_type = other DNA
tactaggactcggtatag

SEQ ID NO: 14321 - DNA, 18 bp, synthetic construct
  source 1..18: mol_type = other DNA
tactccgactcacttttg

SEQ ID NO: 14322 - DNA, 18 bp, synthetic construct
  source 1..18: mol_type = other DNA
tactcctactcactattg

SEQ ID NO: 14323 - DNA, 18 bp, synthetic construct
  source 1..18: mol_type = other DNA
tacttccactcagtatag

SEQ ID NO: 14324 - DNA, 18 bp, synthetic construct
  source 1..18: mol_type = other DNA
tacttcgactaactaaag

SEQ ID NO: 14325 - DNA, 18 bp, synthetic construct
  source 1..18: mol_type = other DNA
tagaacggctcactattg

SEQ ID NO: 14326 - DNA, 18 bp, synthetic construct
  source 1..18: mol_type = other DNA
tagctggactcactatag

SEQ ID NO: 14327 - DNA, 18 bp, synthetic construct
  source 1..18: mol_type = other DNA
tagtacgattcactgttg

SEQ ID NO: 14328 - DNA, 18 bp, synthetic construct
  source 1..18: mol_type = other DNA
tagtacgattcgctttag

SEQ ID NO: 14329 - DNA, 18 bp, synthetic construct
  source 1..18: mol_type = other DNA
tagtccgactcaatattg

SEQ ID NO: 14330 - DNA, 18 bp, synthetic construct
  source 1..18: mol_type = other DNA
tagttagattcactatag

SEQ ID NO: 14331 - DNA, 18 bp, synthetic construct
  source 1..18: mol_type = other DNA
tagttcgactgagtatag

SEQ ID NO: 14332 - DNA, 18 bp, synthetic construct
  source 1..18: mol_type = other DNA
tagttcgattcactctag

SEQ ID NO: 14333 - DNA, 18 bp, synthetic construct
  source 1..18: mol_type = other DNA
tagttcgtctcactatcg

SEQ ID NO: 14334 - DNA, 18 bp, synthetic construct
  source 1..18: mol_type = other DNA
tagtttgcctcactatag

SEQ ID NO: 14335 - DNA, 18 bp, synthetic construct
  source 1..18: mol_type = other DNA
tatcacgactcacgattg

SEQ ID NO: 14336 - DNA, 18 bp, synthetic construct
  source 1..18: mol_type = other DNA
tatgacgacccactattg

SEQ ID NO: 14337 - DNA, 18 bp, synthetic construct
  source 1..18: mol_type = other DNA
tattacgactcacaatta

SEQ ID NO: 14338 - DNA, 18 bp, synthetic construct
  source 1..18: mol_type = other DNA
tattacgacttgctatgg

SEQ ID NO: 14339 - DNA, 18 bp, synthetic construct
  source 1..18: mol_type = other DNA
tattacgagtcacttttg

SEQ ID NO: 14340 - DNA, 18 bp, synthetic construct
  source 1..18: mol_type = other DNA
tattacgcctagctatag

SEQ ID NO: 14341 - DNA, 18 bp, synthetic construct
  source 1..18: mol_type = other DNA
tattactactcgctatcg

SEQ ID NO: 14342 - DNA, 18 bp, synthetic construct
  source 1..18: mol_type = other DNA
tattccgaatcgctatag

SEQ ID NO: 14343 - DNA, 18 bp, synthetic construct
  source 1..18: mol_type = other DNA
tatttcgactcacaataa

SEQ ID NO: 14344 - DNA, 18 bp, synthetic construct
  source 1..18: mol_type = other DNA
tcaaacgacttactattg

SEQ ID NO: 14345 - DNA, 18 bp, synthetic construct
  source 1..18: mol_type = other DNA
tcaatcgactcactaaag

SEQ ID NO: 14346 - DNA, 18 bp, synthetic construct
  source 1..18: mol_type = other DNA
tcatacgactcaccaatg

SEQ ID NO: 14347 - DNA, 18 bp, synthetic construct
  source 1..18: mol_type = other DNA
tcatacgactcactgctg

SEQ ID NO: 14348 - DNA, 18 bp, synthetic construct
  source 1..18: mol_type = other DNA
tcatacgaggcgctatag

SEQ ID NO: 14349 - DNA, 18 bp, synthetic construct
  source 1..18: mol_type = other DNA
tcatactactcactactg

SEQ ID NO: 14350 - DNA, 18 bp, synthetic construct
  source 1..18: mol_type = other DNA
tcatccgactcacttttg

SEQ ID NO: 14351 - DNA, 18 bp, synthetic construct
  source 1..18: mol_type = other DNA
tcattcgactaattatag

SEQ ID NO: 14352 - DNA, 18 bp, synthetic construct
  source 1..18: mol_type = other DNA
tcattggtctcactatag

SEQ ID NO: 14353 - DNA, 18 bp, synthetic construct
  source 1..18: mol_type = other DNA
tcgtacgactcactgttg

SEQ ID NO: 14354 - DNA, 18 bp, synthetic construct
  source 1..18: mol_type = other DNA
tgaaacgactcaccattg

SEQ ID NO: 14355 - DNA, 18 bp, synthetic construct
  source 1..18: mol_type = other DNA
tgaatcgactcactatgg

SEQ ID NO: 14356 - DNA, 18 bp, synthetic construct
  source 1..18: mol_type = other DNA
tgatacgattcgctatcg

SEQ ID NO: 14357 - DNA, 18 bp, synthetic construct
  source 1..18: mol_type = other DNA
tgatacgattcgctttag

SEQ ID NO: 14358 - DNA, 18 bp, synthetic construct
  source 1..18: mol_type = other DNA
tgatactaatcgctatag

SEQ ID NO: 14359 - DNA, 18 bp, synthetic construct
  source 1..18: mol_type = other DNA
tgatcagactcgctatag

SEQ ID NO: 14360 - DNA, 18 bp, synthetic construct
  source 1..18: mol_type = other DNA
tgatgcgactcgcaatag

SEQ ID NO: 14361 - DNA, 18 bp, synthetic construct
  source 1..18: mol_type = other DNA
tgctttgactcactatag

SEQ ID NO: 14362 - DNA, 18 bp, synthetic construct
  source 1..18: mol_type = other DNA
tggttcgacgcactatag

SEQ ID NO: 14363 - DNA, 18 bp, synthetic construct
  source 1..18: mol_type = other DNA
tgtttcgactcactttag

SEQ ID NO: 14364 - DNA, 18 bp, synthetic construct
  source 1..18: mol_type = other DNA
ttacacgactcactcttg

SEQ ID NO: 14365 - DNA, 18 bp, synthetic construct
  source 1..18: mol_type = other DNA
ttataaaactcgctatag

SEQ ID NO: 14366 - DNA, 18 bp, synthetic construct
  source 1..18: mol_type = other DNA
ttataagactcactgttg

SEQ ID NO: 14367 - DNA, 18 bp, synthetic construct
  source 1..18: mol_type = other DNA
ttatacgactcaatatta

SEQ ID NO: 14368 - DNA, 18 bp, synthetic construct
  source 1..18: mol_type = other DNA
ttatacgactcgatatcg

SEQ ID NO: 14369 - DNA, 18 bp, synthetic construct
  source 1..18: mol_type = other DNA
ttatacgactcgttatcg

SEQ ID NO: 14370 - DNA, 18 bp, synthetic construct
  source 1..18: mol_type = other DNA
ttatacggctcgcaatag

SEQ ID NO: 14371 - DNA, 18 bp, synthetic construct
  source 1..18: mol_type = other DNA
ttataggcctcgctatag

SEQ ID NO: 14372 - DNA, 18 bp, synthetic construct
  source 1..18: mol_type = other DNA
ttattccactcactagag

SEQ ID NO: 14373 - DNA, 18 bp, synthetic construct
  source 1..18: mol_type = other DNA
ttattcgactcactatca

SEQ ID NO: 14374 - DNA, 18 bp, synthetic construct
  source 1..18: mol_type = other DNA
ttattcggctgactatag

SEQ ID NO: 14375 - DNA, 18 bp, synthetic construct
  source 1..18: mol_type = other DNA
ttattggactcactatcg

SEQ ID NO: 14376 - DNA, 18 bp, synthetic construct
  source 1..18: mol_type = other DNA
aaaaacgactctccatag

SEQ ID NO: 14377 - DNA, 18 bp, synthetic construct
  source 1..18: mol_type = other DNA
aaaaacgattcactatgg

SEQ ID NO: 14378 - DNA, 18 bp, synthetic construct
  source 1..18: mol_type = other DNA
aaaaactacccactatag

SEQ ID NO: 14379 - DNA, 18 bp, synthetic construct
  source 1..18: mol_type = other DNA
aaataagactcactatct

SEQ ID NO: 14380 - DNA, 18 bp, synthetic construct
  source 1..18: mol_type = other DNA
aaataagactccccatag

SEQ ID NO: 14381 - DNA, 18 bp, synthetic construct
  source 1..18: mol_type = other DNA
aaatacaggtcactatag

SEQ ID NO: 14382 - DNA, 18 bp, synthetic construct
  source 1..18: mol_type = other DNA
aaataccacacattatag

SEQ ID NO: 14383 - DNA, 18 bp, synthetic construct
  source 1..18: mol_type = other DNA
aaataccactctccatag

SEQ ID NO: 14384 - DNA, 18 bp, synthetic construct
  source 1..18: mol_type = other DNA
aaatacgacacaatgtag

SEQ ID NO: 14385 - DNA, 18 bp, synthetic construct
  source 1..18: mol_type = other DNA
aaatacgactctcaataa

SEQ ID NO: 14386 - DNA, 18 bp, synthetic construct
  source 1..18: mol_type = other DNA
aaatacgactgtctatgg

SEQ ID NO: 14387 - DNA, 18 bp, synthetic construct
  source 1..18: mol_type = other DNA
aaatacgacttattttag

SEQ ID NO: 14388 - DNA, 18 bp, synthetic construct
  source 1..18: mol_type = other DNA
aaatacgatccactatcg

SEQ ID NO: 14389 - DNA, 18 bp, synthetic construct
  source 1..18: mol_type = other DNA
aaatacgatgcactttag

SEQ ID NO: 14390 - DNA, 18 bp, synthetic construct
  source 1..18: mol_type = other DNA
aaatacgattcacgacag

SEQ ID NO: 14391 - DNA, 18 bp, synthetic construct
  source 1..18: mol_type = other DNA
aaatacggcgcactttag

SEQ ID NO: 14392 - DNA, 18 bp, synthetic construct
  source 1..18: mol_type = other DNA
aaatacggctgtctatag

SEQ ID NO: 14393 - DNA, 18 bp, synthetic construct
  source 1..18: mol_type = other DNA
aaataggaatcactttag

SEQ ID NO: 14394 - DNA, 18 bp, synthetic construct
  source 1..18: mol_type = other DNA
aaataggactcacaagag

SEQ ID NO: 14395 - DNA, 18 bp, synthetic construct
  source 1..18: mol_type = other DNA
aaataggattcactttag

SEQ ID NO: 14396 - DNA, 18 bp, synthetic construct
  source 1..18: mol_type = other DNA
aaataggcctcactatcg

SEQ ID NO: 14397 - DNA, 18 bp, synthetic construct
  source 1..18: mol_type = other DNA
aaatatcacgcactatag

SEQ ID NO: 14398 - DNA, 18 bp, synthetic construct
  source 1..18: mol_type = other DNA
aaatatgactcacgttag

SEQ ID NO: 14399 - DNA, 18 bp, synthetic construct
  source 1..18: mol_type = other DNA
aaatatgacttactatgg

SEQ ID NO: 14400 - DNA, 18 bp, synthetic construct
  source 1..18: mol_type = other DNA
aaatccgactatctatag

SEQ ID NO: 14401 - DNA, 18 bp, synthetic construct
  source 1..18: mol_type = other DNA
aaatcctactcactctag

SEQ ID NO: 14402 - DNA, 18 bp, synthetic construct
  source 1..18: mol_type = other DNA
aaatgctactcactctag

SEQ ID NO: 14403 - DNA, 18 bp, synthetic construct
  source 1..18: mol_type = other DNA
aacaaggactcactatag

SEQ ID NO: 14404 - DNA, 18 bp, synthetic construct
  source 1..18: mol_type = other DNA
aactacagctcactatag

SEQ ID NO: 14405 - DNA, 18 bp, synthetic construct
  source 1..18: mol_type = other DNA
aactacgactgactacag

SEQ ID NO: 14406 - DNA, 18 bp, synthetic construct
  source 1..18: mol_type = other DNA
aaggacgactaactatag

SEQ ID NO: 14407 - DNA, 18 bp, synthetic construct
  source 1..18: mol_type = other DNA
aagtacgacacactatgg

SEQ ID NO: 14408 - DNA, 18 bp, synthetic construct
  source 1..18: mol_type = other DNA
aagtacgagccactatag

SEQ ID NO: 14409 - DNA, 18 bp, synthetic construct
  source 1..18: mol_type = other DNA
aagtatgattcactatag

SEQ ID NO: 14410 - DNA, 18 bp, synthetic construct
  source 1..18: mol_type = other DNA
aatcgcgactcactatag

SEQ ID NO: 14411 - DNA, 18 bp, synthetic construct
  source 1..18: mol_type = other DNA
aattacgactcactgcag

SEQ ID NO: 14412 - DNA, 18 bp, synthetic construct
  source 1..18: mol_type = other DNA
aattacgactctctatat

SEQ ID NO: 14413 - DNA, 18 bp, synthetic construct
  source 1..18: mol_type = other DNA
aattacgtctccctatag

SEQ ID NO: 14414 - DNA, 18 bp, synthetic construct
  source 1..18: mol_type = other DNA
aattcagactcactatag

SEQ ID NO: 14415 - DNA, 18 bp, synthetic construct
  source 1..18: mol_type = other DNA
acatacgactcactagcg

SEQ ID NO: 14416 - DNA, 18 bp, synthetic construct
  source 1..18: mol_type = other DNA
acatacgactcactctcg

SEQ ID NO: 14417 - DNA, 18 bp, synthetic construct
  source 1..18: mol_type = other DNA
acatacggcttactatag

SEQ ID NO: 14418 - DNA, 18 bp, synthetic construct
  source 1..18: mol_type = other DNA
acataggactcacaatag

SEQ ID NO: 14419 - DNA, 18 bp, synthetic construct
  source 1..18: mol_type = other DNA
acatatggctcactatag

SEQ ID NO: 14420 - DNA, 18 bp, synthetic construct
  source 1..18: mol_type = other DNA
agatacgaatcactagag

SEQ ID NO: 14421 - DNA, 18 bp, synthetic construct
  source 1..18: mol_type = other DNA
agatacgactcagtaaag

SEQ ID NO: 14422 - DNA, 18 bp, synthetic construct
  source 1..18: mol_type = other DNA
aggtacgactaactatag

SEQ ID NO: 14423 - DNA, 18 bp, synthetic construct
  source 1..18: mol_type = other DNA
agttacgactcactctag

SEQ ID NO: 14424 - DNA, 18 bp, synthetic construct
  source 1..18: mol_type = other DNA
atatacgtctcactgtag

SEQ ID NO: 14425 - DNA, 18 bp, synthetic construct
  source 1..18: mol_type = other DNA
atttacgactcactataa

SEQ ID NO: 14426 - DNA, 18 bp, synthetic construct
  source 1..18: mol_type = other DNA
atttaggactcactatag

SEQ ID NO: 14427 - DNA, 18 bp, synthetic construct
  source 1..18: mol_type = other DNA
caaaacgaccaactatag

SEQ ID NO: 14428 - DNA, 18 bp, synthetic construct
  source 1..18: mol_type = other DNA
caaaacgacttactatgg

SEQ ID NO: 14429 - DNA, 18 bp, synthetic construct
  source 1..18: mol_type = other DNA
caaaacgtctcagtatag

SEQ ID NO: 14430 - DNA, 18 bp, synthetic construct
  source 1..18: mol_type = other DNA
caagacgaatcactatcg

SEQ ID NO: 14431 - DNA, 18 bp, synthetic construct
  source 1..18: mol_type = other DNA
caagactactcactctag

SEQ ID NO: 14432 - DNA, 18 bp, synthetic construct
  source 1..18: mol_type = other DNA
caataagacctactatag

SEQ ID NO: 14433 - DNA, 18 bp, synthetic construct
  source 1..18: mol_type = other DNA
caataagtctaactatag

SEQ ID NO: 14434 - DNA, 18 bp, synthetic construct
  source 1..18: mol_type = other DNA
caatacacctcactttag

SEQ ID NO: 14435 - DNA, 18 bp, synthetic construct
  source 1..18: mol_type = other DNA
caataccaccccctatag

SEQ ID NO: 14436 - DNA, 18 bp, synthetic construct
  source 1..18: mol_type = other DNA
caataccactcacttaag

SEQ ID NO: 14437 - DNA, 18 bp, synthetic construct
  source 1..18: mol_type = other DNA
caataccactcactttcg

SEQ ID NO: 14438 - DNA, 18 bp, synthetic construct
  source 1..18: mol_type = other DNA
caataccactcactttgg

SEQ ID NO: 14439 - DNA, 18 bp, synthetic construct
  source 1..18: mol_type = other DNA
caatacgactcacatcag

SEQ ID NO: 14440 - DNA, 18 bp, synthetic construct
  source 1..18: mol_type = other DNA
caatacgatccactatgg

SEQ ID NO: 14441 - DNA, 18 bp, synthetic construct
  source 1..18: mol_type = other DNA
caatacgattcactgcag

SEQ ID NO: 14442 - DNA, 18 bp, synthetic construct
  source 1..18: mol_type = other DNA
caatacgcctccctttag

SEQ ID NO: 14443 - DNA, 18 bp, synthetic construct
  source 1..18: mol_type = other DNA
caatacgcctctctctag

SEQ ID NO: 14444 - DNA, 18 bp, synthetic construct
  source 1..18: mol_type = other DNA
caatacggatcactaaag

SEQ ID NO: 14445 - DNA, 18 bp, synthetic construct
  source 1..18: mol_type = other DNA
caatactacaaactatag

SEQ ID NO: 14446 - DNA, 18 bp, synthetic construct
  source 1..18: mol_type = other DNA
caatacttctgactatag

SEQ ID NO: 14447 - DNA, 18 bp, synthetic construct
  source 1..18: mol_type = other DNA
caatatgactccccatag

SEQ ID NO: 14448 - DNA, 18 bp, synthetic construct
  source 1..18: mol_type = other DNA
caatatgtctaactatag

SEQ ID NO: 14449 - DNA, 18 bp, synthetic construct
  source 1..18: mol_type = other DNA
caatattactcacgatag

SEQ ID NO: 14450 - DNA, 18 bp, synthetic construct
  source 1..18: mol_type = other DNA
caatccgactcactgaag

SEQ ID NO: 14451 - DNA, 18 bp, synthetic construct
  source 1..18: mol_type = other DNA
caatccgagtcactatcg

SEQ ID NO: 14452 - DNA, 18 bp, synthetic construct
  source 1..18: mol_type = other DNA
caatgcgacacactttag

SEQ ID NO: 14453 - DNA, 18 bp, synthetic construct
  source 1..18: mol_type = other DNA
caatgcgactcagtaaag

SEQ ID NO: 14454 - DNA, 18 bp, synthetic construct
  source 1..18: mol_type = other DNA
cactacgactcactgtcg

SEQ ID NO: 14455 - DNA, 18 bp, synthetic construct
  source 1..18: mol_type = other DNA
cagaacgactcactaaag

SEQ ID NO: 14456 - DNA, 18 bp, synthetic construct
  source 1..18: mol_type = other DNA
cagtacaacttactatag

SEQ ID NO: 14457 - DNA, 18 bp, synthetic construct
  source 1..18: mol_type = other DNA
cagtacgactcaatacag

SEQ ID NO: 14458 - DNA, 18 bp, synthetic construct
  source 1..18: mol_type = other DNA
cattacaactcactttag

SEQ ID NO: 14459 - DNA, 18 bp, synthetic construct
  source 1..18: mol_type = other DNA
ccataccactcattatag

SEQ ID NO: 14460 - DNA, 18 bp, synthetic construct
  source 1..18: mol_type = other DNA
ccatacgacacaatatag

SEQ ID NO: 14461 - DNA, 18 bp, synthetic construct
  source 1..18: mol_type = other DNA
ccatatgactctctatag

SEQ ID NO: 14462 - DNA, 18 bp, synthetic construct
  source 1..18: mol_type = other DNA
cgatacacctcactatag

SEQ ID NO: 14463 - DNA, 18 bp, synthetic construct
  source 1..18: mol_type = other DNA
ctagacgactcactatgg

SEQ ID NO: 14464 - DNA, 18 bp, synthetic construct
  source 1..18: mol_type = other DNA
ctataccacccactatag

SEQ ID NO: 14465 - DNA, 18 bp, synthetic construct
  source 1..18: mol_type = other DNA
ctatacgactcaatacag

SEQ ID NO: 14466 - DNA, 18 bp, synthetic construct
  source 1..18: mol_type = other DNA
ctatacgactcattgtag

SEQ ID NO: 14467 - DNA, 18 bp, synthetic construct
  source 1..18: mol_type = other DNA
ctataggactcactagag

SEQ ID NO: 14468 - DNA, 18 bp, synthetic construct
  source 1..18: mol_type = other DNA
ctatccgacccactatag

SEQ ID NO: 14469 - DNA, 18 bp, synthetic construct
  source 1..18: mol_type = other DNA
gaaaacgacacactctag

SEQ ID NO: 14470 - DNA, 18 bp, synthetic construct
  source 1..18: mol_type = other DNA
gaacacgacacactatgg

SEQ ID NO: 14471 - DNA, 18 bp, synthetic construct
  source 1..18: mol_type = other DNA
gaatacgaatctttatag

SEQ ID NO: 14472 - DNA, 18 bp, synthetic construct
  source 1..18: mol_type = other DNA
gaatacgacactctaaag

SEQ ID NO: 14473 - DNA, 18 bp, synthetic construct
  source 1..18: mol_type = other DNA
gaatacgactttctaaag

SEQ ID NO: 14474 - DNA, 18 bp, synthetic construct
  source 1..18: mol_type = other DNA
gaatacgcctcaccttag

SEQ ID NO: 14475 - DNA, 18 bp, synthetic construct
  source 1..18: mol_type = other DNA
gaatccgactctctatgg

SEQ ID NO: 14476 - DNA, 18 bp, synthetic construct
  source 1..18: mol_type = other DNA
gaatgcgtctcaatatag

SEQ ID NO: 14477 - DNA, 18 bp, synthetic construct
  source 1..18: mol_type = other DNA
gagaaccactcactatag

SEQ ID NO: 14478 - DNA, 18 bp, synthetic construct
  source 1..18: mol_type = other DNA
gatgacgcctcactatag

SEQ ID NO: 14479 - DNA, 18 bp, synthetic construct
  source 1..18: mol_type = other DNA
gattaagtctcactatag

SEQ ID NO: 14480 - DNA, 18 bp, synthetic construct
  source 1..18: mol_type = other DNA
gcaaacgaatcactatag

SEQ ID NO: 14481 - DNA, 18 bp, synthetic construct
  source 1..18: mol_type = other DNA
gcataggactcattatag

SEQ ID NO: 14482 - DNA, 18 bp, synthetic construct
  source 1..18: mol_type = other DNA
gtacacgactcactgtag

SEQ ID NO: 14483 - DNA, 18 bp, synthetic construct
  source 1..18: mol_type = other DNA
gtctacgactcactacag

SEQ ID NO: 14484 - DNA, 18 bp, synthetic construct
  source 1..18: mol_type = other DNA
taaaaaaactccctatag

SEQ ID NO: 14485 - DNA, 18 bp, synthetic construct
  source 1..18: mol_type = other DNA
taaaaacactcaatatag

SEQ ID NO: 14486 - DNA, 18 bp, synthetic construct
  source 1..18: mol_type = other DNA
taaaaagaatcattatag

SEQ ID NO: 14487 - DNA, 18 bp, synthetic construct
  source 1..18: mol_type = other DNA
taaaacaactgactatcg

SEQ ID NO: 14488 - DNA, 18 bp, synthetic construct
  source 1..18: mol_type = other DNA
taaaaccgcacactatag

SEQ ID NO: 14489 - DNA, 18 bp, synthetic construct
  source 1..18: mol_type = other DNA
taaaacgaatcagtagag

SEQ ID NO: 14490 - DNA, 18 bp, synthetic construct
  source 1..18: mol_type = other DNA
taaaacgaccccctacag

SEQ ID NO: 14491 - DNA, 18 bp, synthetic construct
  source 1..18: mol_type = other DNA
taaaacgactcataacag

SEQ ID NO: 14492 - DNA, 18 bp, synthetic construct
  source 1..18: mol_type = other DNA
taaaacgatccactatcg

SEQ ID NO: 14493 - DNA, 18 bp, synthetic construct
  source 1..18: mol_type = other DNA
taaaacgatccactatgg

SEQ ID NO: 14494 - DNA, 18 bp, synthetic construct
  source 1..18: mol_type = other DNA
taaaacgcctaactttag

SEQ ID NO: 14495 - DNA, 18 bp, synthetic construct
  source 1..18: mol_type = other DNA
taaaacgtctcactaccg

SEQ ID NO: 14496 - DNA, 18 bp, synthetic construct
  source 1..18: mol_type = other DNA
taaaagaactcactttag

SEQ ID NO: 14497 - DNA, 18 bp, synthetic construct
  source 1..18: mol_type = other DNA
taaaagcactcaatatag

SEQ ID NO: 14498 - DNA, 18 bp, synthetic construct
  source 1..18: mol_type = other DNA
taaaatgccccactatag

SEQ ID NO: 14499 - DNA, 18 bp, synthetic construct
  source 1..18: mol_type = other DNA
taaaccgactcattatcg

SEQ ID NO: 14500 - DNA, 18 bp, synthetic construct
  source 1..18: mol_type = other DNA
taaaccgacttaccatag

SEQ ID NO: 14501 - DNA, 18 bp, synthetic construct
  source 1..18: mol_type = other DNA
taaaccgacttactgtag

SEQ ID NO: 14502 - DNA, 18 bp, synthetic construct
  source 1..18: mol_type = other DNA
taaaccggctcactctag

SEQ ID NO: 14503 - DNA, 18 bp, synthetic construct
  source 1..18: mol_type = other DNA
taaacctactcacaatag

SEQ ID NO: 14504 - DNA, 18 bp, synthetic construct
  source 1..18: mol_type = other DNA
taaagcgaatcactgtag

SEQ ID NO: 14505 - DNA, 18 bp, synthetic construct
  source 1..18: mol_type = other DNA
taaagcgactcaatgtag

SEQ ID NO: 14506 - DNA, 18 bp, synthetic construct
  source 1..18: mol_type = other DNA
taaagcgactcaatttag

SEQ ID NO: 14507 - DNA, 18 bp, synthetic construct
  source 1..18: mol_type = other DNA
taaagcgactccccatag

SEQ ID NO: 14508 - DNA, 18 bp, synthetic construct
  source 1..18: mol_type = other DNA
taaagcgtcccactatag

SEQ ID NO: 14509 - DNA, 18 bp, synthetic construct
  source 1..18: mol_type = other DNA
taaagggactcactacag

SEQ ID NO: 14510 - DNA, 18 bp, synthetic construct
  source 1..18: mol_type = other DNA
taacacaactcactctcg

SEQ ID NO: 14511 - DNA, 18 bp, synthetic construct
  source 1..18: mol_type = other DNA
taacacaagtctctatag

SEQ ID NO: 14512 - DNA, 18 bp, synthetic construct
  source 1..18: mol_type = other DNA
taacacaattcagtatag

SEQ ID NO: 14513 - DNA, 18 bp, synthetic construct
  source 1..18: mol_type = other DNA
taacaccacacactttag

SEQ ID NO: 14514 - DNA, 18 bp, synthetic construct
  source 1..18: mol_type = other DNA
taacacgaatctctatcg

SEQ ID NO: 14515 - DNA, 18 bp, synthetic construct
  source 1..18: mol_type = other DNA
taacacgactatcaatag

SEQ ID NO: 14516 - DNA, 18 bp, synthetic construct
  source 1..18: mol_type = other DNA
taacacgactcacaaacg

SEQ ID NO: 14517 - DNA, 18 bp, synthetic construct
  source 1..18: mol_type = other DNA
taacacgactccatacag

SEQ ID NO: 14518 - DNA, 18 bp, synthetic construct
  source 1..18: mol_type = other DNA
taacacgagtcacaaaag

SEQ ID NO: 14519 - DNA, 18 bp, synthetic construct
  source 1..18: mol_type = other DNA
taacacgataaactatag

SEQ ID NO: 14520 - DNA, 18 bp, synthetic construct
  source 1..18: mol_type = other DNA
taacacgatccactacag

SEQ ID NO: 14521 - DNA, 18 bp, synthetic construct
  source 1..18: mol_type = other DNA
taacacgcctcaataaag

SEQ ID NO: 14522 - DNA, 18 bp, synthetic construct
  source 1..18: mol_type = other DNA
taacacgccttactatgg

SEQ ID NO: 14523 - DNA, 18 bp, synthetic construct
  source 1..18: mol_type = other DNA
taacacgtcgcacaatag

SEQ ID NO: 14524 - DNA, 18 bp, synthetic construct
  source 1..18: mol_type = other DNA
taacacgtcgcactctag

SEQ ID NO: 14525 - DNA, 18 bp, synthetic construct
  source 1..18: mol_type = other DNA
taacacgtctcaccatgg

SEQ ID NO: 14526 - DNA, 18 bp, synthetic construct
  source 1..18: mol_type = other DNA
taacacgtctcactgtcg

SEQ ID NO: 14527 - DNA, 18 bp, synthetic construct
  source 1..18: mol_type = other DNA
taacacgtctctcgatag

SEQ ID NO: 14528 - DNA, 18 bp, synthetic construct
  source 1..18: mol_type = other DNA
taacacgtgtcaatatag

SEQ ID NO: 14529 - DNA, 18 bp, synthetic construct
  source 1..18: mol_type = other DNA
taacaggactaaatatag

SEQ ID NO: 14530 - DNA, 18 bp, synthetic construct
  source 1..18: mol_type = other DNA
taacatgactcaccagag

SEQ ID NO: 14531 - DNA, 18 bp, synthetic construct
  source 1..18: mol_type = other DNA
taacatgacttactctag

SEQ ID NO: 14532 - DNA, 18 bp, synthetic construct
  source 1..18: mol_type = other DNA
taacccgtctcactaaag

SEQ ID NO: 14533 - DNA, 18 bp, synthetic construct
  source 1..18: mol_type = other DNA
taagaagactaactctag

SEQ ID NO: 14534 - DNA, 18 bp, synthetic construct
  source 1..18: mol_type = other DNA
taagaagactcactaacg

SEQ ID NO: 14535 - DNA, 18 bp, synthetic construct
  source 1..18: mol_type = other DNA
taagacaacacaccatag

SEQ ID NO: 14536 - DNA, 18 bp, synthetic construct
  source 1..18: mol_type = other DNA
taagaccactctgtatag

SEQ ID NO: 14537 - DNA, 18 bp, synthetic construct
  source 1..18: mol_type = other DNA
taagaccgctctctatag

SEQ ID NO: 14538 - DNA, 18 bp, synthetic construct
  source 1..18: mol_type = other DNA
taagacgacccactgcag

SEQ ID NO: 14539 - DNA, 18 bp, synthetic construct
  source 1..18: mol_type = other DNA
taagacgactcttaatag

SEQ ID NO: 14540 - DNA, 18 bp, synthetic construct
  source 1..18: mol_type = other DNA
taagacgacttacaaaag

SEQ ID NO: 14541 - DNA, 18 bp, synthetic construct
  source 1..18: mol_type = other DNA
taagacgattaactgtag

SEQ ID NO: 14542 - DNA, 18 bp, synthetic construct
  source 1..18: mol_type = other DNA
taagacgattcacaatcg

SEQ ID NO: 14543 - DNA, 18 bp, synthetic construct
  source 1..18: mol_type = other DNA
taagacgcttcaatatag

SEQ ID NO: 14544 - DNA, 18 bp, synthetic construct
  source 1..18: mol_type = other DNA
taagacggctcaatatcg

SEQ ID NO: 14545 - DNA, 18 bp, synthetic construct
  source 1..18: mol_type = other DNA
taagacgtatcactacag

SEQ ID NO: 14546 - DNA, 18 bp, synthetic construct
  source 1..18: mol_type = other DNA
taagactactaactatcg

SEQ ID NO: 14547 - DNA, 18 bp, synthetic construct
  source 1..18: mol_type = other DNA
taagaggcctcactaaag

SEQ ID NO: 14548 - DNA, 18 bp, synthetic construct
  source 1..18: mol_type = other DNA
taagagttctcactatag

SEQ ID NO: 14549 - DNA, 18 bp, synthetic construct
  source 1..18: mol_type = other DNA
taagatgtctaactatag

SEQ ID NO: 14550 - DNA, 18 bp, synthetic construct
  source 1..18: mol_type = other DNA
taagatgtctcacaatag

SEQ ID NO: 14551 - DNA, 18 bp, synthetic construct
  source 1..18: mol_type = other DNA
taagccgtctcactagag

SEQ ID NO: 14552 - DNA, 18 bp, synthetic construct
  source 1..18: mol_type = other DNA
taagctgactcaccatag

SEQ ID NO: 14553 - DNA, 18 bp, synthetic construct
  source 1..18: mol_type = other DNA
taataagacacacaatcg

SEQ ID NO: 14554 - DNA, 18 bp, synthetic construct
  source 1..18: mol_type = other DNA
taataagacacactctcg

SEQ ID NO: 14555 - DNA, 18 bp, synthetic construct
  source 1..18: mol_type = other DNA
taataagacccacgttag

SEQ ID NO: 14556 - DNA, 18 bp, synthetic construct
  source 1..18: mol_type = other DNA
taataagaccctctacag

SEQ ID NO: 14557 - DNA, 18 bp, synthetic construct
  source 1..18: mol_type = other DNA
taataagactcaaaagag

SEQ ID NO: 14558 - DNA, 18 bp, synthetic construct
  source 1..18: mol_type = other DNA
taataagactcaacacag

SEQ ID NO: 14559 - DNA, 18 bp, synthetic construct
  source 1..18: mol_type = other DNA
taataagactcaccttgg

SEQ ID NO: 14560 - DNA, 18 bp, synthetic construct
  source 1..18: mol_type = other DNA
taataagactcattgcag

SEQ ID NO: 14561 - DNA, 18 bp, synthetic construct
  source 1..18: mol_type = other DNA
taataagactcctgatag

SEQ ID NO: 14562 - DNA, 18 bp, synthetic construct
  source 1..18: mol_type = other DNA
taataagactctgaatag

SEQ ID NO: 14563 - DNA, 18 bp, synthetic construct
  source 1..18: mol_type = other DNA
taataagactgtctttag

SEQ ID NO: 14564 - DNA, 18 bp, synthetic construct
  source 1..18: mol_type = other DNA
taataagagtccgtatag

SEQ ID NO: 14565 - DNA, 18 bp, synthetic construct
  source 1..18: mol_type = other DNA
taataagagttactacag

SEQ ID NO: 14566 - DNA, 18 bp, synthetic construct
  source 1..18: mol_type = other DNA
taataagattccctaaag

SEQ ID NO: 14567 - DNA, 18 bp, synthetic construct
  source 1..18: mol_type = other DNA
taataagattgtctatag

SEQ ID NO: 14568 - DNA, 18 bp, synthetic construct
  source 1..18: mol_type = other DNA
taataagtctcactaacg

SEQ ID NO: 14569 - DNA, 18 bp, synthetic construct
  source 1..18: mol_type = other DNA
taatacaaatcacagtag

SEQ ID NO: 14570 - DNA, 18 bp, synthetic construct
  source 1..18: mol_type = other DNA
taatacaaatctctagag

SEQ ID NO: 14571 - DNA, 18 bp, synthetic construct
  source 1..18: mol_type = other DNA
taatacaactcactgacg

SEQ ID NO: 14572 - DNA, 18 bp, synthetic construct
  source 1..18: mol_type = other DNA
taatacaactcattgcag

SEQ ID NO: 14573 - DNA, 18 bp, synthetic construct
  source 1..18: mol_type = other DNA
taatacaacttacagtag

SEQ ID NO: 14574 - DNA, 18 bp, synthetic construct
  source 1..18: mol_type = other DNA
taatacagctcacaacag

SEQ ID NO: 14575 - DNA, 18 bp, synthetic construct
  source 1..18: mol_type = other DNA
taatacatctcactgtcg

SEQ ID NO: 14576 - DNA, 18 bp, synthetic construct
  source 1..18: mol_type = other DNA
taatacatctccctaaag

SEQ ID NO: 14577 - DNA, 18 bp, synthetic construct
  source 1..18: mol_type = other DNA
taataccaatgacgatag

SEQ ID NO: 14578 - DNA, 18 bp, synthetic construct
  source 1..18: mol_type = other DNA
taataccaccaactatcg

SEQ ID NO: 14579 - DNA, 18 bp, synthetic construct
  source 1..18: mol_type = other DNA
taataccacgctctgtag

SEQ ID NO: 14580 - DNA, 18 bp, synthetic construct
  source 1..18: mol_type = other DNA
taataccactgagtttag

SEQ ID NO: 14581 - DNA, 18 bp, synthetic construct
  source 1..18: mol_type = other DNA
taatacctatcattatag

SEQ ID NO: 14582 - DNA, 18 bp, synthetic construct
  source 1..18: mol_type = other DNA
taatacctcccactttag

SEQ ID NO: 14583 - DNA, 18 bp, synthetic construct
  source 1..18: mol_type = other DNA
taatacctctcacactag

SEQ ID NO: 14584 - DNA, 18 bp, synthetic construct
  source 1..18: mol_type = other DNA
taatacctctgaccatag

SEQ ID NO: 14585 - DNA, 18 bp, synthetic construct
  source 1..18: mol_type = other DNA
taatacgaacctctatgg

SEQ ID NO: 14586 - DNA, 18 bp, synthetic construct
  source 1..18: mol_type = other DNA
taatacgaatcacaacgg

SEQ ID NO: 14587 - DNA, 18 bp, synthetic construct
  source 1..18: mol_type = other DNA
taatacgacaaattacag

SEQ ID NO: 14588 - DNA, 18 bp, synthetic construct
  source 1..18: mol_type = other DNA
taatacgacacacttaaa

SEQ ID NO: 14589 - DNA, 18 bp, synthetic construct
  source 1..18: mol_type = other DNA
taatacgacaccatgtag

SEQ ID NO: 14590 - DNA, 18 bp, synthetic construct
  source 1..18: mol_type = other DNA
taatacgaccaactttcg

SEQ ID NO: 14591 - DNA, 18 bp, synthetic construct
  source 1..18: mol_type = other DNA
taatacgaccttctatgg

SEQ ID NO: 14592 - DNA, 18 bp, synthetic construct
  source 1..18: mol_type = other DNA
taatacgacgcattgtgg

SEQ ID NO: 14593 - DNA, 18 bp, synthetic construct
  source 1..18: mol_type = other DNA
taatacgactaattttgg

SEQ ID NO: 14594 - DNA, 18 bp, synthetic construct
  source 1..18: mol_type = other DNA
taatacgactatctaacg

SEQ ID NO: 14595 - DNA, 18 bp, synthetic construct
  source 1..18: mol_type = other DNA
taatacgactcaaattaa

SEQ ID NO: 14596 - DNA, 18 bp, synthetic construct
  source 1..18: mol_type = other DNA
taatacgactcacagaac

SEQ ID NO: 14597 - DNA, 18 bp, synthetic construct
  source 1..18: mol_type = other DNA
taatacgactcagattac

SEQ ID NO: 14598 - DNA, 18 bp, synthetic construct
  source 1..18: mol_type = other DNA
taatacgactcatgaacg

SEQ ID NO: 14599 - DNA, 18 bp, synthetic construct
  source 1..18: mol_type = other DNA
taatacgactctcctgag

SEQ ID NO: 14600 - DNA, 18 bp, synthetic construct
  source 1..18: mol_type = other DNA
taatacgactctctttca

SEQ ID NO: 14601 - DNA, 18 bp, synthetic construct
  source 1..18: mol_type = other DNA
taatacgactctgcagag

SEQ ID NO: 14602 - DNA, 18 bp, synthetic construct
  source 1..18: mol_type = other DNA
taatacgactcttgttag

SEQ ID NO: 14603 - DNA, 18 bp, synthetic construct
  source 1..18: mol_type = other DNA
taatacgacttacattac

SEQ ID NO: 14604 - DNA, 18 bp, synthetic construct
  source 1..18: mol_type = other DNA
taatacgacttcttatcg

SEQ ID NO: 14605 - DNA, 18 bp, synthetic construct
  source 1..18: mol_type = other DNA
taatacgagacaagatag

SEQ ID NO: 14606 - DNA, 18 bp, synthetic construct
  source 1..18: mol_type = other DNA
taatacgagtgacaatcg

SEQ ID NO: 14607 - DNA, 18 bp, synthetic construct
  source 1..18: mol_type = other DNA
taatacgagttactaaaa

SEQ ID NO: 14608 - DNA, 18 bp, synthetic construct
  source 1..18: mol_type = other DNA
taatacgagttcctttag

SEQ ID NO: 14609 - DNA, 18 bp, synthetic construct
  source 1..18: mol_type = other DNA
taatacgagtttctacag

SEQ ID NO: 14610 - DNA, 18 bp, synthetic construct
  source 1..18: mol_type = other DNA
taatacgatacagtaaag

SEQ ID NO: 14611 - DNA, 18 bp, synthetic construct
  source 1..18: mol_type = other DNA
taatacgatcctatatag

SEQ ID NO: 14612 - DNA, 18 bp, synthetic construct
  source 1..18: mol_type = other DNA
taatacgattaactaacg

SEQ ID NO: 14613 - DNA, 18 bp, synthetic construct
  source 1..18: mol_type = other DNA
taatacgattcaacatcg

SEQ ID NO: 14614 - DNA, 18 bp, synthetic construct
  source 1..18: mol_type = other DNA
taatacgattcccgttag

SEQ ID NO: 14615 - DNA, 18 bp, synthetic construct
  source 1..18: mol_type = other DNA
taatacgcatcaccttag

SEQ ID NO: 14616 - DNA, 18 bp, synthetic construct
  source 1..18: mol_type = other DNA
taatacgcatctctagag

SEQ ID NO: 14617 - DNA, 18 bp, synthetic construct
  source 1..18: mol_type = other DNA
taatacgcatgactttag

SEQ ID NO: 14618 - DNA, 18 bp, synthetic construct
  source 1..18: mol_type = other DNA
taatacgccacaccatgg

SEQ ID NO: 14619 - DNA, 18 bp, synthetic construct
  source 1..18: mol_type = other DNA
taatacgccactccatag

SEQ ID NO: 14620 - DNA, 18 bp, synthetic construct
  source 1..18: mol_type = other DNA
taatacgcgtcactaagg

SEQ ID NO: 14621 - DNA, 18 bp, synthetic construct
  source 1..18: mol_type = other DNA
taatacgcgtctcaatag

SEQ ID NO: 14622 - DNA, 18 bp, synthetic construct
  source 1..18: mol_type = other DNA
taatacggatctctgtag

SEQ ID NO: 14623 - DNA, 18 bp, synthetic construct
  source 1..18: mol_type = other DNA
taatacggcagattatag

SEQ ID NO: 14624 - DNA, 18 bp, synthetic construct
  source 1..18: mol_type = other DNA
taatacggcccattatgg

SEQ ID NO: 14625 - DNA, 18 bp, synthetic construct
  source 1..18: mol_type = other DNA
taatacgggtgactaaag

SEQ ID NO: 14626 - DNA, 18 bp, synthetic construct
  source 1..18: mol_type = other DNA
taatacggttcagtataa

SEQ ID NO: 14627 - DNA, 18 bp, synthetic construct
  source 1..18: mol_type = other DNA
taatacgtcaccatatag

SEQ ID NO: 14628 - DNA, 18 bp, synthetic construct
  source 1..18: mol_type = other DNA
taatacgtcccaatctag

SEQ ID NO: 14629 - DNA, 18 bp, synthetic construct
  source 1..18: mol_type = other DNA
taatacgtcccaccataa

SEQ ID NO: 14630 - DNA, 18 bp, synthetic construct
  source 1..18: mol_type = other DNA
taatacgtccgactaaag

SEQ ID NO: 14631 - DNA, 18 bp, synthetic construct
  source 1..18: mol_type = other DNA
taatacgtcgaactttag

SEQ ID NO: 14632 - DNA, 18 bp, synthetic construct
  source 1..18: mol_type = other DNA
taatacgtcgtactttag

SEQ ID NO: 14633 - DNA, 18 bp, synthetic construct
  source 1..18: mol_type = other DNA
taatacgtctcacaatga

SEQ ID NO: 14634 - DNA, 18 bp, synthetic construct
  source 1..18: mol_type = other DNA
taatacgtctcactaact

SEQ ID NO: 14635 - DNA, 18 bp, synthetic construct
  source 1..18: mol_type = other DNA
taatacgtctcagcctag

SEQ ID NO: 14636 - DNA, 18 bp, synthetic construct
  source 1..18: mol_type = other DNA
taatacgtctgaatagag

SEQ ID NO: 14637 - DNA, 18 bp, synthetic construct
  source 1..18: mol_type = other DNA
taatacgtctttctataa

SEQ ID NO: 14638 - DNA, 18 bp, synthetic construct
  source 1..18: mol_type = other DNA
taatacgtgttagtatag

SEQ ID NO: 14639 - DNA, 18 bp, synthetic construct
  source 1..18: mol_type = other DNA
taatactaatgcctatag

SEQ ID NO: 14640 - DNA, 18 bp, synthetic construct
  source 1..18: mol_type = other DNA
taatactacacaatatgg

SEQ ID NO: 14641 - DNA, 18 bp, synthetic construct
  source 1..18: mol_type = other DNA
taatactactacgtatag

SEQ ID NO: 14642 - DNA, 18 bp, synthetic construct
  source 1..18: mol_type = other DNA
taatactactcaacacag

SEQ ID NO: 14643 - DNA, 18 bp, synthetic construct
  source 1..18: mol_type = other DNA
taatactactcacattac

SEQ ID NO: 14644 - DNA, 18 bp, synthetic construct
  source 1..18: mol_type = other DNA
taatactactcattctgg

SEQ ID NO: 14645 - DNA, 18 bp, synthetic construct
  source 1..18: mol_type = other DNA
taatactactcattggag

SEQ ID NO: 14646 - DNA, 18 bp, synthetic construct
  source 1..18: mol_type = other DNA
taatactactctcaatac

SEQ ID NO: 14647 - DNA, 18 bp, synthetic construct
  source 1..18: mol_type = other DNA
taatactactgactgtcg

SEQ ID NO: 14648 - DNA, 18 bp, synthetic construct
  source 1..18: mol_type = other DNA
taatactactttctagag

SEQ ID NO: 14649 - DNA, 18 bp, synthetic construct
  source 1..18: mol_type = other DNA
taatactagtccctatgg

SEQ ID NO: 14650 - DNA, 18 bp, synthetic construct
  source 1..18: mol_type = other DNA
taataggaatcacttaag

SEQ ID NO: 14651 - DNA, 18 bp, synthetic construct
  source 1..18: mol_type = other DNA
taataggactcactgggg

SEQ ID NO: 14652 - DNA, 18 bp, synthetic construct
  source 1..18: mol_type = other DNA
taataggactctaaatag

SEQ ID NO: 14653 - DNA, 18 bp, synthetic construct
  source 1..18: mol_type = other DNA
taataggactgattatgg

SEQ ID NO: 14654 - DNA, 18 bp, synthetic construct
  source 1..18: mol_type = other DNA
taataggactgtttatag

SEQ ID NO: 14655 - DNA, 18 bp, synthetic construct
  source 1..18: mol_type = other DNA
taataggactttctacag

SEQ ID NO: 14656 - DNA, 18 bp, synthetic construct
  source 1..18: mol_type = other DNA
taataggagtaaatatag

SEQ ID NO: 14657 - DNA, 18 bp, synthetic construct
  source 1..18: mol_type = other DNA
taataggcgtcactagag

SEQ ID NO: 14658 - DNA, 18 bp, synthetic construct
  source 1..18: mol_type = other DNA
taataggtcccactttag

SEQ ID NO: 14659 - DNA, 18 bp, synthetic construct
  source 1..18: mol_type = other DNA
taatagtacacacaatag

SEQ ID NO: 14660 - DNA, 18 bp, synthetic construct
  source 1..18: mol_type = other DNA
taatatcaatcaatatag

SEQ ID NO: 14661 - DNA, 18 bp, synthetic construct
  source 1..18: mol_type = other DNA
taatatcactcacactag

SEQ ID NO: 14662 - DNA, 18 bp, synthetic construct
  source 1..18: mol_type = other DNA
taatatcactcacagtag

SEQ ID NO: 14663 - DNA, 18 bp, synthetic construct
  source 1..18: mol_type = other DNA
taatatccgtcactatag

SEQ ID NO: 14664 - DNA, 18 bp, synthetic construct
  source 1..18: mol_type = other DNA
taatatgaatcaaaatag

SEQ ID NO: 14665 - DNA, 18 bp, synthetic construct
  source 1..18: mol_type = other DNA
taatatgacccactctgg

SEQ ID NO: 14666 - DNA, 18 bp, synthetic construct
  source 1..18: mol_type = other DNA
taatatgaccgactaaag

SEQ ID NO: 14667 - DNA, 18 bp, synthetic construct
  source 1..18: mol_type = other DNA
taatatgactcacataag

SEQ ID NO: 14668 - DNA, 18 bp, synthetic construct
  source 1..18: mol_type = other DNA
taatatgactctctatct

SEQ ID NO: 14669 - DNA, 18 bp, synthetic construct
  source 1..18: mol_type = other DNA
taatatgagacagtatag

SEQ ID NO: 14670 - DNA, 18 bp, synthetic construct
  source 1..18: mol_type = other DNA
taatatgagttaatatag

SEQ ID NO: 14671 - DNA, 18 bp, synthetic construct
  source 1..18: mol_type = other DNA
taatatgatcgactatag

SEQ ID NO: 14672 - DNA, 18 bp, synthetic construct
  source 1..18: mol_type = other DNA
taatatgattaacgatag

SEQ ID NO: 14673 - DNA, 18 bp, synthetic construct
  source 1..18: mol_type = other DNA
taatatgcatcactagag

SEQ ID NO: 14674 - DNA, 18 bp, synthetic construct
  source 1..18: mol_type = other DNA
taatatgccccaatatag

SEQ ID NO: 14675 - DNA, 18 bp, synthetic construct
  source 1..18: mol_type = other DNA
taatatgcctcactctgg

SEQ ID NO: 14676 - DNA, 18 bp, synthetic construct
  source 1..18: mol_type = other DNA
taatatgcctcagtacag

SEQ ID NO: 14677 - DNA, 18 bp, synthetic construct
  source 1..18: mol_type = other DNA
taatatggctgaccatag

SEQ ID NO: 14678 - DNA, 18 bp, synthetic construct
  source 1..18: mol_type = other DNA
taatatgtctcacgctag

SEQ ID NO: 14679 - DNA, 18 bp, synthetic construct
  source 1..18: mol_type = other DNA
taatatgtctccctatgg

SEQ ID NO: 14680 - DNA, 18 bp, synthetic construct
  source 1..18: mol_type = other DNA
taatatgtctctctctag

SEQ ID NO: 14681 - DNA, 18 bp, synthetic construct
  source 1..18: mol_type = other DNA
taatatgtctctctgtag

SEQ ID NO: 14682 - DNA, 18 bp, synthetic construct
  source 1..18: mol_type = other DNA
taatccaaatccctatag

SEQ ID NO: 14683 - DNA, 18 bp, synthetic construct
  source 1..18: mol_type = other DNA
taatccaactcactccag

SEQ ID NO: 14684 - DNA, 18 bp, synthetic construct
  source 1..18: mol_type = other DNA
taatccaattcactatgg

SEQ ID NO: 14685 - DNA, 18 bp, synthetic construct
  source 1..18: mol_type = other DNA
taatcccacgcaatatag

SEQ ID NO: 14686 - DNA, 18 bp, synthetic construct
  source 1..18: mol_type = other DNA
taatccgaaactctatag

SEQ ID NO: 14687 - DNA, 18 bp, synthetic construct
  source 1..18: mol_type = other DNA
taatccgacatactatgg

SEQ ID NO: 14688 - DNA, 18 bp, synthetic construct
  source 1..18: mol_type = other DNA
taatccgactaaatatcg

SEQ ID NO: 14689 - DNA, 18 bp, synthetic construct
  source 1..18: mol_type = other DNA
taatccgactcactttcc

SEQ ID NO: 14690 - DNA, 18 bp, synthetic construct
  source 1..18: mol_type = other DNA
taatccgactctctacgg

SEQ ID NO: 14691 - DNA, 18 bp, synthetic construct
  source 1..18: mol_type = other DNA
taatccgactctctttcg

SEQ ID NO: 14692 - DNA, 18 bp, synthetic construct
  source 1..18: mol_type = other DNA
taatccgactgaaaatag

SEQ ID NO: 14693 - DNA, 18 bp, synthetic construct
  source 1..18: mol_type = other DNA
taatccgacttacgatcg

SEQ ID NO: 14694 - DNA, 18 bp, synthetic construct
  source 1..18: mol_type = other DNA
taatccgatttacgatag

SEQ ID NO: 14695 - DNA, 18 bp, synthetic construct
  source 1..18: mol_type = other DNA
taatccgtcacaccatag

SEQ ID NO: 14696 - DNA, 18 bp, synthetic construct
  source 1..18: mol_type = other DNA
taatccgtcgcactaaag

SEQ ID NO: 14697 - DNA, 18 bp, synthetic construct
  source 1..18: mol_type = other DNA
taatccgtctcagtatcg

SEQ ID NO: 14698 - DNA, 18 bp, synthetic construct
  source 1..18: mol_type = other DNA
taatcctactcacgatgg

SEQ ID NO: 14699 - DNA, 18 bp, synthetic construct
  source 1..18: mol_type = other DNA
taatcctactcactttgg

SEQ ID NO: 14700 - DNA, 18 bp, synthetic construct
  source 1..18: mol_type = other DNA
taatccttctcaccatag

SEQ ID NO: 14701 - DNA, 18 bp, synthetic construct
  source 1..18: mol_type = other DNA
taatcggactcacttcag

SEQ ID NO: 14702 - DNA, 18 bp, synthetic construct
  source 1..18: mol_type = other DNA
taatcggactcattacag

SEQ ID NO: 14703 - DNA, 18 bp, synthetic construct
  source 1..18: mol_type = other DNA
taatctaactcaatatag

SEQ ID NO: 14704 - DNA, 18 bp, synthetic construct
  source 1..18: mol_type = other DNA
taatctgactcaatagag

SEQ ID NO: 14705 - DNA, 18 bp, synthetic construct
  source 1..18: mol_type = other DNA
taatctgactcagtgtag

SEQ ID NO: 14706 - DNA, 18 bp, synthetic construct
  source 1..18: mol_type = other DNA
taatctgcctcaatatag

SEQ ID NO: 14707 - DNA, 18 bp, synthetic construct
  source 1..18: mol_type = other DNA
taatgagactcactccag

SEQ ID NO: 14708 - DNA, 18 bp, synthetic construct
  source 1..18: mol_type = other DNA
taatgagcctcaccatag

SEQ ID NO: 14709 - DNA, 18 bp, synthetic construct
  source 1..18: mol_type = other DNA
taatgcaaatcactgtag

SEQ ID NO: 14710 - DNA, 18 bp, synthetic construct
  source 1..18: mol_type = other DNA
taatgcaactcactttgg

SEQ ID NO: 14711 - DNA, 18 bp, synthetic construct
  source 1..18: mol_type = other DNA
taatgcaactcataatag

SEQ ID NO: 14712 - DNA, 18 bp, synthetic construct
  source 1..18: mol_type = other DNA
taatgcaacttactatcg

SEQ ID NO: 14713 - DNA, 18 bp, synthetic construct
  source 1..18: mol_type = other DNA
taatgcacctcacaatag

SEQ ID NO: 14714 - DNA, 18 bp, synthetic construct
  source 1..18: mol_type = other DNA
taatgcaccttactatag

SEQ ID NO: 14715 - DNA, 18 bp, synthetic construct
  source 1..18: mol_type = other DNA
taatgccactcacattag

SEQ ID NO: 14716 - DNA, 18 bp, synthetic construct
  source 1..18: mol_type = other DNA
taatgccattaactatag

SEQ ID NO: 14717 - DNA, 18 bp, synthetic construct
  source 1..18: mol_type = other DNA
taatgcctgtcactatag

SEQ ID NO: 14718 - DNA, 18 bp, synthetic construct
  source 1..18: mol_type = other DNA
taatgcgactaaccatcg

SEQ ID NO: 14719 - DNA, 18 bp, synthetic construct
  source 1..18: mol_type = other DNA
taatgcgactcaaaaaag

SEQ ID NO: 14720 - DNA, 18 bp, synthetic construct
  source 1..18: mol_type = other DNA
taatgcgactcacattgg

SEQ ID NO: 14721 - DNA, 18 bp, synthetic construct
  source 1..18: mol_type = other DNA
taatgcgactctctttgg

SEQ ID NO: 14722 - DNA, 18 bp, synthetic construct
  source 1..18: mol_type = other DNA
taatgcgacttactctgg

SEQ ID NO: 14723 - DNA, 18 bp, synthetic construct
  source 1..18: mol_type = other DNA
taatgcgagttactttag

SEQ ID NO: 14724 - DNA, 18 bp, synthetic construct
  source 1..18: mol_type = other DNA
taatgcgtctcaccctag

SEQ ID NO: 14725 - DNA, 18 bp, synthetic construct
  source 1..18: mol_type = other DNA
taatgcgtctcactgaag

SEQ ID NO: 14726 - DNA, 18 bp, synthetic construct
  source 1..18: mol_type = other DNA
taatgcgtctcattacag

SEQ ID NO: 14727 - DNA, 18 bp, synthetic construct
  source 1..18: mol_type = other DNA
taatgcgtgtcactatgg

SEQ ID NO: 14728 - DNA, 18 bp, synthetic construct
  source 1..18: mol_type = other DNA
taatgcttcttactatag

SEQ ID NO: 14729 - DNA, 18 bp, synthetic construct
  source 1..18: mol_type = other DNA
taatgggaagcactatag

SEQ ID NO: 14730 - DNA, 18 bp, synthetic construct
  source 1..18: mol_type = other DNA
taatgtgacacaccatag

SEQ ID NO: 14731 - DNA, 18 bp, synthetic construct
  source 1..18: mol_type = other DNA
taatgttactcaatatag

SEQ ID NO: 14732 - DNA, 18 bp, synthetic construct
  source 1..18: mol_type = other DNA
tacaaccacgcactatag

SEQ ID NO: 14733 - DNA, 18 bp, synthetic construct
  source 1..18: mol_type = other DNA
tacaacgactcaatatcg

SEQ ID NO: 14734 - DNA, 18 bp, synthetic construct
  source 1..18: mol_type = other DNA
tacaactactgactatag

SEQ ID NO: 14735 - DNA, 18 bp, synthetic construct
  source 1..18: mol_type = other DNA
taccacgacacattatag

SEQ ID NO: 14736 - DNA, 18 bp, synthetic construct
  source 1..18: mol_type = other DNA
taccacgattccctatag

SEQ ID NO: 14737 - DNA, 18 bp, synthetic construct
  source 1..18: mol_type = other DNA
taccacgtctcattatag

SEQ ID NO: 14738 - DNA, 18 bp, synthetic construct
  source 1..18: mol_type = other DNA
tacgacgactctctatcg

SEQ ID NO: 14739 - DNA, 18 bp, synthetic construct
  source 1..18: mol_type = other DNA
tactaccacacactctag

SEQ ID NO: 14740 - DNA, 18 bp, synthetic construct
  source 1..18: mol_type = other DNA
tactaccactcactttcg

SEQ ID NO: 14741 - DNA, 18 bp, synthetic construct
  source 1..18: mol_type = other DNA
tactacgaataactttag

SEQ ID NO: 14742 - DNA, 18 bp, synthetic construct
  source 1..18: mol_type = other DNA
tactacgacagactttag

SEQ ID NO: 14743 - DNA, 18 bp, synthetic construct
  source 1..18: mol_type = other DNA
tactacgactaaaaatag

SEQ ID NO: 14744 - DNA, 18 bp, synthetic construct
  source 1..18: mol_type = other DNA
tactacggcagactatag

SEQ ID NO: 14745 - DNA, 18 bp, synthetic construct
  source 1..18: mol_type = other DNA
tactacgtcgcactgtag

SEQ ID NO: 14746 - DNA, 18 bp, synthetic construct
  source 1..18: mol_type = other DNA
tactacgtctcactggag

SEQ ID NO: 14747 - DNA, 18 bp, synthetic construct
  source 1..18: mol_type = other DNA
tactactactcaatataa

SEQ ID NO: 14748 - DNA, 18 bp, synthetic construct
  source 1..18: mol_type = other DNA
tactactactctgtatag

SEQ ID NO: 14749 - DNA, 18 bp, synthetic construct
  source 1..18: mol_type = other DNA
tactactactgactacag

SEQ ID NO: 14750 - DNA, 18 bp, synthetic construct
  source 1..18: mol_type = other DNA
tactccgacacactaaag

SEQ ID NO: 14751 - DNA, 18 bp, synthetic construct
  source 1..18: mol_type = other DNA
tactccgactaattatag

SEQ ID NO: 14752 - DNA, 18 bp, synthetic construct
  source 1..18: mol_type = other DNA
tactccgactcaatgtag

SEQ ID NO: 14753 - DNA, 18 bp, synthetic construct
  source 1..18: mol_type = other DNA
tagaacgacccaatatag

SEQ ID NO: 14754 - DNA, 18 bp, synthetic construct
  source 1..18: mol_type = other DNA
tagaacgactcactcaag

SEQ ID NO: 14755 - DNA, 18 bp, synthetic construct
  source 1..18: mol_type = other DNA
tagaacgactcacttgag

SEQ ID NO: 14756 - DNA, 18 bp, synthetic construct
  source 1..18: mol_type = other DNA
tagaactactcacgatag

SEQ ID NO: 14757 - DNA, 18 bp, synthetic construct
  source 1..18: mol_type = other DNA
tagagcgactcacgatag

SEQ ID NO: 14758 - DNA, 18 bp, synthetic construct
  source 1..18: mol_type = other DNA
tagcacgactcagaatag

SEQ ID NO: 14759 - DNA, 18 bp, synthetic construct
  source 1..18: mol_type = other DNA
tagcacgagtgactatag

SEQ ID NO: 14760 - DNA, 18 bp, synthetic construct
  source 1..18: mol_type = other DNA
tagcacgtctaactatag

SEQ ID NO: 14761 - DNA, 18 bp, synthetic construct
  source 1..18: mol_type = other DNA
taggacggctcactacag

SEQ ID NO: 14762 - DNA, 18 bp, synthetic construct
  source 1..18: mol_type = other DNA
tagtaagactcaccttag

SEQ ID NO: 14763 - DNA, 18 bp, synthetic construct
  source 1..18: mol_type = other DNA
tagtacgacggactttag

SEQ ID NO: 14764 - DNA, 18 bp, synthetic construct
  source 1..18: mol_type = other DNA
tagtacgactcactgacg

SEQ ID NO: 14765 - DNA, 18 bp, synthetic construct
  source 1..18: mol_type = other DNA
tagtacgcgtcactatgg

SEQ ID NO: 14766 - DNA, 18 bp, synthetic construct
  source 1..18: mol_type = other DNA
tagtacgtctcacaatcg

SEQ ID NO: 14767 - DNA, 18 bp, synthetic construct
  source 1..18: mol_type = other DNA
tagtagcactcattatag

SEQ ID NO: 14768 - DNA, 18 bp, synthetic construct
  source 1..18: mol_type = other DNA
tagtatggcttactatag

SEQ ID NO: 14769 - DNA, 18 bp, synthetic construct
  source 1..18: mol_type = other DNA
tagtcatactcactatag

SEQ ID NO: 14770 - DNA, 18 bp, synthetic construct
  source 1..18: mol_type = other DNA
tagtgcgacttacaatag

SEQ ID NO: 14771 - DNA, 18 bp, synthetic construct
  source 1..18: mol_type = other DNA
tagtgggacttactatag

SEQ ID NO: 14772 - DNA, 18 bp, synthetic construct
  source 1..18: mol_type = other DNA
tataacgactgacgatag

SEQ ID NO: 14773 - DNA, 18 bp, synthetic construct
  source 1..18: mol_type = other DNA
tataacgcatcactatag

SEQ ID NO: 14774 - DNA, 18 bp, synthetic construct
  source 1..18: mol_type = other DNA
tataaggactcaccatag

SEQ ID NO: 14775 - DNA, 18 bp, synthetic construct
  source 1..18: mol_type = other DNA
tatactgactcactatag

SEQ ID NO: 14776 - DNA, 18 bp, synthetic construct
  source 1..18: mol_type = other DNA
tatcaagactcaccatag

SEQ ID NO: 14777 - DNA, 18 bp, synthetic construct
  source 1..18: mol_type = other DNA
tatcacgcctcactttag

SEQ ID NO: 14778 - DNA, 18 bp, synthetic construct
  source 1..18: mol_type = other DNA
tatgacgcatcactatag

SEQ ID NO: 14779 - DNA, 18 bp, synthetic construct
  source 1..18: mol_type = other DNA
tattaagaatcactctag

SEQ ID NO: 14780 - DNA, 18 bp, synthetic construct
  source 1..18: mol_type = other DNA
tattaagactccctatcg

SEQ ID NO: 14781 - DNA, 18 bp, synthetic construct
  source 1..18: mol_type = other DNA
tattaccactctgtatag

SEQ ID NO: 14782 - DNA, 18 bp, synthetic construct
  source 1..18: mol_type = other DNA
tattacgaatcactaacg

SEQ ID NO: 14783 - DNA, 18 bp, synthetic construct
  source 1..18: mol_type = other DNA
tattacgactcaatggag

SEQ ID NO: 14784 - DNA, 18 bp, synthetic construct
  source 1..18: mol_type = other DNA
tattacgactcaccttcg

SEQ ID NO: 14785 - DNA, 18 bp, synthetic construct
  source 1..18: mol_type = other DNA
tattacgactcacttaaa

SEQ ID NO: 14786 - DNA, 18 bp, synthetic construct
  source 1..18: mol_type = other DNA
tattacgactctctaaaa

SEQ ID NO: 14787 - DNA, 18 bp, synthetic construct
  source 1..18: mol_type = other DNA
tattacgactctctttac

SEQ ID NO: 14788 - DNA, 18 bp, synthetic construct
  source 1..18: mol_type = other DNA
tattacgactgtatatag

SEQ ID NO: 14789 - DNA, 18 bp, synthetic construct
  source 1..18: mol_type = other DNA
tattacgatccacgatag

SEQ ID NO: 14790 - DNA, 18 bp, synthetic construct
  source 1..18: mol_type = other DNA
tattacgcataactatag

SEQ ID NO: 14791 - DNA, 18 bp, synthetic construct
  source 1..18: mol_type = other DNA
tattacgccactctatag

SEQ ID NO: 14792 - DNA, 18 bp, synthetic construct
  source 1..18: mol_type = other DNA
tattacgcttcactatcg

SEQ ID NO: 14793 - DNA, 18 bp, synthetic construct
  source 1..18: mol_type = other DNA
tattacggctccctgtag

SEQ ID NO: 14794 - DNA, 18 bp, synthetic construct
  source 1..18: mol_type = other DNA
tattaggagtgactatag

SEQ ID NO: 14795 - DNA, 18 bp, synthetic construct
  source 1..18: mol_type = other DNA
tattagggctcattatag

SEQ ID NO: 14796 - DNA, 18 bp, synthetic construct
  source 1..18: mol_type = other DNA
tattatgacccactgtag

SEQ ID NO: 14797 - DNA, 18 bp, synthetic construct
  source 1..18: mol_type = other DNA
tattatgactcacgatgg

SEQ ID NO: 14798 - DNA, 18 bp, synthetic construct
  source 1..18: mol_type = other DNA
tattatgactcactctcg

SEQ ID NO: 14799 - DNA, 18 bp, synthetic construct
  source 1..18: mol_type = other DNA
tattatgactcagtatgg

SEQ ID NO: 14800 - DNA, 18 bp, synthetic construct
  source 1..18: mol_type = other DNA
tattcctactcactatcg

SEQ ID NO: 14801 - DNA, 18 bp, synthetic construct
  source 1..18: mol_type = other DNA
tattcggactcactttag

SEQ ID NO: 14802 - DNA, 18 bp, synthetic construct
  source 1..18: mol_type = other DNA
tattcgtactcactatag

SEQ ID NO: 14803 - DNA, 18 bp, synthetic construct
  source 1..18: mol_type = other DNA
tattctgacccactatag

SEQ ID NO: 14804 - DNA, 18 bp, synthetic construct
  source 1..18: mol_type = other DNA
tattgagactcaatatag

SEQ ID NO: 14805 - DNA, 18 bp, synthetic construct
  source 1..18: mol_type = other DNA
tattgagcctcactatag

SEQ ID NO: 14806 - DNA, 18 bp, synthetic construct
  source 1..18: mol_type = other DNA
tattgcgactcaccctag

SEQ ID NO: 14807 - DNA, 18 bp, synthetic construct
  source 1..18: mol_type = other DNA
tattgcttctcactatag

SEQ ID NO: 14808 - DNA, 18 bp, synthetic construct
  source 1..18: mol_type = other DNA
tcaaacgactcacactag

SEQ ID NO: 14809 - DNA, 18 bp, synthetic construct
  source 1..18: mol_type = other DNA
tcaaacgactcactaagg

SEQ ID NO: 14810 - DNA, 18 bp, synthetic construct
  source 1..18: mol_type = other DNA
tcaaacgactcactacgg

SEQ ID NO: 14811 - DNA, 18 bp, synthetic construct
  source 1..18: mol_type = other DNA
tcaaatgactcactaaag

SEQ ID NO: 14812 - DNA, 18 bp, synthetic construct
  source 1..18: mol_type = other DNA
tcagaagactcagtatag

SEQ ID NO: 14813 - DNA, 18 bp, synthetic construct
  source 1..18: mol_type = other DNA
tcagacgactctctatcg

SEQ ID NO: 14814 - DNA, 18 bp, synthetic construct
  source 1..18: mol_type = other DNA
tcagacgtctcactttag

SEQ ID NO: 14815 - DNA, 18 bp, synthetic construct
  source 1..18: mol_type = other DNA
tcataagactaagtatag

SEQ ID NO: 14816 - DNA, 18 bp, synthetic construct
  source 1..18: mol_type = other DNA
tcataccactcattttag

SEQ ID NO: 14817 - DNA, 18 bp, synthetic construct
  source 1..18: mol_type = other DNA
tcataccattcaccatag

SEQ ID NO: 14818 - DNA, 18 bp, synthetic construct
  source 1..18: mol_type = other DNA
tcatacgattccctatcg

SEQ ID NO: 14819 - DNA, 18 bp, synthetic construct
  source 1..18: mol_type = other DNA
tcatacgcctcattatgg

SEQ ID NO: 14820 - DNA, 18 bp, synthetic construct
  source 1..18: mol_type = other DNA
tcatacggctcattttag

SEQ ID NO: 14821 - DNA, 18 bp, synthetic construct
  source 1..18: mol_type = other DNA
tcatacgtctcaacatag

SEQ ID NO: 14822 - DNA, 18 bp, synthetic construct
  source 1..18: mol_type = other DNA
tcatacgtctcatcatag

SEQ ID NO: 14823 - DNA, 18 bp, synthetic construct
  source 1..18: mol_type = other DNA
tcatacgtctctctctag

SEQ ID NO: 14824 - DNA, 18 bp, synthetic construct
  source 1..18: mol_type = other DNA
tcatactaccaactatag

SEQ ID NO: 14825 - DNA, 18 bp, synthetic construct
  source 1..18: mol_type = other DNA
tcataggactcactaacg

SEQ ID NO: 14826 - DNA, 18 bp, synthetic construct
  source 1..18: mol_type = other DNA
tcataggatacactatag

SEQ ID NO: 14827 - DNA, 18 bp, synthetic construct
  source 1..18: mol_type = other DNA
tcatataagtcactatag

SEQ ID NO: 14828 - DNA, 18 bp, synthetic construct
  source 1..18: mol_type = other DNA
tcatatcactcactttag

SEQ ID NO: 14829 - DNA, 18 bp, synthetic construct
  source 1..18: mol_type = other DNA
tcatatcactcagtatag

SEQ ID NO: 14830 - DNA, 18 bp, synthetic construct
  source 1..18: mol_type = other DNA
tcatatgactcatcatag

SEQ ID NO: 14831 - DNA, 18 bp, synthetic construct
  source 1..18: mol_type = other DNA
tcatccgactcattacag

SEQ ID NO: 14832 - DNA, 18 bp, synthetic construct
  source 1..18: mol_type = other DNA
tcatccgactctgtatag

SEQ ID NO: 14833 - DNA, 18 bp, synthetic construct
  source 1..18: mol_type = other DNA
tcatgcgagtcattatag

SEQ ID NO: 14834 - DNA, 18 bp, synthetic construct
  source 1..18: mol_type = other DNA
tcatgcgcctcagtatag

SEQ ID NO: 14835 - DNA, 18 bp, synthetic construct
  source 1..18: mol_type = other DNA
tcctgcgactcactttag

SEQ ID NO: 14836 - DNA, 18 bp, synthetic construct
  source 1..18: mol_type = other DNA
tctaaagactcactatag

SEQ ID NO: 14837 - DNA, 18 bp, synthetic construct
  source 1..18: mol_type = other DNA
tcttaccactcactttag

SEQ ID NO: 14838 - DNA, 18 bp, synthetic construct
  source 1..18: mol_type = other DNA
tcttaggactcactgtag

SEQ ID NO: 14839 - DNA, 18 bp, synthetic construct
  source 1..18: mol_type = other DNA
tgaaacgaaacactatag

SEQ ID NO: 14840 - DNA, 18 bp, synthetic construct
  source 1..18: mol_type = other DNA
tgaaacgattcaatatag

SEQ ID NO: 14841 - DNA, 18 bp, synthetic construct
  source 1..18: mol_type = other DNA
tgaaactacttactatag

SEQ ID NO: 14842 - DNA, 18 bp, synthetic construct
  source 1..18: mol_type = other DNA
tgaagcgactcactaaag

SEQ ID NO: 14843 - DNA, 18 bp, synthetic construct
  source 1..18: mol_type = other DNA
tgacacaactcactatgg

SEQ ID NO: 14844 - DNA, 18 bp, synthetic construct
  source 1..18: mol_type = other DNA
tgacacgactcaccttag

SEQ ID NO: 14845 - DNA, 18 bp, synthetic construct
  source 1..18: mol_type = other DNA
tgataagactcactcaag

SEQ ID NO: 14846 - DNA, 18 bp, synthetic construct
  source 1..18: mol_type = other DNA
tgataagagtaactatag

SEQ ID NO: 14847 - DNA, 18 bp, synthetic construct
  source 1..18: mol_type = other DNA
tgatacaattcactatgg

SEQ ID NO: 14848 - DNA, 18 bp, synthetic construct
  source 1..18: mol_type = other DNA
tgataccactctctctag

SEQ ID NO: 14849 - DNA, 18 bp, synthetic construct
  source 1..18: mol_type = other DNA
tgataccatacactatag

SEQ ID NO: 14850 - DNA, 18 bp, synthetic construct
  source 1..18: mol_type = other DNA
tgatacgaattactgtag

SEQ ID NO: 14851 - DNA, 18 bp, synthetic construct
  source 1..18: mol_type = other DNA
tgatacgagtcacattag

SEQ ID NO: 14852 - DNA, 18 bp, synthetic construct
  source 1..18: mol_type = other DNA
tgatacgatatactatag

SEQ ID NO: 14853 - DNA, 18 bp, synthetic construct
  source 1..18: mol_type = other DNA
tgatacgattcccaatag

SEQ ID NO: 14854 - DNA, 18 bp, synthetic construct
  source 1..18: mol_type = other DNA
tgatacgcctcaataaag

SEQ ID NO: 14855 - DNA, 18 bp, synthetic construct
  source 1..18: mol_type = other DNA
tgatacgtttaactatag

SEQ ID NO: 14856 - DNA, 18 bp, synthetic construct
  source 1..18: mol_type = other DNA
tgatagctctcactatag

SEQ ID NO: 14857 - DNA, 18 bp, synthetic construct
  source 1..18: mol_type = other DNA
tgataggactcattgtag

SEQ ID NO: 14858 - DNA, 18 bp, synthetic construct
  source 1..18: mol_type = other DNA
tgatatgacccattatag

SEQ ID NO: 14859 - DNA, 18 bp, synthetic construct
  source 1..18: mol_type = other DNA
tgatatgactgtctatag

SEQ ID NO: 14860 - DNA, 18 bp, synthetic construct
  source 1..18: mol_type = other DNA
tgatcccactcactaaag

SEQ ID NO: 14861 - DNA, 18 bp, synthetic construct
  source 1..18: mol_type = other DNA
tgatgcgattcactttag

SEQ ID NO: 14862 - DNA, 18 bp, synthetic construct
  source 1..18: mol_type = other DNA
tggtaggactcaccatag

SEQ ID NO: 14863 - DNA, 18 bp, synthetic construct
  source 1..18: mol_type = other DNA
tggtaggactccctatag

SEQ ID NO: 14864 - DNA, 18 bp, synthetic construct
  source 1..18: mol_type = other DNA
tgtaacgactcactacag

SEQ ID NO: 14865 - DNA, 18 bp, synthetic construct
  source 1..18: mol_type = other DNA
tgtcacgactccctatag

SEQ ID NO: 14866 - DNA, 18 bp, synthetic construct
  source 1..18: mol_type = other DNA
tgttaagactcactctag

SEQ ID NO: 14867 - DNA, 18 bp, synthetic construct
  source 1..18: mol_type = other DNA
tgttacaacccactatag

SEQ ID NO: 14868 - DNA, 18 bp, synthetic construct
  source 1..18: mol_type = other DNA
tgttacgacgcacaatag

SEQ ID NO: 14869 - DNA, 18 bp, synthetic construct
  source 1..18: mol_type = other DNA
tgttacgacttactaaag

SEQ ID NO: 14870 - DNA, 18 bp, synthetic construct
  source 1..18: mol_type = other DNA
ttaaaagactcaatatag

SEQ ID NO: 14871 - DNA, 18 bp, synthetic construct
  source 1..18: mol_type = other DNA
ttaaacgactcaggatag

SEQ ID NO: 14872 - DNA, 18 bp, synthetic construct
  source 1..18: mol_type = other DNA
ttaaacgatccactatag

SEQ ID NO: 14873 - DNA, 18 bp, synthetic construct
  source 1..18: mol_type = other DNA
ttaaacgcctcaccatag

SEQ ID NO: 14874 - DNA, 18 bp, synthetic construct
  source 1..18: mol_type = other DNA
ttaaacgcctgactatag

SEQ ID NO: 14875 - DNA, 18 bp, synthetic construct
  source 1..18: mol_type = other DNA
ttacacgactaactatcg

SEQ ID NO: 14876 - DNA, 18 bp, synthetic construct
  source 1..18: mol_type = other DNA
ttacaggcctcactatag

SEQ ID NO: 14877 - DNA, 18 bp, synthetic construct
  source 1..18: mol_type = other DNA
ttagacgcctcactctag

SEQ ID NO: 14878 - DNA, 18 bp, synthetic construct
  source 1..18: mol_type = other DNA
ttataaaactcactaaag

SEQ ID NO: 14879 - DNA, 18 bp, synthetic construct
  source 1..18: mol_type = other DNA
ttataaaactcactacag

SEQ ID NO: 14880 - DNA, 18 bp, synthetic construct
  source 1..18: mol_type = other DNA
ttataagactcactttaa

SEQ ID NO: 14881 - DNA, 18 bp, synthetic construct
  source 1..18: mol_type = other DNA
ttataagactccctatgg

SEQ ID NO: 14882 - DNA, 18 bp, synthetic construct
  source 1..18: mol_type = other DNA
ttataaggcacactatag

SEQ ID NO: 14883 - DNA, 18 bp, synthetic construct
  source 1..18: mol_type = other DNA
ttatacaacgaactatag

SEQ ID NO: 14884 - DNA, 18 bp, synthetic construct
  source 1..18: mol_type = other DNA
ttatacaactcactaccg

SEQ ID NO: 14885 - DNA, 18 bp, synthetic construct
  source 1..18: mol_type = other DNA
ttatacaactcagtaaag

SEQ ID NO: 14886 - DNA, 18 bp, synthetic construct
  source 1..18: mol_type = other DNA
ttatacaatgcactatag

SEQ ID NO: 14887 - DNA, 18 bp, synthetic construct
  source 1..18: mol_type = other DNA
ttatacgaaccactacag

SEQ ID NO: 14888 - DNA, 18 bp, synthetic construct
  source 1..18: mol_type = other DNA
ttatacgacgcactacgg

SEQ ID NO: 14889 - DNA, 18 bp, synthetic construct
  source 1..18: mol_type = other DNA
ttatacgacgcactgcag

SEQ ID NO: 14890 - DNA, 18 bp, synthetic construct
  source 1..18: mol_type = other DNA
ttatacgactcaatctgg

SEQ ID NO: 14891 - DNA, 18 bp, synthetic construct
  source 1..18: mol_type = other DNA
ttatacgactcaatgcag

SEQ ID NO: 14892 - DNA, 18 bp, synthetic construct
  source 1..18: mol_type = other DNA
ttatacgactcacattaa

SEQ ID NO: 14893 - DNA, 18 bp, synthetic construct
  source 1..18: mol_type = other DNA
ttatacgactgcctctag

SEQ ID NO: 14894 - DNA, 18 bp, synthetic construct
  source 1..18: mol_type = other DNA
ttatacgacttactcaag

SEQ ID NO: 14895 - DNA, 18 bp, synthetic construct
  source 1..18: mol_type = other DNA
ttatacgagtcaccagag

SEQ ID NO: 14896 - DNA, 18 bp, synthetic construct
  source 1..18: mol_type = other DNA
ttatacgattcaatatcg

SEQ ID NO: 14897 - DNA, 18 bp, synthetic construct
  source 1..18: mol_type = other DNA
ttatacgcataactatag

SEQ ID NO: 14898 - DNA, 18 bp, synthetic construct
  source 1..18: mol_type = other DNA
ttatacgcctaactgtag

SEQ ID NO: 14899 - DNA, 18 bp, synthetic construct
  source 1..18: mol_type = other DNA
ttatacgcctcactctcg

SEQ ID NO: 14900 - DNA, 18 bp, synthetic construct
  source 1..18: mol_type = other DNA
ttatacggcgcaatatag

SEQ ID NO: 14901 - DNA, 18 bp, synthetic construct
  source 1..18: mol_type = other DNA
ttatacgtatcactacag

SEQ ID NO: 14902 - DNA, 18 bp, synthetic construct
  source 1..18: mol_type = other DNA
ttatacgtcggactatag

SEQ ID NO: 14903 - DNA, 18 bp, synthetic construct
  source 1..18: mol_type = other DNA
ttatagaactcactctag

SEQ ID NO: 14904 - DNA, 18 bp, synthetic construct
  source 1..18: mol_type = other DNA
ttataggtctaactatag

SEQ ID NO: 14905 - DNA, 18 bp, synthetic construct
  source 1..18: mol_type = other DNA
ttatatgactccctatgg

SEQ ID NO: 14906 - DNA, 18 bp, synthetic construct
  source 1..18: mol_type = other DNA
ttatatggctcactatcg

SEQ ID NO: 14907 - DNA, 18 bp, synthetic construct
  source 1..18: mol_type = other DNA
ttatcagactgactatag

SEQ ID NO: 14908 - DNA, 18 bp, synthetic construct
  source 1..18: mol_type = other DNA
ttatcatactcactatag

SEQ ID NO: 14909 - DNA, 18 bp, synthetic construct
  source 1..18: mol_type = other DNA
ttatccaactcactataa

SEQ ID NO: 14910 - DNA, 18 bp, synthetic construct
  source 1..18: mol_type = other DNA
ttatccgaatcaatatag

SEQ ID NO: 14911 - DNA, 18 bp, synthetic construct
  source 1..18: mol_type = other DNA
ttatgagactcaccatag

SEQ ID NO: 14912 - DNA, 18 bp, synthetic construct
  source 1..18: mol_type = other DNA
ttatgcgactcactaacg

SEQ ID NO: 14913 - DNA, 18 bp, synthetic construct
  source 1..18: mol_type = other DNA
ttatgcgactccctatcg

SEQ ID NO: 14914 - DNA, 18 bp, synthetic construct
  source 1..18: mol_type = other DNA
ttatgcgactccctctag

SEQ ID NO: 14915 - DNA, 18 bp, synthetic construct
  source 1..18: mol_type = other DNA
ttatgtgacccactatag

SEQ ID NO: 14916 - DNA, 18 bp, synthetic construct
  source 1..18: mol_type = other DNA
ttctacgcctcactatcg

SEQ ID NO: 14917 - DNA, 18 bp, synthetic construct
  source 1..18: mol_type = other DNA
ttgaacgactcactctag

SEQ ID NO: 14918 - DNA, 18 bp, synthetic construct
  source 1..18: mol_type = other DNA
ttgtactgctcactatag

SEQ ID NO: 14919 - DNA, 18 bp, synthetic construct
  source 1..18: mol_type = other DNA
ttgtaggactcactctag

SEQ ID NO: 14920 - DNA, 18 bp, synthetic construct
  source 1..18: mol_type = other DNA
ttgtccgaatcactatag

SEQ ID NO: 14921 - DNA, 18 bp, synthetic construct
  source 1..18: mol_type = other DNA
ttttacgaatcactatcg

SEQ ID NO: 14922 - DNA, 18 bp, synthetic construct
  source 1..18: mol_type = other DNA
ttttacgactaactagag

SEQ ID NO: 14923 - DNA, 18 bp, synthetic construct
  source 1..18: mol_type = other DNA
ttttacgactcactctac

SEQ ID NO: 14924 - DNA, 18 bp, synthetic construct
  source 1..18: mol_type = other DNA
ttttacgtctcactataa

SEQ ID NO: 14925 - DNA, 18 bp, synthetic construct
  source 1..18: mol_type = other DNA
ttttaggactctctatag

SEQ ID NO: 14926 - DNA, 18 bp, synthetic construct
  source 1..18: mol_type = other DNA
ttttatgactcactatcg

SEQ ID NO: 14927 - DNA, 18 bp, synthetic construct
  source 1..18: mol_type = other DNA
ttttccgactcaccatag

SEQ ID NO: 14928 - DNA, 18 bp, synthetic construct
  source 1..18: mol_type = other DNA
tattacaactcacttttg

SEQ ID NO: 14929 - DNA, 18 bp, synthetic construct
  source 1..18: mol_type = other DNA
taatgcgtctcactaatg

SEQ ID NO: 14930 - DNA, 18 bp, synthetic construct
  source 1..18: mol_type = other DNA
taatacgacactccattg

SEQ ID NO: 14931 - DNA, 18 bp, synthetic construct
  source 1..18: mol_type = other DNA
aaatccgtctcactaaag

SEQ ID NO: 14932 - DNA, 18 bp, synthetic construct
  source 1..18: mol_type = other DNA
ttttacgactcactttgg

SEQ ID NO: 14933 - DNA, 18 bp, synthetic construct
  source 1..18: mol_type = other DNA
ttatacaactcactactg

SEQ ID NO: 14934 - DNA, 18 bp, synthetic construct
  source 1..18: mol_type = other DNA
aaaaatgactcactagag

SEQ ID NO: 14935 - DNA, 18 bp, synthetic construct
  source 1..18: mol_type = other DNA
tagtgcgtctcactttag

SEQ ID NO: 14936 - DNA, 18 bp, synthetic construct
  source 1..18: mol_type = other DNA
tatagcgactcactgtag

SEQ ID NO: 14937 - DNA, 18 bp, synthetic construct
  source 1..18: mol_type = other DNA
taatacgtcccactcaag

SEQ ID NO: 14938 - DNA, 18 bp, synthetic construct
  source 1..18: mol_type = other DNA
tgatgcgactcaccattg

SEQ ID NO: 14939 - DNA, 18 bp, synthetic construct
  source 1..18: mol_type = other DNA
tttcacgcctcactatag

SEQ ID NO: 14940 - DNA, 18 bp, synthetic construct
  source 1..18: mol_type = other DNA
ttttcagactcactatag

SEQ ID NO: 14941 - DNA, 18 bp, synthetic construct
  source 1..18: mol_type = other DNA
taatgcgtctcacttaag

SEQ ID NO: 14942 - DNA, 18 bp, synthetic construct
  source 1..18: mol_type = other DNA
ttatacgcatcactaaag

SEQ ID NO: 14943 - DNA, 18 bp, synthetic construct
  source 1..18: mol_type = other DNA
ttatacgactcgccattg

SEQ ID NO: 14944 - DNA, 18 bp, synthetic construct
  source 1..18: mol_type = other DNA
aaatacgactcgctccag

SEQ ID NO: 14945 - DNA, 18 bp, synthetic construct
  source 1..18: mol_type = other DNA
taattagactcaataaag

SEQ ID NO: 14946 - DNA, 18 bp, synthetic construct
  source 1..18: mol_type = other DNA
ttaaacgacgcactattg

SEQ ID NO: 14947 - DNA, 18 bp, synthetic construct
  source 1..18: mol_type = other DNA
taaaataactcactaaag

SEQ ID NO: 14948 - DNA, 18 bp, synthetic construct
  source 1..18: mol_type = other DNA
taatgcgactctctctcg

SEQ ID NO: 14949 - DNA, 18 bp, synthetic construct
  source 1..18: mol_type = other DNA
ttataagcctcactttag

SEQ ID NO: 14950 - DNA, 18 bp, synthetic construct
  source 1..18: mol_type = other DNA
ctatacgactcgctattg

SEQ ID NO: 14951 - DNA, 18 bp, synthetic construct
  source 1..18: mol_type = other DNA
ttatgcgactcacttttg

SEQ ID NO: 14952 - DNA, 18 bp, synthetic construct
  source 1..18: mol_type = other DNA
atatccgacacactatag

SEQ ID NO: 14953 - DNA, 18 bp, synthetic construct
  source 1..18: mol_type = other DNA
ttttacaactcactaaag

SEQ ID NO: 14954 - DNA, 18 bp, synthetic construct
  source 1..18: mol_type = other DNA
ttataggactcactgttg

SEQ ID NO: 14955 - DNA, 18 bp, synthetic construct
  source 1..18: mol_type = other DNA
aaatagaactcactatcg

SEQ ID NO: 14956 - DNA, 18 bp, synthetic construct
  source 1..18: mol_type = other DNA
caatccgtctcactatgg

SEQ ID NO: 14957 - DNA, 18 bp, synthetic construct
  source 1..18: mol_type = other DNA
taaaccgactcactttcg

SEQ ID NO: 14958 - DNA, 18 bp, synthetic construct
  source 1..18: mol_type = other DNA
tgttacgtatcactatag

SEQ ID NO: 14959 - DNA, 18 bp, synthetic construct
  source 1..18: mol_type = other DNA
ctatatgcctcactatag

SEQ ID NO: 14960 - DNA, 18 bp, synthetic construct
  source 1..18: mol_type = other DNA
ttaaaggactcactaaag

SEQ ID NO: 14961 - DNA, 18 bp, synthetic construct
  source 1..18: mol_type = other DNA
ttatacaactcacttgag

SEQ ID NO: 14962 - DNA, 18 bp, synthetic construct
  source 1..18: mol_type = other DNA
taattgaactcactattg

SEQ ID NO: 14963 - DNA, 18 bp, synthetic construct
  source 1..18: mol_type = other DNA
ttaatcgactcgctatag

SEQ ID NO: 14964 - DNA, 18 bp, synthetic construct
  source 1..18: mol_type = other DNA
taattagtctcaccatag

SEQ ID NO: 14965 - DNA, 18 bp, synthetic construct
  source 1..18: mol_type = other DNA
tgatacgacgcactgttg

SEQ ID NO: 14966 - DNA, 18 bp, synthetic construct
  source 1..18: mol_type = other DNA
gcaaacgactaactatag

SEQ ID NO: 14967 - DNA, 18 bp, synthetic construct
  source 1..18: mol_type = other DNA
taataggtctctctgtag

SEQ ID NO: 14968 - DNA, 18 bp, synthetic construct
  source 1..18: mol_type = other DNA
ttaaacgactaactaaag

SEQ ID NO: 14969 - DNA, 18 bp, synthetic construct
  source 1..18: mol_type = other DNA
taatacaactcccttttg

SEQ ID NO: 14970 - DNA, 18 bp, synthetic construct
  source 1..18: mol_type = other DNA
tagttagactcactttag

SEQ ID NO: 14971 - DNA, 18 bp, synthetic construct
  source 1..18: mol_type = other DNA
ttattcgactcaggatag

SEQ ID NO: 14972 - DNA, 18 bp, synthetic construct
  source 1..18: mol_type = other DNA
aaatacaactctgtatag

SEQ ID NO: 14973 - DNA, 18 bp, synthetic construct
  source 1..18: mol_type = other DNA
taatagaactcacttaag

SEQ ID NO: 14974 - DNA, 18 bp, synthetic construct
  source 1..18: mol_type = other DNA
taatgcgtcacactaaag

SEQ ID NO: 14975 - DNA, 18 bp, synthetic construct
  source 1..18: mol_type = other DNA
ttaaacgactcacttcag

SEQ ID NO: 14976 - DNA, 18 bp, synthetic construct
  source 1..18: mol_type = other DNA
ttaatcgactcactagag

SEQ ID NO: 14977 - DNA, 18 bp, synthetic construct
  source 1..18: mol_type = other DNA
ttatgcgattcactaaag

SEQ ID NO: 14978 - DNA, 18 bp, synthetic construct
  source 1..18: mol_type = other DNA
taaatcaactcgctatag

SEQ ID NO: 14979 - DNA, 18 bp, synthetic construct
  source 1..18: mol_type = other DNA
atatacgactcaccattg

SEQ ID NO: 14980 - DNA, 18 bp, synthetic construct
  source 1..18: mol_type = other DNA
taatgctactcacttttg

SEQ ID NO: 14981 - DNA, 18 bp, synthetic construct
  source 1..18: mol_type = other DNA
taattcaactcacgctag

SEQ ID NO: 14982 - DNA, 18 bp, synthetic construct
  source 1..18: mol_type = other DNA
taattcgtcgctctatag

SEQ ID NO: 14983 - DNA, 18 bp, synthetic construct
  source 1..18: mol_type = other DNA
taattctgcgcactatag

SEQ ID NO: 14984 - DNA, 18 bp, synthetic construct
  source 1..18: mol_type = other DNA
tatatcgactcactgtag

SEQ ID NO: 14985 - DNA, 18 bp, synthetic construct
  source 1..18: mol_type = other DNA
tattgcgactcactagtg

SEQ ID NO: 14986 - DNA, 18 bp, synthetic construct
  source 1..18: mol_type = other DNA
tgattcggctcacaatag

SEQ ID NO: 14987 - DNA, 18 bp, synthetic construct
  source 1..18: mol_type = other DNA
aaatactagtcactttag

SEQ ID NO: 14988 - DNA, 18 bp, synthetic construct
  source 1..18: mol_type = other DNA
taacaggactcaccacag

SEQ ID NO: 14989 - DNA, 18 bp, synthetic construct
  source 1..18: mol_type = other DNA
taataccactctttatcg

SEQ ID NO: 14990 - DNA, 18 bp, synthetic construct
  source 1..18: mol_type = other DNA
taatacgagcttctatag

SEQ ID NO: 14991 - DNA, 18 bp, synthetic construct
  source 1..18: mol_type = other DNA
taataggactctgtttag

SEQ ID NO: 14992 - DNA, 18 bp, synthetic construct
  source 1..18: mol_type = other DNA
tattaagacccactctag

SEQ ID NO: 14993 - DNA, 18 bp, synthetic construct
  source 1..18: mol_type = other DNA
tcctacgactcacttcag

SEQ ID NO: 14994 - DNA, 18 bp, synthetic construct
  source 1..18: mol_type = other DNA
ttaaaagactcactctag

SEQ ID NO: 14995 - DNA, 18 bp, synthetic construct
  source 1..18: mol_type = other DNA
ttagactactcacaatag

SEQ ID NO: 14996 - DNA, 18 bp, synthetic construct
  source 1..18: mol_type = other DNA
ttctacgactccctaaag

SEQ ID NO: 14997 - DNA, 18 bp, synthetic construct
  source 1..18: mol_type = other DNA
taattggactcacttttg

SEQ ID NO: 14998 - DNA, 18 bp, synthetic construct
  source 1..18: mol_type = other DNA
ttttaagactcgctatag

SEQ ID NO: 14999 - DNA, 18 bp, synthetic construct
  source 1..18: mol_type = other DNA
atatgcgactcactttag

SEQ ID NO: 15000 - DNA, 18 bp, synthetic construct
  source 1..18: mol_type = other DNA
taattcaactcactactg

SEQ ID NO: 15001 - DNA, 18 bp, synthetic construct
  source 1..18: mol_type = other DNA
tattacaactctctacag

SEQ ID NO: 15002 - DNA, 18 bp, synthetic construct
  source 1..18: mol_type = other DNA
ttattcgtctcactgtag

SEQ ID NO: 15003 - DNA, 18 bp, synthetic construct
  source 1..18: mol_type = other DNA
taatacttctcgctattg

SEQ ID NO: 15004 - DNA, 18 bp, synthetic construct
  source 1..18: mol_type = other DNA
taaagcgactcacttttg

SEQ ID NO: 15005 - DNA, 18 bp, synthetic construct
  source 1..18: mol_type = other DNA
ttatacaactcgctacag

SEQ ID NO: 15006 - DNA, 18 bp, synthetic construct
  source 1..18: mol_type = other DNA
tattacgagttactttag

SEQ ID NO: 15007 - DNA, 18 bp, synthetic construct
  source 1..18: mol_type = other DNA
taatgcgtctcacttttg

SEQ ID NO: 15008 - DNA, 18 bp, synthetic construct
  source 1..18: mol_type = other DNA
taatgtgactcgctatcg

SEQ ID NO: 15009 - DNA, 18 bp, synthetic construct
  source 1..18: mol_type = other DNA
tattttgcctcactatag

SEQ ID NO: 15010 - DNA, 18 bp, synthetic construct
  source 1..18: mol_type = other DNA
ttcatcgactcactatag

SEQ ID NO: 15011 - DNA, 18 bp, synthetic construct
  source 1..18: mol_type = other DNA
ttataggactcacttttg

SEQ ID NO: 15012 - DNA, 18 bp, synthetic construct
  source 1..18: mol_type = other DNA
ttattcgcctcactattg

SEQ ID NO: 15013 - DNA, 18 bp, synthetic construct
  source 1..18: mol_type = other DNA
taaaaggactcactcttg

SEQ ID NO: 15014 - DNA, 18 bp, synthetic construct
  source 1..18: mol_type = other DNA
ttatgcgactcactttcg

SEQ ID NO: 15015 - DNA, 18 bp, synthetic construct
  source 1..18: mol_type = other DNA
taatacgacacgcaattg

SEQ ID NO: 15016 - DNA, 18 bp, synthetic construct
  source 1..18: mol_type = other DNA
taattcgacacgccatag

SEQ ID NO: 15017 - DNA, 18 bp, synthetic construct
  source 1..18: mol_type = other DNA
aaatacgtgtcactattg

SEQ ID NO: 15018 - DNA, 18 bp, synthetic construct
  source 1..18: mol_type = other DNA
aaatccgactctctattg

SEQ ID NO: 15019 - DNA, 18 bp, synthetic construct
  source 1..18: mol_type = other DNA
caatacgactcaataatg

SEQ ID NO: 15020 - DNA, 18 bp, synthetic construct
  source 1..18: mol_type = other DNA
caatccaactcactattg

SEQ ID NO: 15021 - DNA, 18 bp, synthetic construct
  source 1..18: mol_type = other DNA
gaattcgactcactgaag

SEQ ID NO: 15022 - DNA, 18 bp, synthetic construct
  source 1..18: mol_type = other DNA
taaaactgctcgctatag

SEQ ID NO: 15023 - DNA, 18 bp, synthetic construct
  source 1..18: mol_type = other DNA
taaagcgactcaatattg

SEQ ID NO: 15024 - DNA, 18 bp, synthetic construct
  source 1..18: mol_type = other DNA
taacaccacccgctatag

SEQ ID NO: 15025 - DNA, 18 bp, synthetic construct
  source 1..18: mol_type = other DNA
taacacgcctcaatattg

SEQ ID NO: 15026 - DNA, 18 bp, synthetic construct
  source 1..18: mol_type = other DNA
taataaaactcgctttag

SEQ ID NO: 15027 - DNA, 18 bp, synthetic construct
  source 1..18: mol_type = other DNA
taataccactcacatttg

SEQ ID NO: 15028 - DNA, 18 bp, synthetic construct
  source 1..18: mol_type = other DNA
taatacgacttaccactg

SEQ ID NO: 15029 - DNA, 18 bp, synthetic construct
  source 1..18: mol_type = other DNA
taatatgagtcaccattg

SEQ ID NO: 15030 - DNA, 18 bp, synthetic construct
  source 1..18: mol_type = other DNA
taatattactcgccatag

SEQ ID NO: 15031 - DNA, 18 bp, synthetic construct
  source 1..18: mol_type = other DNA
taatccgaatcactgttg

SEQ ID NO: 15032 - DNA, 18 bp, synthetic construct
  source 1..18: mol_type = other DNA
taatccgaatcgttatag

SEQ ID NO: 15033 - DNA, 18 bp, synthetic construct
  source 1..18: mol_type = other DNA
taattggactcactcaag

SEQ ID NO: 15034 - DNA, 18 bp, synthetic construct
  source 1..18: mol_type = other DNA
taatttgactcagtttag

SEQ ID NO: 15035 - DNA, 18 bp, synthetic construct
  source 1..18: mol_type = other DNA
tactacgactcacagttg

SEQ ID NO: 15036 - DNA, 18 bp, synthetic construct
  source 1..18: mol_type = other DNA
tacttcgactctctatgg

SEQ ID NO: 15037 - DNA, 18 bp, synthetic construct
  source 1..18: mol_type = other DNA
tagttcgagtcactatcg

SEQ ID NO: 15038 - DNA, 18 bp, synthetic construct
  source 1..18: mol_type = other DNA
tataacgactcgccatag

SEQ ID NO: 15039 - DNA, 18 bp, synthetic construct
  source 1..18: mol_type = other DNA
tattaccacttactattg

SEQ ID NO: 15040 - DNA, 18 bp, synthetic construct
  source 1..18: mol_type = other DNA
tatttccacgcactatag

SEQ ID NO: 15041 - DNA, 18 bp, synthetic construct
  source 1..18: mol_type = other DNA
tcataagactctctattg

SEQ ID NO: 15042 - DNA, 18 bp, synthetic construct
  source 1..18: mol_type = other DNA
tcattcgactcagaatag

SEQ ID NO: 15043 - DNA, 18 bp, synthetic construct
  source 1..18: mol_type = other DNA
tctcacgactcgctatag

SEQ ID NO: 15044 - DNA, 18 bp, synthetic construct
  source 1..18: mol_type = other DNA
tgatacgactccctcttg

SEQ ID NO: 15045 - DNA, 18 bp, synthetic construct
  source 1..18: mol_type = other DNA
ttatacgactcgctagcg

SEQ ID NO: 15046 - DNA, 18 bp, synthetic construct
  source 1..18: mol_type = other DNA
ttattccactccctatag

SEQ ID NO: 15047 - DNA, 18 bp, synthetic construct
  source 1..18: mol_type = other DNA
ttattcgactccccatag

SEQ ID NO: 15048 - DNA, 18 bp, synthetic construct
  source 1..18: mol_type = other DNA
aaaaactactcacgatag

SEQ ID NO: 15049 - DNA, 18 bp, synthetic construct
  source 1..18: mol_type = other DNA
aaagatgaatcactatag

SEQ ID NO: 15050 - DNA, 18 bp, synthetic construct
  source 1..18: mol_type = other DNA
aaataagcctctctatag

SEQ ID NO: 15051 - DNA, 18 bp, synthetic construct
  source 1..18: mol_type = other DNA
aataacgactcacgatag

SEQ ID NO: 15052 - DNA, 18 bp, synthetic construct
  source 1..18: mol_type = other DNA
aattccgactcattatag

SEQ ID NO: 15053 - DNA, 18 bp, synthetic construct
  source 1..18: mol_type = other DNA
agatacaacacactatag

SEQ ID NO: 15054 - DNA, 18 bp, synthetic construct
  source 1..18: mol_type = other DNA
ccatacgacacaccatag

SEQ ID NO: 15055 - DNA, 18 bp, synthetic construct
  source 1..18: mol_type = other DNA
ccatatggctcactatag

SEQ ID NO: 15056 - DNA, 18 bp, synthetic construct
  source 1..18: mol_type = other DNA
cgataagactcactttag

SEQ ID NO: 15057 - DNA, 18 bp, synthetic construct
  source 1..18: mol_type = other DNA
ctatacaactcactctag

SEQ ID NO: 15058 - DNA, 18 bp, synthetic construct
  source 1..18: mol_type = other DNA
ctatacgactaattatag

SEQ ID NO: 15059 - DNA, 18 bp, synthetic construct
  source 1..18: mol_type = other DNA
taaaacgaattacgatag

SEQ ID NO: 15060 - DNA, 18 bp, synthetic construct
  source 1..18: mol_type = other DNA
taaaacgactcacctaag

SEQ ID NO: 15061 - DNA, 18 bp, synthetic construct
  source 1..18: mol_type = other DNA
taaaacgactcagtctgg

SEQ ID NO: 15062 - DNA, 18 bp, synthetic construct
  source 1..18: mol_type = other DNA
taaaacgactctccacag

SEQ ID NO: 15063 - DNA, 18 bp, synthetic construct
  source 1..18: mol_type = other DNA
taaaacggctcccaatag

SEQ ID NO: 15064 - DNA, 18 bp, synthetic construct
  source 1..18: mol_type = other DNA
taaagcgactcacttcag

SEQ ID NO: 15065 - DNA, 18 bp, synthetic construct
  source 1..18: mol_type = other DNA
taaagcgcctcactaaag

SEQ ID NO: 15066 - DNA, 18 bp, synthetic construct
  source 1..18: mol_type = other DNA
taaagcgtctcactaaag

SEQ ID NO: 15067 - DNA, 18 bp, synthetic construct
  source 1..18: mol_type = other DNA
taacacatctcactatcg

SEQ ID NO: 15068 - DNA, 18 bp, synthetic construct
  source 1..18: mol_type = other DNA
taacacgactctcaatcg

SEQ ID NO: 15069 - DNA, 18 bp, synthetic construct
  source 1..18: mol_type = other DNA
taataacgctcactaaag

SEQ ID NO: 15070 - DNA, 18 bp, synthetic construct
  source 1..18: mol_type = other DNA
taataaggttaactatag

SEQ ID NO: 15071 - DNA, 18 bp, synthetic construct
  source 1..18: mol_type = other DNA
taatacccctcacttgag

SEQ ID NO: 15072 - DNA, 18 bp, synthetic construct
  source 1..18: mol_type = other DNA
taatacgaattcgtatag

SEQ ID NO: 15073 - DNA, 18 bp, synthetic construct
  source 1..18: mol_type = other DNA
taatacgacacatcagag

SEQ ID NO: 15074 - DNA, 18 bp, synthetic construct
  source 1..18: mol_type = other DNA
taatacgacataatctag

SEQ ID NO: 15075 - DNA, 18 bp, synthetic construct
  source 1..18: mol_type = other DNA
taatacgactcagaaacg

SEQ ID NO: 15076 - DNA, 18 bp, synthetic construct
  source 1..18: mol_type = other DNA
taatacgactccgtctgg

SEQ ID NO: 15077 - DNA, 18 bp, synthetic construct
  source 1..18: mol_type = other DNA
taatacgactgtcgatcg

SEQ ID NO: 15078 - DNA, 18 bp, synthetic construct
  source 1..18: mol_type = other DNA
taatacgatccaataaag

SEQ ID NO: 15079 - DNA, 18 bp, synthetic construct
  source 1..18: mol_type = other DNA
taatacggctgacgacag

SEQ ID NO: 15080 - DNA, 18 bp, synthetic construct
  source 1..18: mol_type = other DNA
taatacgtctctctcgag

SEQ ID NO: 15081 - DNA, 18 bp, synthetic construct
  source 1..18: mol_type = other DNA
taatactactaacttcag

SEQ ID NO: 15082 - DNA, 18 bp, synthetic construct
  source 1..18: mol_type = other DNA
taataggactgaccatgg

SEQ ID NO: 15083 - DNA, 18 bp, synthetic construct
  source 1..18: mol_type = other DNA
taatatgactctggatag

SEQ ID NO: 15084 - DNA, 18 bp, synthetic construct
  source 1..18: mol_type = other DNA
taatccaactcattaaag

SEQ ID NO: 15085 - DNA, 18 bp, synthetic construct
  source 1..18: mol_type = other DNA
taatcccacacactatcg

SEQ ID NO: 15086 - DNA, 18 bp, synthetic construct
  source 1..18: mol_type = other DNA
taatgctactcactaacg

SEQ ID NO: 15087 - DNA, 18 bp, synthetic construct
  source 1..18: mol_type = other DNA
tacaacgacttagtatag

SEQ ID NO: 15088 - DNA, 18 bp, synthetic construct
  source 1..18: mol_type = other DNA
tactaggactcaatctag

SEQ ID NO: 15089 - DNA, 18 bp, synthetic construct
  source 1..18: mol_type = other DNA
tatcacgactaactctag

SEQ ID NO: 15090 - DNA, 18 bp, synthetic construct
  source 1..18: mol_type = other DNA
tattccgactcactaacg

SEQ ID NO: 15091 - DNA, 18 bp, synthetic construct
  source 1..18: mol_type = other DNA
tattgcgactaactaaag

SEQ ID NO: 15092 - DNA, 18 bp, synthetic construct
  source 1..18: mol_type = other DNA
tattgcgactcagtctag

SEQ ID NO: 15093 - DNA, 18 bp, synthetic construct
  source 1..18: mol_type = other DNA
tcatacgacaccctatgg

SEQ ID NO: 15094 - DNA, 18 bp, synthetic construct
  source 1..18: mol_type = other DNA
tcttacgacacactctag

SEQ ID NO: 15095 - DNA, 18 bp, synthetic construct
  source 1..18: mol_type = other DNA
tgatacgtcacaatatag

SEQ ID NO: 15096 - DNA, 18 bp, synthetic construct
  source 1..18: mol_type = other DNA
tgatacgtcacaccatag

SEQ ID NO: 15097 - DNA, 18 bp, synthetic construct
  source 1..18: mol_type = other DNA
tgatgtaactcactatag

SEQ ID NO: 15098 - DNA, 18 bp, synthetic construct
  source 1..18: mol_type = other DNA
tgctacgaatcagtatag

SEQ ID NO: 15099 - DNA, 18 bp, synthetic construct
  source 1..18: mol_type = other DNA
ttaaacgactcactgcag

SEQ ID NO: 15100 - DNA, 18 bp, synthetic construct
  source 1..18: mol_type = other DNA
ttaaacgactcagtatgg

SEQ ID NO: 15101 - DNA, 18 bp, synthetic construct
  source 1..18: mol_type = other DNA
ttacacgagtcactttag

SEQ ID NO: 15102 - DNA, 18 bp, synthetic construct
  source 1..18: mol_type = other DNA
ttataacactcagtatag

SEQ ID NO: 15103 - DNA, 18 bp, synthetic construct
  source 1..18: mol_type = other DNA
ttataagactcactacgg

SEQ ID NO: 15104 - DNA, 18 bp, synthetic construct
  source 1..18: mol_type = other DNA
ttatacagctcactctag

SEQ ID NO: 15105 - DNA, 18 bp, synthetic construct
  source 1..18: mol_type = other DNA
ttatacgacttactctgg

SEQ ID NO: 15106 - DNA, 18 bp, synthetic construct
  source 1..18: mol_type = other DNA
ttatatgactctctctag

SEQ ID NO: 15107 - DNA, 18 bp, synthetic construct
  source 1..18: mol_type = other DNA
ttatgcgactccctttag

SEQ ID NO: 15108 - DNA, 18 bp, synthetic construct
  source 1..18: mol_type = other DNA
ttatgcggatcactatag

SEQ ID NO: 15109 - DNA, 18 bp, synthetic construct
  source 1..18: mol_type = other DNA
ttgtacgactgcctatag

SEQ ID NO: 15110 - DNA, 18 bp, synthetic construct
  source 1..18: mol_type = other DNA
ttttacgactcactctcg

SEQ ID NO: 15111 - DNA, 18 bp, synthetic construct
  source 1..18: mol_type = other DNA
ttattgaactcactatag

SEQ ID NO: 15112 - DNA, 18 bp, synthetic construct
  source 1..18: mol_type = other DNA
ttttacgactcactactg

SEQ ID NO: 15113 - DNA, 18 bp, synthetic construct
  source 1..18: mol_type = other DNA
ttttgcgtctcactatag

SEQ ID NO: 15114 - DNA, 18 bp, synthetic construct
  source 1..18: mol_type = other DNA
caattagactcactattg

SEQ ID NO: 15115 - DNA, 18 bp, synthetic construct
  source 1..18: mol_type = other DNA
tatttagactcactattg

SEQ ID NO: 15116 - DNA, 18 bp, synthetic construct
  source 1..18: mol_type = other DNA
taaatcgactcacactag

SEQ ID NO: 15117 - DNA, 18 bp, synthetic construct
  source 1..18: mol_type = other DNA
taatacgtctcgctaatg

SEQ ID NO: 15118 - DNA, 18 bp, synthetic construct
  source 1..18: mol_type = other DNA
taaatggactcactttag

SEQ ID NO: 15119 - DNA, 18 bp, synthetic construct
  source 1..18: mol_type = other DNA
taacacacctcactattg

SEQ ID NO: 15120 - DNA, 18 bp, synthetic construct
  source 1..18: mol_type = other DNA
taattcgactctcttaag

SEQ ID NO: 15121 - DNA, 18 bp, synthetic construct
  source 1..18: mol_type = other DNA
caataagactcacgatcg

SEQ ID NO: 15122 - DNA, 18 bp, synthetic construct
  source 1..18: mol_type = other DNA
taatacaactcgcttaag

SEQ ID NO: 15123 - DNA, 18 bp, synthetic construct
  source 1..18: mol_type = other DNA
tagtacgactctttttag

SEQ ID NO: 15124 - DNA, 18 bp, synthetic construct
  source 1..18: mol_type = other DNA
gaattcgtctcactattg

SEQ ID NO: 15125 - DNA, 18 bp, synthetic construct
  source 1..18: mol_type = other DNA
taatttgactcgctattg

SEQ ID NO: 15126 - DNA, 18 bp, synthetic construct
  source 1..18: mol_type = other DNA
taatacgacacgctaatg

SEQ ID NO: 15127 - DNA, 18 bp, synthetic construct
  source 1..18: mol_type = other DNA
taattcgactcggtaaag

SEQ ID NO: 15128 - DNA, 18 bp, synthetic construct
  source 1..18: mol_type = other DNA
taaagcgactcgctaaag

SEQ ID NO: 15129 - DNA, 18 bp, synthetic construct
  source 1..18: mol_type = other DNA
taatacgcatcacttttg

SEQ ID NO: 15130 - DNA, 18 bp, synthetic construct
  source 1..18: mol_type = other DNA
taatgcgcctctctattg

SEQ ID NO: 15131 - DNA, 18 bp, synthetic construct
  source 1..18: mol_type = other DNA
taattaaactcactatcg

SEQ ID NO: 15132 - DNA, 18 bp, synthetic construct
  source 1..18: mol_type = other DNA
tagtacgacccacttttg

SEQ ID NO: 15133 - DNA, 18 bp, synthetic construct
  source 1..18: mol_type = other DNA
tatttcgactcacgatgg

SEQ ID NO: 15134 - DNA, 18 bp, synthetic construct
  source 1..18: mol_type = other DNA
ttattcaactcactgtag

SEQ ID NO: 15135 - DNA, 18 bp, synthetic construct
  source 1..18: mol_type = other DNA
aaatacgcgtcactatgg

SEQ ID NO: 15136 - DNA, 18 bp, synthetic construct
  source 1..18: mol_type = other DNA
aaatactactcaatatgg

SEQ ID NO: 15137 - DNA, 18 bp, synthetic construct
  source 1..18: mol_type = other DNA
taaagcaagtcactatag

SEQ ID NO: 15138 - DNA, 18 bp, synthetic construct
  source 1..18: mol_type = other DNA
taataagtatcactctag

SEQ ID NO: 15139 - DNA, 18 bp, synthetic construct
  source 1..18: mol_type = other DNA
taatacgaagaacaatag

SEQ ID NO: 15140 - DNA, 18 bp, synthetic construct
  source 1..18: mol_type = other DNA
taatacggtgcattatag

SEQ ID NO: 15141 - DNA, 18 bp, synthetic construct
  source 1..18: mol_type = other DNA
taatagaactcacaaaag

SEQ ID NO: 15142 - DNA, 18 bp, synthetic construct
  source 1..18: mol_type = other DNA
taatccgacatattatag

SEQ ID NO: 15143 - DNA, 18 bp, synthetic construct
  source 1..18: mol_type = other DNA
taatcggaatcactatcg

SEQ ID NO: 15144 - DNA, 18 bp, synthetic construct
  source 1..18: mol_type = other DNA
tagtacgactctctccag

SEQ ID NO: 15145 - DNA, 18 bp, synthetic construct
  source 1..18: mol_type = other DNA
tattaccactcaccacag

SEQ ID NO: 15146 - DNA, 18 bp, synthetic construct
  source 1..18: mol_type = other DNA
tattatgactaactagag

SEQ ID NO: 15147 - DNA, 18 bp, synthetic construct
  source 1..18: mol_type = other DNA
ttacacaactcactttag

SEQ ID NO: 15148 - DNA, 18 bp, synthetic construct
  source 1..18: mol_type = other DNA
tgatacgtctcgcaatag

SEQ ID NO: 15149 - DNA, 18 bp, synthetic construct
  source 1..18: mol_type = other DNA
ttatacaactcacttaag

SEQ ID NO: 15150 - DNA, 18 bp, synthetic construct
  source 1..18: mol_type = other DNA
ttatacgtctcactactg

SEQ ID NO: 15151 - DNA, 18 bp, synthetic construct
  source 1..18: mol_type = other DNA
taattcgactcacaaatg

SEQ ID NO: 15152 - DNA, 18 bp, synthetic construct
  source 1..18: mol_type = other DNA
aaataagactcgctattg

SEQ ID NO: 15153 - DNA, 18 bp, synthetic construct
  source 1..18: mol_type = other DNA
taaatcgcctcactttag

SEQ ID NO: 15154 - DNA, 18 bp, synthetic construct
  source 1..18: mol_type = other DNA
taatacgtctcggtacag

SEQ ID NO: 15155 - DNA, 18 bp, synthetic construct
  source 1..18: mol_type = other DNA
ttattcgactcaccgtag

SEQ ID NO: 15156 - DNA, 18 bp, synthetic construct
  source 1..18: mol_type = other DNA
aattaggactcagtatag

SEQ ID NO: 15157 - DNA, 18 bp, synthetic construct
  source 1..18: mol_type = other DNA
taaaacaactccttatag

SEQ ID NO: 15158 - DNA, 18 bp, synthetic construct
  source 1..18: mol_type = other DNA
taatgcgacatactgtag

SEQ ID NO: 15159 - DNA, 18 bp, synthetic construct
  source 1..18: mol_type = other DNA
ttataaaactcactctag

SEQ ID NO: 15160 - DNA, 18 bp, synthetic construct
  source 1..18: mol_type = other DNA
ttatactagtcattatag

SEQ ID NO: 15161 - DNA, 18 bp, synthetic construct
  source 1..18: mol_type = other DNA
tattgcgtctcactttag

SEQ ID NO: 15162 - DNA, 18 bp, synthetic construct
  source 1..18: mol_type = other DNA
ttattcgtctcactaaag

SEQ ID NO: 15163 - DNA, 18 bp, synthetic construct
  source 1..18: mol_type = other DNA
taatacgtcacgcaatag

SEQ ID NO: 15164 - DNA, 18 bp, synthetic construct
  source 1..18: mol_type = other DNA
taatataactcaatattg

SEQ ID NO: 15165 - DNA, 18 bp, synthetic construct
  source 1..18: mol_type = other DNA
tttttcgactcactatcg

SEQ ID NO: 15166 - DNA, 18 bp, synthetic construct
  source 1..18: mol_type = other DNA
aaatctgagtcactatag

SEQ ID NO: 15167 - DNA, 18 bp, synthetic construct
  source 1..18: mol_type = other DNA
gtctccgactcactatag

SEQ ID NO: 15168 - DNA, 18 bp, synthetic construct
  source 1..18: mol_type = other DNA
taatataactcactaagg

SEQ ID NO: 15169 - DNA, 18 bp, synthetic construct
  source 1..18: mol_type = other DNA
taatgcaactcacagtag

SEQ ID NO: 15170 - DNA, 18 bp, synthetic construct
  source 1..18: mol_type = other DNA
ttgtacgtctcactttag

SEQ ID NO: 15171 - DNA, 18 bp, synthetic construct
  source 1..18: mol_type = other DNA
ttatacgactcacttctg

SEQ ID NO: 15172 - DNA, 18 bp, synthetic construct
  source 1..18: mol_type = other DNA
taaaacgtctcactactg

SEQ ID NO: 15173 - DNA, 18 bp, synthetic construct
  source 1..18: mol_type = other DNA
taataggactcacgaatg

SEQ ID NO: 15174 - DNA, 18 bp, synthetic construct
  source 1..18: mol_type = other DNA
taatacgtcccactttcg

SEQ ID NO: 15175 - DNA, 18 bp, synthetic construct
  source 1..18: mol_type = other DNA
tagtacgacattctatag

SEQ ID NO: 15176 - DNA, 18 bp, synthetic construct
  source 1..18: mol_type = other DNA
tatttagactcactttag

SEQ ID NO: 15177 - DNA, 18 bp, synthetic construct
  source 1..18: mol_type = other DNA
taatacgactcgcctgag

SEQ ID NO: 15178 - DNA, 18 bp, synthetic construct
  source 1..18: mol_type = other DNA
taattcgtctctccatag

SEQ ID NO: 15179 - DNA, 18 bp, synthetic construct
  source 1..18: mol_type = other DNA
taatacgtgtctctttag

SEQ ID NO: 15180 - DNA, 18 bp, synthetic construct
  source 1..18: mol_type = other DNA
taaagcgactcaccattg

SEQ ID NO: 15181 - DNA, 18 bp, synthetic construct
  source 1..18: mol_type = other DNA
tattatgactcacttttg

SEQ ID NO: 15182 - DNA, 18 bp, synthetic construct
  source 1..18: mol_type = other DNA
tttaacgactcactatgg

SEQ ID NO: 15183 - DNA, 18 bp, synthetic construct
  source 1..18: mol_type = other DNA
tataaggactcactttag

SEQ ID NO: 15184 - DNA, 18 bp, synthetic construct
  source 1..18: mol_type = other DNA
ttttacgactctctctag

SEQ ID NO: 15185 - DNA, 18 bp, synthetic construct
  source 1..18: mol_type = other DNA
taaatggactcgctatag

SEQ ID NO: 15186 - DNA, 18 bp, synthetic construct
  source 1..18: mol_type = other DNA
taatacgtgtcgctattg

SEQ ID NO: 15187 - DNA, 18 bp, synthetic construct
  source 1..18: mol_type = other DNA
aaatagaactcgctatag

SEQ ID NO: 15188 - DNA, 18 bp, synthetic construct
  source 1..18: mol_type = other DNA
aaatatgactcacttttg

SEQ ID NO: 15189 - DNA, 18 bp, synthetic construct
  source 1..18: mol_type = other DNA
taaaaggactcactaatg

SEQ ID NO: 15190 - DNA, 18 bp, synthetic construct
  source 1..18: mol_type = other DNA
taattcccctcactgtag

SEQ ID NO: 15191 - DNA, 18 bp, synthetic construct
  source 1..18: mol_type = other DNA
ttaaacgactcgttatag

SEQ ID NO: 15192 - DNA, 18 bp, synthetic construct
  source 1..18: mol_type = other DNA
ttatacgactcgctgtcg

SEQ ID NO: 15193 - DNA, 18 bp, synthetic construct
  source 1..18: mol_type = other DNA
aaatacaacttactttag

SEQ ID NO: 15194 - DNA, 18 bp, synthetic construct
  source 1..18: mol_type = other DNA
aaatgcgactcacgaaag

SEQ ID NO: 15195 - DNA, 18 bp, synthetic construct
  source 1..18: mol_type = other DNA
caataagactcaccttag

SEQ ID NO: 15196 - DNA, 18 bp, synthetic construct
  source 1..18: mol_type = other DNA
caatatgtctcactagag

SEQ ID NO: 15197 - DNA, 18 bp, synthetic construct
  source 1..18: mol_type = other DNA
gagtgcgactcactttag

SEQ ID NO: 15198 - DNA, 18 bp, synthetic construct
  source 1..18: mol_type = other DNA
gattaccgctcactatag

SEQ ID NO: 15199 - DNA, 18 bp, synthetic construct
  source 1..18: mol_type = other DNA
taaagcgactctctaaag

SEQ ID NO: 15200 - DNA, 18 bp, synthetic construct
  source 1..18: mol_type = other DNA
taagacgagtcacaaaag

SEQ ID NO: 15201 - DNA, 18 bp, synthetic construct
  source 1..18: mol_type = other DNA
taatacgatttcctacag

SEQ ID NO: 15202 - DNA, 18 bp, synthetic construct
  source 1..18: mol_type = other DNA
taatactactcaccaacg

SEQ ID NO: 15203 - DNA, 18 bp, synthetic construct
  source 1..18: mol_type = other DNA
tactacgaataactctag

SEQ ID NO: 15204 - DNA, 18 bp, synthetic construct
  source 1..18: mol_type = other DNA
tattacgactttatatag

SEQ ID NO: 15205 - DNA, 18 bp, synthetic construct
  source 1..18: mol_type = other DNA
tattccgactcactctgg

SEQ ID NO: 15206 - DNA, 18 bp, synthetic construct
  source 1..18: mol_type = other DNA
tattgcgactctctatcg

SEQ ID NO: 15207 - DNA, 18 bp, synthetic construct
  source 1..18: mol_type = other DNA
ttaaaccgctcactatag

SEQ ID NO: 15208 - DNA, 18 bp, synthetic construct
  source 1..18: mol_type = other DNA
ttatccgacccactgtag

SEQ ID NO: 15209 - DNA, 18 bp, synthetic construct
  source 1..18: mol_type = other DNA
ttttaggtctcactatag

SEQ ID NO: 15210 - DNA, 18 bp, synthetic construct
  source 1..18: mol_type = other DNA
taattcgcctcgctattg

SEQ ID NO: 15211 - DNA, 18 bp, synthetic construct
  source 1..18: mol_type = other DNA
aaattcgactcgctatcg

SEQ ID NO: 15212 - DNA, 18 bp, synthetic construct
  source 1..18: mol_type = other DNA
caattccactcactattg

SEQ ID NO: 15213 - DNA, 18 bp, synthetic construct
  source 1..18: mol_type = other DNA
caattcgactagctatag

SEQ ID NO: 15214 - DNA, 18 bp, synthetic construct
  source 1..18: mol_type = other DNA
caattcgactcgctttag

SEQ ID NO: 15215 - DNA, 18 bp, synthetic construct
  source 1..18: mol_type = other DNA
caattcgacttgctatag

SEQ ID NO: 15216 - DNA, 18 bp, synthetic construct
  source 1..18: mol_type = other DNA
taaatcgattcgctatag

SEQ ID NO: 15217 - DNA, 18 bp, synthetic construct
  source 1..18: mol_type = other DNA
taataagactcgctgttg

SEQ ID NO: 15218 - DNA, 18 bp, synthetic construct
  source 1..18: mol_type = other DNA
taataaggctcgctattg

SEQ ID NO: 15219 - DNA, 18 bp, synthetic construct
  source 1..18: mol_type = other DNA
taatacgacacggtattg

SEQ ID NO: 15220 - DNA, 18 bp, synthetic construct
  source 1..18: mol_type = other DNA
taatatgagtcgctattg

SEQ ID NO: 15221 - DNA, 18 bp, synthetic construct
  source 1..18: mol_type = other DNA
taatgcgactcgctatta

SEQ ID NO: 15222 - DNA, 18 bp, synthetic construct
  source 1..18: mol_type = other DNA
taattagactcgatatag

SEQ ID NO: 15223 - DNA, 18 bp, synthetic construct
  source 1..18: mol_type = other DNA
taattagactcggtatag

SEQ ID NO: 15224 - DNA, 18 bp, synthetic construct
  source 1..18: mol_type = other DNA
taattcaactcactatta

SEQ ID NO: 15225 - DNA, 18 bp, synthetic construct
  source 1..18: mol_type = other DNA
taattcaactcgctgtag

SEQ ID NO: 15226 - DNA, 18 bp, synthetic construct
  source 1..18: mol_type = other DNA
taattcaacttgctatag

SEQ ID NO: 15227 - DNA, 18 bp, synthetic construct
  source 1..18: mol_type = other DNA
taattcgacctactattg

SEQ ID NO: 15228 - DNA, 18 bp, synthetic construct
  source 1..18: mol_type = other DNA
taattcgacgaactattg

SEQ ID NO: 15229 - DNA, 18 bp, synthetic construct
  source 1..18: mol_type = other DNA
taattcgactcaatgttg

SEQ ID NO: 15230 - DNA, 18 bp, synthetic construct
  source 1..18: mol_type = other DNA
taattcgactcagtatta

SEQ ID NO: 15231 - DNA, 18 bp, synthetic construct
  source 1..18: mol_type = other DNA
taattcgactcgcaatcg

SEQ ID NO: 15232 - DNA, 18 bp, synthetic construct
  source 1..18: mol_type = other DNA
taattcgacttacgattg

SEQ ID NO: 15233 - DNA, 18 bp, synthetic construct
  source 1..18: mol_type = other DNA
taattcgagtcgctatgg

SEQ ID NO: 15234 - DNA, 18 bp, synthetic construct
  source 1..18: mol_type = other DNA
taattcggctcactactg

SEQ ID NO: 15235 - DNA, 18 bp, synthetic construct
  source 1..18: mol_type = other DNA
taatttgtctcgctatag

SEQ ID NO: 15236 - DNA, 18 bp, synthetic construct
  source 1..18: mol_type = other DNA
tacttcggctcgctatag

SEQ ID NO: 15237 - DNA, 18 bp, synthetic construct
  source 1..18: mol_type = other DNA
tagtgcgactcgctattg

SEQ ID NO: 15238 - DNA, 18 bp, synthetic construct
  source 1..18: mol_type = other DNA
ttatacgaatcgctattg

SEQ ID NO: 15239 - DNA, 18 bp, synthetic construct
  source 1..18: mol_type = other DNA
ttatacgacacgctattg

SEQ ID NO: 15240 - DNA, 18 bp, synthetic construct
  source 1..18: mol_type = other DNA
ttatacgacccgctattg

SEQ ID NO: 15241 - DNA, 18 bp, synthetic construct
  source 1..18: mol_type = other DNA
ttatacgattcgctattg

SEQ ID NO: 15242 - DNA, 18 bp, synthetic construct
  source 1..18: mol_type = other DNA
ttatccgactcgctattg

SEQ ID NO: 15243 - DNA, 18 bp, synthetic construct
  source 1..18: mol_type = other DNA
ttattcgactcgatatag

SEQ ID NO: 15244 - DNA, 18 bp, synthetic construct
  source 1..18: mol_type = other DNA
ttattggactcgctatag

SEQ ID NO: 15245 - DNA, 18 bp, synthetic construct
  source 1..18: mol_type = other DNA
aaatacgacccactagtg

SEQ ID NO: 15246 - DNA, 18 bp, synthetic construct
  source 1..18: mol_type = other DNA
aaatacgactcattgttg

SEQ ID NO: 15247 - DNA, 18 bp, synthetic construct
  source 1..18: mol_type = other DNA
aaatacgattcgcaatag

SEQ ID NO: 15248 - DNA, 18 bp, synthetic construct
  source 1..18: mol_type = other DNA
aaatacggctcattattg

SEQ ID NO: 15249 - DNA, 18 bp, synthetic construct
  source 1..18: mol_type = other DNA
aaataggactcattattg

SEQ ID NO: 15250 - DNA, 18 bp, synthetic construct
  source 1..18: mol_type = other DNA
aaatgcgactcattattg

SEQ ID NO: 15251 - DNA, 18 bp, synthetic construct
  source 1..18: mol_type = other DNA
aaatgcgactcgctatgg

SEQ ID NO: 15252 - DNA, 18 bp, synthetic construct
  source 1..18: mol_type = other DNA
aaattcgacaaactatag

SEQ ID NO: 15253 - DNA, 18 bp, synthetic construct
  source 1..18: mol_type = other DNA
aaattcgattcattatag

SEQ ID NO: 15254 - DNA, 18 bp, synthetic construct
  source 1..18: mol_type = other DNA
aaatttgactcaccatag

SEQ ID NO: 15255 - DNA, 18 bp, synthetic construct
  source 1..18: mol_type = other DNA
aactacgacttgctatag

SEQ ID NO: 15256 - DNA, 18 bp, synthetic construct
  source 1..18: mol_type = other DNA
aagtgcgactcgctatag

SEQ ID NO: 15257 - DNA, 18 bp, synthetic construct
  source 1..18: mol_type = other DNA
aagttcgactcattatag

SEQ ID NO: 15258 - DNA, 18 bp, synthetic construct
  source 1..18: mol_type = other DNA
aattacgactcggtatag

SEQ ID NO: 15259 - DNA, 18 bp, synthetic construct
  source 1..18: mol_type = other DNA
aatttcgactcactgtag

SEQ ID NO: 15260 - DNA, 18 bp, synthetic construct
  source 1..18: mol_type = other DNA
acatacgactcacgattg

SEQ ID NO: 15261 - DNA, 18 bp, synthetic construct
  source 1..18: mol_type = other DNA
agattcgattcactatag

SEQ ID NO: 15262 - DNA, 18 bp, synthetic construct
  source 1..18: mol_type = other DNA
caaaacgactcggtatag

SEQ ID NO: 15263 - DNA, 18 bp, synthetic construct
  source 1..18: mol_type = other DNA
caagaagactcgctatag

SEQ ID NO: 15264 - DNA, 18 bp, synthetic construct
  source 1..18: mol_type = other DNA
caatacaactcgcaatag

SEQ ID NO: 15265 - DNA, 18 bp, synthetic construct
  source 1..18: mol_type = other DNA
caataccactcactgttg

SEQ ID NO: 15266 - DNA, 18 bp, synthetic construct
  source 1..18: mol_type = other DNA
caatacgactcagtgttg

SEQ ID NO: 15267 - DNA, 18 bp, synthetic construct
  source 1..18: mol_type = other DNA
caatacggttcactattg

SEQ ID NO: 15268 - DNA, 18 bp, synthetic construct
  source 1..18: mol_type = other DNA
caatacgtatcactattg

SEQ ID NO: 15269 - DNA, 18 bp, synthetic construct
  source 1..18: mol_type = other DNA
caatacgtcttactattg

SEQ ID NO: 15270 - DNA, 18 bp, synthetic construct
  source 1..18: mol_type = other DNA
caatccggctcactattg

SEQ ID NO: 15271 - DNA, 18 bp, synthetic construct
  source 1..18: mol_type = other DNA
caattcgactatctatag

SEQ ID NO: 15272 - DNA, 18 bp, synthetic construct
  source 1..18: mol_type = other DNA
caattcggctcactttag

SEQ ID NO: 15273 - DNA, 18 bp, synthetic construct
  source 1..18: mol_type = other DNA
caatttgactcagtatag

SEQ ID NO: 15274 - DNA, 18 bp, synthetic construct
  source 1..18: mol_type = other DNA
cacatcgactcactatag

SEQ ID NO: 15275 - DNA, 18 bp, synthetic construct
  source 1..18: mol_type = other DNA
cactacgactcattattg

SEQ ID NO: 15276 - DNA, 18 bp, synthetic construct
  source 1..18: mol_type = other DNA
cactacgtctcactattg

SEQ ID NO: 15277 - DNA, 18 bp, synthetic construct
  source 1..18: mol_type = other DNA
cagtacgactcactaatg

SEQ ID NO: 15278 - DNA, 18 bp, synthetic construct
  source 1..18: mol_type = other DNA
cgataggactcactattg

SEQ ID NO: 15279 - DNA, 18 bp, synthetic construct
  source 1..18: mol_type = other DNA
ctatttgactcactatag

SEQ ID NO: 15280 - DNA, 18 bp, synthetic construct
  source 1..18: mol_type = other DNA
gaaaacgactcactactg

SEQ ID NO: 15281 - DNA, 18 bp, synthetic construct
  source 1..18: mol_type = other DNA
gaaatcgactcattatag

SEQ ID NO: 15282 - DNA, 18 bp, synthetic construct
  source 1..18: mol_type = other DNA
gaataagactcgctaaag

SEQ ID NO: 15283 - DNA, 18 bp, synthetic construct
  source 1..18: mol_type = other DNA
gaatacgtttcactattg

SEQ ID NO: 15284 - DNA, 18 bp, synthetic construct
  source 1..18: mol_type = other DNA
gaattcgaatcactctag

SEQ ID NO: 15285 - DNA, 18 bp, synthetic construct
  source 1..18: mol_type = other DNA
gaattcgacttactaaag

SEQ ID NO: 15286 - DNA, 18 bp, synthetic construct
  source 1..18: mol_type = other DNA
gaattggactcacaatag

SEQ ID NO: 15287 - DNA, 18 bp, synthetic construct
  source 1..18: mol_type = other DNA
taaaacgaatcgctaaag

SEQ ID NO: 15288 - DNA, 18 bp, synthetic construct
  source 1..18: mol_type = other DNA
taaaacgactcaatatta

SEQ ID NO: 15289 - DNA, 18 bp, synthetic construct
  source 1..18: mol_type = other DNA
taaaacgcctcactaatg

SEQ ID NO: 15290 - DNA, 18 bp, synthetic construct
  source 1..18: mol_type = other DNA
taaaaggactcaccattg

SEQ ID NO: 15291 - DNA, 18 bp, synthetic construct
  source 1..18: mol_type = other DNA
taaaatgagtcactattg

SEQ ID NO: 15292 - DNA, 18 bp, synthetic construct
  source 1..18: mol_type = other DNA
taaaccaactcactattg

SEQ ID NO: 15293 - DNA, 18 bp, synthetic construct
  source 1..18: mol_type = other DNA
taaaccgcctcgctatag

SEQ ID NO: 15294 - DNA, 18 bp, synthetic construct
  source 1..18: mol_type = other DNA
taaatccactcaatatag

SEQ ID NO: 15295 - DNA, 18 bp, synthetic construct
  source 1..18: mol_type = other DNA
taaatcgacacactataa

SEQ ID NO: 15296 - DNA, 18 bp, synthetic construct
  source 1..18: mol_type = other DNA
taaatcgactgacaatag

SEQ ID NO: 15297 - DNA, 18 bp, synthetic construct
  source 1..18: mol_type = other DNA
taaattgactcaccatag

SEQ ID NO: 15298 - DNA, 18 bp, synthetic construct
  source 1..18: mol_type = other DNA
taaattgactgactatag

SEQ ID NO: 15299 - DNA, 18 bp, synthetic construct
  source 1..18: mol_type = other DNA
taacacaactcacttttg

SEQ ID NO: 15300 - DNA, 18 bp, synthetic construct
  source 1..18: mol_type = other DNA
taacacaactcagtattg

SEQ ID NO: 15301 - DNA, 18 bp, synthetic construct
  source 1..18: mol_type = other DNA
taacacgactcagtaatg

SEQ ID NO: 15302 - DNA, 18 bp, synthetic construct
  source 1..18: mol_type = other DNA
taacacgactcgatatcg

SEQ ID NO: 15303 - DNA, 18 bp, synthetic construct
  source 1..18: mol_type = other DNA
taacacgactctctcttg

SEQ ID NO: 15304 - DNA, 18 bp, synthetic construct
  source 1..18: mol_type = other DNA
taacacgactgcctattg

SEQ ID NO: 15305 - DNA, 18 bp, synthetic construct
  source 1..18: mol_type = other DNA
taacacgactggcaatag

SEQ ID NO: 15306 - DNA, 18 bp, synthetic construct
  source 1..18: mol_type = other DNA
taacatgactcactagtg

SEQ ID NO: 15307 - DNA, 18 bp, synthetic construct
  source 1..18: mol_type = other DNA
taacgcgactcgctaaag

SEQ ID NO: 15308 - DNA, 18 bp, synthetic construct
  source 1..18: mol_type = other DNA
taactccattcactatag

SEQ ID NO: 15309 - DNA, 18 bp, synthetic construct
  source 1..18: mol_type = other DNA
taactcgccccactatag

SEQ ID NO: 15310 - DNA, 18 bp, synthetic construct
  source 1..18: mol_type = other DNA
taagataactcactattg

SEQ ID NO: 15311 - DNA, 18 bp, synthetic construct
  source 1..18: mol_type = other DNA
taagtcaacacactatag

SEQ ID NO: 15312 - DNA, 18 bp, synthetic construct
  source 1..18: mol_type = other DNA
taagttgactcattatag

SEQ ID NO: 15313 - DNA, 18 bp, synthetic construct
  source 1..18: mol_type = other DNA
taataacacacgctatag

SEQ ID NO: 15314 - DNA, 18 bp, synthetic construct
  source 1..18: mol_type = other DNA
taatacaactgacaattg

SEQ ID NO: 15315 - DNA, 18 bp, synthetic construct
  source 1..18: mol_type = other DNA
taatacaagtcgctttag

SEQ ID NO: 15316 - DNA, 18 bp, synthetic construct
  source 1..18: mol_type = other DNA
taataccactcgcaatcg

SEQ ID NO: 15317 - DNA, 18 bp, synthetic construct
  source 1..18: mol_type = other DNA
taatacgaatctctgttg

SEQ ID NO: 15318 - DNA, 18 bp, synthetic construct
  source 1..18: mol_type = other DNA
taatacgacacaggattg

SEQ ID NO: 15319 - DNA, 18 bp, synthetic construct
  source 1..18: mol_type = other DNA
taatacgacgcgccacag

SEQ ID NO: 15320 - DNA, 18 bp, synthetic construct
  source 1..18: mol_type = other DNA
taatacgactcacccgtg

SEQ ID NO: 15321 - DNA, 18 bp, synthetic construct
  source 1..18: mol_type = other DNA
taatacgactcacgtatg

SEQ ID NO: 15322 - DNA, 18 bp, synthetic construct
  source 1..18: mol_type = other DNA
taatacgactccttcttg

SEQ ID NO: 15323 - DNA, 18 bp, synthetic construct
  source 1..18: mol_type = other DNA
taatacgactcgcagaag

SEQ ID NO: 15324 - DNA, 18 bp, synthetic construct
  source 1..18: mol_type = other DNA
taatacgactggccaaag

SEQ ID NO: 15325 - DNA, 18 bp, synthetic construct
  source 1..18: mol_type = other DNA
taatacgagaaactattg

SEQ ID NO: 15326 - DNA, 18 bp, synthetic construct
  source 1..18: mol_type = other DNA
taatacgagtcgttacag

SEQ ID NO: 15327 - DNA, 18 bp, synthetic construct
  source 1..18: mol_type = other DNA
taatacgagtctctatta

SEQ ID NO: 15328 - DNA, 18 bp, synthetic construct
  source 1..18: mol_type = other DNA
taatacgattaactactg

SEQ ID NO: 15329 - DNA, 18 bp, synthetic construct
  source 1..18: mol_type = other DNA
taatacgattcattgttg

SEQ ID NO: 15330 - DNA, 18 bp, synthetic construct
  source 1..18: mol_type = other DNA
taatacgcatcgcaatag

SEQ ID NO: 15331 - DNA, 18 bp, synthetic construct
  source 1..18: mol_type = other DNA
taatacgtcgcaatattg

SEQ ID NO: 15332 - DNA, 18 bp, synthetic construct
  source 1..18: mol_type = other DNA
taatacgtctcaccgttg

SEQ ID NO: 15333 - DNA, 18 bp, synthetic construct
  source 1..18: mol_type = other DNA
taatactacccactgttg

SEQ ID NO: 15334 - DNA, 18 bp, synthetic construct
  source 1..18: mol_type = other DNA
taatactactcgctaacg

SEQ ID NO: 15335 - DNA, 18 bp, synthetic construct
  source 1..18: mol_type = other DNA
taatactactcgctcaag

SEQ ID NO: 15336 - DNA, 18 bp, synthetic construct
  source 1..18: mol_type = other DNA
taatactactgcctattg

SEQ ID NO: 15337 - DNA, 18 bp, synthetic construct
  source 1..18: mol_type = other DNA
taatactacttgctctag

SEQ ID NO: 15338 - DNA, 18 bp, synthetic construct
  source 1..18: mol_type = other DNA
taatactcctcactcttg

SEQ ID NO: 15339 - DNA, 18 bp, synthetic construct
  source 1..18: mol_type = other DNA
taatactcctcagtattg

SEQ ID NO: 15340 - DNA, 18 bp, synthetic construct
  source 1..18: mol_type = other DNA
taatagaacttgctatag

SEQ ID NO: 15341 - DNA, 18 bp, synthetic construct
  source 1..18: mol_type = other DNA
taatagagctcactattg

SEQ ID NO: 15342 - DNA, 18 bp, synthetic construct
  source 1..18: mol_type = other DNA
taatagcaatcactattg

SEQ ID NO: 15343 - DNA, 18 bp, synthetic construct
  source 1..18: mol_type = other DNA
taataggacacgctctag

SEQ ID NO: 15344 - DNA, 18 bp, synthetic construct
  source 1..18: mol_type = other DNA
taataggactcacgtttg

SEQ ID NO: 15345 - DNA, 18 bp, synthetic construct
  source 1..18: mol_type = other DNA
taataggacttactgttg

SEQ ID NO: 15346 - DNA, 18 bp, synthetic construct
  source 1..18: mol_type = other DNA
taataggtatcactattg

SEQ ID NO: 15347 - DNA, 18 bp, synthetic construct
  source 1..18: mol_type = other DNA
taataggtctcgatatag

SEQ ID NO: 15348 - DNA, 18 bp, synthetic construct
  source 1..18: mol_type = other DNA
taataggtcttgctatag

SEQ ID NO: 15349 - DNA, 18 bp, synthetic construct
  source 1..18: mol_type = other DNA
taatataactcactagtg

SEQ ID NO: 15350 - DNA, 18 bp, synthetic construct
  source 1..18: mol_type = other DNA
taatatgaatcactatta

SEQ ID NO: 15351 - DNA, 18 bp, synthetic construct
  source 1..18: mol_type = other DNA
taatatgaatcgcgatag

SEQ ID NO: 15352 - DNA, 18 bp, synthetic construct
  source 1..18: mol_type = other DNA
taatatgactccatattg

SEQ ID NO: 15353 - DNA, 18 bp, synthetic construct
  source 1..18: mol_type = other DNA
taatatgactcgctgtcg

SEQ ID NO: 15354 - DNA, 18 bp, synthetic construct
  source 1..18: mol_type = other DNA
taatatgtctcaccattg

SEQ ID NO: 15355 - DNA, 18 bp, synthetic construct
  source 1..18: mol_type = other DNA
taatattactgactattg

SEQ ID NO: 15356 - DNA, 18 bp, synthetic construct
  source 1..18: mol_type = other DNA
taatccgaatcggtatag

SEQ ID NO: 15357 - DNA, 18 bp, synthetic construct
  source 1..18: mol_type = other DNA
taatccgacccaatattg

SEQ ID NO: 15358 - DNA, 18 bp, synthetic construct
  source 1..18: mol_type = other DNA
taatccgacccgctaaag

SEQ ID NO: 15359 - DNA, 18 bp, synthetic construct
  source 1..18: mol_type = other DNA
taatccgactcgcttaag

SEQ ID NO: 15360 - DNA, 18 bp, synthetic construct
  source 1..18: mol_type = other DNA
taatccgactctatattg

SEQ ID NO: 15361 - DNA, 18 bp, synthetic construct
  source 1..18: mol_type = other DNA
taatccgactgacttttg

SEQ ID NO: 15362 - DNA, 18 bp, synthetic construct
  source 1..18: mol_type = other DNA
taatccgattcgctagag

SEQ ID NO: 15363 - DNA, 18 bp, synthetic construct
  source 1..18: mol_type = other DNA
taatcggactcacttttg

SEQ ID NO: 15364 - DNA, 18 bp, synthetic construct
  source 1..18: mol_type = other DNA
taatgagagtcactattg

SEQ ID NO: 15365 - DNA, 18 bp, synthetic construct
  source 1..18: mol_type = other DNA
taatgccaatcgctatag

SEQ ID NO: 15366 - DNA, 18 bp, synthetic construct
  source 1..18: mol_type = other DNA
taatgcgattcaccattg

SEQ ID NO: 15367 - DNA, 18 bp, synthetic construct
  source 1..18: mol_type = other DNA
taatgcgtgtcactattg

SEQ ID NO: 15368 - DNA, 18 bp, synthetic construct
  source 1..18: mol_type = other DNA
taatgtgactcacttttg

SEQ ID NO: 15369 - DNA, 18 bp, synthetic construct
  source 1..18: mol_type = other DNA
taatgtgactggctatag

SEQ ID NO: 15370 - DNA, 18 bp, synthetic construct
  source 1..18: mol_type = other DNA
taattagacgcactttag

SEQ ID NO: 15371 - DNA, 18 bp, synthetic construct
  source 1..18: mol_type = other DNA
taattagactcaatctag

SEQ ID NO: 15372 - DNA, 18 bp, synthetic construct
  source 1..18: mol_type = other DNA
taattagactcactaacg

SEQ ID NO: 15373 - DNA, 18 bp, synthetic construct
  source 1..18: mol_type = other DNA
taattagactcagaatag

SEQ ID NO: 15374 - DNA, 18 bp, synthetic construct
  source 1..18: mol_type = other DNA
taattagattcagtatag

SEQ ID NO: 15375 - DNA, 18 bp, synthetic construct
  source 1..18: mol_type = other DNA
taattagtcccactatag

SEQ ID NO: 15376 - DNA, 18 bp, synthetic construct
  source 1..18: mol_type = other DNA
taattatactcactacag

SEQ ID NO: 15377 - DNA, 18 bp, synthetic construct
  source 1..18: mol_type = other DNA
taattccagtcactaaag

SEQ ID NO: 15378 - DNA, 18 bp, synthetic construct
  source 1..18: mol_type = other DNA
taattcgaatcaccatgg

SEQ ID NO: 15379 - DNA, 18 bp, synthetic construct
  source 1..18: mol_type = other DNA
taattcgaatcacgttag

SEQ ID NO: 15380 - DNA, 18 bp, synthetic construct
  source 1..18: mol_type = other DNA
taattcgaatccttatag

SEQ ID NO: 15381 - DNA, 18 bp, synthetic construct
  source 1..18: mol_type = other DNA
taattcgacacactgtgg

SEQ ID NO: 15382 - DNA, 18 bp, synthetic construct
  source 1..18: mol_type = other DNA
taattcgacgcagaatag

SEQ ID NO: 15383 - DNA, 18 bp, synthetic construct
  source 1..18: mol_type = other DNA
taattcgactcagaacag

SEQ ID NO: 15384 - DNA, 18 bp, synthetic construct
  source 1..18: mol_type = other DNA
taattcgactcaggaaag

SEQ ID NO: 15385 - DNA, 18 bp, synthetic construct
  source 1..18: mol_type = other DNA
taattcgactctatagag

SEQ ID NO: 15386 - DNA, 18 bp, synthetic construct
  source 1..18: mol_type = other DNA
taattcgagtcaaaatag

SEQ ID NO: 15387 - DNA, 18 bp, synthetic construct
  source 1..18: mol_type = other DNA
taattcgattccctctag

SEQ ID NO: 15388 - DNA, 18 bp, synthetic construct
  source 1..18: mol_type = other DNA
taattcgcctgaatatag

SEQ ID NO: 15389 - DNA, 18 bp, synthetic construct
  source 1..18: mol_type = other DNA
taattcggctaaccatag

SEQ ID NO: 15390 - DNA, 18 bp, synthetic construct
  source 1..18: mol_type = other DNA
taattcgtcttactagag

SEQ ID NO: 15391 - DNA, 18 bp, synthetic construct
  source 1..18: mol_type = other DNA
taattctactcagtctag

SEQ ID NO: 15392 - DNA, 18 bp, synthetic construct
  source 1..18: mol_type = other DNA
taattctactccctatgg

SEQ ID NO: 15393 - DNA, 18 bp, synthetic construct
  source 1..18: mol_type = other DNA
taattgaactcactgtag

SEQ ID NO: 15394 - DNA, 18 bp, synthetic construct
  source 1..18: mol_type = other DNA
taattggactcagtttag

SEQ ID NO: 15395 - DNA, 18 bp, synthetic construct
  source 1..18: mol_type = other DNA
taattgtactcactttag

SEQ ID NO: 15396 - DNA, 18 bp, synthetic construct
  source 1..18: mol_type = other DNA
taatttcactgactatag

SEQ ID NO: 15397 - DNA, 18 bp, synthetic construct
  source 1..18: mol_type = other DNA
taatttgacgcactttag

SEQ ID NO: 15398 - DNA, 18 bp, synthetic construct
  source 1..18: mol_type = other DNA
taatttgactcagcatag

SEQ ID NO: 15399 - DNA, 18 bp, synthetic construct
  source 1..18: mol_type = other DNA
taatttgactctctgtag

SEQ ID NO: 15400 - DNA, 18 bp, synthetic construct
  source 1..18: mol_type = other DNA
tactacgactatctattg

SEQ ID NO: 15401 - DNA, 18 bp, synthetic construct
  source 1..18: mol_type = other DNA
tactacgactcacttgtg

SEQ ID NO: 15402 - DNA, 18 bp, synthetic construct
  source 1..18: mol_type = other DNA
tactacgcctcaccattg

SEQ ID NO: 15403 - DNA, 18 bp, synthetic construct
  source 1..18: mol_type = other DNA
tacttccacccactatag

SEQ ID NO: 15404 - DNA, 18 bp, synthetic construct
  source 1..18: mol_type = other DNA
tacttcgactcacagtag

SEQ ID NO: 15405 - DNA, 18 bp, synthetic construct
  source 1..18: mol_type = other DNA
tacttcgattccctatag

SEQ ID NO: 15406 - DNA, 18 bp, synthetic construct
  source 1..18: mol_type = other DNA
tacttcgcctcactctag

SEQ ID NO: 15407 - DNA, 18 bp, synthetic construct
  source 1..18: mol_type = other DNA
tagaacgacacgctatag

SEQ ID NO: 15408 - DNA, 18 bp, synthetic construct
  source 1..18: mol_type = other DNA
tagctcgacgcactatag

SEQ ID NO: 15409 - DNA, 18 bp, synthetic construct
  source 1..18: mol_type = other DNA
tagtacgacacgctctag

SEQ ID NO: 15410 - DNA, 18 bp, synthetic construct
  source 1..18: mol_type = other DNA
tagtacgactcgttacag

SEQ ID NO: 15411 - DNA, 18 bp, synthetic construct
  source 1..18: mol_type = other DNA
tagtacgattcactcttg

SEQ ID NO: 15412 - DNA, 18 bp, synthetic construct
  source 1..18: mol_type = other DNA
tagttccactgactatag

SEQ ID NO: 15413 - DNA, 18 bp, synthetic construct
  source 1..18: mol_type = other DNA
tagttcgactcactttaa

SEQ ID NO: 15414 - DNA, 18 bp, synthetic construct
  source 1..18: mol_type = other DNA
tagttcgactcagtaaag

SEQ ID NO: 15415 - DNA, 18 bp, synthetic construct
  source 1..18: mol_type = other DNA
tagttcgactctctacag

SEQ ID NO: 15416 - DNA, 18 bp, synthetic construct
  source 1..18: mol_type = other DNA
tagttctactcactacag

SEQ ID NO: 15417 - DNA, 18 bp, synthetic construct
  source 1..18: mol_type = other DNA
tagtttgactcactttag

SEQ ID NO: 15418 - DNA, 18 bp, synthetic construct
  source 1..18: mol_type = other DNA
tatgacgactcgttatag

SEQ ID NO: 15419 - DNA, 18 bp, synthetic construct
  source 1..18: mol_type = other DNA
tattaagactcgctacag

SEQ ID NO: 15420 - DNA, 18 bp, synthetic construct
  source 1..18: mol_type = other DNA
tattaccacgcactattg

SEQ ID NO: 15421 - DNA, 18 bp, synthetic construct
  source 1..18: mol_type = other DNA
tattacgagacactattg

SEQ ID NO: 15422 - DNA, 18 bp, synthetic construct
  source 1..18: mol_type = other DNA
tattacgcctcactatta

SEQ ID NO: 15423 - DNA, 18 bp, synthetic construct
  source 1..18: mol_type = other DNA
tattacgccttgctatag

SEQ ID NO: 15424 - DNA, 18 bp, synthetic construct
  source 1..18: mol_type = other DNA
tattacgtctcgctatcg

SEQ ID NO: 15425 - DNA, 18 bp, synthetic construct
  source 1..18: mol_type = other DNA
tattaggactccctattg

SEQ ID NO: 15426 - DNA, 18 bp, synthetic construct
  source 1..18: mol_type = other DNA
tattgcgactcgctagag

SEQ ID NO: 15427 - DNA, 18 bp, synthetic construct
  source 1..18: mol_type = other DNA
tatttcgactcactacgg

SEQ ID NO: 15428 - DNA, 18 bp, synthetic construct
  source 1..18: mol_type = other DNA
tatttcgactcactatga

SEQ ID NO: 15429 - DNA, 18 bp, synthetic construct
  source 1..18: mol_type = other DNA
tcaaacgaatcactattg

SEQ ID NO: 15430 - DNA, 18 bp, synthetic construct
  source 1..18: mol_type = other DNA
tcaaacgactcactatta

SEQ ID NO: 15431 - DNA, 18 bp, synthetic construct
  source 1..18: mol_type = other DNA
tcatacgacccgctacag

SEQ ID NO: 15432 - DNA, 18 bp, synthetic construct
  source 1..18: mol_type = other DNA
tcatacgactctctgttg

SEQ ID NO: 15433 - DNA, 18 bp, synthetic construct
  source 1..18: mol_type = other DNA
tcatactactcgccatag

SEQ ID NO: 15434 - DNA, 18 bp, synthetic construct
  source 1..18: mol_type = other DNA
tcatatcactcactattg

SEQ ID NO: 15435 - DNA, 18 bp, synthetic construct
  source 1..18: mol_type = other DNA
tcattcggcttactatag

SEQ ID NO: 15436 - DNA, 18 bp, synthetic construct
  source 1..18: mol_type = other DNA
tcattggcctcactatag

SEQ ID NO: 15437 - DNA, 18 bp, synthetic construct
  source 1..18: mol_type = other DNA
tcgtacgactagctatag

SEQ ID NO: 15438 - DNA, 18 bp, synthetic construct
  source 1..18: mol_type = other DNA
tgaatcgtctcactatag

SEQ ID NO: 15439 - DNA, 18 bp, synthetic construct
  source 1..18: mol_type = other DNA
tgacacgaatcgctatag

SEQ ID NO: 15440 - DNA, 18 bp, synthetic construct
  source 1..18: mol_type = other DNA
tgatacaactctctattg

SEQ ID NO: 15441 - DNA, 18 bp, synthetic construct
  source 1..18: mol_type = other DNA
tgataccgctcgctatag

SEQ ID NO: 15442 - DNA, 18 bp, synthetic construct
  source 1..18: mol_type = other DNA
tgatacgacgcattattg

SEQ ID NO: 15443 - DNA, 18 bp, synthetic construct
  source 1..18: mol_type = other DNA
tgatacgactcattactg

SEQ ID NO: 15444 - DNA, 18 bp, synthetic construct
  source 1..18: mol_type = other DNA
tgatacgagtctctattg

SEQ ID NO: 15445 - DNA, 18 bp, synthetic construct
  source 1..18: mol_type = other DNA
tgataggactcacaattg

SEQ ID NO: 15446 - DNA, 18 bp, synthetic construct
  source 1..18: mol_type = other DNA
tgattagactcactatcg

SEQ ID NO: 15447 - DNA, 18 bp, synthetic construct
  source 1..18: mol_type = other DNA
tgattcgactcaccataa

SEQ ID NO: 15448 - DNA, 18 bp, synthetic construct
  source 1..18: mol_type = other DNA
tgattcggctcactatcg

SEQ ID NO: 15449 - DNA, 18 bp, synthetic construct
  source 1..18: mol_type = other DNA
tgattggaatcactatag

SEQ ID NO: 15450 - DNA, 18 bp, synthetic construct
  source 1..18: mol_type = other DNA
tggtacgactcaccattg

SEQ ID NO: 15451 - DNA, 18 bp, synthetic construct
  source 1..18: mol_type = other DNA
tgttacaactcactattg

SEQ ID NO: 15452 - DNA, 18 bp, synthetic construct
  source 1..18: mol_type = other DNA
ttacaagactcgctatag

SEQ ID NO: 15453 - DNA, 18 bp, synthetic construct
  source 1..18: mol_type = other DNA
ttactcgactcacgatag

SEQ ID NO: 15454 - DNA, 18 bp, synthetic construct
  source 1..18: mol_type = other DNA
ttactcgactcactatcg

SEQ ID NO: 15455 - DNA, 18 bp, synthetic construct
  source 1..18: mol_type = other DNA
ttataagactcgctatcg

SEQ ID NO: 15456 - DNA, 18 bp, synthetic construct
  source 1..18: mol_type = other DNA
ttataccactcgctttag

SEQ ID NO: 15457 - DNA, 18 bp, synthetic construct
  source 1..18: mol_type = other DNA
ttatacgactcactgttc

SEQ ID NO: 15458 - DNA, 18 bp, synthetic construct
  source 1..18: mol_type = other DNA
ttatacgactcgatacag

SEQ ID NO: 15459 - DNA, 18 bp, synthetic construct
  source 1..18: mol_type = other DNA
ttatacgactgggtatag

SEQ ID NO: 15460 - DNA, 18 bp, synthetic construct
  source 1..18: mol_type = other DNA
ttataggagtcactattg

SEQ ID NO: 15461 - DNA, 18 bp, synthetic construct
  source 1..18: mol_type = other DNA
ttattcgaccctctatag

SEQ ID NO: 15462 - DNA, 18 bp, synthetic construct
  source 1..18: mol_type = other DNA
ttattcgactcaccatcg

SEQ ID NO: 15463 - DNA, 18 bp, synthetic construct
  source 1..18: mol_type = other DNA
ttctaccactcactattg

SEQ ID NO: 15464 - DNA, 18 bp, synthetic construct
  source 1..18: mol_type = other DNA
ttctactactcgctatag

SEQ ID NO: 15465 - DNA, 18 bp, synthetic construct
  source 1..18: mol_type = other DNA
aaaaacgacccactacag

SEQ ID NO: 15466 - DNA, 18 bp, synthetic construct
  source 1..18: mol_type = other DNA
aaaaacgacttaatatag

SEQ ID NO: 15467 - DNA, 18 bp, synthetic construct
  source 1..18: mol_type = other DNA
aaaaaggactcactaaag

SEQ ID NO: 15468 - DNA, 18 bp, synthetic construct
  source 1..18: mol_type = other DNA
aaaacggactcactatag

SEQ ID NO: 15469 - DNA, 18 bp, synthetic construct
  source 1..18: mol_type = other DNA
aaacacgactcacactag

SEQ ID NO: 15470 - DNA, 18 bp, synthetic construct
  source 1..18: mol_type = other DNA
aaacacgacttactttag

SEQ ID NO: 15471 - DNA, 18 bp, synthetic construct
  source 1..18: mol_type = other DNA
aaagacgactctctctag

SEQ ID NO: 15472 - DNA, 18 bp, synthetic construct
  source 1..18: mol_type = other DNA
aaagacgagtcactctag

SEQ ID NO: 15473 - DNA, 18 bp, synthetic construct
  source 1..18: mol_type = other DNA
aaagactactcactgtag

SEQ ID NO: 15474 - DNA, 18 bp, synthetic construct
  source 1..18: mol_type = other DNA
aaagactactcattatag

SEQ ID NO: 15475 - DNA, 18 bp, synthetic construct
  source 1..18: mol_type = other DNA
aaagccgactcactgtag

SEQ ID NO: 15476 - DNA, 18 bp, synthetic construct
  source 1..18: mol_type = other DNA
aaaggcgactcattatag

SEQ ID NO: 15477 - DNA, 18 bp, synthetic construct
  source 1..18: mol_type = other DNA
aaataagactcaccagag

SEQ ID NO: 15478 - DNA, 18 bp, synthetic construct
  source 1..18: mol_type = other DNA
aaatacaactcacttcag

SEQ ID NO: 15479 - DNA, 18 bp, synthetic construct
  source 1..18: mol_type = other DNA
aaataccacgcacaatag

SEQ ID NO: 15480 - DNA, 18 bp, synthetic construct
  source 1..18: mol_type = other DNA
aaataccactctctacag

SEQ ID NO: 15481 - DNA, 18 bp, synthetic construct
  source 1..18: mol_type = other DNA
aaataccactgactctag

SEQ ID NO: 15482 - DNA, 18 bp, synthetic construct
  source 1..18: mol_type = other DNA
aaatacgaaccactacag

SEQ ID NO: 15483 - DNA, 18 bp, synthetic construct
  source 1..18: mol_type = other DNA
aaatacgaatcaccgtag

SEQ ID NO: 15484 - DNA, 18 bp, synthetic construct
  source 1..18: mol_type = other DNA
aaatacgaattagtatag

SEQ ID NO: 15485 - DNA, 18 bp, synthetic construct
  source 1..18: mol_type = other DNA
aaatacgacactctctag

SEQ ID NO: 15486 - DNA, 18 bp, synthetic construct
  source 1..18: mol_type = other DNA
aaatacgactacccatag

SEQ ID NO: 15487 - DNA, 18 bp, synthetic construct
  source 1..18: mol_type = other DNA
aaatacgactcaacacag

SEQ ID NO: 15488 - DNA, 18 bp, synthetic construct
  source 1..18: mol_type = other DNA
aaatacgactcagttaag

SEQ ID NO: 15489 - DNA, 18 bp, synthetic construct
  source 1..18: mol_type = other DNA
aaatacgactcagttcag

SEQ ID NO: 15490 - DNA, 18 bp, synthetic construct
  source 1..18: mol_type = other DNA
aaatacgactgaccacag

SEQ ID NO: 15491 - DNA, 18 bp, synthetic construct
  source 1..18: mol_type = other DNA
aaatacgacttattagag

SEQ ID NO: 15492 - DNA, 18 bp, synthetic construct
  source 1..18: mol_type = other DNA
aaatacgagtaactttag

SEQ ID NO: 15493 - DNA, 18 bp, synthetic construct
  source 1..18: mol_type = other DNA
aaatacgagtcacaacag

SEQ ID NO: 15494 - DNA, 18 bp, synthetic construct
  source 1..18: mol_type = other DNA
aaatacgcttcactagag

SEQ ID NO: 15495 - DNA, 18 bp, synthetic construct
  source 1..18: mol_type = other DNA
aaatacggctcacttaag

SEQ ID NO: 15496 - DNA, 18 bp, synthetic construct
  source 1..18: mol_type = other DNA
aaatacgtgtcaccatag

SEQ ID NO: 15497 - DNA, 18 bp, synthetic construct
  source 1..18: mol_type = other DNA
aaatactactcaacatag

SEQ ID NO: 15498 - DNA, 18 bp, synthetic construct
  source 1..18: mol_type = other DNA
aaatactactcagtacag

SEQ ID NO: 15499 - DNA, 18 bp, synthetic construct
  source 1..18: mol_type = other DNA
aaataggaatcactagag

SEQ ID NO: 15500 - DNA, 18 bp, synthetic construct
  source 1..18: mol_type = other DNA
aaataggactcaccttag

SEQ ID NO: 15501 - DNA, 18 bp, synthetic construct
  source 1..18: mol_type = other DNA
aaataggactcatcatag

SEQ ID NO: 15502 - DNA, 18 bp, synthetic construct
  source 1..18: mol_type = other DNA
aaataggtctgactatag

SEQ ID NO: 15503 - DNA, 18 bp, synthetic construct
  source 1..18: mol_type = other DNA
aaatatgacacactgtag

SEQ ID NO: 15504 - DNA, 18 bp, synthetic construct
  source 1..18: mol_type = other DNA
aaatatgactcacaataa

SEQ ID NO: 15505 - DNA, 18 bp, synthetic construct
  source 1..18: mol_type = other DNA
aaatatgactctgtatag

SEQ ID NO: 15506 - DNA, 18 bp, synthetic construct
  source 1..18: mol_type = other DNA
aaatatgactgactatgg

SEQ ID NO: 15507 - DNA, 18 bp, synthetic construct
  source 1..18: mol_type = other DNA
aaatccaattcactatag

SEQ ID NO: 15508 - DNA, 18 bp, synthetic construct
  source 1..18: mol_type = other DNA
aaatccgaatcattatag

SEQ ID NO: 15509 - DNA, 18 bp, synthetic construct
  source 1..18: mol_type = other DNA
aaatccgacacaccatag

SEQ ID NO: 15510 - DNA, 18 bp, synthetic construct
  source 1..18: mol_type = other DNA
aaatcggactaactatag

SEQ ID NO: 15511 - DNA, 18 bp, synthetic construct
  source 1..18: mol_type = other DNA
aaatgcgaatcactaaag

SEQ ID NO: 15512 - DNA, 18 bp, synthetic construct
  source 1..18: mol_type = other DNA
aaatgcgaattactatag

SEQ ID NO: 15513 - DNA, 18 bp, synthetic construct
  source 1..18: mol_type = other DNA
aaatgcgactctctaaag

SEQ ID NO: 15514 - DNA, 18 bp, synthetic construct
  source 1..18: mol_type = other DNA
aaatgcgtctaactatag

SEQ ID NO: 15515 - DNA, 18 bp, synthetic construct
  source 1..18: mol_type = other DNA
aaatgcgtttcactatag

SEQ ID NO: 15516 - DNA, 18 bp, synthetic construct
  source 1..18: mol_type = other DNA
aagaacgactcacaatag

SEQ ID NO: 15517 - DNA, 18 bp, synthetic construct
  source 1..18: mol_type = other DNA
aagtacaattcactatag

SEQ ID NO: 15518 - DNA, 18 bp, synthetic construct
  source 1..18: mol_type = other DNA
aagtacggctcactaaag

SEQ ID NO: 15519 - DNA, 18 bp, synthetic construct
  source 1..18: mol_type = other DNA
aagtaggactcacgatag

SEQ ID NO: 15520 - DNA, 18 bp, synthetic construct
  source 1..18: mol_type = other DNA
aagtgcgcctcactatag

SEQ ID NO: 15521 - DNA, 18 bp, synthetic construct
  source 1..18: mol_type = other DNA
aatgacgactcactacag

SEQ ID NO: 15522 - DNA, 18 bp, synthetic construct
  source 1..18: mol_type = other DNA
aattacgactcactccag

SEQ ID NO: 15523 - DNA, 18 bp, synthetic construct
  source 1..18: mol_type = other DNA
aattacgactcactgtgg

SEQ ID NO: 15524 - DNA, 18 bp, synthetic construct
  source 1..18: mol_type = other DNA
aattaggactcactttag

SEQ ID NO: 15525 - DNA, 18 bp, synthetic construct
  source 1..18: mol_type = other DNA
acacacgactcactctag

SEQ ID NO: 15526 - DNA, 18 bp, synthetic construct
  source 1..18: mol_type = other DNA
acatacgaccccctatag

SEQ ID NO: 15527 - DNA, 18 bp, synthetic construct
  source 1..18: mol_type = other DNA
acatacgacgcaatatag

SEQ ID NO: 15528 - DNA, 18 bp, synthetic construct
  source 1..18: mol_type = other DNA
acatacgagtaactatag

SEQ ID NO: 15529 - DNA, 18 bp, synthetic construct
  source 1..18: mol_type = other DNA
agaaacgtctcactatag

SEQ ID NO: 15530 - DNA, 18 bp, synthetic construct
  source 1..18: mol_type = other DNA
agttacgactgactatag

SEQ ID NO: 15531 - DNA, 18 bp, synthetic construct
  source 1..18: mol_type = other DNA
atagaagactcactatag

SEQ ID NO: 15532 - DNA, 18 bp, synthetic construct
  source 1..18: mol_type = other DNA
atagacgagtcactatag

SEQ ID NO: 15533 - DNA, 18 bp, synthetic construct
  source 1..18: mol_type = other DNA
atatacgaatcactagag

SEQ ID NO: 15534 - DNA, 18 bp, synthetic construct
  source 1..18: mol_type = other DNA
atataggactcactatgg

SEQ ID NO: 15535 - DNA, 18 bp, synthetic construct
  source 1..18: mol_type = other DNA
caaaacaacacactatag

SEQ ID NO: 15536 - DNA, 18 bp, synthetic construct
  source 1..18: mol_type = other DNA
caaaacgactaactacag

SEQ ID NO: 15537 - DNA, 18 bp, synthetic construct
  source 1..18: mol_type = other DNA
caaaacgactcacaaaag

SEQ ID NO: 15538 - DNA, 18 bp, synthetic construct
  source 1..18: mol_type = other DNA
caaaacgactcataatag

SEQ ID NO: 15539 - DNA, 18 bp, synthetic construct
  source 1..18: mol_type = other DNA
caaacggactcactatag

SEQ ID NO: 15540 - DNA, 18 bp, synthetic construct
  source 1..18: mol_type = other DNA
caacacaactcactctag

SEQ ID NO: 15541 - DNA, 18 bp, synthetic construct
  source 1..18: mol_type = other DNA
caacacgactcccaatag

SEQ ID NO: 15542 - DNA, 18 bp, synthetic construct
  source 1..18: mol_type = other DNA
caacacgactctctagag

SEQ ID NO: 15543 - DNA, 18 bp, synthetic construct
  source 1..18: mol_type = other DNA
caacacgagtcactctag

SEQ ID NO: 15544 - DNA, 18 bp, synthetic construct
  source 1..18: mol_type = other DNA
caataagacccactaaag

SEQ ID NO: 15545 - DNA, 18 bp, synthetic construct
  source 1..18: mol_type = other DNA
caatacaaatcactatgg

SEQ ID NO: 15546 - DNA, 18 bp, synthetic construct
  source 1..18: mol_type = other DNA
caatacaacccactttag

SEQ ID NO: 15547 - DNA, 18 bp, synthetic construct
  source 1..18: mol_type = other DNA
caatacgacgcactaggg

SEQ ID NO: 15548 - DNA, 18 bp, synthetic construct
  source 1..18: mol_type = other DNA
caatacgactcacaaacg

SEQ ID NO: 15549 - DNA, 18 bp, synthetic construct
  source 1..18: mol_type = other DNA
caatacgccgcacaatag

SEQ ID NO: 15550 - DNA, 18 bp, synthetic construct
  source 1..18: mol_type = other DNA
caatacgcctaactacag

SEQ ID NO: 15551 - DNA, 18 bp, synthetic construct
  source 1..18: mol_type = other DNA
caatacgcttcactatcg

SEQ ID NO: 15552 - DNA, 18 bp, synthetic construct
  source 1..18: mol_type = other DNA
caatacggatcacaatag

SEQ ID NO: 15553 - DNA, 18 bp, synthetic construct
  source 1..18: mol_type = other DNA
caatacggcttaccatag

SEQ ID NO: 15554 - DNA, 18 bp, synthetic construct
  source 1..18: mol_type = other DNA
caatactaatcactatgg

SEQ ID NO: 15555 - DNA, 18 bp, synthetic construct
  source 1..18: mol_type = other DNA
caatactactcacttgag

SEQ ID NO: 15556 - DNA, 18 bp, synthetic construct
  source 1..18: mol_type = other DNA
caataggaatcactaaag

SEQ ID NO: 15557 - DNA, 18 bp, synthetic construct
  source 1..18: mol_type = other DNA
caataggactgcctatag

SEQ ID NO: 15558 - DNA, 18 bp, synthetic construct
  source 1..18: mol_type = other DNA
caataggatccactatag

SEQ ID NO: 15559 - DNA, 18 bp, synthetic construct
  source 1..18: mol_type = other DNA
caatatgactctatatag

SEQ ID NO: 15560 - DNA, 18 bp, synthetic construct
  source 1..18: mol_type = other DNA
caatccgacacactttag

SEQ ID NO: 15561 - DNA, 18 bp, synthetic construct
  source 1..18: mol_type = other DNA
caatccgactaactaaag

SEQ ID NO: 15562 - DNA, 18 bp, synthetic construct
  source 1..18: mol_type = other DNA
caatccgactaactttag

SEQ ID NO: 15563 - DNA, 18 bp, synthetic construct
  source 1..18: mol_type = other DNA
caatccgcctcacaatag

SEQ ID NO: 15564 - DNA, 18 bp, synthetic construct
  source 1..18: mol_type = other DNA
caatcctactgactatag

SEQ ID NO: 15565 - DNA, 18 bp, synthetic construct
  source 1..18: mol_type = other DNA
caatgcgactcacttaag

SEQ ID NO: 15566 - DNA, 18 bp, synthetic construct
  source 1..18: mol_type = other DNA
caatgcgactctctatcg

SEQ ID NO: 15567 - DNA, 18 bp, synthetic construct
  source 1..18: mol_type = other DNA
cactaccactaactatag

SEQ ID NO: 15568 - DNA, 18 bp, synthetic construct
  source 1..18: mol_type = other DNA
cactacgattcactacag

SEQ ID NO: 15569 - DNA, 18 bp, synthetic construct
  source 1..18: mol_type = other DNA
cagtacgacactctatag

SEQ ID NO: 15570 - DNA, 18 bp, synthetic construct
  source 1..18: mol_type = other DNA
cagtacgacttaccatag

SEQ ID NO: 15571 - DNA, 18 bp, synthetic construct
  source 1..18: mol_type = other DNA
cagtacgccccactatag

SEQ ID NO: 15572 - DNA, 18 bp, synthetic construct
  source 1..18: mol_type = other DNA
cagtgagactcactatag

SEQ ID NO: 15573 - DNA, 18 bp, synthetic construct
  source 1..18: mol_type = other DNA
cattgcgactcagtatag

SEQ ID NO: 15574 - DNA, 18 bp, synthetic construct
  source 1..18: mol_type = other DNA
ccatgcgagtcactatag

SEQ ID NO: 15575 - DNA, 18 bp, synthetic construct
  source 1..18: mol_type = other DNA
cgatacgactcacgaaag

SEQ ID NO: 15576 - DNA, 18 bp, synthetic construct
  source 1..18: mol_type = other DNA
cgctacgactcactaaag

SEQ ID NO: 15577 - DNA, 18 bp, synthetic construct
  source 1..18: mol_type = other DNA
ctagacgactcactttag

SEQ ID NO: 15578 - DNA, 18 bp, synthetic construct
  source 1..18: mol_type = other DNA
ctagacgactccctatag

SEQ ID NO: 15579 - DNA, 18 bp, synthetic construct
  source 1..18: mol_type = other DNA
ctatacgactcagtatcg

SEQ ID NO: 15580 - DNA, 18 bp, synthetic construct
  source 1..18: mol_type = other DNA
ctatacgacttactatcg

SEQ ID NO: 15581 - DNA, 18 bp, synthetic construct
  source 1..18: mol_type = other DNA
ctctacgactcactatcg

SEQ ID NO: 15582 - DNA, 18 bp, synthetic construct
  source 1..18: mol_type = other DNA
gaaaacgacacactaaag

SEQ ID NO: 15583 - DNA, 18 bp, synthetic construct
  source 1..18: mol_type = other DNA
gaaaacgatttactatag

SEQ ID NO: 15584 - DNA, 18 bp, synthetic construct
  source 1..18: mol_type = other DNA
gaaaacgtttcactatag

SEQ ID NO: 15585 - DNA, 18 bp, synthetic construct
  source 1..18: mol_type = other DNA
gaacacgtctcactgtag

SEQ ID NO: 15586 - DNA, 18 bp, synthetic construct
  source 1..18: mol_type = other DNA
gaacgcgactcaccatag

SEQ ID NO: 15587 - DNA, 18 bp, synthetic construct
  source 1..18: mol_type = other DNA
gaatacgacttcctacag

SEQ ID NO: 15588 - DNA, 18 bp, synthetic construct
  source 1..18: mol_type = other DNA
gaatacgattcacttgag

SEQ ID NO: 15589 - DNA, 18 bp, synthetic construct
  source 1..18: mol_type = other DNA
gaatacgattctctacag

SEQ ID NO: 15590 - DNA, 18 bp, synthetic construct
  source 1..18: mol_type = other DNA
gaatactaccaactatag

SEQ ID NO: 15591 - DNA, 18 bp, synthetic construct
  source 1..18: mol_type = other DNA
gaatccatctcactatag

SEQ ID NO: 15592 - DNA, 18 bp, synthetic construct
  source 1..18: mol_type = other DNA
gaatgcgattcactatcg

SEQ ID NO: 15593 - DNA, 18 bp, synthetic construct
  source 1..18: mol_type = other DNA
gagtacgcctcacaatag

SEQ ID NO: 15594 - DNA, 18 bp, synthetic construct
  source 1..18: mol_type = other DNA
ggatactactcaatatag

SEQ ID NO: 15595 - DNA, 18 bp, synthetic construct
  source 1..18: mol_type = other DNA
gtatacgactcacaatcg

SEQ ID NO: 15596 - DNA, 18 bp, synthetic construct
  source 1..18: mol_type = other DNA
gtatactacacactatag

SEQ ID NO: 15597 - DNA, 18 bp, synthetic construct
  source 1..18: mol_type = other DNA
gtatatgtctcactatag

SEQ ID NO: 15598 - DNA, 18 bp, synthetic construct
  source 1..18: mol_type = other DNA
gtatccgtctcactatag

SEQ ID NO: 15599 - DNA, 18 bp, synthetic construct
  source 1..18: mol_type = other DNA
taaaaagactcactttgg

SEQ ID NO: 15600 - DNA, 18 bp, synthetic construct
  source 1..18: mol_type = other DNA
taaaaagactccctgtag

SEQ ID NO: 15601 - DNA, 18 bp, synthetic construct
  source 1..18: mol_type = other DNA
taaaacaactcactcgag

SEQ ID NO: 15602 - DNA, 18 bp, synthetic construct
  source 1..18: mol_type = other DNA
taaaacccctctctatag

SEQ ID NO: 15603 - DNA, 18 bp, synthetic construct
  source 1..18: mol_type = other DNA
taaaacgaatcactaagg

SEQ ID NO: 15604 - DNA, 18 bp, synthetic construct
  source 1..18: mol_type = other DNA
taaaacgaccctctacag

SEQ ID NO: 15605 - DNA, 18 bp, synthetic construct
  source 1..18: mol_type = other DNA
taaaacgactcagtaacg

SEQ ID NO: 15606 - DNA, 18 bp, synthetic construct
  source 1..18: mol_type = other DNA
taaaacgactccccatgg

SEQ ID NO: 15607 - DNA, 18 bp, synthetic construct
  source 1..18: mol_type = other DNA
taaaacgacttaccatcg

SEQ ID NO: 15608 - DNA, 18 bp, synthetic construct
  source 1..18: mol_type = other DNA
taaaacgagtcaatagag

SEQ ID NO: 15609 - DNA, 18 bp, synthetic construct
  source 1..18: mol_type = other DNA
taaaacgagtctccatag

SEQ ID NO: 15610 - DNA, 18 bp, synthetic construct
  source 1..18: mol_type = other DNA
taaaacgattaactagag

SEQ ID NO: 15611 - DNA, 18 bp, synthetic construct
  source 1..18: mol_type = other DNA
taaaacgcctcaataaag

SEQ ID NO: 15612 - DNA, 18 bp, synthetic construct
  source 1..18: mol_type = other DNA
taaaacgccttagtatag

SEQ ID NO: 15613 - DNA, 18 bp, synthetic construct
  source 1..18: mol_type = other DNA
taaaacgtctcagtatcg

SEQ ID NO: 15614 - DNA, 18 bp, synthetic construct
  source 1..18: mol_type = other DNA
taaaacgtgtcactatgg

SEQ ID NO: 15615 - DNA, 18 bp, synthetic construct
  source 1..18: mol_type = other DNA
taaaactacacacgatag

SEQ ID NO: 15616 - DNA, 18 bp, synthetic construct
  source 1..18: mol_type = other DNA
taaaaggacacactttag

SEQ ID NO: 15617 - DNA, 18 bp, synthetic construct
  source 1..18: mol_type = other DNA
taaaaggaccgactatag

SEQ ID NO: 15618 - DNA, 18 bp, synthetic construct
  source 1..18: mol_type = other DNA
taaaaggactcaatgtag

SEQ ID NO: 15619 - DNA, 18 bp, synthetic construct
  source 1..18: mol_type = other DNA
taaaaggactctccatag

SEQ ID NO: 15620 - DNA, 18 bp, synthetic construct
  source 1..18: mol_type = other DNA
taaaatgactccctatcg

SEQ ID NO: 15621 - DNA, 18 bp, synthetic construct
  source 1..18: mol_type = other DNA
taaaattactcactgtag

SEQ ID NO: 15622 - DNA, 18 bp, synthetic construct
  source 1..18: mol_type = other DNA
taaaccgactcacaatcg

SEQ ID NO: 15623 - DNA, 18 bp, synthetic construct
  source 1..18: mol_type = other DNA
taaaccgactcacgatcg

SEQ ID NO: 15624 - DNA, 18 bp, synthetic construct
  source 1..18: mol_type = other DNA
taaaccgattcattatag

SEQ ID NO: 15625 - DNA, 18 bp, synthetic construct
  source 1..18: mol_type = other DNA
taaaccggctcactttag

SEQ ID NO: 15626 - DNA, 18 bp, synthetic construct
  source 1..18: mol_type = other DNA
taaagaggctcactatag

SEQ ID NO: 15627 - DNA, 18 bp, synthetic construct
  source 1..18: mol_type = other DNA
taaagcaactcactaaag

SEQ ID NO: 15628 - DNA, 18 bp, synthetic construct
  source 1..18: mol_type = other DNA
taaagcgactaactaaag

SEQ ID NO: 15629 - DNA, 18 bp, synthetic construct
  source 1..18: mol_type = other DNA
taaagcggctcaccatag

SEQ ID NO: 15630 - DNA, 18 bp, synthetic construct
  source 1..18: mol_type = other DNA
taaagcgtctcactatgg

SEQ ID NO: 15631 - DNA, 18 bp, synthetic construct
  source 1..18: mol_type = other DNA
taacaagacacattatag

SEQ ID NO: 15632 - DNA, 18 bp, synthetic construct
  source 1..18: mol_type = other DNA
taacacgaatgattatag

SEQ ID NO: 15633 - DNA, 18 bp, synthetic construct
  source 1..18: mol_type = other DNA
taacacgactaacaatgg

SEQ ID NO: 15634 - DNA, 18 bp, synthetic construct
  source 1..18: mol_type = other DNA
taacacgtctctctatgg

SEQ ID NO: 15635 - DNA, 18 bp, synthetic construct
  source 1..18: mol_type = other DNA
taacacgtgccactatag

SEQ ID NO: 15636 - DNA, 18 bp, synthetic construct
  source 1..18: mol_type = other DNA
taacactactcatcatag

SEQ ID NO: 15637 - DNA, 18 bp, synthetic construct
  source 1..18: mol_type = other DNA
taacactactcattagag

SEQ ID NO: 15638 - DNA, 18 bp, synthetic construct
  source 1..18: mol_type = other DNA
taacactactgactttag

SEQ ID NO: 15639 - DNA, 18 bp, synthetic construct
  source 1..18: mol_type = other DNA
taacaggactaactagag

SEQ ID NO: 15640 - DNA, 18 bp, synthetic construct
  source 1..18: mol_type = other DNA
taacccgatccactatag

SEQ ID NO: 15641 - DNA, 18 bp, synthetic construct
  source 1..18: mol_type = other DNA
taacccgattcagtatag

SEQ ID NO: 15642 - DNA, 18 bp, synthetic construct
  source 1..18: mol_type = other DNA
taacgcgactcacaaaag

SEQ ID NO: 15643 - DNA, 18 bp, synthetic construct
  source 1..18: mol_type = other DNA
taacgcgagtaactatag

SEQ ID NO: 15644 - DNA, 18 bp, synthetic construct
  source 1..18: mol_type = other DNA
taacgcgcctaactatag

SEQ ID NO: 15645 - DNA, 18 bp, synthetic construct
  source 1..18: mol_type = other DNA
taacgcgcctcattatag

SEQ ID NO: 15646 - DNA, 18 bp, synthetic construct
  source 1..18: mol_type = other DNA
taagaagacatactatag

SEQ ID NO: 15647 - DNA, 18 bp, synthetic construct
  source 1..18: mol_type = other DNA
taagacgaatcataatag

SEQ ID NO: 15648 - DNA, 18 bp, synthetic construct
  source 1..18: mol_type = other DNA
taagacgacctacgatag

SEQ ID NO: 15649 - DNA, 18 bp, synthetic construct
  source 1..18: mol_type = other DNA
taagactactcacagtag

SEQ ID NO: 15650 - DNA, 18 bp, synthetic construct
  source 1..18: mol_type = other DNA
taagaggactcacattag

SEQ ID NO: 15651 - DNA, 18 bp, synthetic construct
  source 1..18: mol_type = other DNA
taagatcactcactatcg

SEQ ID NO: 15652 - DNA, 18 bp, synthetic construct
  source 1..18: mol_type = other DNA
taagatgacatactatag

SEQ ID NO: 15653 - DNA, 18 bp, synthetic construct
  source 1..18: mol_type = other DNA
taagatgactctctttag

SEQ ID NO: 15654 - DNA, 18 bp, synthetic construct
  source 1..18: mol_type = other DNA
taagatgtctcaatatag

SEQ ID NO: 15655 - DNA, 18 bp, synthetic construct
  source 1..18: mol_type = other DNA
taagattagtcactatag

SEQ ID NO: 15656 - DNA, 18 bp, synthetic construct
  source 1..18: mol_type = other DNA
taagcagtctcactatag

SEQ ID NO: 15657 - DNA, 18 bp, synthetic construct
  source 1..18: mol_type = other DNA
taagccgacccactaaag

SEQ ID NO: 15658 - DNA, 18 bp, synthetic construct
  source 1..18: mol_type = other DNA
taagccgactctctctag

SEQ ID NO: 15659 - DNA, 18 bp, synthetic construct
  source 1..18: mol_type = other DNA
taaggcaactcactttag

SEQ ID NO: 15660 - DNA, 18 bp, synthetic construct
  source 1..18: mol_type = other DNA
taataaaactcatgatag

SEQ ID NO: 15661 - DNA, 18 bp, synthetic construct
  source 1..18: mol_type = other DNA
taataaaactctctagag

SEQ ID NO: 15662 - DNA, 18 bp, synthetic construct
  source 1..18: mol_type = other DNA
taataaaatccactatag

SEQ ID NO: 15663 - DNA, 18 bp, synthetic construct
  source 1..18: mol_type = other DNA
taataaagatcactatag

SEQ ID NO: 15664 - DNA, 18 bp, synthetic construct
  source 1..18: mol_type = other DNA
taataacaatccctatag

SEQ ID NO: 15665 - DNA, 18 bp, synthetic construct
  source 1..18: mol_type = other DNA
taataactctcaatatag

SEQ ID NO: 15666 - DNA, 18 bp, synthetic construct
  source 1..18: mol_type = other DNA
taataagaatcaatatcg

SEQ ID NO: 15667 - DNA, 18 bp, synthetic construct
  source 1..18: mol_type = other DNA
taataagaatcaccttag

SEQ ID NO: 15668 - DNA, 18 bp, synthetic construct
  source 1..18: mol_type = other DNA
taataagaatgagtatag

SEQ ID NO: 15669 - DNA, 18 bp, synthetic construct
  source 1..18: mol_type = other DNA
taataagacgcataatag

SEQ ID NO: 15670 - DNA, 18 bp, synthetic construct
  source 1..18: mol_type = other DNA
taataagactaaatgtag

SEQ ID NO: 15671 - DNA, 18 bp, synthetic construct
  source 1..18: mol_type = other DNA
taataagactaaccatgg

SEQ ID NO: 15672 - DNA, 18 bp, synthetic construct
  source 1..18: mol_type = other DNA
taataagactcaatctgg

SEQ ID NO: 15673 - DNA, 18 bp, synthetic construct
  source 1..18: mol_type = other DNA
taataagactcacttggg

SEQ ID NO: 15674 - DNA, 18 bp, synthetic construct
  source 1..18: mol_type = other DNA
taataagactcataatcg

SEQ ID NO: 15675 - DNA, 18 bp, synthetic construct
  source 1..18: mol_type = other DNA
taataagactccctttcg

SEQ ID NO: 15676 - DNA, 18 bp, synthetic construct
  source 1..18: mol_type = other DNA
taataagactctctctgg

SEQ ID NO: 15677 - DNA, 18 bp, synthetic construct
  source 1..18: mol_type = other DNA
taataagagtcattatcg

SEQ ID NO: 15678 - DNA, 18 bp, synthetic construct
  source 1..18: mol_type = other DNA
taataagtatcactgtag

SEQ ID NO: 15679 - DNA, 18 bp, synthetic construct
  source 1..18: mol_type = other DNA
taataagtccaactatag

SEQ ID NO: 15680 - DNA, 18 bp, synthetic construct
  source 1..18: mol_type = other DNA
taataagtcttactagag

SEQ ID NO: 15681 - DNA, 18 bp, synthetic construct
  source 1..18: mol_type = other DNA
taataatactcaaaatag

SEQ ID NO: 15682 - DNA, 18 bp, synthetic construct
  source 1..18: mol_type = other DNA
taataatactcaccatcg

SEQ ID NO: 15683 - DNA, 18 bp, synthetic construct
  source 1..18: mol_type = other DNA
taataatagttactatag

SEQ ID NO: 15684 - DNA, 18 bp, synthetic construct
  source 1..18: mol_type = other DNA
taatacaaatcaatacag

SEQ ID NO: 15685 - DNA, 18 bp, synthetic construct
  source 1..18: mol_type = other DNA
taatacaaatccatatag

SEQ ID NO: 15686 - DNA, 18 bp, synthetic construct
  source 1..18: mol_type = other DNA
taatacaaatccttatag

SEQ ID NO: 15687 - DNA, 18 bp, synthetic construct
  source 1..18: mol_type = other DNA
taatacaacccagtagag

SEQ ID NO: 15688 - DNA, 18 bp, synthetic construct
  source 1..18: mol_type = other DNA
taatacaagtaactatcg

SEQ ID NO: 15689 - DNA, 18 bp, synthetic construct
  source 1..18: mol_type = other DNA
taatacagccccctatag

SEQ ID NO: 15690 - DNA, 18 bp, synthetic construct
  source 1..18: mol_type = other DNA
taatacagctcagtaaag

SEQ ID NO: 15691 - DNA, 18 bp, synthetic construct
  source 1..18: mol_type = other DNA
taatacatctcaccacag

SEQ ID NO: 15692 - DNA, 18 bp, synthetic construct
  source 1..18: mol_type = other DNA
taatacatctcaccgtag

SEQ ID NO: 15693 - DNA, 18 bp, synthetic construct
  source 1..18: mol_type = other DNA
taatacatctcactggag

SEQ ID NO: 15694 - DNA, 18 bp, synthetic construct
  source 1..18: mol_type = other DNA
taatacatctgcctatag

SEQ ID NO: 15695 - DNA, 18 bp, synthetic construct
  source 1..18: mol_type = other DNA
taataccacgctctttag

SEQ ID NO: 15696 - DNA, 18 bp, synthetic construct
  source 1..18: mol_type = other DNA
taataccactcagaaaag

SEQ ID NO: 15697 - DNA, 18 bp, synthetic construct
  source 1..18: mol_type = other DNA
taataccacttacaagag

SEQ ID NO: 15698 - DNA, 18 bp, synthetic construct
  source 1..18: mol_type = other DNA
taataccatccaatatag

SEQ ID NO: 15699 - DNA, 18 bp, synthetic construct
  source 1..18: mol_type = other DNA
taataccattcaatatcg

SEQ ID NO: 15700 - DNA, 18 bp, synthetic construct
  source 1..18: mol_type = other DNA
taataccatttactatcg

SEQ ID NO: 15701 - DNA, 18 bp, synthetic construct
  source 1..18: mol_type = other DNA
taataccgatcattatag

SEQ ID NO: 15702 - DNA, 18 bp, synthetic construct
  source 1..18: mol_type = other DNA
taatacgaaaccctctag

SEQ ID NO: 15703 - DNA, 18 bp, synthetic construct
  source 1..18: mol_type = other DNA
taatacgaaatactatgg

SEQ ID NO: 15704 - DNA, 18 bp, synthetic construct
  source 1..18: mol_type = other DNA
taatacgaactattatag

SEQ ID NO: 15705 - DNA, 18 bp, synthetic construct
  source 1..18: mol_type = other DNA
taatacgaacttctatag

SEQ ID NO: 15706 - DNA, 18 bp, synthetic construct
  source 1..18: mol_type = other DNA
taatacgacaaactggag

SEQ ID NO: 15707 - DNA, 18 bp, synthetic construct
  source 1..18: mol_type = other DNA
taatacgacacagcatcg

SEQ ID NO: 15708 - DNA, 18 bp, synthetic construct
  source 1..18: mol_type = other DNA
taatacgacaccctagcg

SEQ ID NO: 15709 - DNA, 18 bp, synthetic construct
  source 1..18: mol_type = other DNA
taatacgacataatgtag

SEQ ID NO: 15710 - DNA, 18 bp, synthetic construct
  source 1..18: mol_type = other DNA
taatacgaccctgtagag

SEQ ID NO: 15711 - DNA, 18 bp, synthetic construct
  source 1..18: mol_type = other DNA
taatacgaccgataatag

SEQ ID NO: 15712 - DNA, 18 bp, synthetic construct
  source 1..18: mol_type = other DNA
taatacgaccgccaatag

SEQ ID NO: 15713 - DNA, 18 bp, synthetic construct
  source 1..18: mol_type = other DNA
taatacgacgctttatgg

SEQ ID NO: 15714 - DNA, 18 bp, synthetic construct
  source 1..18: mol_type = other DNA
taatacgactcaattagg

SEQ ID NO: 15715 - DNA, 18 bp, synthetic construct
  source 1..18: mol_type = other DNA
taatacgactcactggcc

SEQ ID NO: 15716 - DNA, 18 bp, synthetic construct
  source 1..18: mol_type = other DNA
taatacgactcatcaagg

SEQ ID NO: 15717 - DNA, 18 bp, synthetic construct
  source 1..18: mol_type = other DNA
taatacgactcccccaag

SEQ ID NO: 15718 - DNA, 18 bp, synthetic construct
  source 1..18: mol_type = other DNA
taatacgactctcggcag

SEQ ID NO: 15719 - DNA, 18 bp, synthetic construct
  source 1..18: mol_type = other DNA
taatacgactgacttacg

SEQ ID NO: 15720 - DNA, 18 bp, synthetic construct
  source 1..18: mol_type = other DNA
taatacgacttactcagg

SEQ ID NO: 15721 - DNA, 18 bp, synthetic construct
  source 1..18: mol_type = other DNA
taatacgacttagttaag

SEQ ID NO: 15722 - DNA, 18 bp, synthetic construct
  source 1..18: mol_type = other DNA
taatacgacttataagag

SEQ ID NO: 15723 - DNA, 18 bp, synthetic construct
  source 1..18: mol_type = other DNA
taatacgagacactggag

SEQ ID NO: 15724 - DNA, 18 bp, synthetic construct
  source 1..18: mol_type = other DNA
taatacgagtaactaacg

SEQ ID NO: 15725 - DNA, 18 bp, synthetic construct
  source 1..18: mol_type = other DNA
taatacgatagactatcg

SEQ ID NO: 15726 - DNA, 18 bp, synthetic construct
  source 1..18: mol_type = other DNA
taatacgatagagtatag

SEQ ID NO: 15727 - DNA, 18 bp, synthetic construct
  source 1..18: mol_type = other DNA
taatacgattcacacgag

SEQ ID NO: 15728 - DNA, 18 bp, synthetic construct
  source 1..18: mol_type = other DNA
taatacgcatcaatgtag

SEQ ID NO: 15729 - DNA, 18 bp, synthetic construct
  source 1..18: mol_type = other DNA
taatacgcattacaatag

SEQ ID NO: 15730 - DNA, 18 bp, synthetic construct
  source 1..18: mol_type = other DNA
taatacgcctcaataacg

SEQ ID NO: 15731 - DNA, 18 bp, synthetic construct
  source 1..18: mol_type = other DNA
taatacgcctcccagtag

SEQ ID NO: 15732 - DNA, 18 bp, synthetic construct
  source 1..18: mol_type = other DNA
taatacgcgccactttag

SEQ ID NO: 15733 - DNA, 18 bp, synthetic construct
  source 1..18: mol_type = other DNA
taatacgctgcactaaag

SEQ ID NO: 15734 - DNA, 18 bp, synthetic construct
  source 1..18: mol_type = other DNA
taatacggaccactaaag

SEQ ID NO: 15735 - DNA, 18 bp, synthetic construct
  source 1..18: mol_type = other DNA
taatacggatccctacag

SEQ ID NO: 15736 - DNA, 18 bp, synthetic construct
  source 1..18: mol_type = other DNA
taatacggctaactccag

SEQ ID NO: 15737 - DNA, 18 bp, synthetic construct
  source 1..18: mol_type = other DNA
taatacggctcaatttcg

SEQ ID NO: 15738 - DNA, 18 bp, synthetic construct
  source 1..18: mol_type = other DNA
taatacggctcattcaag

SEQ ID NO: 15739 - DNA, 18 bp, synthetic construct
  source 1..18: mol_type = other DNA
taatacggtttactatcg

SEQ ID NO: 15740 - DNA, 18 bp, synthetic construct
  source 1..18: mol_type = other DNA
taatacgtatcagtttag

SEQ ID NO: 15741 - DNA, 18 bp, synthetic construct
  source 1..18: mol_type = other DNA
taatacgtcacacaataa

SEQ ID NO: 15742 - DNA, 18 bp, synthetic construct
  source 1..18: mol_type = other DNA
taatacgtcactctctag

SEQ ID NO: 15743 - DNA, 18 bp, synthetic construct
  source 1..18: mol_type = other DNA
taatacgtcgcattaaag

SEQ ID NO: 15744 - DNA, 18 bp, synthetic construct
  source 1..18: mol_type = other DNA
taatacgtcggactttag

SEQ ID NO: 15745 - DNA, 18 bp, synthetic construct
  source 1..18: mol_type = other DNA
taatacgtctaagtatgg

SEQ ID NO: 15746 - DNA, 18 bp, synthetic construct
  source 1..18: mol_type = other DNA
taatacgtctccggatag

SEQ ID NO: 15747 - DNA, 18 bp, synthetic construct
  source 1..18: mol_type = other DNA
taatacgtctgacttcag

SEQ ID NO: 15748 - DNA, 18 bp, synthetic construct
  source 1..18: mol_type = other DNA
taatacgtgccaccatag

SEQ ID NO: 15749 - DNA, 18 bp, synthetic construct
  source 1..18: mol_type = other DNA
taatacgttctactatag

SEQ ID NO: 15750 - DNA, 18 bp, synthetic construct
  source 1..18: mol_type = other DNA
taatacgtttccctgtag

SEQ ID NO: 15751 - DNA, 18 bp, synthetic construct
  source 1..18: mol_type = other DNA
taatacgtttgactgtag

SEQ ID NO: 15752 - DNA, 18 bp, synthetic construct
  source 1..18: mol_type = other DNA
taatactaatccctatcg

SEQ ID NO: 15753 - DNA, 18 bp, synthetic construct
  source 1..18: mol_type = other DNA
taatactacacacgacag

SEQ ID NO: 15754 - DNA, 18 bp, synthetic construct
  source 1..18: mol_type = other DNA
taatactactcaatcaag

SEQ ID NO: 15755 - DNA, 18 bp, synthetic construct
  source 1..18: mol_type = other DNA
taatactactcacattgg

SEQ ID NO: 15756 - DNA, 18 bp, synthetic construct
  source 1..18: mol_type = other DNA
taatactactccagatag

SEQ ID NO: 15757 - DNA, 18 bp, synthetic construct
  source 1..18: mol_type = other DNA
taatactactgaccaaag

SEQ ID NO: 15758 - DNA, 18 bp, synthetic construct
  source 1..18: mol_type = other DNA
taatactcgtcacaatag

SEQ ID NO: 15759 - DNA, 18 bp, synthetic construct
  source 1..18: mol_type = other DNA
taatacttctaactagag

SEQ ID NO: 15760 - DNA, 18 bp, synthetic construct
  source 1..18: mol_type = other DNA
taatacttctccctgtag

SEQ ID NO: 15761 - DNA, 18 bp, synthetic construct
  source 1..18: mol_type = other DNA
taatagcaatcactatgg

SEQ ID NO: 15762 - DNA, 18 bp, synthetic construct
  source 1..18: mol_type = other DNA
taataggactcaccggag

SEQ ID NO: 15763 - DNA, 18 bp, synthetic construct
  source 1..18: mol_type = other DNA
taataggactcagaaaag

SEQ ID NO: 15764 - DNA, 18 bp, synthetic construct
  source 1..18: mol_type = other DNA
taataggactcagaagag

SEQ ID NO: 15765 - DNA, 18 bp, synthetic construct
  source 1..18: mol_type = other DNA
taataggatccagtatag

SEQ ID NO: 15766 - DNA, 18 bp, synthetic construct
  source 1..18: mol_type = other DNA
taataggccacacgatag

SEQ ID NO: 15767 - DNA, 18 bp, synthetic construct
  source 1..18: mol_type = other DNA
taatagtaattactatag

SEQ ID NO: 15768 - DNA, 18 bp, synthetic construct
  source 1..18: mol_type = other DNA
taatataaatcactgtag

SEQ ID NO: 15769 - DNA, 18 bp, synthetic construct
  source 1..18: mol_type = other DNA
taatataacagactatag

SEQ ID NO: 15770 - DNA, 18 bp, synthetic construct
  source 1..18: mol_type = other DNA
taatataactctctgtag

SEQ ID NO: 15771 - DNA, 18 bp, synthetic construct
  source 1..18: mol_type = other DNA
taatataatttactatag

SEQ ID NO: 15772 - DNA, 18 bp, synthetic construct
  source 1..18: mol_type = other DNA
taatatgaattactgtag

SEQ ID NO: 15773 - DNA, 18 bp, synthetic construct
  source 1..18: mol_type = other DNA
taatatgacacaggatag

SEQ ID NO: 15774 - DNA, 18 bp, synthetic construct
  source 1..18: mol_type = other DNA
taatatgacataccatag

SEQ ID NO: 15775 - DNA, 18 bp, synthetic construct
  source 1..18: mol_type = other DNA
taatatgactcaataccg

SEQ ID NO: 15776 - DNA, 18 bp, synthetic construct
  source 1..18: mol_type = other DNA
taatatgactcactacct

SEQ ID NO: 15777 - DNA, 18 bp, synthetic construct
  source 1..18: mol_type = other DNA
taatatgactctctgcag

SEQ ID NO: 15778 - DNA, 18 bp, synthetic construct
  source 1..18: mol_type = other DNA
taatatgactctcttgag

SEQ ID NO: 15779 - DNA, 18 bp, synthetic construct
  source 1..18: mol_type = other DNA
taatatgacttactaagg

SEQ ID NO: 15780 - DNA, 18 bp, synthetic construct
  source 1..18: mol_type = other DNA
taatatgactttctgtag

SEQ ID NO: 15781 - DNA, 18 bp, synthetic construct
  source 1..18: mol_type = other DNA
taatatgagtcccaatag

SEQ ID NO: 15782 - DNA, 18 bp, synthetic construct
  source 1..18: mol_type = other DNA
taatatgtctcactttgg

SEQ ID NO: 15783 - DNA, 18 bp, synthetic construct
  source 1..18: mol_type = other DNA
taatatgtctgactaaag

SEQ ID NO: 15784 - DNA, 18 bp, synthetic construct
  source 1..18: mol_type = other DNA
taatattactaattatag

SEQ ID NO: 15785 - DNA, 18 bp, synthetic construct
  source 1..18: mol_type = other DNA
taatattactccttatag

SEQ ID NO: 15786 - DNA, 18 bp, synthetic construct
  source 1..18: mol_type = other DNA
taatcaggctcactatcg

SEQ ID NO: 15787 - DNA, 18 bp, synthetic construct
  source 1..18: mol_type = other DNA
taatccaacacactctag

SEQ ID NO: 15788 - DNA, 18 bp, synthetic construct
  source 1..18: mol_type = other DNA
taatccaacccaccatag

SEQ ID NO: 15789 - DNA, 18 bp, synthetic construct
  source 1..18: mol_type = other DNA
taatccaactcacttgag

SEQ ID NO: 15790 - DNA, 18 bp, synthetic construct
  source 1..18: mol_type = other DNA
taatccgactaacactag

SEQ ID NO: 15791 - DNA, 18 bp, synthetic construct
  source 1..18: mol_type = other DNA
taatccgagtctcaatag

SEQ ID NO: 15792 - DNA, 18 bp, synthetic construct
  source 1..18: mol_type = other DNA
taatccgattcactttcg

SEQ ID NO: 15793 - DNA, 18 bp, synthetic construct
  source 1..18: mol_type = other DNA
taatccgattctctataa

SEQ ID NO: 15794 - DNA, 18 bp, synthetic construct
  source 1..18: mol_type = other DNA
taatccgcttcattatag

SEQ ID NO: 15795 - DNA, 18 bp, synthetic construct
  source 1..18: mol_type = other DNA
taatccggcccactatgg

SEQ ID NO: 15796 - DNA, 18 bp, synthetic construct
  source 1..18: mol_type = other DNA
taatccgtcgaactatag

SEQ ID NO: 15797 - DNA, 18 bp, synthetic construct
  source 1..18: mol_type = other DNA
taatccgtgtcactttag

SEQ ID NO: 15798 - DNA, 18 bp, synthetic construct
  source 1..18: mol_type = other DNA
taatcggactcaccatcg

SEQ ID NO: 15799 - DNA, 18 bp, synthetic construct
  source 1..18: mol_type = other DNA
taatcgtagtcactatag

SEQ ID NO: 15800 - DNA, 18 bp, synthetic construct
  source 1..18: mol_type = other DNA
taatctgaatcactatgg

SEQ ID NO: 15801 - DNA, 18 bp, synthetic construct
  source 1..18: mol_type = other DNA
taatctgacacaatatag

SEQ ID NO: 15802 - DNA, 18 bp, synthetic construct
  source 1..18: mol_type = other DNA
taatctgactcactgcag

SEQ ID NO: 15803 - DNA, 18 bp, synthetic construct
  source 1..18: mol_type = other DNA
taatctgactcattttag

SEQ ID NO: 15804 - DNA, 18 bp, synthetic construct
  source 1..18: mol_type = other DNA
taatcttactctctatag

SEQ ID NO: 15805 - DNA, 18 bp, synthetic construct
  source 1..18: mol_type = other DNA
taatgagactcactaagg

SEQ ID NO: 15806 - DNA, 18 bp, synthetic construct
  source 1..18: mol_type = other DNA
taatgcaactcactctcg

SEQ ID NO: 15807 - DNA, 18 bp, synthetic construct
  source 1..18: mol_type = other DNA
taatgccacgcattatag

SEQ ID NO: 15808 - DNA, 18 bp, synthetic construct
  source 1..18: mol_type = other DNA
taatgccattcactttag

SEQ ID NO: 15809 - DNA, 18 bp, synthetic construct
  source 1..18: mol_type = other DNA
taatgcgaaacactatgg

SEQ ID NO: 15810 - DNA, 18 bp, synthetic construct
  source 1..18: mol_type = other DNA
taatgcgaatcagtctag

SEQ ID NO: 15811 - DNA, 18 bp, synthetic construct
  source 1..18: mol_type = other DNA
taatgcgactcacactgg

SEQ ID NO: 15812 - DNA, 18 bp, synthetic construct
  source 1..18: mol_type = other DNA
taatgcgactctcgataa

SEQ ID NO: 15813 - DNA, 18 bp, synthetic construct
  source 1..18: mol_type = other DNA
taatgcgacttactagcg

SEQ ID NO: 15814 - DNA, 18 bp, synthetic construct
  source 1..18: mol_type = other DNA
taatgcgatccacgatag

SEQ ID NO: 15815 - DNA, 18 bp, synthetic construct
  source 1..18: mol_type = other DNA
taatgcgatttaccatag

SEQ ID NO: 15816 - DNA, 18 bp, synthetic construct
  source 1..18: mol_type = other DNA
taatgcggctcacactag

SEQ ID NO: 15817 - DNA, 18 bp, synthetic construct
  source 1..18: mol_type = other DNA
taatgcggctcactatca

SEQ ID NO: 15818 - DNA, 18 bp, synthetic construct
  source 1..18: mol_type = other DNA
taatgcggctctcgatag

SEQ ID NO: 15819 - DNA, 18 bp, synthetic construct
  source 1..18: mol_type = other DNA
taatgcgtcttaatatag

SEQ ID NO: 15820 - DNA, 18 bp, synthetic construct
  source 1..18: mol_type = other DNA
taatgctactcacaatcg

SEQ ID NO: 15821 - DNA, 18 bp, synthetic construct
  source 1..18: mol_type = other DNA
taatggtacacactatag

SEQ ID NO: 15822 - DNA, 18 bp, synthetic construct
  source 1..18: mol_type = other DNA
taatgtgaatcactacag

SEQ ID NO: 15823 - DNA, 18 bp, synthetic construct
  source 1..18: mol_type = other DNA
taatgtgcctctctatag

SEQ ID NO: 15824 - DNA, 18 bp, synthetic construct
  source 1..18: mol_type = other DNA
taatgtgtctgactatag

SEQ ID NO: 15825 - DNA, 18 bp, synthetic construct
  source 1..18: mol_type = other DNA
taatgttactcagtatag

SEQ ID NO: 15826 - DNA, 18 bp, synthetic construct
  source 1..18: mol_type = other DNA
tacaacgactaattatag

SEQ ID NO: 15827 - DNA, 18 bp, synthetic construct
  source 1..18: mol_type = other DNA
tacaacgactcatcatag

SEQ ID NO: 15828 - DNA, 18 bp, synthetic construct
  source 1..18: mol_type = other DNA
tacaacgagtcactaaag

SEQ ID NO: 15829 - DNA, 18 bp, synthetic construct
  source 1..18: mol_type = other DNA
tacaacgagtcattatag

SEQ ID NO: 15830 - DNA, 18 bp, synthetic construct
  source 1..18: mol_type = other DNA
tacaacgattcactctag

SEQ ID NO: 15831 - DNA, 18 bp, synthetic construct
  source 1..18: mol_type = other DNA
tacaatgactcactctag

SEQ ID NO: 15832 - DNA, 18 bp, synthetic construct
  source 1..18: mol_type = other DNA
tacaatgactctctatag

SEQ ID NO: 15833 - DNA, 18 bp, synthetic construct
  source 1..18: mol_type = other DNA
tacacagactcactatag

SEQ ID NO: 15834 - DNA, 18 bp, synthetic construct
  source 1..18: mol_type = other DNA
taccacgagtcacgatag

SEQ ID NO: 15835 - DNA, 18 bp, synthetic construct
  source 1..18: mol_type = other DNA
tacgacgagtcactatcg

SEQ ID NO: 15836 - DNA, 18 bp, synthetic construct
  source 1..18: mol_type = other DNA
tactaagactcacttaag

SEQ ID NO: 15837 - DNA, 18 bp, synthetic construct
  source 1..18: mol_type = other DNA
tactaaggctcactttag

SEQ ID NO: 15838 - DNA, 18 bp, synthetic construct
  source 1..18: mol_type = other DNA
tactacaacatactatag

SEQ ID NO: 15839 - DNA, 18 bp, synthetic construct
  source 1..18: mol_type = other DNA
tactaccactctcaatag

SEQ ID NO: 15840 - DNA, 18 bp, synthetic construct
  source 1..18: mol_type = other DNA
tactacgaatcattacag

SEQ ID NO: 15841 - DNA, 18 bp, synthetic construct
  source 1..18: mol_type = other DNA
tactacgacagaatatag

SEQ ID NO: 15842 - DNA, 18 bp, synthetic construct
  source 1..18: mol_type = other DNA
tactacgactcacaccag

SEQ ID NO: 15843 - DNA, 18 bp, synthetic construct
  source 1..18: mol_type = other DNA
tactacgagtacctatag

SEQ ID NO: 15844 - DNA, 18 bp, synthetic construct
  source 1..18: mol_type = other DNA
tactacgcctctctatcg

SEQ ID NO: 15845 - DNA, 18 bp, synthetic construct
  source 1..18: mol_type = other DNA
tactacggctctctctag

SEQ ID NO: 15846 - DNA, 18 bp, synthetic construct
  source 1..18: mol_type = other DNA
tactatgactctctacag

SEQ ID NO: 15847 - DNA, 18 bp, synthetic construct
  source 1..18: mol_type = other DNA
tactccgtctcactttag

SEQ ID NO: 15848 - DNA, 18 bp, synthetic construct
  source 1..18: mol_type = other DNA
tactcttactcactatag

SEQ ID NO: 15849 - DNA, 18 bp, synthetic construct
  source 1..18: mol_type = other DNA
tactgcgactcactgtcg

SEQ ID NO: 15850 - DNA, 18 bp, synthetic construct
  source 1..18: mol_type = other DNA
tactgcgattcactttag

SEQ ID NO: 15851 - DNA, 18 bp, synthetic construct
  source 1..18: mol_type = other DNA
tagaacgactcaatatgg

SEQ ID NO: 15852 - DNA, 18 bp, synthetic construct
  source 1..18: mol_type = other DNA
tagaacgactcactgaag

SEQ ID NO: 15853 - DNA, 18 bp, synthetic construct
  source 1..18: mol_type = other DNA
tagaacgacttaatatag

SEQ ID NO: 15854 - DNA, 18 bp, synthetic construct
  source 1..18: mol_type = other DNA
tagaactactcaccatag

SEQ ID NO: 15855 - DNA, 18 bp, synthetic construct
  source 1..18: mol_type = other DNA
tagaatgagtcactatag

SEQ ID NO: 15856 - DNA, 18 bp, synthetic construct
  source 1..18: mol_type = other DNA
tagtaagattcactatgg

SEQ ID NO: 15857 - DNA, 18 bp, synthetic construct
  source 1..18: mol_type = other DNA
tagtacaaattactatag

SEQ ID NO: 15858 - DNA, 18 bp, synthetic construct
  source 1..18: mol_type = other DNA
tagtaccattcaccatag

SEQ ID NO: 15859 - DNA, 18 bp, synthetic construct
  source 1..18: mol_type = other DNA
tagtacctctctctatag

SEQ ID NO: 15860 - DNA, 18 bp, synthetic construct
  source 1..18: mol_type = other DNA
tagtacgactcaaagtag

SEQ ID NO: 15861 - DNA, 18 bp, synthetic construct
  source 1..18: mol_type = other DNA
tagtacgactcagttaag

SEQ ID NO: 15862 - DNA, 18 bp, synthetic construct
  source 1..18: mol_type = other DNA
tagtacgacttaatttag

SEQ ID NO: 15863 - DNA, 18 bp, synthetic construct
  source 1..18: mol_type = other DNA
tagtacgattcaccgtag

SEQ ID NO: 15864 - DNA, 18 bp, synthetic construct
  source 1..18: mol_type = other DNA
tagtacgccatactatag

SEQ ID NO: 15865 - DNA, 18 bp, synthetic construct
  source 1..18: mol_type = other DNA
tagtacgtcccactttag

SEQ ID NO: 15866 - DNA, 18 bp, synthetic construct
  source 1..18: mol_type = other DNA
tagtactaccgactatag

SEQ ID NO: 15867 - DNA, 18 bp, synthetic construct
  source 1..18: mol_type = other DNA
tagtagatctcactatag

SEQ ID NO: 15868 - DNA, 18 bp, synthetic construct
  source 1..18: mol_type = other DNA
tagtatgactcattatcg

SEQ ID NO: 15869 - DNA, 18 bp, synthetic construct
  source 1..18: mol_type = other DNA
tagtatgagtcattatag

SEQ ID NO: 15870 - DNA, 18 bp, synthetic construct
  source 1..18: mol_type = other DNA
tagtcctactcactaaag

SEQ ID NO: 15871 - DNA, 18 bp, synthetic construct
  source 1..18: mol_type = other DNA
tagtgcaacacactatag

SEQ ID NO: 15872 - DNA, 18 bp, synthetic construct
  source 1..18: mol_type = other DNA
tagtgcgactcaccagag

SEQ ID NO: 15873 - DNA, 18 bp, synthetic construct
  source 1..18: mol_type = other DNA
tataacgaccccctatag

SEQ ID NO: 15874 - DNA, 18 bp, synthetic construct
  source 1..18: mol_type = other DNA
tataacgactcaccacag

SEQ ID NO: 15875 - DNA, 18 bp, synthetic construct
  source 1..18: mol_type = other DNA
tataacgactcactggag

SEQ ID NO: 15876 - DNA, 18 bp, synthetic construct
  source 1..18: mol_type = other DNA
tatcacgacacagtatag

SEQ ID NO: 15877 - DNA, 18 bp, synthetic construct
  source 1..18: mol_type = other DNA
tatcacgactctctatgg

SEQ ID NO: 15878 - DNA, 18 bp, synthetic construct
  source 1..18: mol_type = other DNA
tatcacgactctgtatag

SEQ ID NO: 15879 - DNA, 18 bp, synthetic construct
  source 1..18: mol_type = other DNA
tatcacgtcgcactatag

SEQ ID NO: 15880 - DNA, 18 bp, synthetic construct
  source 1..18: mol_type = other DNA
tatcactactcactatcg

SEQ ID NO: 15881 - DNA, 18 bp, synthetic construct
  source 1..18: mol_type = other DNA
tatcatgactaactatag

SEQ ID NO: 15882 - DNA, 18 bp, synthetic construct
  source 1..18: mol_type = other DNA
tatgaggactcactgtag

SEQ ID NO: 15883 - DNA, 18 bp, synthetic construct
  source 1..18: mol_type = other DNA
tattaccactcagtgtag

SEQ ID NO: 15884 - DNA, 18 bp, synthetic construct
  source 1..18: mol_type = other DNA
tattacgaaccacgatag

SEQ ID NO: 15885 - DNA, 18 bp, synthetic construct
  source 1..18: mol_type = other DNA
tattacgacacaccttag

SEQ ID NO: 15886 - DNA, 18 bp, synthetic construct
  source 1..18: mol_type = other DNA
tattacgacacacgttag

SEQ ID NO: 15887 - DNA, 18 bp, synthetic construct
  source 1..18: mol_type = other DNA
tattacgacgcaatctag

SEQ ID NO: 15888 - DNA, 18 bp, synthetic construct
  source 1..18: mol_type = other DNA
tattacgacgcactaacg

SEQ ID NO: 15889 - DNA, 18 bp, synthetic construct
  source 1..18: mol_type = other DNA
tattacgactaacttgag

SEQ ID NO: 15890 - DNA, 18 bp, synthetic construct
  source 1..18: mol_type = other DNA
tattacgactcacaaccg

SEQ ID NO: 15891 - DNA, 18 bp, synthetic construct
  source 1..18: mol_type = other DNA
tattacgactcacgttgg

SEQ ID NO: 15892 - DNA, 18 bp, synthetic construct
  source 1..18: mol_type = other DNA
tattacgactcactcaaa

SEQ ID NO: 15893 - DNA, 18 bp, synthetic construct
  source 1..18: mol_type = other DNA
tattacgactcacttccg

SEQ ID NO: 15894 - DNA, 18 bp, synthetic construct
  source 1..18: mol_type = other DNA
tattacgactcctaatag

SEQ ID NO: 15895 - DNA, 18 bp, synthetic construct
  source 1..18: mol_type = other DNA
tattacgattcactccag

SEQ ID NO: 15896 - DNA, 18 bp, synthetic construct
  source 1..18: mol_type = other DNA
tattacgccgcaatatag

SEQ ID NO: 15897 - DNA, 18 bp, synthetic construct
  source 1..18: mol_type = other DNA
tattacgcctccctacag

SEQ ID NO: 15898 - DNA, 18 bp, synthetic construct
  source 1..18: mol_type = other DNA
tattacgcgtcactttag

SEQ ID NO: 15899 - DNA, 18 bp, synthetic construct
  source 1..18: mol_type = other DNA
tattacggcccactctag

SEQ ID NO: 15900 - DNA, 18 bp, synthetic construct
  source 1..18: mol_type = other DNA
tattacggctcaatatgg

SEQ ID NO: 15901 - DNA, 18 bp, synthetic construct
  source 1..18: mol_type = other DNA
tattacggctcacgatgg

SEQ ID NO: 15902 - DNA, 18 bp, synthetic construct
  source 1..18: mol_type = other DNA
tattacggctgactagag

SEQ ID NO: 15903 - DNA, 18 bp, synthetic construct
  source 1..18: mol_type = other DNA
tattacggttccctatag

SEQ ID NO: 15904 - DNA, 18 bp, synthetic construct
  source 1..18: mol_type = other DNA
tattacgtccccctatag

SEQ ID NO: 15905 - DNA, 18 bp, synthetic construct
  source 1..18: mol_type = other DNA
tattacgtctcactaagg

SEQ ID NO: 15906 - DNA, 18 bp, synthetic construct
  source 1..18: mol_type = other DNA
tattatcacacactatag

SEQ ID NO: 15907 - DNA, 18 bp, synthetic construct
  source 1..18: mol_type = other DNA
tattatgacccactatgg

SEQ ID NO: 15908 - DNA, 18 bp, synthetic construct
  source 1..18: mol_type = other DNA
tattcccagtcactatag

SEQ ID NO: 15909 - DNA, 18 bp, synthetic construct
  source 1..18: mol_type = other DNA
tattccgaatcactagag

SEQ ID NO: 15910 - DNA, 18 bp, synthetic construct
  source 1..18: mol_type = other DNA
tattcggactcaatatag

SEQ ID NO: 15911 - DNA, 18 bp, synthetic construct
  source 1..18: mol_type = other DNA
tattgcgactcagaatag

SEQ ID NO: 15912 - DNA, 18 bp, synthetic construct
  source 1..18: mol_type = other DNA
tattgcgacttattatag

SEQ ID NO: 15913 - DNA, 18 bp, synthetic construct
  source 1..18: mol_type = other DNA
tcaaacgagtcacaatag

SEQ ID NO: 15914 - DNA, 18 bp, synthetic construct
  source 1..18: mol_type = other DNA
tcaagcgactcactctag

SEQ ID NO: 15915 - DNA, 18 bp, synthetic construct
  source 1..18: mol_type = other DNA
tcacacggctcactacag

SEQ ID NO: 15916 - DNA, 18 bp, synthetic construct
  source 1..18: mol_type = other DNA
tcacatgattcactatag

SEQ ID NO: 15917 - DNA, 18 bp, synthetic construct
  source 1..18: mol_type = other DNA
tcataagacttacgatag

SEQ ID NO: 15918 - DNA, 18 bp, synthetic construct
  source 1..18: mol_type = other DNA
tcataagattcactatgg

SEQ ID NO: 15919 - DNA, 18 bp, synthetic construct
  source 1..18: mol_type = other DNA
tcataagcctcactatcg

SEQ ID NO: 15920 - DNA, 18 bp, synthetic construct
  source 1..18: mol_type = other DNA
tcataaggctcactctag

SEQ ID NO: 15921 - DNA, 18 bp, synthetic construct
  source 1..18: mol_type = other DNA
tcatacaactccctatcg

SEQ ID NO: 15922 - DNA, 18 bp, synthetic construct
  source 1..18: mol_type = other DNA
tcataccactcactgcag

SEQ ID NO: 15923 - DNA, 18 bp, synthetic construct
  source 1..18: mol_type = other DNA
tcatacgaataactttag

SEQ ID NO: 15924 - DNA, 18 bp, synthetic construct
  source 1..18: mol_type = other DNA
tcatacgacacactaacg

SEQ ID NO: 15925 - DNA, 18 bp, synthetic construct
  source 1..18: mol_type = other DNA
tcatacgactcaacacag

SEQ ID NO: 15926 - DNA, 18 bp, synthetic construct
  source 1..18: mol_type = other DNA
tcatacgactcacaagcg

SEQ ID NO: 15927 - DNA, 18 bp, synthetic construct
  source 1..18: mol_type = other DNA
tcatacgactgattctag

SEQ ID NO: 15928 - DNA, 18 bp, synthetic construct
  source 1..18: mol_type = other DNA
tcatacgacttcctaaag

SEQ ID NO: 15929 - DNA, 18 bp, synthetic construct
  source 1..18: mol_type = other DNA
tcatacgacttcttatag

SEQ ID NO: 15930 - DNA, 18 bp, synthetic construct
  source 1..18: mol_type = other DNA
tcatacggcccaatatag

SEQ ID NO: 15931 - DNA, 18 bp, synthetic construct
  source 1..18: mol_type = other DNA
tcatacggctaaatatag

SEQ ID NO: 15932 - DNA, 18 bp, synthetic construct
  source 1..18: mol_type = other DNA
tcatacggctccctaaag

SEQ ID NO: 15933 - DNA, 18 bp, synthetic construct
  source 1..18: mol_type = other DNA
tcatactactcaataaag

SEQ ID NO: 15934 - DNA, 18 bp, synthetic construct
  source 1..18: mol_type = other DNA
tcatactactctctagag

SEQ ID NO: 15935 - DNA, 18 bp, synthetic construct
  source 1..18: mol_type = other DNA
tcatactattcactgtag

SEQ ID NO: 15936 - DNA, 18 bp, synthetic construct
  source 1..18: mol_type = other DNA
tcataggactcacttaag

SEQ ID NO: 15937 - DNA, 18 bp, synthetic construct
  source 1..18: mol_type = other DNA
tcataggactcattaaag

SEQ ID NO: 15938 - DNA, 18 bp, synthetic construct
  source 1..18: mol_type = other DNA
tcatatggctcactatgg

SEQ ID NO: 15939 - DNA, 18 bp, synthetic construct
  source 1..18: mol_type = other DNA
tcatctgactcactatcg

SEQ ID NO: 15940 - DNA, 18 bp, synthetic construct
  source 1..18: mol_type = other DNA
tcatgcgactcaccgtag

SEQ ID NO: 15941 - DNA, 18 bp, synthetic construct
  source 1..18: mol_type = other DNA
tcctaagcctcactatag

SEQ ID NO: 15942 - DNA, 18 bp, synthetic construct
  source 1..18: mol_type = other DNA
tcctgcgagtcactatag

SEQ ID NO: 15943 - DNA, 18 bp, synthetic construct
  source 1..18: mol_type = other DNA
tcgtacgtctctctatag

SEQ ID NO: 15944 - DNA, 18 bp, synthetic construct
  source 1..18: mol_type = other DNA
tctaatgactcactatag

SEQ ID NO: 15945 - DNA, 18 bp, synthetic construct
  source 1..18: mol_type = other DNA
tctcacgacgcactatag

SEQ ID NO: 15946 - DNA, 18 bp, synthetic construct
  source 1..18: mol_type = other DNA
tgaaacgaatcactaaag

SEQ ID NO: 15947 - DNA, 18 bp, synthetic construct
  source 1..18: mol_type = other DNA
tgaaacgactctctagag

SEQ ID NO: 15948 - DNA, 18 bp, synthetic construct
  source 1..18: mol_type = other DNA
tgaaacgcctcaatatag

SEQ ID NO: 15949 - DNA, 18 bp, synthetic construct
  source 1..18: mol_type = other DNA
tgaaacgcctccctatag

SEQ ID NO: 15950 - DNA, 18 bp, synthetic construct
  source 1..18: mol_type = other DNA
tgaaaggtctcactatag

SEQ ID NO: 15951 - DNA, 18 bp, synthetic construct
  source 1..18: mol_type = other DNA
tgaaccaactcactatag

SEQ ID NO: 15952 - DNA, 18 bp, synthetic construct
  source 1..18: mol_type = other DNA
tgacaggtctcactatag

SEQ ID NO: 15953 - DNA, 18 bp, synthetic construct
  source 1..18: mol_type = other DNA
tgataagacccattatag

SEQ ID NO: 15954 - DNA, 18 bp, synthetic construct
  source 1..18: mol_type = other DNA
tgataagattcacgatag

SEQ ID NO: 15955 - DNA, 18 bp, synthetic construct
  source 1..18: mol_type = other DNA
tgataccactcacaaaag

SEQ ID NO: 15956 - DNA, 18 bp, synthetic construct
  source 1..18: mol_type = other DNA
tgatacgaaccactctag

SEQ ID NO: 15957 - DNA, 18 bp, synthetic construct
  source 1..18: mol_type = other DNA
tgatacgaatcacactag

SEQ ID NO: 15958 - DNA, 18 bp, synthetic construct
  source 1..18: mol_type = other DNA
tgatacgacagactaaag

SEQ ID NO: 15959 - DNA, 18 bp, synthetic construct
  source 1..18: mol_type = other DNA
tgatacgactaactaacg

SEQ ID NO: 15960 - DNA, 18 bp, synthetic construct
  source 1..18: mol_type = other DNA
tgatacgacttattctag

SEQ ID NO: 15961 - DNA, 18 bp, synthetic construct
  source 1..18: mol_type = other DNA
tgatacgacttcctacag

SEQ ID NO: 15962 - DNA, 18 bp, synthetic construct
  source 1..18: mol_type = other DNA
tgatacgacttcgtatag

SEQ ID NO: 15963 - DNA, 18 bp, synthetic construct
  source 1..18: mol_type = other DNA
tgatacgagtccctttag

SEQ ID NO: 15964 - DNA, 18 bp, synthetic construct
  source 1..18: mol_type = other DNA
tgatacgattcactaagg

SEQ ID NO: 15965 - DNA, 18 bp, synthetic construct
  source 1..18: mol_type = other DNA
tgatacggctcattagag

SEQ ID NO: 15966 - DNA, 18 bp, synthetic construct
  source 1..18: mol_type = other DNA
tgatactacccactctag

SEQ ID NO: 15967 - DNA, 18 bp, synthetic construct
  source 1..18: mol_type = other DNA
tgatactagtccctatag

SEQ ID NO: 15968 - DNA, 18 bp, synthetic construct
  source 1..18: mol_type = other DNA
tgatactcctcactttag

SEQ ID NO: 15969 - DNA, 18 bp, synthetic construct
  source 1..18: mol_type = other DNA
tgatactgctgactatag

SEQ ID NO: 15970 - DNA, 18 bp, synthetic construct
  source 1..18: mol_type = other DNA
tgataggactcccaatag

SEQ ID NO: 15971 - DNA, 18 bp, synthetic construct
  source 1..18: mol_type = other DNA
tgatccgacttactatcg

SEQ ID NO: 15972 - DNA, 18 bp, synthetic construct
  source 1..18: mol_type = other DNA
tgatgggactccctatag

SEQ ID NO: 15973 - DNA, 18 bp, synthetic construct
  source 1..18: mol_type = other DNA
tgcaacgactgactatag

SEQ ID NO: 15974 - DNA, 18 bp, synthetic construct
  source 1..18: mol_type = other DNA
tgctacgtctcattatag

SEQ ID NO: 15975 - DNA, 18 bp, synthetic construct
  source 1..18: mol_type = other DNA
tgctgcgactcactatgg

SEQ ID NO: 15976 - DNA, 18 bp, synthetic construct
  source 1..18: mol_type = other DNA
tggaacgactcaccatag

SEQ ID NO: 15977 - DNA, 18 bp, synthetic construct
  source 1..18: mol_type = other DNA
tggtatgacgcactatag

SEQ ID NO: 15978 - DNA, 18 bp, synthetic construct
  source 1..18: mol_type = other DNA
tgtaacgactcactctag

SEQ ID NO: 15979 - DNA, 18 bp, synthetic construct
  source 1..18: mol_type = other DNA
tgttacgactccttatag

SEQ ID NO: 15980 - DNA, 18 bp, synthetic construct
  source 1..18: mol_type = other DNA
tgttacgacttagtatag

SEQ ID NO: 15981 - DNA, 18 bp, synthetic construct
  source 1..18: mol_type = other DNA
tgttacgtctcaatatag

SEQ ID NO: 15982 - DNA, 18 bp, synthetic construct
  source 1..18: mol_type = other DNA
tgttactactcactgtag

SEQ ID NO: 15983 - DNA, 18 bp, synthetic construct
  source 1..18: mol_type = other DNA
tgttactactgactatag

SEQ ID NO: 15984 - DNA, 18 bp, synthetic construct
  source 1..18: mol_type = other DNA
ttaaacgactcaatgtag

SEQ ID NO: 15985 - DNA, 18 bp, synthetic construct
  source 1..18: mol_type = other DNA
ttaaacgactctctctag

SEQ ID NO: 15986 - DNA, 18 bp, synthetic construct
  source 1..18: mol_type = other DNA
ttaaacgcctcactatgg

SEQ ID NO: 15987 - DNA, 18 bp, synthetic construct
  source 1..18: mol_type = other DNA
ttaagggactcactatag

SEQ ID NO: 15988 - DNA, 18 bp, synthetic construct
  source 1..18: mol_type = other DNA
ttacacccctcactatag

SEQ ID NO: 15989 - DNA, 18 bp, synthetic construct
  source 1..18: mol_type = other DNA
ttacacgacccacaatag

SEQ ID NO: 15990 - DNA, 18 bp, synthetic construct
  source 1..18: mol_type = other DNA
ttacactactcactatcg

SEQ ID NO: 15991 - DNA, 18 bp, synthetic construct
  source 1..18: mol_type = other DNA
ttacaggactcactatcg

SEQ ID NO: 15992 - DNA, 18 bp, synthetic construct
  source 1..18: mol_type = other DNA
ttacatgtctcactatag

SEQ ID NO: 15993 - DNA, 18 bp, synthetic construct
  source 1..18: mol_type = other DNA
ttagacggctccctatag

SEQ ID NO: 15994 - DNA, 18 bp, synthetic construct
  source 1..18: mol_type = other DNA
ttagacgtctcattatag

SEQ ID NO: 15995 - DNA, 18 bp, synthetic construct
  source 1..18: mol_type = other DNA
ttatacaactcaatatcg

SEQ ID NO: 15996 - DNA, 18 bp, synthetic construct
  source 1..18: mol_type = other DNA
ttataccaatcagtatag

SEQ ID NO: 15997 - DNA, 18 bp, synthetic construct
  source 1..18: mol_type = other DNA
ttataccacccaccatag

SEQ ID NO: 15998 - DNA, 18 bp, synthetic construct
  source 1..18: mol_type = other DNA
ttatacgaatcactgcag

SEQ ID NO: 15999 - DNA, 18 bp, synthetic construct
  source 1..18: mol_type = other DNA
ttatacgacccaccaaag

SEQ ID NO: 16000 - DNA, 18 bp, synthetic construct
  source 1..18: mol_type = other DNA
ttatacgactccttagag

SEQ ID NO: 16001 - DNA, 18 bp, synthetic construct
  source 1..18: mol_type = other DNA
ttatacgactctccctag

SEQ ID NO: 16002 - DNA, 18 bp, synthetic construct
  source 1..18: mol_type = other DNA
ttatacgactgtctataa

SEQ ID NO: 16003 - DNA, 18 bp, synthetic construct
  source 1..18: mol_type = other DNA
ttatacgacttaataaag

SEQ ID NO: 16004 - DNA, 18 bp, synthetic construct
  source 1..18: mol_type = other DNA
ttatacgacttaatatcg

SEQ ID NO: 16005 - DNA, 18 bp, synthetic construct
  source 1..18: mol_type = other DNA
ttatacgagtccttatag

SEQ ID NO: 16006 - DNA, 18 bp, synthetic construct
  source 1..18: mol_type = other DNA
ttatacgattccctgtag

SEQ ID NO: 16007 - DNA, 18 bp, synthetic construct
  source 1..18: mol_type = other DNA
ttatacgcctcacgagag

SEQ ID NO: 16008 - DNA, 18 bp, synthetic construct
  source 1..18: mol_type = other DNA
ttatacgccttactgtag

SEQ ID NO: 16009 - DNA, 18 bp, synthetic construct
  source 1..18: mol_type = other DNA
ttatacgcttcactgtag

SEQ ID NO: 16010 - DNA, 18 bp, synthetic construct
  source 1..18: mol_type = other DNA
ttatacggctccctctag

SEQ ID NO: 16011 - DNA, 18 bp, synthetic construct
  source 1..18: mol_type = other DNA
ttatacgtctcagtctag

SEQ ID NO: 16012 - DNA, 18 bp, synthetic construct
  source 1..18: mol_type = other DNA
ttatacgtttcacgatag

SEQ ID NO: 16013 - DNA, 18 bp, synthetic construct
  source 1..18: mol_type = other DNA
ttataggactcacgaaag

SEQ ID NO: 16014 - DNA, 18 bp, synthetic construct
  source 1..18: mol_type = other DNA
ttataggactcattgtag

SEQ ID NO: 16015 - DNA, 18 bp, synthetic construct
  source 1..18: mol_type = other DNA
ttatatgactcaatagag

SEQ ID NO: 16016 - DNA, 18 bp, synthetic construct
  source 1..18: mol_type = other DNA
ttatatgacttacgatag

SEQ ID NO: 16017 - DNA, 18 bp, synthetic construct
  source 1..18: mol_type = other DNA
ttatattacgcactatag

SEQ ID NO: 16018 - DNA, 18 bp, synthetic construct
  source 1..18: mol_type = other DNA
ttatccaactcactatcg

SEQ ID NO: 16019 - DNA, 18 bp, synthetic construct
  source 1..18: mol_type = other DNA
ttatccgactaaccatag

SEQ ID NO: 16020 - DNA, 18 bp, synthetic construct
  source 1..18: mol_type = other DNA
ttatccgactcactttcg

SEQ ID NO: 16021 - DNA, 18 bp, synthetic construct
  source 1..18: mol_type = other DNA
ttatccgacttactttag

SEQ ID NO: 16022 - DNA, 18 bp, synthetic construct
  source 1..18: mol_type = other DNA
ttatccggctcaatatag

SEQ ID NO: 16023 - DNA, 18 bp, synthetic construct
  source 1..18: mol_type = other DNA
ttatgcgactaacaatag

SEQ ID NO: 16024 - DNA, 18 bp, synthetic construct
  source 1..18: mol_type = other DNA
ttatgcgactcacaatcg

SEQ ID NO: 16025 - DNA, 18 bp, synthetic construct
  source 1..18: mol_type = other DNA
ttatgcgagtcagtatag

SEQ ID NO: 16026 - DNA, 18 bp, synthetic construct
  source 1..18: mol_type = other DNA
ttatgcgcctcactttag

SEQ ID NO: 16027 - DNA, 18 bp, synthetic construct
  source 1..18: mol_type = other DNA
ttccacgacccactatag

SEQ ID NO: 16028 - DNA, 18 bp, synthetic construct
  source 1..18: mol_type = other DNA
ttcgacgactctctatag

SEQ ID NO: 16029 - DNA, 18 bp, synthetic construct
  source 1..18: mol_type = other DNA
ttctacgacacagtatag

SEQ ID NO: 16030 - DNA, 18 bp, synthetic construct
  source 1..18: mol_type = other DNA
ttctacgactgtctatag

SEQ ID NO: 16031 - DNA, 18 bp, synthetic construct
  source 1..18: mol_type = other DNA
ttctgcgtctcactatag

SEQ ID NO: 16032 - DNA, 18 bp, synthetic construct
  source 1..18: mol_type = other DNA
ttgtacgactccttatag

SEQ ID NO: 16033 - DNA, 18 bp, synthetic construct
  source 1..18: mol_type = other DNA
ttgtacgactctatatag

SEQ ID NO: 16034 - DNA, 18 bp, synthetic construct
  source 1..18: mol_type = other DNA
ttgtactactcactacag

SEQ ID NO: 16035 - DNA, 18 bp, synthetic construct
  source 1..18: mol_type = other DNA
ttgtactactgactatag

SEQ ID NO: 16036 - DNA, 18 bp, synthetic construct
  source 1..18: mol_type = other DNA
ttttacgactcaagatag

SEQ ID NO: 16037 - DNA, 18 bp, synthetic construct
  source 1..18: mol_type = other DNA
ttttgcgactcactacag

SEQ ID NO: 16038 - DNA, 18 bp, synthetic construct
  source 1..18: mol_type = other DNA
taattcaactcacttttg

SEQ ID NO: 16039 - DNA, 18 bp, synthetic construct
  source 1..18: mol_type = other DNA
ttttaagactcactaaag

SEQ ID NO: 16040 - DNA, 18 bp, synthetic construct
  source 1..18: mol_type = other DNA
aaatgcgactcactaatg

SEQ ID NO: 16041 - DNA, 18 bp, synthetic construct
  source 1..18: mol_type = other DNA
taatacgcctaacaaaag

SEQ ID NO: 16042 - DNA, 18 bp, synthetic construct
  source 1..18: mol_type = other DNA
taatatttctcacaatag

SEQ ID NO: 16043 - DNA, 18 bp, synthetic construct
  source 1..18: mol_type = other DNA
tagtacgactcacattcg

SEQ ID NO: 16044 - DNA, 18 bp, synthetic construct
  source 1..18: mol_type = other DNA
taattcgcctcattttag

SEQ ID NO: 16045 - DNA, 18 bp, synthetic construct
  source 1..18: mol_type = other DNA
ttatacgactatctattg

SEQ ID NO: 16046 - DNA, 18 bp, synthetic construct
  source 1..18: mol_type = other DNA
tattgcgcctcactttag

SEQ ID NO: 16047 - DNA, 18 bp, synthetic construct
  source 1..18: mol_type = other DNA
tgattagactcactattg

SEQ ID NO: 16048 - DNA, 18 bp, synthetic construct
  source 1..18: mol_type = other DNA
aaataggactcgctaaag

SEQ ID NO: 16049 - DNA, 18 bp, synthetic construct
  source 1..18: mol_type = other DNA
ctaatcgactcactatag

SEQ ID NO: 16050 - DNA, 18 bp, synthetic construct
  source 1..18: mol_type = other DNA
aattacgactcagaatag

SEQ ID NO: 16051 - DNA, 18 bp, synthetic construct
  source 1..18: mol_type = other DNA
agatagaactcactatag

SEQ ID NO: 16052 - DNA, 18 bp, synthetic construct
  source 1..18: mol_type = other DNA
tattgcgactcacttaag

SEQ ID NO: 16053 - DNA, 18 bp, synthetic construct
  source 1..18: mol_type = other DNA
ttattggactcactttag

SEQ ID NO: 16054 - DNA, 18 bp, synthetic construct
  source 1..18: mol_type = other DNA
taatacaactcactcatg

SEQ ID NO: 16055 - DNA, 18 bp, synthetic construct
  source 1..18: mol_type = other DNA
tattacgactccgtttag

SEQ ID NO: 16056 - DNA, 18 bp, synthetic construct
  source 1..18: mol_type = other DNA
ttatacaactcagtctag

SEQ ID NO: 16057 - DNA, 18 bp, synthetic construct
  source 1..18: mol_type = other DNA
ttatacgtctcactcaag

SEQ ID NO: 16058 - DNA, 18 bp, synthetic construct
  source 1..18: mol_type = other DNA
ttatagaactcactattg

SEQ ID NO: 16059 - DNA, 18 bp, synthetic construct
  source 1..18: mol_type = other DNA
ttattagacgcactatag

SEQ ID NO: 16060 - DNA, 18 bp, synthetic construct
  source 1..18: mol_type = other DNA
aaataggactcactcaag

SEQ ID NO: 16061 - DNA, 18 bp, synthetic construct
  source 1..18: mol_type = other DNA
ctttacgactcactaaag

SEQ ID NO: 16062 - DNA, 18 bp, synthetic construct
  source 1..18: mol_type = other DNA
ttaaacgactcacactag

SEQ ID NO: 16063 - DNA, 18 bp, synthetic construct
  source 1..18: mol_type = other DNA
ttatacgactcacataag

SEQ ID NO: 16064 - DNA, 18 bp, synthetic construct
  source 1..18: mol_type = other DNA
taattcgactagctacag

SEQ ID NO: 16065 - DNA, 18 bp, synthetic construct
  source 1..18: mol_type = other DNA
atatacgactcgctatgg

SEQ ID NO: 16066 - DNA, 18 bp, synthetic construct
  source 1..18: mol_type = other DNA
taaaacggctcgctttag

SEQ ID NO: 16067 - DNA, 18 bp, synthetic construct
  source 1..18: mol_type = other DNA
taaatcgagtcactaaag

SEQ ID NO: 16068 - DNA, 18 bp, synthetic construct
  source 1..18: mol_type = other DNA
taatacaacacgctacag

SEQ ID NO: 16069 - DNA, 18 bp, synthetic construct
  source 1..18: mol_type = other DNA
taatacgacactctagtg

SEQ ID NO: 16070 - DNA, 18 bp, synthetic construct
  source 1..18: mol_type = other DNA
tcaatcgcctcactatag

SEQ ID NO: 16071 - DNA, 18 bp, synthetic construct
  source 1..18: mol_type = other DNA
tgatacgacttagtattg

SEQ ID NO: 16072 - DNA, 18 bp, synthetic construct
  source 1..18: mol_type = other DNA
ttattcgactcacttgag

SEQ ID NO: 16073 - DNA, 18 bp, synthetic construct
  source 1..18: mol_type = other DNA
ttattcgactcagaatag

SEQ ID NO: 16074 - DNA, 18 bp, synthetic construct
  source 1..18: mol_type = other DNA
aaatgcgccttactatag

SEQ ID NO: 16075 - DNA, 18 bp, synthetic construct
  source 1..18: mol_type = other DNA
agataccaatcactatag

SEQ ID NO: 16076 - DNA, 18 bp, synthetic construct
  source 1..18: mol_type = other DNA
taaaacgactcagttaag

SEQ ID NO: 16077 - DNA, 18 bp, synthetic construct
  source 1..18: mol_type = other DNA
taacacgtctcactctcg

SEQ ID NO: 16078 - DNA, 18 bp, synthetic construct
  source 1..18: mol_type = other DNA
taatacgtctcacaccag

SEQ ID NO: 16079 - DNA, 18 bp, synthetic construct
  source 1..18: mol_type = other DNA
tagtacggctcaatatgg

SEQ ID NO: 16080 - DNA, 18 bp, synthetic construct
  source 1..18: mol_type = other DNA
tcaaacgactcattaaag

SEQ ID NO: 16081 - DNA, 18 bp, synthetic construct
  source 1..18: mol_type = other DNA
tcctacgaatcactttag

SEQ ID NO: 16082 - DNA, 18 bp, synthetic construct
  source 1..18: mol_type = other DNA
tgatacttctcaatatag

SEQ ID NO: 16083 - DNA, 18 bp, synthetic construct
  source 1..18: mol_type = other DNA
tgttacgactcactcaag

SEQ ID NO: 16084 - DNA, 18 bp, synthetic construct
  source 1..18: mol_type = other DNA
ttaaccgactcactttag

SEQ ID NO: 16085 - DNA, 18 bp, synthetic construct
  source 1..18: mol_type = other DNA
ttatactcctcactacag

SEQ ID NO: 16086 - DNA, 18 bp, synthetic construct
  source 1..18: mol_type = other DNA
ttatccgattcactaaag

SEQ ID NO: 16087 - DNA, 18 bp, synthetic construct
  source 1..18: mol_type = other DNA
ttatgcgactccctacag

SEQ ID NO: 16088 - DNA, 18 bp, synthetic construct
  source 1..18: mol_type = other DNA
caatacgactcagttttg

SEQ ID NO: 16089 - DNA, 18 bp, synthetic construct
  source 1..18: mol_type = other DNA
ttattcggctcactaaag

SEQ ID NO: 16090 - DNA, 18 bp, synthetic construct
  source 1..18: mol_type = other DNA
ttttacggctcactattg

SEQ ID NO: 16091 - DNA, 18 bp, synthetic construct
  source 1..18: mol_type = other DNA
gaattcgactcactccag

SEQ ID NO: 16092 - DNA, 18 bp, synthetic construct
  source 1..18: mol_type = other DNA
taatgagactcactcttg

SEQ ID NO: 16093 - DNA, 18 bp, synthetic construct
  source 1..18: mol_type = other DNA
ctatacaactcactaaag

SEQ ID NO: 16094 - DNA, 18 bp, synthetic construct
  source 1..18: mol_type = other DNA
taatcagactcacttcag

SEQ ID NO: 16095 - DNA, 18 bp, synthetic construct
  source 1..18: mol_type = other DNA
tattacgactctcttcag

SEQ ID NO: 16096 - DNA, 18 bp, synthetic construct
  source 1..18: mol_type = other DNA
taattcgactcagattag

SEQ ID NO: 16097 - DNA, 18 bp, synthetic construct
  source 1..18: mol_type = other DNA
ttatgtgtctcactatag

SEQ ID NO: 16098 - DNA, 18 bp, synthetic construct
  source 1..18: mol_type = other DNA
aattaagactcactttag

SEQ ID NO: 16099 - DNA, 18 bp, synthetic construct
  source 1..18: mol_type = other DNA
taattcgagtcgctattg

SEQ ID NO: 16100 - DNA, 18 bp, synthetic construct
  source 1..18: mol_type = other DNA
aaatacgactcgctactg

SEQ ID NO: 16101 - DNA, 18 bp, synthetic construct
  source 1..18: mol_type = other DNA
caatacgacgcgctattg

SEQ ID NO: 16102 - DNA, 18 bp, synthetic construct
  source 1..18: mol_type = other DNA
taatacgaaccgctattg

SEQ ID NO: 16103 - DNA, 18 bp, synthetic construct
  source 1..18: mol_type = other DNA
taatacgactcgctgctg

SEQ ID NO: 16104 - DNA, 18 bp, synthetic construct
  source 1..18: mol_type = other DNA
taattcgtctcacgattg

SEQ ID NO: 16105 - DNA, 18 bp, synthetic construct
  source 1..18: mol_type = other DNA
aaatgcgactcaatattg

SEQ ID NO: 16106 - DNA, 18 bp, synthetic construct
  source 1..18: mol_type = other DNA
caaaacgactcactaatg

SEQ ID NO: 16107 - DNA, 18 bp, synthetic construct
  source 1..18: mol_type = other DNA
cagtccgactcgctatag

SEQ ID NO: 16108 - DNA, 18 bp, synthetic construct
  source 1..18: mol_type = other DNA
gacttcgactcactttag

SEQ ID NO: 16109 - DNA, 18 bp, synthetic construct
  source 1..18: mol_type = other DNA
ggatacgactcacaattg

SEQ ID NO: 16110 - DNA, 18 bp, synthetic construct
  source 1..18: mol_type = other DNA
ggatacgactcgctatcg

SEQ ID NO: 16111 - DNA, 18 bp, synthetic construct
  source 1..18: mol_type = other DNA
taaatcgactcagtttag

SEQ ID NO: 16112 - DNA, 18 bp, synthetic construct
  source 1..18: mol_type = other DNA
taacacaactcgttatag

SEQ ID NO: 16113 - DNA, 18 bp, synthetic construct
  source 1..18: mol_type = other DNA
taactcgacacaccatag

SEQ ID NO: 16114 - DNA, 18 bp, synthetic construct
  source 1..18: mol_type = other DNA
taatacaacacgctctag

SEQ ID NO: 16115 - DNA, 18 bp, synthetic construct
  source 1..18: mol_type = other DNA
taatacgaccctctcttg

SEQ ID NO: 16116 - DNA, 18 bp, synthetic construct
  source 1..18: mol_type = other DNA
taatacgtatcgatatag

SEQ ID NO: 16117 - DNA, 18 bp, synthetic construct
  source 1..18: mol_type = other DNA
taatacgtatcgctatcg

SEQ ID NO: 16118 - DNA, 18 bp, synthetic construct
  source 1..18: mol_type = other DNA
taatactatttactattg

SEQ ID NO: 16119 - DNA, 18 bp, synthetic construct
  source 1..18: mol_type = other DNA
taatagcactcactaatg

SEQ ID NO: 16120 - DNA, 18 bp, synthetic construct
  source 1..18: mol_type = other DNA
taataggacacacttttg

SEQ ID NO: 16121 - DNA, 18 bp, synthetic construct
  source 1..18: mol_type = other DNA
taatatgactcgatttag

SEQ ID NO: 16122 - DNA, 18 bp, synthetic construct
  source 1..18: mol_type = other DNA
taatatgactcgctacgg

SEQ ID NO: 16123 - DNA, 18 bp, synthetic construct
  source 1..18: mol_type = other DNA
taattagactcacgaaag

SEQ ID NO: 16124 - DNA, 18 bp, synthetic construct
  source 1..18: mol_type = other DNA
taattcgaaacactctag

SEQ ID NO: 16125 - DNA, 18 bp, synthetic construct
  source 1..18: mol_type = other DNA
taattcgactcattttcg

SEQ ID NO: 16126 - DNA, 18 bp, synthetic construct
  source 1..18: mol_type = other DNA
taattcgactcccttaag

SEQ ID NO: 16127 - DNA, 18 bp, synthetic construct
  source 1..18: mol_type = other DNA
taattcggctcaacatag

SEQ ID NO: 16128 - DNA, 18 bp, synthetic construct
  source 1..18: mol_type = other DNA
tactacgacttacaattg

SEQ ID NO: 16129 - DNA, 18 bp, synthetic construct
  source 1..18: mol_type = other DNA
tactccgactcacaattg

SEQ ID NO: 16130 - DNA, 18 bp, synthetic construct
  source 1..18: mol_type = other DNA
tagtacgtctcactcttg

SEQ ID NO: 16131 - DNA, 18 bp, synthetic construct
  source 1..18: mol_type = other DNA
tattacgtctcgcgatag

SEQ ID NO: 16132 - DNA, 18 bp, synthetic construct
  source 1..18: mol_type = other DNA
tcatgcgactggctatag

SEQ ID NO: 16133 - DNA, 18 bp, synthetic construct
  source 1..18: mol_type = other DNA
ttatacgactcacagttg

SEQ ID NO: 16134 - DNA, 18 bp, synthetic construct
  source 1..18: mol_type = other DNA
aaatatgacaccctatag

SEQ ID NO: 16135 - DNA, 18 bp, synthetic construct
  source 1..18: mol_type = other DNA
aaatccgaatcactgtag

SEQ ID NO: 16136 - DNA, 18 bp, synthetic construct
  source 1..18: mol_type = other DNA
aagtccgacgcactatag

SEQ ID NO: 16137 - DNA, 18 bp, synthetic construct
  source 1..18: mol_type = other DNA
acatacaactcaccatag

SEQ ID NO: 16138 - DNA, 18 bp, synthetic construct
  source 1..18: mol_type = other DNA
caataagactcactccag

SEQ ID NO: 16139 - DNA, 18 bp, synthetic construct
  source 1..18: mol_type = other DNA
caataagactcacttaag

SEQ ID NO: 16140 - DNA, 18 bp, synthetic construct
  source 1..18: mol_type = other DNA
caatacggttcactttag

SEQ ID NO: 16141 - DNA, 18 bp, synthetic construct
  source 1..18: mol_type = other DNA
caatacgtttcactgtag

SEQ ID NO: 16142 - DNA, 18 bp, synthetic construct
  source 1..18: mol_type = other DNA
cactacgactctcaatag

SEQ ID NO: 16143 - DNA, 18 bp, synthetic construct
  source 1..18: mol_type = other DNA
cattacaactgactatag

SEQ ID NO: 16144 - DNA, 18 bp, synthetic construct
  source 1..18: mol_type = other DNA
cattacggcttactatag

SEQ ID NO: 16145 - DNA, 18 bp, synthetic construct
  source 1..18: mol_type = other DNA
ctatccgactccctatag

SEQ ID NO: 16146 - DNA, 18 bp, synthetic construct
  source 1..18: mol_type = other DNA
gaatacgactcaaattag

SEQ ID NO: 16147 - DNA, 18 bp, synthetic construct
  source 1..18: mol_type = other DNA
gaatacgtatcactttag

SEQ ID NO: 16148 - DNA, 18 bp, synthetic construct
  source 1..18: mol_type = other DNA
gtatgcgactcactgtag

SEQ ID NO: 16149 - DNA, 18 bp, synthetic construct
  source 1..18: mol_type = other DNA
taaaacgatttactttag

SEQ ID NO: 16150 - DNA, 18 bp, synthetic construct
  source 1..18: mol_type = other DNA
taacaagtctcattatag

SEQ ID NO: 16151 - DNA, 18 bp, synthetic construct
  source 1..18: mol_type = other DNA
taacaccacgcactttag

SEQ ID NO: 16152 - DNA, 18 bp, synthetic construct
  source 1..18: mol_type = other DNA
taacacgactctttacag

SEQ ID NO: 16153 - DNA, 18 bp, synthetic construct
  source 1..18: mol_type = other DNA
taacgcgacttattatag

SEQ ID NO: 16154 - DNA, 18 bp, synthetic construct
  source 1..18: mol_type = other DNA
taagacaactaacaatag

SEQ ID NO: 16155 - DNA, 18 bp, synthetic construct
  source 1..18: mol_type = other DNA
taataagactcagttgag

SEQ ID NO: 16156 - DNA, 18 bp, synthetic construct
  source 1..18: mol_type = other DNA
taataagactgactgaag

SEQ ID NO: 16157 - DNA, 18 bp, synthetic construct
  source 1..18: mol_type = other DNA
taataagagttacaatag

SEQ ID NO: 16158 - DNA, 18 bp, synthetic construct
  source 1..18: mol_type = other DNA
taatacaattcagtatcg

SEQ ID NO: 16159 - DNA, 18 bp, synthetic construct
  source 1..18: mol_type = other DNA
taatacacaacactatag

SEQ ID NO: 16160 - DNA, 18 bp, synthetic construct
  source 1..18: mol_type = other DNA
taatacacttcactttag

SEQ ID NO: 16161 - DNA, 18 bp, synthetic construct
  source 1..18: mol_type = other DNA
taataccactcaaagtag

SEQ ID NO: 16162 - DNA, 18 bp, synthetic construct
  source 1..18: mol_type = other DNA
taataccattatctatag

SEQ ID NO: 16163 - DNA, 18 bp, synthetic construct
  source 1..18: mol_type = other DNA
taatacgacacccaagag

SEQ ID NO: 16164 - DNA, 18 bp, synthetic construct
  source 1..18: mol_type = other DNA
taatacgacagacaacag

SEQ ID NO: 16165 - DNA, 18 bp, synthetic construct
  source 1..18: mol_type = other DNA
taatacgtcacattatgg

SEQ ID NO: 16166 - DNA, 18 bp, synthetic construct
  source 1..18: mol_type = other DNA
taatacgtctgaccacag

SEQ ID NO: 16167 - DNA, 18 bp, synthetic construct
  source 1..18: mol_type = other DNA
taatactactcacaaacg

SEQ ID NO: 16168 - DNA, 18 bp, synthetic construct
  source 1..18: mol_type = other DNA
taatatgactcattaacg

SEQ ID NO: 16169 - DNA, 18 bp, synthetic construct
  source 1..18: mol_type = other DNA
taatatgactcccattag

SEQ ID NO: 16170 - DNA, 18 bp, synthetic construct
  source 1..18: mol_type = other DNA
taatatgactgaatatcg

SEQ ID NO: 16171 - DNA, 18 bp, synthetic construct
  source 1..18: mol_type = other DNA
taatccaagtcaccatag

SEQ ID NO: 16172 - DNA, 18 bp, synthetic construct
  source 1..18: mol_type = other DNA
taatcccactcccaatag

SEQ ID NO: 16173 - DNA, 18 bp, synthetic construct
  source 1..18: mol_type = other DNA
taatccgaatcaccttag

SEQ ID NO: 16174 - DNA, 18 bp, synthetic construct
  source 1..18: mol_type = other DNA
taatccgactcatagtag

SEQ ID NO: 16175 - DNA, 18 bp, synthetic construct
  source 1..18: mol_type = other DNA
taatccgactctacatag

SEQ ID NO: 16176 - DNA, 18 bp, synthetic construct
  source 1..18: mol_type = other DNA
taatccgacttactttgg

SEQ ID NO: 16177 - DNA, 18 bp, synthetic construct
  source 1..18: mol_type = other DNA
taatccgattcacattag

SEQ ID NO: 16178 - DNA, 18 bp, synthetic construct
  source 1..18: mol_type = other DNA
taatctaactcactacag

SEQ ID NO: 16179 - DNA, 18 bp, synthetic construct
  source 1..18: mol_type = other DNA
taatctgattcacaatag

SEQ ID NO: 16180 - DNA, 18 bp, synthetic construct
  source 1..18: mol_type = other DNA
taatgcgtctcactttcg

SEQ ID NO: 16181 - DNA, 18 bp, synthetic construct
  source 1..18: mol_type = other DNA
tacaacgcctcactctag

SEQ ID NO: 16182 - DNA, 18 bp, synthetic construct
  source 1..18: mol_type = other DNA
tactactacccactttag

SEQ ID NO: 16183 - DNA, 18 bp, synthetic construct
  source 1..18: mol_type = other DNA
tactaggtttcactatag

SEQ ID NO: 16184 - DNA, 18 bp, synthetic construct
  source 1..18: mol_type = other DNA
tactgcgactcataatag

SEQ ID NO: 16185 - DNA, 18 bp, synthetic construct
  source 1..18: mol_type = other DNA
tagtacgacatactatcg

SEQ ID NO: 16186 - DNA, 18 bp, synthetic construct
  source 1..18: mol_type = other DNA
tagtacggctcaatacag

SEQ ID NO: 16187 - DNA, 18 bp, synthetic construct
  source 1..18: mol_type = other DNA
tagtactattcattatag

SEQ ID NO: 16188 - DNA, 18 bp, synthetic construct
  source 1..18: mol_type = other DNA
tagtaggacttactaaag

SEQ ID NO: 16189 - DNA, 18 bp, synthetic construct
  source 1..18: mol_type = other DNA
tatcacgacacactctag

SEQ ID NO: 16190 - DNA, 18 bp, synthetic construct
  source 1..18: mol_type = other DNA
tattacgattcacaatcg

SEQ ID NO: 16191 - DNA, 18 bp, synthetic construct
  source 1..18: mol_type = other DNA
tattactactcaccatcg

SEQ ID NO: 16192 - DNA, 18 bp, synthetic construct
  source 1..18: mol_type = other DNA
tattactgcccactatag

SEQ ID NO: 16193 - DNA, 18 bp, synthetic construct
  source 1..18: mol_type = other DNA
tattaggactctctaaag

SEQ ID NO: 16194 - DNA, 18 bp, synthetic construct
  source 1..18: mol_type = other DNA
tattccgactcacaaaag

SEQ ID NO: 16195 - DNA, 18 bp, synthetic construct
  source 1..18: mol_type = other DNA
tcataagacaccctatag

SEQ ID NO: 16196 - DNA, 18 bp, synthetic construct
  source 1..18: mol_type = other DNA
tcatacctctcaatatag

SEQ ID NO: 16197 - DNA, 18 bp, synthetic construct
  source 1..18: mol_type = other DNA
tcatacgaatgtctatag

SEQ ID NO: 16198 - DNA, 18 bp, synthetic construct
  source 1..18: mol_type = other DNA
tcatacgactaaatacag

SEQ ID NO: 16199 - DNA, 18 bp, synthetic construct
  source 1..18: mol_type = other DNA
tcatgcgtctctctatag

SEQ ID NO: 16200 - DNA, 18 bp, synthetic construct
  source 1..18: mol_type = other DNA
tcctatgactcactttag

SEQ ID NO: 16201 - DNA, 18 bp, synthetic construct
  source 1..18: mol_type = other DNA
tgatacaacaccctatag

SEQ ID NO: 16202 - DNA, 18 bp, synthetic construct
  source 1..18: mol_type = other DNA
tgatacgactcacttagg

SEQ ID NO: 16203 - DNA, 18 bp, synthetic construct
  source 1..18: mol_type = other DNA
tgatacgtatcactctag

SEQ ID NO: 16204 - DNA, 18 bp, synthetic construct
  source 1..18: mol_type = other DNA
tgatccgacttactgtag

SEQ ID NO: 16205 - DNA, 18 bp, synthetic construct
  source 1..18: mol_type = other DNA
tgctacgactctctgtag

SEQ ID NO: 16206 - DNA, 18 bp, synthetic construct
  source 1..18: mol_type = other DNA
tggtccgactcattatag

SEQ ID NO: 16207 - DNA, 18 bp, synthetic construct
  source 1..18: mol_type = other DNA
ttaaccgagtcactatag

SEQ ID NO: 16208 - DNA, 18 bp, synthetic construct
  source 1..18: mol_type = other DNA
ttacacgattcaccatag

SEQ ID NO: 16209 - DNA, 18 bp, synthetic construct
  source 1..18: mol_type = other DNA
ttataataatcactatag

SEQ ID NO: 16210 - DNA, 18 bp, synthetic construct
  source 1..18: mol_type = other DNA
ttataatactcacaatag

SEQ ID NO: 16211 - DNA, 18 bp, synthetic construct
  source 1..18: mol_type = other DNA
ttataccactaactagag

SEQ ID NO: 16212 - DNA, 18 bp, synthetic construct
  source 1..18: mol_type = other DNA
ttataggactcagtttag

SEQ ID NO: 16213 - DNA, 18 bp, synthetic construct
  source 1..18: mol_type = other DNA
ttatgctactcactacag

SEQ ID NO: 16214 - DNA, 18 bp, synthetic construct
  source 1..18: mol_type = other DNA
ttatgctactcactgtag

SEQ ID NO: 16215 - DNA, 18 bp, synthetic construct
  source 1..18: mol_type = other DNA
ttgtacgacgccctatag

SEQ ID NO: 16216 - DNA, 18 bp, synthetic construct
  source 1..18: mol_type = other DNA
ttttacgactccgtatag

SEQ ID NO: 16217 - DNA, 18 bp, synthetic construct
  source 1..18: mol_type = other DNA
taaaacaactcactactg

SEQ ID NO: 16218 - DNA, 18 bp, synthetic construct
  source 1..18: mol_type = other DNA
ttaatcgactcaccatag

SEQ ID NO: 16219 - DNA, 18 bp, synthetic construct
  source 1..18: mol_type = other DNA
ttaatcgactcactatcg

SEQ ID NO: 16220 - DNA, 18 bp, synthetic construct
  source 1..18: mol_type = other DNA
taattcgactcactgatg

SEQ ID NO: 16221 - DNA, 18 bp, synthetic construct
  source 1..18: mol_type = other DNA
tttttcaactcactatag

SEQ ID NO: 16222 - DNA, 18 bp, synthetic construct
  source 1..18: mol_type = other DNA
tattacaactcagtttag

SEQ ID NO: 16223 - DNA, 18 bp, synthetic construct
  source 1..18: mol_type = other DNA
ttatgggactcactaaag

SEQ ID NO: 16224 - DNA, 18 bp, synthetic construct
  source 1..18: mol_type = other DNA
caataggactcactaatg

SEQ ID NO: 16225 - DNA, 18 bp, synthetic construct
  source 1..18: mol_type = other DNA
tatttcgtctcgctatag

SEQ ID NO: 16226 - DNA, 18 bp, synthetic construct
  source 1..18: mol_type = other DNA
tattgcgtctcactattg

SEQ ID NO: 16227 - DNA, 18 bp, synthetic construct
  source 1..18: mol_type = other DNA
tattacgtctcgctattg

SEQ ID NO: 16228 - DNA, 18 bp, synthetic construct
  source 1..18: mol_type = other DNA
aaatgcgactcgctatcg

SEQ ID NO: 16229 - DNA, 18 bp, synthetic construct
  source 1..18: mol_type = other DNA
taacacgtctcactactg

SEQ ID NO: 16230 - DNA, 18 bp, synthetic construct
  source 1..18: mol_type = other DNA
taatacgattcgcttaag

SEQ ID NO: 16231 - DNA, 18 bp, synthetic construct
  source 1..18: mol_type = other DNA
taatatggctgactattg

SEQ ID NO: 16232 - DNA, 18 bp, synthetic construct
  source 1..18: mol_type = other DNA
tactacgtctcgctaaag

SEQ ID NO: 16233 - DNA, 18 bp, synthetic construct
  source 1..18: mol_type = other DNA
tgatactactcacttttg

SEQ ID NO: 16234 - DNA, 18 bp, synthetic construct
  source 1..18: mol_type = other DNA
ttctacgtctcactattg

SEQ ID NO: 16235 - DNA, 18 bp, synthetic construct
  source 1..18: mol_type = other DNA
aaaaacgtctcaccatag

SEQ ID NO: 16236 - DNA, 18 bp, synthetic construct
  source 1..18: mol_type = other DNA
caatacgactaagtaaag

SEQ ID NO: 16237 - DNA, 18 bp, synthetic construct
  source 1..18: mol_type = other DNA
cataacgacgcactatag

SEQ ID NO: 16238 - DNA, 18 bp, synthetic construct
  source 1..18: mol_type = other DNA
gaataggactcactttgg

SEQ ID NO: 16239 - DNA, 18 bp, synthetic construct
  source 1..18: mol_type = other DNA
taaaacgcctcagtaaag

SEQ ID NO: 16240 - DNA, 18 bp, synthetic construct
  source 1..18: mol_type = other DNA
taacacggcccaccatag

SEQ ID NO: 16241 - DNA, 18 bp, synthetic construct
  source 1..18: mol_type = other DNA
taatacgtcccacaaaag

SEQ ID NO: 16242 - DNA, 18 bp, synthetic construct
  source 1..18: mol_type = other DNA
taatacgtgacactatcg

SEQ ID NO: 16243 - DNA, 18 bp, synthetic construct
  source 1..18: mol_type = other DNA
taataggtttcactttag

SEQ ID NO: 16244 - DNA, 18 bp, synthetic construct
  source 1..18: mol_type = other DNA
tatcacgtctcactaaag

SEQ ID NO: 16245 - DNA, 18 bp, synthetic construct
  source 1..18: mol_type = other DNA
tattaaaactcattatag

SEQ ID NO: 16246 - DNA, 18 bp, synthetic construct
  source 1..18: mol_type = other DNA
tattacgactccatagag

SEQ ID NO: 16247 - DNA, 18 bp, synthetic construct
  source 1..18: mol_type = other DNA
tcaaacaactcactgtag

SEQ ID NO: 16248 - DNA, 18 bp, synthetic construct
  source 1..18: mol_type = other DNA
tcgtacgaaacactatag

SEQ ID NO: 16249 - DNA, 18 bp, synthetic construct
  source 1..18: mol_type = other DNA
ttaagcaactcactatag

SEQ ID NO: 16250 - DNA, 18 bp, synthetic construct
  source 1..18: mol_type = other DNA
ttatgcgaatcactaaag

SEQ ID NO: 16251 - DNA, 18 bp, synthetic construct
  source 1..18: mol_type = other DNA
ttatgtgactcactaaag

SEQ ID NO: 16252 - DNA, 18 bp, synthetic construct
  source 1..18: mol_type = other DNA
tattgcgactcactgcag

SEQ ID NO: 16253 - DNA, 18 bp, synthetic construct
  source 1..18: mol_type = other DNA
caatacaactcactcttg

SEQ ID NO: 16254 - DNA, 18 bp, synthetic construct
  source 1..18: mol_type = other DNA
agatacgtctcactaaag

SEQ ID NO: 16255 - DNA, 18 bp, synthetic construct
  source 1..18: mol_type = other DNA
taatagtgcacactatag

SEQ ID NO: 16256 - DNA, 18 bp, synthetic construct
  source 1..18: mol_type = other DNA
tattgggactcactaaag

SEQ ID NO: 16257 - DNA, 18 bp, synthetic construct
  source 1..18: mol_type = other DNA
taaaacgactcgcttaag

SEQ ID NO: 16258 - DNA, 18 bp, synthetic construct
  source 1..18: mol_type = other DNA
taatacgattcataattg

SEQ ID NO: 16259 - DNA, 18 bp, synthetic construct
  source 1..18: mol_type = other DNA
tttttcgactcactttag

SEQ ID NO: 16260 - DNA, 18 bp, synthetic construct
  source 1..18: mol_type = other DNA
caatgcgacgcaccatag

SEQ ID NO: 16261 - DNA, 18 bp, synthetic construct
  source 1..18: mol_type = other DNA
ttaatggactcactatag

SEQ ID NO: 16262 - DNA, 18 bp, synthetic construct
  source 1..18: mol_type = other DNA
ttattcgactctctttag

SEQ ID NO: 16263 - DNA, 18 bp, synthetic construct
  source 1..18: mol_type = other DNA
taatacgactcgcaactg

SEQ ID NO: 16264 - DNA, 18 bp, synthetic construct
  source 1..18: mol_type = other DNA
tcaatcgtctcactatag

SEQ ID NO: 16265 - DNA, 18 bp, synthetic construct
  source 1..18: mol_type = other DNA
ttttacgactcgctttag

SEQ ID NO: 16266 - DNA, 18 bp, synthetic construct
  source 1..18: mol_type = other DNA
atatacgcctcactaaag

SEQ ID NO: 16267 - DNA, 18 bp, synthetic construct
  source 1..18: mol_type = other DNA
ttaaacgactcactgaag

SEQ ID NO: 16268 - DNA, 18 bp, synthetic construct
  source 1..18: mol_type = other DNA
tatttcgactcgctattg

SEQ ID NO: 16269 - DNA, 18 bp, synthetic construct
  source 1..18: mol_type = other DNA
aaatacgactcgatattg

SEQ ID NO: 16270 - DNA, 18 bp, synthetic construct
  source 1..18: mol_type = other DNA
caaaacgactcgctattg

SEQ ID NO: 16271 - DNA, 18 bp, synthetic construct
  source 1..18: mol_type = other DNA
caattagactcgctatag

SEQ ID NO: 16272 - DNA, 18 bp, synthetic construct
  source 1..18: mol_type = other DNA
caattcgactcaatattg

SEQ ID NO: 16273 - DNA, 18 bp, synthetic construct
  source 1..18: mol_type = other DNA
taaatctactcgctatag

SEQ ID NO: 16274 - DNA, 18 bp, synthetic construct
  source 1..18: mol_type = other DNA
taatacgcctcgcttttg

SEQ ID NO: 16275 - DNA, 18 bp, synthetic construct
  source 1..18: mol_type = other DNA
taattcaactcgctaaag

SEQ ID NO: 16276 - DNA, 18 bp, synthetic construct
  source 1..18: mol_type = other DNA
taattccactcactcttg

SEQ ID NO: 16277 - DNA, 18 bp, synthetic construct
  source 1..18: mol_type = other DNA
taattcgaagcactattg

SEQ ID NO: 16278 - DNA, 18 bp, synthetic construct
  source 1..18: mol_type = other DNA
taattcgaatcgatatag

SEQ ID NO: 16279 - DNA, 18 bp, synthetic construct
  source 1..18: mol_type = other DNA
taattcgactcgatttag

SEQ ID NO: 16280 - DNA, 18 bp, synthetic construct
  source 1..18: mol_type = other DNA
taattcgactcgcactag

SEQ ID NO: 16281 - DNA, 18 bp, synthetic construct
  source 1..18: mol_type = other DNA
taattcgagtcgctctag

SEQ ID NO: 16282 - DNA, 18 bp, synthetic construct
  source 1..18: mol_type = other DNA
taattgggctcactattg

SEQ ID NO: 16283 - DNA, 18 bp, synthetic construct
  source 1..18: mol_type = other DNA
tagtacgactagctattg

SEQ ID NO: 16284 - DNA, 18 bp, synthetic construct
  source 1..18: mol_type = other DNA
tagtacgactcgcttttg

SEQ ID NO: 16285 - DNA, 18 bp, synthetic construct
  source 1..18: mol_type = other DNA
tagttcgactctctattg

SEQ ID NO: 16286 - DNA, 18 bp, synthetic construct
  source 1..18: mol_type = other DNA
tataacgactcgctattg

SEQ ID NO: 16287 - DNA, 18 bp, synthetic construct
  source 1..18: mol_type = other DNA
tattacaactcgctattg

SEQ ID NO: 16288 - DNA, 18 bp, synthetic construct
  source 1..18: mol_type = other DNA
tcattcgactgactattg

SEQ ID NO: 16289 - DNA, 18 bp, synthetic construct
  source 1..18: mol_type = other DNA
tcttacgactcgctattg

SEQ ID NO: 16290 - DNA, 18 bp, synthetic construct
  source 1..18: mol_type = other DNA
tgatacgacacgctattg

SEQ ID NO: 16291 - DNA, 18 bp, synthetic construct
  source 1..18: mol_type = other DNA
ttatacgactcgcaattg

SEQ ID NO: 16292 - DNA, 18 bp, synthetic construct
  source 1..18: mol_type = other DNA
ttatacgactcgctaatg

SEQ ID NO: 16293 - DNA, 18 bp, synthetic construct
  source 1..18: mol_type = other DNA
aaaatcgacgcactatag

SEQ ID NO: 16294 - DNA, 18 bp, synthetic construct
  source 1..18: mol_type = other DNA
aaactcgagtcactatag

SEQ ID NO: 16295 - DNA, 18 bp, synthetic construct
  source 1..18: mol_type = other DNA
aaatatgactcaccattg

SEQ ID NO: 16296 - DNA, 18 bp, synthetic construct
  source 1..18: mol_type = other DNA
aaatccgactcgctatcg

SEQ ID NO: 16297 - DNA, 18 bp, synthetic construct
  source 1..18: mol_type = other DNA
aaatccgagtcactattg

SEQ ID NO: 16298 - DNA, 18 bp, synthetic construct
  source 1..18: mol_type = other DNA
aaatgcgattcgctatag

SEQ ID NO: 16299 - DNA, 18 bp, synthetic construct
  source 1..18: mol_type = other DNA
aaattcgactcaccgtag

SEQ ID NO: 16300 - DNA, 18 bp, synthetic construct
  source 1..18: mol_type = other DNA
aaattcgactcactgcag

SEQ ID NO: 16301 - DNA, 18 bp, synthetic construct
  source 1..18: mol_type = other DNA
aactacgacttactattg

SEQ ID NO: 16302 - DNA, 18 bp, synthetic construct
  source 1..18: mol_type = other DNA
acatacgactcgttatag

SEQ ID NO: 16303 - DNA, 18 bp, synthetic construct
  source 1..18: mol_type = other DNA
atatacgactcgctataa

SEQ ID NO: 16304 - DNA, 18 bp, synthetic construct
  source 1..18: mol_type = other DNA
caaaacgacacactattg

SEQ ID NO: 16305 - DNA, 18 bp, synthetic construct
  source 1..18: mol_type = other DNA
caagactactcgctatag

SEQ ID NO: 16306 - DNA, 18 bp, synthetic construct
  source 1..18: mol_type = other DNA
caatacgatacactattg

SEQ ID NO: 16307 - DNA, 18 bp, synthetic construct
  source 1..18: mol_type = other DNA
caattcgactctctgtag

SEQ ID NO: 16308 - DNA, 18 bp, synthetic construct
  source 1..18: mol_type = other DNA
caattcgagtcactatgg

SEQ ID NO: 16309 - DNA, 18 bp, synthetic construct
  source 1..18: mol_type = other DNA
caattcgagttactatag

SEQ ID NO: 16310 - DNA, 18 bp, synthetic construct
  source 1..18: mol_type = other DNA
cgttacgactcactattg

SEQ ID NO: 16311 - DNA, 18 bp, synthetic construct
  source 1..18: mol_type = other DNA
ctataagactcactattg

SEQ ID NO: 16312 - DNA, 18 bp, synthetic construct
  source 1..18: mol_type = other DNA
gaataagacttgctatag

SEQ ID NO: 16313 - DNA, 18 bp, synthetic construct
  source 1..18: mol_type = other DNA
gaatacaactcagtattg

SEQ ID NO: 16314 - DNA, 18 bp, synthetic construct
  source 1..18: mol_type = other DNA
gaatacgacacaccattg

SEQ ID NO: 16315 - DNA, 18 bp, synthetic construct
  source 1..18: mol_type = other DNA
gaattcgactcacagtag

SEQ ID NO: 16316 - DNA, 18 bp, synthetic construct
  source 1..18: mol_type = other DNA
gaattcgattcacaatag

SEQ ID NO: 16317 - DNA, 18 bp, synthetic construct
  source 1..18: mol_type = other DNA
gagttcgactcacaatag

SEQ ID NO: 16318 - DNA, 18 bp, synthetic construct
  source 1..18: mol_type = other DNA
gtatacgactcacttttg

SEQ ID NO: 16319 - DNA, 18 bp, synthetic construct
  source 1..18: mol_type = other DNA
taaaacgactcactggtg

SEQ ID NO: 16320 - DNA, 18 bp, synthetic construct
  source 1..18: mol_type = other DNA
taaaacgactcgctgaag

SEQ ID NO: 16321 - DNA, 18 bp, synthetic construct
  source 1..18: mol_type = other DNA
taaaacgactgactactg

SEQ ID NO: 16322 - DNA, 18 bp, synthetic construct
  source 1..18: mol_type = other DNA
taaaacgcctcgctacag

SEQ ID NO: 16323 - DNA, 18 bp, synthetic construct
  source 1..18: mol_type = other DNA
taaaaggtctcactattg

SEQ ID NO: 16324 - DNA, 18 bp, synthetic construct
  source 1..18: mol_type = other DNA
taaaatgactcgctacag

SEQ ID NO: 16325 - DNA, 18 bp, synthetic construct
  source 1..18: mol_type = other DNA
taaagcgactcgctgtag

SEQ ID NO: 16326 - DNA, 18 bp, synthetic construct
  source 1..18: mol_type = other DNA
taaatcgacgcattatag

SEQ ID NO: 16327 - DNA, 18 bp, synthetic construct
  source 1..18: mol_type = other DNA
taaatcgactcacttcag

SEQ ID NO: 16328 - DNA, 18 bp, synthetic construct
  source 1..18: mol_type = other DNA
taaatcgattcactacag

SEQ ID NO: 16329 - DNA, 18 bp, synthetic construct
  source 1..18: mol_type = other DNA
taaatggactcactaaag

SEQ ID NO: 16330 - DNA, 18 bp, synthetic construct
  source 1..18: mol_type = other DNA
taaatggactcactacag

SEQ ID NO: 16331 - DNA, 18 bp, synthetic construct
  source 1..18: mol_type = other DNA
taaatttactcactatag

SEQ ID NO: 16332 - DNA, 18 bp, synthetic construct
  source 1..18: mol_type = other DNA
taacacgacacagtattg

SEQ ID NO: 16333 - DNA, 18 bp, synthetic construct
  source 1..18: mol_type = other DNA
taacacgactcgatttag

SEQ ID NO: 16334 - DNA, 18 bp, synthetic construct
  source 1..18: mol_type = other DNA
taacacgatgcgctatag

SEQ ID NO: 16335 - DNA, 18 bp, synthetic construct
  source 1..18: mol_type = other DNA
taacactactcactgttg

SEQ ID NO: 16336 - DNA, 18 bp, synthetic construct
  source 1..18: mol_type = other DNA
taacaggattcgctatag

SEQ ID NO: 16337 - DNA, 18 bp, synthetic construct
  source 1..18: mol_type = other DNA
taactagactcactttag

SEQ ID NO: 16338 - DNA, 18 bp, synthetic construct
  source 1..18: mol_type = other DNA
taactcgacttactacag

SEQ ID NO: 16339 - DNA, 18 bp, synthetic construct
  source 1..18: mol_type = other DNA
taactcgagtcaatatag

SEQ ID NO: 16340 - DNA, 18 bp, synthetic construct
  source 1..18: mol_type = other DNA
taagaagactaactattg

SEQ ID NO: 16341 - DNA, 18 bp, synthetic construct
  source 1..18: mol_type = other DNA
taagacgaatctctattg

SEQ ID NO: 16342 - DNA, 18 bp, synthetic construct
  source 1..18: mol_type = other DNA
taagacgtctcacttttg

SEQ ID NO: 16343 - DNA, 18 bp, synthetic construct
  source 1..18: mol_type = other DNA
taagtaaactcactatag

SEQ ID NO: 16344 - DNA, 18 bp, synthetic construct
  source 1..18: mol_type = other DNA
taagttgactcactaaag

SEQ ID NO: 16345 - DNA, 18 bp, synthetic construct
  source 1..18: mol_type = other DNA
taataaaaatcgctatag

SEQ ID NO: 16346 - DNA, 18 bp, synthetic construct
  source 1..18: mol_type = other DNA
taataacactcactactg

SEQ ID NO: 16347 - DNA, 18 bp, synthetic construct
  source 1..18: mol_type = other DNA
taataagtctcgcaatag

SEQ ID NO: 16348 - DNA, 18 bp, synthetic construct
  source 1..18: mol_type = other DNA
taatacaaatcgctatgg

SEQ ID NO: 16349 - DNA, 18 bp, synthetic construct
  source 1..18: mol_type = other DNA
taatacacctcaccattg

SEQ ID NO: 16350 - DNA, 18 bp, synthetic construct
  source 1..18: mol_type = other DNA
taatacacgtcactattg

SEQ ID NO: 16351 - DNA, 18 bp, synthetic construct
  source 1..18: mol_type = other DNA
taataccactcacaatta

SEQ ID NO: 16352 - DNA, 18 bp, synthetic construct
  source 1..18: mol_type = other DNA
taatacgaatcacgtttg

SEQ ID NO: 16353 - DNA, 18 bp, synthetic construct
  source 1..18: mol_type = other DNA
taatacgaattaatattg

SEQ ID NO: 16354 - DNA, 18 bp, synthetic construct
  source 1..18: mol_type = other DNA
taatacgaattactgttg

SEQ ID NO: 16355 - DNA, 18 bp, synthetic construct
  source 1..18: mol_type = other DNA
taatacgacacgcaaaag

SEQ ID NO: 16356 - DNA, 18 bp, synthetic construct
  source 1..18: mol_type = other DNA
taatacgacacgcttgag

SEQ ID NO: 16357 - DNA, 18 bp, synthetic construct
  source 1..18: mol_type = other DNA
taatacgactcacctgtg

SEQ ID NO: 16358 - DNA, 18 bp, synthetic construct
  source 1..18: mol_type = other DNA
taatacgactcactgatc

SEQ ID NO: 16359 - DNA, 18 bp, synthetic construct
  source 1..18: mol_type = other DNA
taatacgactccccaatg

SEQ ID NO: 16360 - DNA, 18 bp, synthetic construct
  source 1..18: mol_type = other DNA
taatacgacttattgttg

SEQ ID NO: 16361 - DNA, 18 bp, synthetic construct
  source 1..18: mol_type = other DNA
taatacgacttgttatcg

SEQ ID NO: 16362 - DNA, 18 bp, synthetic construct
  source 1..18: mol_type = other DNA
taatacgagtcgataaag

SEQ ID NO: 16363 - DNA, 18 bp, synthetic construct
  source 1..18: mol_type = other DNA
taatacgagtcgcattag

SEQ ID NO: 16364 - DNA, 18 bp, synthetic construct
  source 1..18: mol_type = other DNA
taatacgagttgatatag

SEQ ID NO: 16365 - DNA, 18 bp, synthetic construct
  source 1..18: mol_type = other DNA
taatacgagttgctttag

SEQ ID NO: 16366 - DNA, 18 bp, synthetic construct
  source 1..18: mol_type = other DNA
taatacgattcaccactg

SEQ ID NO: 16367 - DNA, 18 bp, synthetic construct
  source 1..18: mol_type = other DNA
taatacgccccacttttg

SEQ ID NO: 16368 - DNA, 18 bp, synthetic construct
  source 1..18: mol_type = other DNA
taatacgcctctgtattg

SEQ ID NO: 16369 - DNA, 18 bp, synthetic construct
  source 1..18: mol_type = other DNA
taatacggctctccattg

SEQ ID NO: 16370 - DNA, 18 bp, synthetic construct
  source 1..18: mol_type = other DNA
taatacgtctcgctaacg

SEQ ID NO: 16371 - DNA, 18 bp, synthetic construct
  source 1..18: mol_type = other DNA
taatactactaactactg

SEQ ID NO: 16372 - DNA, 18 bp, synthetic construct
  source 1..18: mol_type = other DNA
taatactactcgcaaaag

SEQ ID NO: 16373 - DNA, 18 bp, synthetic construct
  source 1..18: mol_type = other DNA
taataggtctccctattg

SEQ ID NO: 16374 - DNA, 18 bp, synthetic construct
  source 1..18: mol_type = other DNA
taatagtactcgatatag

SEQ ID NO: 16375 - DNA, 18 bp, synthetic construct
  source 1..18: mol_type = other DNA
taatataaatcgctatag

SEQ ID NO: 16376 - DNA, 18 bp, synthetic construct
  source 1..18: mol_type = other DNA
taatatcactcaccattg

SEQ ID NO: 16377 - DNA, 18 bp, synthetic construct
  source 1..18: mol_type = other DNA
taatatgactcgcgctag

SEQ ID NO: 16378 - DNA, 18 bp, synthetic construct
  source 1..18: mol_type = other DNA
taatatgactcgtcatag

SEQ ID NO: 16379 - DNA, 18 bp, synthetic construct
  source 1..18: mol_type = other DNA
taatatgactgactactg

SEQ ID NO: 16380 - DNA, 18 bp, synthetic construct
  source 1..18: mol_type = other DNA
taatatgagacactattg

SEQ ID NO: 16381 - DNA, 18 bp, synthetic construct
  source 1..18: mol_type = other DNA
taatatgattaactattg

SEQ ID NO: 16382 - DNA, 18 bp, synthetic construct
  source 1..18: mol_type = other DNA
taatcccactcactactg

SEQ ID NO: 16383 - DNA, 18 bp, synthetic construct
  source 1..18: mol_type = other DNA
taatccgactacctattg

SEQ ID NO: 16384 - DNA, 18 bp, synthetic construct
  source 1..18: mol_type = other DNA
taatcgtactcactattg

SEQ ID NO: 16385 - DNA, 18 bp, synthetic construct
  source 1..18: mol_type = other DNA
taatctcactcgctatag

SEQ ID NO: 16386 - DNA, 18 bp, synthetic construct
  source 1..18: mol_type = other DNA
taatgagactcacttttg

SEQ ID NO: 16387 - DNA, 18 bp, synthetic construct
  source 1..18: mol_type = other DNA
taatgcaactcgttatag

SEQ ID NO: 16388 - DNA, 18 bp, synthetic construct
  source 1..18: mol_type = other DNA
taatgcgacacaatattg

SEQ ID NO: 16389 - DNA, 18 bp, synthetic construct
  source 1..18: mol_type = other DNA
taatgcgactcacaactg

SEQ ID NO: 16390 - DNA, 18 bp, synthetic construct
  source 1..18: mol_type = other DNA
taatgcgactcagtaatg

SEQ ID NO: 16391 - DNA, 18 bp, synthetic construct
  source 1..18: mol_type = other DNA
taatgcgactgtctattg

SEQ ID NO: 16392 - DNA, 18 bp, synthetic construct
  source 1..18: mol_type = other DNA
taatgctactcacgattg

SEQ ID NO: 16393 - DNA, 18 bp, synthetic construct
  source 1..18: mol_type = other DNA
taatgtgactctctattg

SEQ ID NO: 16394 - DNA, 18 bp, synthetic construct
  source 1..18: mol_type = other DNA
taattagaatcactataa

SEQ ID NO: 16395 - DNA, 18 bp, synthetic construct
  source 1..18: mol_type = other DNA
taattagactcactttaa

SEQ ID NO: 16396 - DNA, 18 bp, synthetic construct
  source 1..18: mol_type = other DNA
taattagactcactttcg

SEQ ID NO: 16397 - DNA, 18 bp, synthetic construct
  source 1..18: mol_type = other DNA
taattagactcattagag

SEQ ID NO: 16398 - DNA, 18 bp, synthetic construct
  source 1..18: mol_type = other DNA
taattagacttagtatag

SEQ ID NO: 16399 - DNA, 18 bp, synthetic construct
  source 1..18: mol_type = other DNA
taattcaacccactttag

SEQ ID NO: 16400 - DNA, 18 bp, synthetic construct
  source 1..18: mol_type = other DNA
taattcaactcccgatag

SEQ ID NO: 16401 - DNA, 18 bp, synthetic construct
  source 1..18: mol_type = other DNA
taattcaactccctagag

SEQ ID NO: 16402 - DNA, 18 bp, synthetic construct
  source 1..18: mol_type = other DNA
taattcaactgcctatag

SEQ ID NO: 16403 - DNA, 18 bp, synthetic construct
  source 1..18: mol_type = other DNA
taattccactcacactag

SEQ ID NO: 16404 - DNA, 18 bp, synthetic construct
  source 1..18: mol_type = other DNA
taattccactcaccctag

SEQ ID NO: 16405 - DNA, 18 bp, synthetic construct
  source 1..18: mol_type = other DNA
taattccactctgtatag

SEQ ID NO: 16406 - DNA, 18 bp, synthetic construct
  source 1..18: mol_type = other DNA
taattcgactcaccagcg

SEQ ID NO: 16407 - DNA, 18 bp, synthetic construct
  source 1..18: mol_type = other DNA
taattcgactcacctaag

SEQ ID NO: 16408 - DNA, 18 bp, synthetic construct
  source 1..18: mol_type = other DNA
taattcgactgcatatag

SEQ ID NO: 16409 - DNA, 18 bp, synthetic construct
  source 1..18: mol_type = other DNA
taattcgatgcacgatag

SEQ ID NO: 16410 - DNA, 18 bp, synthetic construct
  source 1..18: mol_type = other DNA
taattcgattcaatacag

SEQ ID NO: 16411 - DNA, 18 bp, synthetic construct
  source 1..18: mol_type = other DNA
taattcgattcacaacag

SEQ ID NO: 16412 - DNA, 18 bp, synthetic construct
  source 1..18: mol_type = other DNA
taattcgccccactaaag

SEQ ID NO: 16413 - DNA, 18 bp, synthetic construct
  source 1..18: mol_type = other DNA
taattcgcctcactaagg

SEQ ID NO: 16414 - DNA, 18 bp, synthetic construct
  source 1..18: mol_type = other DNA
taattcgcttcactaaag

SEQ ID NO: 16415 - DNA, 18 bp, synthetic construct
  source 1..18: mol_type = other DNA
taattcggctctgtatag

SEQ ID NO: 16416 - DNA, 18 bp, synthetic construct
  source 1..18: mol_type = other DNA
taattcgtctgactgtag

SEQ ID NO: 16417 - DNA, 18 bp, synthetic construct
  source 1..18: mol_type = other DNA
taattcgtcttacgatag

SEQ ID NO: 16418 - DNA, 18 bp, synthetic construct
  source 1..18: mol_type = other DNA
taattctactaattatag

SEQ ID NO: 16419 - DNA, 18 bp, synthetic construct
  source 1..18: mol_type = other DNA
taattctactcacttgag

SEQ ID NO: 16420 - DNA, 18 bp, synthetic construct
  source 1..18: mol_type = other DNA
taattctactgcctatag

SEQ ID NO: 16421 - DNA, 18 bp, synthetic construct
  source 1..18: mol_type = other DNA
taattctattcaccatag

SEQ ID NO: 16422 - DNA, 18 bp, synthetic construct
  source 1..18: mol_type = other DNA
taattctcctcactgtag

SEQ ID NO: 16423 - DNA, 18 bp, synthetic construct
  source 1..18: mol_type = other DNA
taattctgctcactaaag

SEQ ID NO: 16424 - DNA, 18 bp, synthetic construct
  source 1..18: mol_type = other DNA
taattgcacacactatag

SEQ ID NO: 16425 - DNA, 18 bp, synthetic construct
  source 1..18: mol_type = other DNA
taattgcactcactttag

SEQ ID NO: 16426 - DNA, 18 bp, synthetic construct
  source 1..18: mol_type = other DNA
taattggactcacaatcg

SEQ ID NO: 16427 - DNA, 18 bp, synthetic construct
  source 1..18: mol_type = other DNA
taatttgaatcactagag

SEQ ID NO: 16428 - DNA, 18 bp, synthetic construct
  source 1..18: mol_type = other DNA
taatttgactcaatttag

SEQ ID NO: 16429 - DNA, 18 bp, synthetic construct
  source 1..18: mol_type = other DNA
taatttgcctcactatgg

SEQ ID NO: 16430 - DNA, 18 bp, synthetic construct
  source 1..18: mol_type = other DNA
tactaacactcgctatag

SEQ ID NO: 16431 - DNA, 18 bp, synthetic construct
  source 1..18: mol_type = other DNA
tactaggactcactactg

SEQ ID NO: 16432 - DNA, 18 bp, synthetic construct
  source 1..18: mol_type = other DNA
tactccgactaactattg

SEQ ID NO: 16433 - DNA, 18 bp, synthetic construct
  source 1..18: mol_type = other DNA
tacttcgacacagtatag

SEQ ID NO: 16434 - DNA, 18 bp, synthetic construct
  source 1..18: mol_type = other DNA
tacttcgacctactatag

SEQ ID NO: 16435 - DNA, 18 bp, synthetic construct
  source 1..18: mol_type = other DNA
tacttcgactgactaaag

SEQ ID NO: 16436 - DNA, 18 bp, synthetic construct
  source 1..18: mol_type = other DNA
tacttcgacttactaaag

SEQ ID NO: 16437 - DNA, 18 bp, synthetic construct
  source 1..18: mol_type = other DNA
tagaccgactcactattg

SEQ ID NO: 16438 - DNA, 18 bp, synthetic construct
  source 1..18: mol_type = other DNA
tagtacgactcgccagag

SEQ ID NO: 16439 - DNA, 18 bp, synthetic construct
  source 1..18: mol_type = other DNA
tagtacgagtcggtatag

SEQ ID NO: 16440 - DNA, 18 bp, synthetic construct
  source 1..18: mol_type = other DNA
tagtacgtctaactattg

SEQ ID NO: 16441 - DNA, 18 bp, synthetic construct
  source 1..18: mol_type = other DNA
tagtaggactctctattg

SEQ ID NO: 16442 - DNA, 18 bp, synthetic construct
  source 1..18: mol_type = other DNA
tagttcgaatcacaatag

SEQ ID NO: 16443 - DNA, 18 bp, synthetic construct
  source 1..18: mol_type = other DNA
tagttcgtctcactaaag

SEQ ID NO: 16444 - DNA, 18 bp, synthetic construct
  source 1..18: mol_type = other DNA
tagtttgactcactctag

SEQ ID NO: 16445 - DNA, 18 bp, synthetic construct
  source 1..18: mol_type = other DNA
tataacgactcgcgatag

SEQ ID NO: 16446 - DNA, 18 bp, synthetic construct
  source 1..18: mol_type = other DNA
tatcacgacttactattg

SEQ ID NO: 16447 - DNA, 18 bp, synthetic construct
  source 1..18: mol_type = other DNA
tattaagactcgctatgg

SEQ ID NO: 16448 - DNA, 18 bp, synthetic construct
  source 1..18: mol_type = other DNA
tattaagactcgctctag

SEQ ID NO: 16449 - DNA, 18 bp, synthetic construct
  source 1..18: mol_type = other DNA
tattacgaatccctattg

SEQ ID NO: 16450 - DNA, 18 bp, synthetic construct
  source 1..18: mol_type = other DNA
tattacgactcacccttg

SEQ ID NO: 16451 - DNA, 18 bp, synthetic construct
  source 1..18: mol_type = other DNA
tattacgactcactactt

SEQ ID NO: 16452 - DNA, 18 bp, synthetic construct
  source 1..18: mol_type = other DNA
tattacgactcactcctg

SEQ ID NO: 16453 - DNA, 18 bp, synthetic construct
  source 1..18: mol_type = other DNA
tattacgactcgatacag

SEQ ID NO: 16454 - DNA, 18 bp, synthetic construct
  source 1..18: mol_type = other DNA
tattacggcccactattg

SEQ ID NO: 16455 - DNA, 18 bp, synthetic construct
  source 1..18: mol_type = other DNA
tattccgactcaccattg

SEQ ID NO: 16456 - DNA, 18 bp, synthetic construct
  source 1..18: mol_type = other DNA
tattccgactcgctttag

SEQ ID NO: 16457 - DNA, 18 bp, synthetic construct
  source 1..18: mol_type = other DNA
tattgcgactaactattg

SEQ ID NO: 16458 - DNA, 18 bp, synthetic construct
  source 1..18: mol_type = other DNA
tatttccactcattatag

SEQ ID NO: 16459 - DNA, 18 bp, synthetic construct
  source 1..18: mol_type = other DNA
tatttccactgactatag

SEQ ID NO: 16460 - DNA, 18 bp, synthetic construct
  source 1..18: mol_type = other DNA
tatttcgacacactctag

SEQ ID NO: 16461 - DNA, 18 bp, synthetic construct
  source 1..18: mol_type = other DNA
tatttcgactcacaatcg

SEQ ID NO: 16462 - DNA, 18 bp, synthetic construct
  source 1..18: mol_type = other DNA
tatttcgactcaccttag

SEQ ID NO: 16463 - DNA, 18 bp, synthetic construct
  source 1..18: mol_type = other DNA
tatttcgactcactagcg

SEQ ID NO: 16464 - DNA, 18 bp, synthetic construct
  source 1..18: mol_type = other DNA
tatttcgactcacttgag

SEQ ID NO: 16465 - DNA, 18 bp, synthetic construct
  source 1..18: mol_type = other DNA
tatttggactcacgatag

SEQ ID NO: 16466 - DNA, 18 bp, synthetic construct
  source 1..18: mol_type = other DNA
tatttggactcactaaag

SEQ ID NO: 16467 - DNA, 18 bp, synthetic construct
  source 1..18: mol_type = other DNA
tatttggactcagtatag

SEQ ID NO: 16468 - DNA, 18 bp, synthetic construct
  source 1..18: mol_type = other DNA
tcaatggactcactatag

SEQ ID NO: 16469 - DNA, 18 bp, synthetic construct
  source 1..18: mol_type = other DNA
tcacacgattcactattg

SEQ ID NO: 16470 - DNA, 18 bp, synthetic construct
  source 1..18: mol_type = other DNA
tcactcgagtcactatag

SEQ ID NO: 16471 - DNA, 18 bp, synthetic construct
  source 1..18: mol_type = other DNA
tcatacgacccaatattg

SEQ ID NO: 16472 - DNA, 18 bp, synthetic construct
  source 1..18: mol_type = other DNA
tcatacgactctctcttg

SEQ ID NO: 16473 - DNA, 18 bp, synthetic construct
  source 1..18: mol_type = other DNA
tcattcgagtcactatgg

SEQ ID NO: 16474 - DNA, 18 bp, synthetic construct
  source 1..18: mol_type = other DNA
tcattcgcgtcactatag

SEQ ID NO: 16475 - DNA, 18 bp, synthetic construct
  source 1..18: mol_type = other DNA
tcatttgacccactatag

SEQ ID NO: 16476 - DNA, 18 bp, synthetic construct
  source 1..18: mol_type = other DNA
tgactcggctcactatag

SEQ ID NO: 16477 - DNA, 18 bp, synthetic construct
  source 1..18: mol_type = other DNA
tgataagacgcactattg

SEQ ID NO: 16478 - DNA, 18 bp, synthetic construct
  source 1..18: mol_type = other DNA
tgataagactcactgttg

SEQ ID NO: 16479 - DNA, 18 bp, synthetic construct
  source 1..18: mol_type = other DNA
tgatacacctcactattg

SEQ ID NO: 16480 - DNA, 18 bp, synthetic construct
  source 1..18: mol_type = other DNA
tgatacgtcccactattg

SEQ ID NO: 16481 - DNA, 18 bp, synthetic construct
  source 1..18: mol_type = other DNA
tgataggactcgctttag

SEQ ID NO: 16482 - DNA, 18 bp, synthetic construct
  source 1..18: mol_type = other DNA
tgatccgactcagtattg

SEQ ID NO: 16483 - DNA, 18 bp, synthetic construct
  source 1..18: mol_type = other DNA
tgattcgactcaccgtag

SEQ ID NO: 16484 - DNA, 18 bp, synthetic construct
  source 1..18: mol_type = other DNA
tgattcgactcactctgg

SEQ ID NO: 16485 - DNA, 18 bp, synthetic construct
  source 1..18: mol_type = other DNA
tgattcgactctctatcg

SEQ ID NO: 16486 - DNA, 18 bp, synthetic construct
  source 1..18: mol_type = other DNA
tgattcgtctcagtatag

SEQ ID NO: 16487 - DNA, 18 bp, synthetic construct
  source 1..18: mol_type = other DNA
tgcaacgactcactattg

SEQ ID NO: 16488 - DNA, 18 bp, synthetic construct
  source 1..18: mol_type = other DNA
tgttacgactcactactg

SEQ ID NO: 16489 - DNA, 18 bp, synthetic construct
  source 1..18: mol_type = other DNA
ttataccagtcactattg

SEQ ID NO: 16490 - DNA, 18 bp, synthetic construct
  source 1..18: mol_type = other DNA
ttatacgacacgctctag

SEQ ID NO: 16491 - DNA, 18 bp, synthetic construct
  source 1..18: mol_type = other DNA
ttatacgactcacaatta

SEQ ID NO: 16492 - DNA, 18 bp, synthetic construct
  source 1..18: mol_type = other DNA
ttatacgcctcactaatg

SEQ ID NO: 16493 - DNA, 18 bp, synthetic construct
  source 1..18: mol_type = other DNA
ttattagactcaccatag

SEQ ID NO: 16494 - DNA, 18 bp, synthetic construct
  source 1..18: mol_type = other DNA
ttattaggctcactatag

SEQ ID NO: 16495 - DNA, 18 bp, synthetic construct
  source 1..18: mol_type = other DNA
ttattcgactcactccag

SEQ ID NO: 16496 - DNA, 18 bp, synthetic construct
  source 1..18: mol_type = other DNA
ttattcgactcccgatag

SEQ ID NO: 16497 - DNA, 18 bp, synthetic construct
  source 1..18: mol_type = other DNA
ttctacgacgcgctatag

SEQ ID NO: 16498 - DNA, 18 bp, synthetic construct
  source 1..18: mol_type = other DNA
ttctacgactcgctgtag

SEQ ID NO: 16499 - DNA, 18 bp, synthetic construct
  source 1..18: mol_type = other DNA
ttcttcgactcaccatag

SEQ ID NO: 16500 - DNA, 18 bp, synthetic construct
  source 1..18: mol_type = other DNA
ttgtacaactcgctatag

SEQ ID NO: 16501 - DNA, 18 bp, synthetic construct
  source 1..18: mol_type = other DNA
ttgtacgactcgctacag

SEQ ID NO: 16502 - DNA, 18 bp, synthetic construct
  source 1..18: mol_type = other DNA
ttgtacgactggctatag

SEQ ID NO: 16503 - DNA, 18 bp, synthetic construct
  source 1..18: mol_type = other DNA
ttttacgactcgccatag

SEQ ID NO: 16504 - DNA, 18 bp, synthetic construct
  source 1..18: mol_type = other DNA
aaaaacgacccattatag

SEQ ID NO: 16505 - DNA, 18 bp, synthetic construct
  source 1..18: mol_type = other DNA
aaacaggactcacaatag

SEQ ID NO: 16506 - DNA, 18 bp, synthetic construct
  source 1..18: mol_type = other DNA
aaagacgactgattatag

SEQ ID NO: 16507 - DNA, 18 bp, synthetic construct
  source 1..18: mol_type = other DNA
aaagacgtcacactatag

SEQ ID NO: 16508 - DNA, 18 bp, synthetic construct
  source 1..18: mol_type = other DNA
aaataagacacactgtag

SEQ ID NO: 16509 - DNA, 18 bp, synthetic construct
  source 1..18: mol_type = other DNA
aaataagactcaccacag

SEQ ID NO: 16510 - DNA, 18 bp, synthetic construct
  source 1..18: mol_type = other DNA
aaataagattaactatag

SEQ ID NO: 16511 - DNA, 18 bp, synthetic construct
  source 1..18: mol_type = other DNA
aaatacatgtcactatag

SEQ ID NO: 16512 - DNA, 18 bp, synthetic construct
  source 1..18: mol_type = other DNA
aaataccactcaatatgg

SEQ ID NO: 16513 - DNA, 18 bp, synthetic construct
  source 1..18: mol_type = other DNA
aaataccattcacgatag

SEQ ID NO: 16514 - DNA, 18 bp, synthetic construct
  source 1..18: mol_type = other DNA
aaatacgacacattataa

SEQ ID NO: 16515 - DNA, 18 bp, synthetic construct
  source 1..18: mol_type = other DNA
aaatacgacaccatatag

SEQ ID NO: 16516 - DNA, 18 bp, synthetic construct
  source 1..18: mol_type = other DNA
aaatacgactcaaactag

SEQ ID NO: 16517 - DNA, 18 bp, synthetic construct
  source 1..18: mol_type = other DNA
aaatacgactcaacagag

SEQ ID NO: 16518 - DNA, 18 bp, synthetic construct
  source 1..18: mol_type = other DNA
aaatacgacttagtgtag

SEQ ID NO: 16519 - DNA, 18 bp, synthetic construct
  source 1..18: mol_type = other DNA
aaatacgagtcattctag

SEQ ID NO: 16520 - DNA, 18 bp, synthetic construct
  source 1..18: mol_type = other DNA
aaatacgagtctcaatag

SEQ ID NO: 16521 - DNA, 18 bp, synthetic construct
  source 1..18: mol_type = other DNA
aaatacgattctctacag

SEQ ID NO: 16522 - DNA, 18 bp, synthetic construct
  source 1..18: mol_type = other DNA
aaatacgcaacactatag

SEQ ID NO: 16523 - DNA, 18 bp, synthetic construct
  source 1..18: mol_type = other DNA
aaatacgccacattatag

SEQ ID NO: 16524 - DNA, 18 bp, synthetic construct
  source 1..18: mol_type = other DNA
aaatacgtctaactctag

SEQ ID NO: 16525 - DNA, 18 bp, synthetic construct
  source 1..18: mol_type = other DNA
aaatacgtctcaatctag

SEQ ID NO: 16526 - DNA, 18 bp, synthetic construct
  source 1..18: mol_type = other DNA
aaatactacatactatag

SEQ ID NO: 16527 - DNA, 18 bp, synthetic construct
  source 1..18: mol_type = other DNA
aaatactccttactatag

SEQ ID NO: 16528 - DNA, 18 bp, synthetic construct
  source 1..18: mol_type = other DNA
aaatagcacttactatag

SEQ ID NO: 16529 - DNA, 18 bp, synthetic construct
  source 1..18: mol_type = other DNA
aaataggacatactatag

SEQ ID NO: 16530 - DNA, 18 bp, synthetic construct
  source 1..18: mol_type = other DNA
aaataggacttactatcg

SEQ ID NO: 16531 - DNA, 18 bp, synthetic construct
  source 1..18: mol_type = other DNA
aaataggcctcactacag

SEQ ID NO: 16532 - DNA, 18 bp, synthetic construct
  source 1..18: mol_type = other DNA
aaatccaactcactctag

SEQ ID NO: 16533 - DNA, 18 bp, synthetic construct
  source 1..18: mol_type = other DNA
aaatccgacagactatag

SEQ ID NO: 16534 - DNA, 18 bp, synthetic construct
  source 1..18: mol_type = other DNA
aaatcctactcactagag

SEQ ID NO: 16535 - DNA, 18 bp, synthetic construct
  source 1..18: mol_type = other DNA
aaatgagactcacgatag

SEQ ID NO: 16536 - DNA, 18 bp, synthetic construct
  source 1..18: mol_type = other DNA
aaatgcgactcacttcag

SEQ ID NO: 16537 - DNA, 18 bp, synthetic construct
  source 1..18: mol_type = other DNA
aaatgcgagtcacaatag

SEQ ID NO: 16538 - DNA, 18 bp, synthetic construct
  source 1..18: mol_type = other DNA
aactaccactcattatag

SEQ ID NO: 16539 - DNA, 18 bp, synthetic construct
  source 1..18: mol_type = other DNA
aactacgactgactgtag

SEQ ID NO: 16540 - DNA, 18 bp, synthetic construct
  source 1..18: mol_type = other DNA
aactacgtctcattatag

SEQ ID NO: 16541 - DNA, 18 bp, synthetic construct
  source 1..18: mol_type = other DNA
aactctgactcactatag

SEQ ID NO: 16542 - DNA, 18 bp, synthetic construct
  source 1..18: mol_type = other DNA
aagtacgactcacttcag

SEQ ID NO: 16543 - DNA, 18 bp, synthetic construct
  source 1..18: mol_type = other DNA
aagtatgactccctatag

SEQ ID NO: 16544 - DNA, 18 bp, synthetic construct
  source 1..18: mol_type = other DNA
aattacgactcacgaaag

SEQ ID NO: 16545 - DNA, 18 bp, synthetic construct
  source 1..18: mol_type = other DNA
aattgggactcactatag

SEQ ID NO: 16546 - DNA, 18 bp, synthetic construct
  source 1..18: mol_type = other DNA
acttaccactcactatag

SEQ ID NO: 16547 - DNA, 18 bp, synthetic construct
  source 1..18: mol_type = other DNA
agacacgactcactatgg

SEQ ID NO: 16548 - DNA, 18 bp, synthetic construct
  source 1..18: mol_type = other DNA
agagacgactctctatag

SEQ ID NO: 16549 - DNA, 18 bp, synthetic construct
  source 1..18: mol_type = other DNA
agataagactaactatag

SEQ ID NO: 16550 - DNA, 18 bp, synthetic construct
  source 1..18: mol_type = other DNA
agatacgactctctagag

SEQ ID NO: 16551 - DNA, 18 bp, synthetic construct
  source 1..18: mol_type = other DNA
agatacgagtctctatag

SEQ ID NO: 16552 - DNA, 18 bp, synthetic construct
  source 1..18: mol_type = other DNA
agatatgactcagtatag

SEQ ID NO: 16553 - DNA, 18 bp, synthetic construct
  source 1..18: mol_type = other DNA
atacacgactcactacag

SEQ ID NO: 16554 - DNA, 18 bp, synthetic construct
  source 1..18: mol_type = other DNA
atagacgtctcactatag

SEQ ID NO: 16555 - DNA, 18 bp, synthetic construct
  source 1..18: mol_type = other DNA
atatacgacgcactctag

SEQ ID NO: 16556 - DNA, 18 bp, synthetic construct
  source 1..18: mol_type = other DNA
atatacgactaactagag

SEQ ID NO: 16557 - DNA, 18 bp, synthetic construct
  source 1..18: mol_type = other DNA
atatacgactcagaatag

SEQ ID NO: 16558 - DNA, 18 bp, synthetic construct
  source 1..18: mol_type = other DNA
atatacgactgcctatag

SEQ ID NO: 16559 - DNA, 18 bp, synthetic construct
  source 1..18: mol_type = other DNA
atatagaactcactatag

SEQ ID NO: 16560 - DNA, 18 bp, synthetic construct
  source 1..18: mol_type = other DNA
atataggacgcactatag

SEQ ID NO: 16561 - DNA, 18 bp, synthetic construct
  source 1..18: mol_type = other DNA
caaaacgaatcactaaag

SEQ ID NO: 16562 - DNA, 18 bp, synthetic construct
  source 1..18: mol_type = other DNA
caaaacgtcttactatag

SEQ ID NO: 16563 - DNA, 18 bp, synthetic construct
  source 1..18: mol_type = other DNA
caacacgactcacactag

SEQ ID NO: 16564 - DNA, 18 bp, synthetic construct
  source 1..18: mol_type = other DNA
caacgcgtctcactatag

SEQ ID NO: 16565 - DNA, 18 bp, synthetic construct
  source 1..18: mol_type = other DNA
caagacgcctcactaaag

SEQ ID NO: 16566 - DNA, 18 bp, synthetic construct
  source 1..18: mol_type = other DNA
caagatgactctctatag

SEQ ID NO: 16567 - DNA, 18 bp, synthetic construct
  source 1..18: mol_type = other DNA
caataacactcactacag

SEQ ID NO: 16568 - DNA, 18 bp, synthetic construct
  source 1..18: mol_type = other DNA
caataagaatccctatag

SEQ ID NO: 16569 - DNA, 18 bp, synthetic construct
  source 1..18: mol_type = other DNA
caataagacccactttag

SEQ ID NO: 16570 - DNA, 18 bp, synthetic construct
  source 1..18: mol_type = other DNA
caataaggctcactaaag

SEQ ID NO: 16571 - DNA, 18 bp, synthetic construct
  source 1..18: mol_type = other DNA
caataagtctcactgtag

SEQ ID NO: 16572 - DNA, 18 bp, synthetic construct
  source 1..18: mol_type = other DNA
caatacaacacacaatag

SEQ ID NO: 16573 - DNA, 18 bp, synthetic construct
  source 1..18: mol_type = other DNA
caatacaacttacgatag

SEQ ID NO: 16574 - DNA, 18 bp, synthetic construct
  source 1..18: mol_type = other DNA
caataccaatcactatcg

SEQ ID NO: 16575 - DNA, 18 bp, synthetic construct
  source 1..18: mol_type = other DNA
caatacgaatcactagcg

SEQ ID NO: 16576 - DNA, 18 bp, synthetic construct
  source 1..18: mol_type = other DNA
caatacgactaacaaaag

SEQ ID NO: 16577 - DNA, 18 bp, synthetic construct
  source 1..18: mol_type = other DNA
caatacgactaagaatag

SEQ ID NO: 16578 - DNA, 18 bp, synthetic construct
  source 1..18: mol_type = other DNA
caatacgactctacatag

SEQ ID NO: 16579 - DNA, 18 bp, synthetic construct
  source 1..18: mol_type = other DNA
caatacgactgaatacag

SEQ ID NO: 16580 - DNA, 18 bp, synthetic construct
  source 1..18: mol_type = other DNA
caatacggctcacaaaag

SEQ ID NO: 16581 - DNA, 18 bp, synthetic construct
  source 1..18: mol_type = other DNA
caatacggttcactagag

SEQ ID NO: 16582 - DNA, 18 bp, synthetic construct
  source 1..18: mol_type = other DNA
caatacgtctcacagtag

SEQ ID NO: 16583 - DNA, 18 bp, synthetic construct
  source 1..18: mol_type = other DNA
caatacgtcttaatatag

SEQ ID NO: 16584 - DNA, 18 bp, synthetic construct
  source 1..18: mol_type = other DNA
caatactacttaatatag

SEQ ID NO: 16585 - DNA, 18 bp, synthetic construct
  source 1..18: mol_type = other DNA
caatactcttcactatag

SEQ ID NO: 16586 - DNA, 18 bp, synthetic construct
  source 1..18: mol_type = other DNA
caatataactcactaaag

SEQ ID NO: 16587 - DNA, 18 bp, synthetic construct
  source 1..18: mol_type = other DNA
caatatgactcaaaatag

SEQ ID NO: 16588 - DNA, 18 bp, synthetic construct
  source 1..18: mol_type = other DNA
caatatgactgactatcg

SEQ ID NO: 16589 - DNA, 18 bp, synthetic construct
  source 1..18: mol_type = other DNA
caatatgcctcactttag

SEQ ID NO: 16590 - DNA, 18 bp, synthetic construct
  source 1..18: mol_type = other DNA
caatatgtctcactctag

SEQ ID NO: 16591 - DNA, 18 bp, synthetic construct
  source 1..18: mol_type = other DNA
caatatgtcttactatag

SEQ ID NO: 16592 - DNA, 18 bp, synthetic construct
  source 1..18: mol_type = other DNA
caatccgattcactctag

SEQ ID NO: 16593 - DNA, 18 bp, synthetic construct
  source 1..18: mol_type = other DNA
caatcctactcactaaag

SEQ ID NO: 16594 - DNA, 18 bp, synthetic construct
  source 1..18: mol_type = other DNA
cactacatctcactatag

SEQ ID NO: 16595 - DNA, 18 bp, synthetic construct
  source 1..18: mol_type = other DNA
cactacccctcactatag

SEQ ID NO: 16596 - DNA, 18 bp, synthetic construct
  source 1..18: mol_type = other DNA
cactacgactaactaaag

SEQ ID NO: 16597 - DNA, 18 bp, synthetic construct
  source 1..18: mol_type = other DNA
cactacgtttcactatag

SEQ ID NO: 16598 - DNA, 18 bp, synthetic construct
  source 1..18: mol_type = other DNA
cagtacgattctctatag

SEQ ID NO: 16599 - DNA, 18 bp, synthetic construct
  source 1..18: mol_type = other DNA
cagtatgactcaccatag

SEQ ID NO: 16600 - DNA, 18 bp, synthetic construct
  source 1..18: mol_type = other DNA
cataacgcctcactatag

SEQ ID NO: 16601 - DNA, 18 bp, synthetic construct
  source 1..18: mol_type = other DNA
catcacgacacactatag

SEQ ID NO: 16602 - DNA, 18 bp, synthetic construct
  source 1..18: mol_type = other DNA
cattacaacccactatag

SEQ ID NO: 16603 - DNA, 18 bp, synthetic construct
  source 1..18: mol_type = other DNA
cattacgactcattaaag

SEQ ID NO: 16604 - DNA, 18 bp, synthetic construct
  source 1..18: mol_type = other DNA
cgttacgactaactatag

SEQ ID NO: 16605 - DNA, 18 bp, synthetic construct
  source 1..18: mol_type = other DNA
ctataagactcaatatag

SEQ ID NO: 16606 - DNA, 18 bp, synthetic construct
  source 1..18: mol_type = other DNA
ctataccactgactatag

SEQ ID NO: 16607 - DNA, 18 bp, synthetic construct
  source 1..18: mol_type = other DNA
ctatacgagtctctatag

SEQ ID NO: 16608 - DNA, 18 bp, synthetic construct
  source 1..18: mol_type = other DNA
ctatatgactcactatgg

SEQ ID NO: 16609 - DNA, 18 bp, synthetic construct
  source 1..18: mol_type = other DNA
ctatgcaactcactatag

SEQ ID NO: 16610 - DNA, 18 bp, synthetic construct
  source 1..18: mol_type = other DNA
gaaaacgattcattatag

SEQ ID NO: 16611 - DNA, 18 bp, synthetic construct
  source 1..18: mol_type = other DNA
gaatacgacacaccttag

SEQ ID NO: 16612 - DNA, 18 bp, synthetic construct
  source 1..18: mol_type = other DNA
gaatacgactcacattgg

SEQ ID NO: 16613 - DNA, 18 bp, synthetic construct
  source 1..18: mol_type = other DNA
gaatactactcagaatag

SEQ ID NO: 16614 - DNA, 18 bp, synthetic construct
  source 1..18: mol_type = other DNA
gaatccgactctatatag

SEQ ID NO: 16615 - DNA, 18 bp, synthetic construct
  source 1..18: mol_type = other DNA
gacaacgactcactgtag

SEQ ID NO: 16616 - DNA, 18 bp, synthetic construct
  source 1..18: mol_type = other DNA
gactacgacccactttag

SEQ ID NO: 16617 - DNA, 18 bp, synthetic construct
  source 1..18: mol_type = other DNA
gactacgactcactaagg

SEQ ID NO: 16618 - DNA, 18 bp, synthetic construct
  source 1..18: mol_type = other DNA
gactatgactcactacag

SEQ ID NO: 16619 - DNA, 18 bp, synthetic construct
  source 1..18: mol_type = other DNA
gagtacgacacactctag

SEQ ID NO: 16620 - DNA, 18 bp, synthetic construct
  source 1..18: mol_type = other DNA
gattacgactcattgtag

SEQ ID NO: 16621 - DNA, 18 bp, synthetic construct
  source 1..18: mol_type = other DNA
ggatacgtcccactatag

SEQ ID NO: 16622 - DNA, 18 bp, synthetic construct
  source 1..18: mol_type = other DNA
ggatcggactcactatag

SEQ ID NO: 16623 - DNA, 18 bp, synthetic construct
  source 1..18: mol_type = other DNA
ggctacgactcactctag

SEQ ID NO: 16624 - DNA, 18 bp, synthetic construct
  source 1..18: mol_type = other DNA
ggttacgaatcactatag

SEQ ID NO: 16625 - DNA, 18 bp, synthetic construct
  source 1..18: mol_type = other DNA
gtatacaactcactaaag

SEQ ID NO: 16626 - DNA, 18 bp, synthetic construct
  source 1..18: mol_type = other DNA
gtatacgactctctgtag

SEQ ID NO: 16627 - DNA, 18 bp, synthetic construct
  source 1..18: mol_type = other DNA
taaaaagaccgactatag

SEQ ID NO: 16628 - DNA, 18 bp, synthetic construct
  source 1..18: mol_type = other DNA
taaaaagactcacttgag

SEQ ID NO: 16629 - DNA, 18 bp, synthetic construct
  source 1..18: mol_type = other DNA
taaaaagactctctttag

SEQ ID NO: 16630 - DNA, 18 bp, synthetic construct
  source 1..18: mol_type = other DNA
taaaaagattcactctag

SEQ ID NO: 16631 - DNA, 18 bp, synthetic construct
  source 1..18: mol_type = other DNA
taaaaccactcacgacag

SEQ ID NO: 16632 - DNA, 18 bp, synthetic construct
  source 1..18: mol_type = other DNA
taaaaccactcagaatag

SEQ ID NO: 16633 - DNA, 18 bp, synthetic construct
  source 1..18: mol_type = other DNA
taaaacgaatacctatag

SEQ ID NO: 16634 - DNA, 18 bp, synthetic construct
  source 1..18: mol_type = other DNA
taaaacgacacagtttag

SEQ ID NO: 16635 - DNA, 18 bp, synthetic construct
  source 1..18: mol_type = other DNA
taaaacgacatactataa

SEQ ID NO: 16636 - DNA, 18 bp, synthetic construct
  source 1..18: mol_type = other DNA
taaaacgacccacaacag

SEQ ID NO: 16637 - DNA, 18 bp, synthetic construct
  source 1..18: mol_type = other DNA
taaaacgactaacgaaag

SEQ ID NO: 16638 - DNA, 18 bp, synthetic construct
  source 1..18: mol_type = other DNA
taaaacgactcacaggag

SEQ ID NO: 16639 - DNA, 18 bp, synthetic construct
  source 1..18: mol_type = other DNA
taaaacgactcaccgtgg

SEQ ID NO: 16640 - DNA, 18 bp, synthetic construct
  source 1..18: mol_type = other DNA
taaaacgactcactccgg

SEQ ID NO: 16641 - DNA, 18 bp, synthetic construct
  source 1..18: mol_type = other DNA
taaaacgactcatcatcg

SEQ ID NO: 16642 - DNA, 18 bp, synthetic construct
  source 1..18: mol_type = other DNA
taaaacgagtcactgaag

SEQ ID NO: 16643 - DNA, 18 bp, synthetic construct
  source 1..18: mol_type = other DNA
taaaacgagtcattacag

SEQ ID NO: 16644 - DNA, 18 bp, synthetic construct
  source 1..18: mol_type = other DNA
taaaacgattgactttag

SEQ ID NO: 16645 - DNA, 18 bp, synthetic construct
  source 1..18: mol_type = other DNA
taaaacggcacacaatag

SEQ ID NO: 16646 - DNA, 18 bp, synthetic construct
  source 1..18: mol_type = other DNA
taaaacgtatcactatgg

SEQ ID NO: 16647 - DNA, 18 bp, synthetic construct
  source 1..18: mol_type = other DNA
taaaactactgactatcg

SEQ ID NO: 16648 - DNA, 18 bp, synthetic construct
  source 1..18: mol_type = other DNA
taaaactagtcactatgg

SEQ ID NO: 16649 - DNA, 18 bp, synthetic construct
  source 1..18: mol_type = other DNA
taaaactcctcaccatag

SEQ ID NO: 16650 - DNA, 18 bp, synthetic construct
  source 1..18: mol_type = other DNA
taaaactgctcaccatag

SEQ ID NO: 16651 - DNA, 18 bp, synthetic construct
  source 1..18: mol_type = other DNA
taaaacttctcactagag

SEQ ID NO: 16652 - DNA, 18 bp, synthetic construct
  source 1..18: mol_type = other DNA
taaaaggactcacaatcg

SEQ ID NO: 16653 - DNA, 18 bp, synthetic construct
  source 1..18: mol_type = other DNA
taaaaggactcacttaag

SEQ ID NO: 16654 - DNA, 18 bp, synthetic construct
  source 1..18: mol_type = other DNA
taaaaggactcataatag

SEQ ID NO: 16655 - DNA, 18 bp, synthetic construct
  source 1..18: mol_type = other DNA
taaaataactcactacag

SEQ ID NO: 16656 - DNA, 18 bp, synthetic construct
  source 1..18: mol_type = other DNA
taaaattactccctatag

SEQ ID NO: 16657 - DNA, 18 bp, synthetic construct
  source 1..18: mol_type = other DNA
taaaattagtcactatag

SEQ ID NO: 16658 - DNA, 18 bp, synthetic construct
  source 1..18: mol_type = other DNA
taaaccgacacactttag

SEQ ID NO: 16659 - DNA, 18 bp, synthetic construct
  source 1..18: mol_type = other DNA
taaagccactcattatag

SEQ ID NO: 16660 - DNA, 18 bp, synthetic construct
  source 1..18: mol_type = other DNA
taaagcgactcacgagag

SEQ ID NO: 16661 - DNA, 18 bp, synthetic construct
  source 1..18: mol_type = other DNA
taaagcgactgactttag

SEQ ID NO: 16662 - DNA, 18 bp, synthetic construct
  source 1..18: mol_type = other DNA
taaagcggctcactttag

SEQ ID NO: 16663 - DNA, 18 bp, synthetic construct
  source 1..18: mol_type = other DNA
taaagcgtctcaccatag

SEQ ID NO: 16664 - DNA, 18 bp, synthetic construct
  source 1..18: mol_type = other DNA
taaagcttctcactatag

SEQ ID NO: 16665 - DNA, 18 bp, synthetic construct
  source 1..18: mol_type = other DNA
taaagggactcattatag

SEQ ID NO: 16666 - DNA, 18 bp, synthetic construct
  source 1..18: mol_type = other DNA
taacaaaactcactacag

SEQ ID NO: 16667 - DNA, 18 bp, synthetic construct
  source 1..18: mol_type = other DNA
taacaatactcactaaag

SEQ ID NO: 16668 - DNA, 18 bp, synthetic construct
  source 1..18: mol_type = other DNA
taacacaacccactatgg

SEQ ID NO: 16669 - DNA, 18 bp, synthetic construct
  source 1..18: mol_type = other DNA
taacacaagacactatag

SEQ ID NO: 16670 - DNA, 18 bp, synthetic construct
  source 1..18: mol_type = other DNA
taacacgaataactttag

SEQ ID NO: 16671 - DNA, 18 bp, synthetic construct
  source 1..18: mol_type = other DNA
taacacgaccaactctag

SEQ ID NO: 16672 - DNA, 18 bp, synthetic construct
  source 1..18: mol_type = other DNA
taacacgactaagtagag

SEQ ID NO: 16673 - DNA, 18 bp, synthetic construct
  source 1..18: mol_type = other DNA
taacacgactctcactag

SEQ ID NO: 16674 - DNA, 18 bp, synthetic construct
  source 1..18: mol_type = other DNA
taacacgacttagaatag

SEQ ID NO: 16675 - DNA, 18 bp, synthetic construct
  source 1..18: mol_type = other DNA
taacacgattctatatag

SEQ ID NO: 16676 - DNA, 18 bp, synthetic construct
  source 1..18: mol_type = other DNA
taacacgcgccactatag

SEQ ID NO: 16677 - DNA, 18 bp, synthetic construct
  source 1..18: mol_type = other DNA
taacacgcgtcactttag

SEQ ID NO: 16678 - DNA, 18 bp, synthetic construct
  source 1..18: mol_type = other DNA
taacacgtctaactatcg

SEQ ID NO: 16679 - DNA, 18 bp, synthetic construct
  source 1..18: mol_type = other DNA
taacactactcattgtag

SEQ ID NO: 16680 - DNA, 18 bp, synthetic construct
  source 1..18: mol_type = other DNA
taacaggaatctctatag

SEQ ID NO: 16681 - DNA, 18 bp, synthetic construct
  source 1..18: mol_type = other DNA
taaccagactcaatatag

SEQ ID NO: 16682 - DNA, 18 bp, synthetic construct
  source 1..18: mol_type = other DNA
taacccgacttactaaag

SEQ ID NO: 16683 - DNA, 18 bp, synthetic construct
  source 1..18: mol_type = other DNA
taacgcgacctactatag

SEQ ID NO: 16684 - DNA, 18 bp, synthetic construct
  source 1..18: mol_type = other DNA
taacgcgactccctacag

SEQ ID NO: 16685 - DNA, 18 bp, synthetic construct
  source 1..18: mol_type = other DNA
taacgctaatcactatag

SEQ ID NO: 16686 - DNA, 18 bp, synthetic construct
  source 1..18: mol_type = other DNA
taagaagaatcactttag

SEQ ID NO: 16687 - DNA, 18 bp, synthetic construct
  source 1..18: mol_type = other DNA
taagaagacacattatag

SEQ ID NO: 16688 - DNA, 18 bp, synthetic construct
  source 1..18: mol_type = other DNA
taagaccattcaccatag

SEQ ID NO: 16689 - DNA, 18 bp, synthetic construct
  source 1..18: mol_type = other DNA
taagacgactccttctag

SEQ ID NO: 16690 - DNA, 18 bp, synthetic construct
  source 1..18: mol_type = other DNA
taagacgattaaccatag

SEQ ID NO: 16691 - DNA, 18 bp, synthetic construct
  source 1..18: mol_type = other DNA
taagacgtgtctctatag

SEQ ID NO: 16692 - DNA, 18 bp, synthetic construct
  source 1..18: mol_type = other DNA
taagacttctcaccatag

SEQ ID NO: 16693 - DNA, 18 bp, synthetic construct
  source 1..18: mol_type = other DNA
taagatgactctatatag

SEQ ID NO: 16694 - DNA, 18 bp, synthetic construct
  source 1..18: mol_type = other DNA
taaggccactaactatag

SEQ ID NO: 16695 - DNA, 18 bp, synthetic construct
  source 1..18: mol_type = other DNA
taaggcgagtcactatgg

SEQ ID NO: 16696 - DNA, 18 bp, synthetic construct
  source 1..18: mol_type = other DNA
taataaaacacactatcg

SEQ ID NO: 16697 - DNA, 18 bp, synthetic construct
  source 1..18: mol_type = other DNA
taataaaactcactctcg

SEQ ID NO: 16698 - DNA, 18 bp, synthetic construct
  source 1..18: mol_type = other DNA
taataacacttactatcg

SEQ ID NO: 16699 - DNA, 18 bp, synthetic construct
  source 1..18: mol_type = other DNA
taataacagtcaatatag

SEQ ID NO: 16700 - DNA, 18 bp, synthetic construct
  source 1..18: mol_type = other DNA
taataagaatcaatagag

SEQ ID NO: 16701 - DNA, 18 bp, synthetic construct
  source 1..18: mol_type = other DNA
taataagaatcagtatgg

SEQ ID NO: 16702 - DNA, 18 bp, synthetic construct
  source 1..18: mol_type = other DNA
taataagacacacaacag

SEQ ID NO: 16703 - DNA, 18 bp, synthetic construct
  source 1..18: mol_type = other DNA
taataagacgctttatag

SEQ ID NO: 16704 - DNA, 18 bp, synthetic construct
  source 1..18: mol_type = other DNA
taataagactcactcagg

SEQ ID NO: 16705 - DNA, 18 bp, synthetic construct
  source 1..18: mol_type = other DNA
taataagacttaacatag

SEQ ID NO: 16706 - DNA, 18 bp, synthetic construct
  source 1..18: mol_type = other DNA
taataagagtaattatag

SEQ ID NO: 16707 - DNA, 18 bp, synthetic construct
  source 1..18: mol_type = other DNA
taataagcctcacattag

SEQ ID NO: 16708 - DNA, 18 bp, synthetic construct
  source 1..18: mol_type = other DNA
taataagcctcattatgg

SEQ ID NO: 16709 - DNA, 18 bp, synthetic construct
  source 1..18: mol_type = other DNA
taataagcctgactatgg

SEQ ID NO: 16710 - DNA, 18 bp, synthetic construct
  source 1..18: mol_type = other DNA
taataagcgtcactgtag

SEQ ID NO: 16711 - DNA, 18 bp, synthetic construct
  source 1..18: mol_type = other DNA
taataaggcatactatag

SEQ ID NO: 16712 - DNA, 18 bp, synthetic construct
  source 1..18: mol_type = other DNA
taataagtcccaatatag

SEQ ID NO: 16713 - DNA, 18 bp, synthetic construct
  source 1..18: mol_type = other DNA
taataagtctccctttag

SEQ ID NO: 16714 - DNA, 18 bp, synthetic construct
  source 1..18: mol_type = other DNA
taataagttacactatag

SEQ ID NO: 16715 - DNA, 18 bp, synthetic construct
  source 1..18: mol_type = other DNA
taataagtttcactagag

SEQ ID NO: 16716 - DNA, 18 bp, synthetic construct
  source 1..18: mol_type = other DNA
taatacaacacaatatgg

SEQ ID NO: 16717 - DNA, 18 bp, synthetic construct
  source 1..18: mol_type = other DNA
taatacaactaattgtag

SEQ ID NO: 16718 - DNA, 18 bp, synthetic construct
  source 1..18: mol_type = other DNA
taatacaactcagagtag

SEQ ID NO: 16719 - DNA, 18 bp, synthetic construct
  source 1..18: mol_type = other DNA
taatacaacttaatgtag

SEQ ID NO: 16720 - DNA, 18 bp, synthetic construct
  source 1..18: mol_type = other DNA
taatacaacttactctcg

SEQ ID NO: 16721 - DNA, 18 bp, synthetic construct
  source 1..18: mol_type = other DNA
taatacaactttccatag

SEQ ID NO: 16722 - DNA, 18 bp, synthetic construct
  source 1..18: mol_type = other DNA
taatacaatcctctatag

SEQ ID NO: 16723 - DNA, 18 bp, synthetic construct
  source 1..18: mol_type = other DNA
taatacaattatctatag

SEQ ID NO: 16724 - DNA, 18 bp, synthetic construct
  source 1..18: mol_type = other DNA
taatacaattctctagag

SEQ ID NO: 16725 - DNA, 18 bp, synthetic construct
  source 1..18: mol_type = other DNA
taatacagctcaagatag

SEQ ID NO: 16726 - DNA, 18 bp, synthetic construct
  source 1..18: mol_type = other DNA
taataccaataacaatag

SEQ ID NO: 16727 - DNA, 18 bp, synthetic construct
  source 1..18: mol_type = other DNA
taataccaatccctagag

SEQ ID NO: 16728 - DNA, 18 bp, synthetic construct
  source 1..18: mol_type = other DNA
taataccaattacgatag

SEQ ID NO: 16729 - DNA, 18 bp, synthetic construct
  source 1..18: mol_type = other DNA
taataccaattactctag

SEQ ID NO: 16730 - DNA, 18 bp, synthetic construct
  source 1..18: mol_type = other DNA
taataccacacccgatag

SEQ ID NO: 16731 - DNA, 18 bp, synthetic construct
  source 1..18: mol_type = other DNA
taataccaccccctacag

SEQ ID NO: 16732 - DNA, 18 bp, synthetic construct
  source 1..18: mol_type = other DNA
taataccactcacttacg

SEQ ID NO: 16733 - DNA, 18 bp, synthetic construct
  source 1..18: mol_type = other DNA
taataccactctctggag

SEQ ID NO: 16734 - DNA, 18 bp, synthetic construct
  source 1..18: mol_type = other DNA
taataccactctctgtcg

SEQ ID NO: 16735 - DNA, 18 bp, synthetic construct
  source 1..18: mol_type = other DNA
taataccacttagtatcg

SEQ ID NO: 16736 - DNA, 18 bp, synthetic construct
  source 1..18: mol_type = other DNA
taataccagccactaaag

SEQ ID NO: 16737 - DNA, 18 bp, synthetic construct
  source 1..18: mol_type = other DNA
taataccagtcacaagag

SEQ ID NO: 16738 - DNA, 18 bp, synthetic construct
  source 1..18: mol_type = other DNA
taatacctcccacgatag

SEQ ID NO: 16739 - DNA, 18 bp, synthetic construct
  source 1..18: mol_type = other DNA
taatacgaaacagtaaag

SEQ ID NO: 16740 - DNA, 18 bp, synthetic construct
  source 1..18: mol_type = other DNA
taatacgaactacgatag

SEQ ID NO: 16741 - DNA, 18 bp, synthetic construct
  source 1..18: mol_type = other DNA
taatacgaagcataatag

SEQ ID NO: 16742 - DNA, 18 bp, synthetic construct
  source 1..18: mol_type = other DNA
taatacgaatacttatag

SEQ ID NO: 16743 - DNA, 18 bp, synthetic construct
  source 1..18: mol_type = other DNA
taatacgaatcagcacag

SEQ ID NO: 16744 - DNA, 18 bp, synthetic construct
  source 1..18: mol_type = other DNA
taatacgaatccccatgg

SEQ ID NO: 16745 - DNA, 18 bp, synthetic construct
  source 1..18: mol_type = other DNA
taatacgacaaacaacag

SEQ ID NO: 16746 - DNA, 18 bp, synthetic construct
  source 1..18: mol_type = other DNA
taatacgacaaagtgtag

SEQ ID NO: 16747 - DNA, 18 bp, synthetic construct
  source 1..18: mol_type = other DNA
taatacgacaatctgtag

SEQ ID NO: 16748 - DNA, 18 bp, synthetic construct
  source 1..18: mol_type = other DNA
taatacgacacagaaaag

SEQ ID NO: 16749 - DNA, 18 bp, synthetic construct
  source 1..18: mol_type = other DNA
taatacgacactgtttag

SEQ ID NO: 16750 - DNA, 18 bp, synthetic construct
  source 1..18: mol_type = other DNA
taatacgacagactaagg

SEQ ID NO: 16751 - DNA, 18 bp, synthetic construct
  source 1..18: mol_type = other DNA
taatacgacagtccatag

SEQ ID NO: 16752 - DNA, 18 bp, synthetic construct
  source 1..18: mol_type = other DNA
taatacgaccaataatag

SEQ ID NO: 16753 - DNA, 18 bp, synthetic construct
  source 1..18: mol_type = other DNA
taatacgacccaccttgg

SEQ ID NO: 16754 - DNA, 18 bp, synthetic construct
  source 1..18: mol_type = other DNA
taatacgaccctatacag

SEQ ID NO: 16755 - DNA, 18 bp, synthetic construct
  source 1..18: mol_type = other DNA
taatacgacgaacttaag

SEQ ID NO: 16756 - DNA, 18 bp, synthetic construct
  source 1..18: mol_type = other DNA
taatacgacgccgtgtag

SEQ ID NO: 16757 - DNA, 18 bp, synthetic construct
  source 1..18: mol_type = other DNA
taatacgactaacactgg

SEQ ID NO: 16758 - DNA, 18 bp, synthetic construct
  source 1..18: mol_type = other DNA
taatacgactacccaaag

SEQ ID NO: 16759 - DNA, 18 bp, synthetic construct
  source 1..18: mol_type = other DNA
taatacgactatccttag

SEQ ID NO: 16760 - DNA, 18 bp, synthetic construct
  source 1..18: mol_type = other DNA
taatacgactctatccag

SEQ ID NO: 16761 - DNA, 18 bp, synthetic construct
  source 1..18: mol_type = other DNA
taatacgactctccaccg

SEQ ID NO: 16762 - DNA, 18 bp, synthetic construct
  source 1..18: mol_type = other DNA
taatacgactgaatgtaa

SEQ ID NO: 16763 - DNA, 18 bp, synthetic construct
  source 1..18: mol_type = other DNA
taatacgacttatcaaag

SEQ ID NO: 16764 - DNA, 18 bp, synthetic construct
  source 1..18: mol_type = other DNA
taatacgagaaattatag

SEQ ID NO: 16765 - DNA, 18 bp, synthetic construct
  source 1..18: mol_type = other DNA
taatacgagcctctaaag

SEQ ID NO: 16766 - DNA, 18 bp, synthetic construct
  source 1..18: mol_type = other DNA
taatacgaggcattacag

SEQ ID NO: 16767 - DNA, 18 bp, synthetic construct
  source 1..18: mol_type = other DNA
taatacgagtcaggatcg

SEQ ID NO: 16768 - DNA, 18 bp, synthetic construct
  source 1..18: mol_type = other DNA
taatacgatacacttcag

SEQ ID NO: 16769 - DNA, 18 bp, synthetic construct
  source 1..18: mol_type = other DNA
taatacgatgacctatag

SEQ ID NO: 16770 - DNA, 18 bp, synthetic construct
  source 1..18: mol_type = other DNA
taatacgattcaatagcg

SEQ ID NO: 16771 - DNA, 18 bp, synthetic construct
  source 1..18: mol_type = other DNA
taatacgcatcacaacag

SEQ ID NO: 16772 - DNA, 18 bp, synthetic construct
  source 1..18: mol_type = other DNA
taatacgccacataatag

SEQ ID NO: 16773 - DNA, 18 bp, synthetic construct
  source 1..18: mol_type = other DNA
taatacgccactctatgg

SEQ ID NO: 16774 - DNA, 18 bp, synthetic construct
  source 1..18: mol_type = other DNA
taatacgcccaaatatag

SEQ ID NO: 16775 - DNA, 18 bp, synthetic construct
  source 1..18: mol_type = other DNA
taatacgcctacctaaag

SEQ ID NO: 16776 - DNA, 18 bp, synthetic construct
  source 1..18: mol_type = other DNA
taatacgcctgacttcag

SEQ ID NO: 16777 - DNA, 18 bp, synthetic construct
  source 1..18: mol_type = other DNA
taatacgccttatcatag

SEQ ID NO: 16778 - DNA, 18 bp, synthetic construct
  source 1..18: mol_type = other DNA
taatacggctaagtacag

SEQ ID NO: 16779 - DNA, 18 bp, synthetic construct
  source 1..18: mol_type = other DNA
taatacggttaactaaag

SEQ ID NO: 16780 - DNA, 18 bp, synthetic construct
  source 1..18: mol_type = other DNA
taatacggttctctgtag

SEQ ID NO: 16781 - DNA, 18 bp, synthetic construct
  source 1..18: mol_type = other DNA
taatacggtttattatag

SEQ ID NO: 16782 - DNA, 18 bp, synthetic construct
  source 1..18: mol_type = other DNA
taatacgtcccaaaatag

SEQ ID NO: 16783 - DNA, 18 bp, synthetic construct
  source 1..18: mol_type = other DNA
taatacgtcccaacatag

SEQ ID NO: 16784 - DNA, 18 bp, synthetic construct
  source 1..18: mol_type = other DNA
taatacgtcccagtatcg

SEQ ID NO: 16785 - DNA, 18 bp, synthetic construct
  source 1..18: mol_type = other DNA
taatacgtcgctatatag

SEQ ID NO: 16786 - DNA, 18 bp, synthetic construct
  source 1..18: mol_type = other DNA
taatacgtctcaaaatcg

SEQ ID NO: 16787 - DNA, 18 bp, synthetic construct
  source 1..18: mol_type = other DNA
taatacgtctcacccaag

SEQ ID NO: 16788 - DNA, 18 bp, synthetic construct
  source 1..18: mol_type = other DNA
taatacgtctccatatcg

SEQ ID NO: 16789 - DNA, 18 bp, synthetic construct
  source 1..18: mol_type = other DNA
taatacgtctccctttcg

SEQ ID NO: 16790 - DNA, 18 bp, synthetic construct
  source 1..18: mol_type = other DNA
taatacgtctccttgtag

SEQ ID NO: 16791 - DNA, 18 bp, synthetic construct
  source 1..18: mol_type = other DNA
taatacgtctgaatgtag

SEQ ID NO: 16792 - DNA, 18 bp, synthetic construct
  source 1..18: mol_type = other DNA
taatacgtctgaccagag

SEQ ID NO: 16793 - DNA, 18 bp, synthetic construct
  source 1..18: mol_type = other DNA
taatacgtcttaatctag

SEQ ID NO: 16794 - DNA, 18 bp, synthetic construct
  source 1..18: mol_type = other DNA
taatacgtgccattatag

SEQ ID NO: 16795 - DNA, 18 bp, synthetic construct
  source 1..18: mol_type = other DNA
taatacgtgtaactaaag

SEQ ID NO: 16796 - DNA, 18 bp, synthetic construct
  source 1..18: mol_type = other DNA
taatacgtttctgtatag

SEQ ID NO: 16797 - DNA, 18 bp, synthetic construct
  source 1..18: mol_type = other DNA
taatacgtttgaccatag

SEQ ID NO: 16798 - DNA, 18 bp, synthetic construct
  source 1..18: mol_type = other DNA
taatactaaacaccatag

SEQ ID NO: 16799 - DNA, 18 bp, synthetic construct
  source 1..18: mol_type = other DNA
taatactacacactagcg

SEQ ID NO: 16800 - DNA, 18 bp, synthetic construct
  source 1..18: mol_type = other DNA
taatactactcaataacg

SEQ ID NO: 16801 - DNA, 18 bp, synthetic construct
  source 1..18: mol_type = other DNA
taatactactcaccctgg

SEQ ID NO: 16802 - DNA, 18 bp, synthetic construct
  source 1..18: mol_type = other DNA
taatactactcccactag

SEQ ID NO: 16803 - DNA, 18 bp, synthetic construct
  source 1..18: mol_type = other DNA
taatactactgacattag

SEQ ID NO: 16804 - DNA, 18 bp, synthetic construct
  source 1..18: mol_type = other DNA
taatactacttaatatcg

SEQ ID NO: 16805 - DNA, 18 bp, synthetic construct
  source 1..18: mol_type = other DNA
taatactacttactaacg

SEQ ID NO: 16806 - DNA, 18 bp, synthetic construct
  source 1..18: mol_type = other DNA
taatactacttactcaag

SEQ ID NO: 16807 - DNA, 18 bp, synthetic construct
  source 1..18: mol_type = other DNA
taatactattccctatgg

SEQ ID NO: 16808 - DNA, 18 bp, synthetic construct
  source 1..18: mol_type = other DNA
taatactcctccttatag

SEQ ID NO: 16809 - DNA, 18 bp, synthetic construct
  source 1..18: mol_type = other DNA
taatactcttcactgtag

SEQ ID NO: 16810 - DNA, 18 bp, synthetic construct
  source 1..18: mol_type = other DNA
taatactgctcaccaaag

SEQ ID NO: 16811 - DNA, 18 bp, synthetic construct
  source 1..18: mol_type = other DNA
taatactggccactatag

SEQ ID NO: 16812 - DNA, 18 bp, synthetic construct
  source 1..18: mol_type = other DNA
taatacttgtcactatgg

SEQ ID NO: 16813 - DNA, 18 bp, synthetic construct
  source 1..18: mol_type = other DNA
taatagaactcagtaaag

SEQ ID NO: 16814 - DNA, 18 bp, synthetic construct
  source 1..18: mol_type = other DNA
taatagaattcacaatag

SEQ ID NO: 16815 - DNA, 18 bp, synthetic construct
  source 1..18: mol_type = other DNA
taatagaattcactaaag

SEQ ID NO: 16816 - DNA, 18 bp, synthetic construct
  source 1..18: mol_type = other DNA
taatagcactaaccatag

SEQ ID NO: 16817 - DNA, 18 bp, synthetic construct
  source 1..18: mol_type = other DNA
taatagcactaactttag

SEQ ID NO: 16818 - DNA, 18 bp, synthetic construct
  source 1..18: mol_type = other DNA
taatagcactccttatag

SEQ ID NO: 16819 - DNA, 18 bp, synthetic construct
  source 1..18: mol_type = other DNA
taataggaagcactttag

SEQ ID NO: 16820 - DNA, 18 bp, synthetic construct
  source 1..18: mol_type = other DNA
taataggacactccatag

SEQ ID NO: 16821 - DNA, 18 bp, synthetic construct
  source 1..18: mol_type = other DNA
taataggaccgactttag

SEQ ID NO: 16822 - DNA, 18 bp, synthetic construct
  source 1..18: mol_type = other DNA
taataggactaattagag

SEQ ID NO: 16823 - DNA, 18 bp, synthetic construct
  source 1..18: mol_type = other DNA
taataggactcaatgcag

SEQ ID NO: 16824 - DNA, 18 bp, synthetic construct
  source 1..18: mol_type = other DNA
taataggactctttatgg

SEQ ID NO: 16825 - DNA, 18 bp, synthetic construct
  source 1..18: mol_type = other DNA
taataggtctcaatacag

SEQ ID NO: 16826 - DNA, 18 bp, synthetic construct
  source 1..18: mol_type = other DNA
taataggtgtcattatag

SEQ ID NO: 16827 - DNA, 18 bp, synthetic construct
  source 1..18: mol_type = other DNA
taataggtttcagtatag

SEQ ID NO: 16828 - DNA, 18 bp, synthetic construct
  source 1..18: mol_type = other DNA
taatagtactaactatgg

SEQ ID NO: 16829 - DNA, 18 bp, synthetic construct
  source 1..18: mol_type = other DNA
taatataactcagtctag

SEQ ID NO: 16830 - DNA, 18 bp, synthetic construct
  source 1..18: mol_type = other DNA
taatataactctgtatag

SEQ ID NO: 16831 - DNA, 18 bp, synthetic construct
  source 1..18: mol_type = other DNA
taatataactgactctag

SEQ ID NO: 16832 - DNA, 18 bp, synthetic construct
  source 1..18: mol_type = other DNA
taatatcactgactatgg

SEQ ID NO: 16833 - DNA, 18 bp, synthetic construct
  source 1..18: mol_type = other DNA
taatatccctgactatag

SEQ ID NO: 16834 - DNA, 18 bp, synthetic construct
  source 1..18: mol_type = other DNA
taatatctctcactacag

SEQ ID NO: 16835 - DNA, 18 bp, synthetic construct
  source 1..18: mol_type = other DNA
taatatgactcaccagcg

SEQ ID NO: 16836 - DNA, 18 bp, synthetic construct
  source 1..18: mol_type = other DNA
taatatgactcactcccg

SEQ ID NO: 16837 - DNA, 18 bp, synthetic construct
  source 1..18: mol_type = other DNA
taatatgactccatctag

SEQ ID NO: 16838 - DNA, 18 bp, synthetic construct
  source 1..18: mol_type = other DNA
taatatgactctttatgg

SEQ ID NO: 16839 - DNA, 18 bp, synthetic construct
  source 1..18: mol_type = other DNA
taatatgagtcaataaag

SEQ ID NO: 16840 - DNA, 18 bp, synthetic construct
  source 1..18: mol_type = other DNA
taatatgattcaatatcg

SEQ ID NO: 16841 - DNA, 18 bp, synthetic construct
  source 1..18: mol_type = other DNA
taatatgattcagtttag

SEQ ID NO: 16842 - DNA, 18 bp, synthetic construct
  source 1..18: mol_type = other DNA
taatatgattccctttag

SEQ ID NO: 16843 - DNA, 18 bp, synthetic construct
  source 1..18: mol_type = other DNA
taatatgcctccttatag

SEQ ID NO: 16844 - DNA, 18 bp, synthetic construct
  source 1..18: mol_type = other DNA
taatatgcctctcaatag

SEQ ID NO: 16845 - DNA, 18 bp, synthetic construct
  source 1..18: mol_type = other DNA
taatattactaactttag

SEQ ID NO: 16846 - DNA, 18 bp, synthetic construct
  source 1..18: mol_type = other DNA
taatcaaactcactttag

SEQ ID NO: 16847 - DNA, 18 bp, synthetic construct
  source 1..18: mol_type = other DNA
taatcagacgcactacag

SEQ ID NO: 16848 - DNA, 18 bp, synthetic construct
  source 1..18: mol_type = other DNA
taatccaactcaccagag

SEQ ID NO: 16849 - DNA, 18 bp, synthetic construct
  source 1..18: mol_type = other DNA
taatccaactccatatag

SEQ ID NO: 16850 - DNA, 18 bp, synthetic construct
  source 1..18: mol_type = other DNA
taatccgacactctatgg

SEQ ID NO: 16851 - DNA, 18 bp, synthetic construct
  source 1..18: mol_type = other DNA
taatccgacagactttag

SEQ ID NO: 16852 - DNA, 18 bp, synthetic construct
  source 1..18: mol_type = other DNA
taatccgacataccatag

SEQ ID NO: 16853 - DNA, 18 bp, synthetic construct
  source 1..18: mol_type = other DNA
taatccgacgcataatag

SEQ ID NO: 16854 - DNA, 18 bp, synthetic construct
  source 1..18: mol_type = other DNA
taatccgactctgcatag

SEQ ID NO: 16855 - DNA, 18 bp, synthetic construct
  source 1..18: mol_type = other DNA
taatccgcatcactttag

SEQ ID NO: 16856 - DNA, 18 bp, synthetic construct
  source 1..18: mol_type = other DNA
taatccgcctcaaaatag

SEQ ID NO: 16857 - DNA, 18 bp, synthetic construct
  source 1..18: mol_type = other DNA
taatccgcctcacaatcg

SEQ ID NO: 16858 - DNA, 18 bp, synthetic construct
  source 1..18: mol_type = other DNA
taatccgtctcaatctag

SEQ ID NO: 16859 - DNA, 18 bp, synthetic construct
  source 1..18: mol_type = other DNA
taatcctactctgtatag

SEQ ID NO: 16860 - DNA, 18 bp, synthetic construct
  source 1..18: mol_type = other DNA
taatctgactaacaatag

SEQ ID NO: 16861 - DNA, 18 bp, synthetic construct
  source 1..18: mol_type = other DNA
taatctgactcactaacg

SEQ ID NO: 16862 - DNA, 18 bp, synthetic construct
  source 1..18: mol_type = other DNA
taatcttactcactacag

SEQ ID NO: 16863 - DNA, 18 bp, synthetic construct
  source 1..18: mol_type = other DNA
taatgagacacaccatag

SEQ ID NO: 16864 - DNA, 18 bp, synthetic construct
  source 1..18: mol_type = other DNA
taatgagcctcattatag

SEQ ID NO: 16865 - DNA, 18 bp, synthetic construct
  source 1..18: mol_type = other DNA
taatgcaactcacactag

SEQ ID NO: 16866 - DNA, 18 bp, synthetic construct
  source 1..18: mol_type = other DNA
taatgccattcagtatag

SEQ ID NO: 16867 - DNA, 18 bp, synthetic construct
  source 1..18: mol_type = other DNA
taatgcgactctcactag

SEQ ID NO: 16868 - DNA, 18 bp, synthetic construct
  source 1..18: mol_type = other DNA
taatgcgacttaatacag

SEQ ID NO: 16869 - DNA, 18 bp, synthetic construct
  source 1..18: mol_type = other DNA
taatgcgagtccctctag

SEQ ID NO: 16870 - DNA, 18 bp, synthetic construct
  source 1..18: mol_type = other DNA
taatgcgcctcactaacg

SEQ ID NO: 16871 - DNA, 18 bp, synthetic construct
  source 1..18: mol_type = other DNA
taatgcgcctccctatgg

SEQ ID NO: 16872 - DNA, 18 bp, synthetic construct
  source 1..18: mol_type = other DNA
taatgcggcgcactatgg

SEQ ID NO: 16873 - DNA, 18 bp, synthetic construct
  source 1..18: mol_type = other DNA
taatgcgtcacattatag

SEQ ID NO: 16874 - DNA, 18 bp, synthetic construct
  source 1..18: mol_type = other DNA
taatgcgtctaactaaag

SEQ ID NO: 16875 - DNA, 18 bp, synthetic construct
  source 1..18: mol_type = other DNA
taatgcgtctcactcaag

SEQ ID NO: 16876 - DNA, 18 bp, synthetic construct
  source 1..18: mol_type = other DNA
taatgctacacattatag

SEQ ID NO: 16877 - DNA, 18 bp, synthetic construct
  source 1..18: mol_type = other DNA
taatgggacgcaccatag

SEQ ID NO: 16878 - DNA, 18 bp, synthetic construct
  source 1..18: mol_type = other DNA
taatgggactcacactag

SEQ ID NO: 16879 - DNA, 18 bp, synthetic construct
  source 1..18: mol_type = other DNA
taatgggactcattgtag

SEQ ID NO: 16880 - DNA, 18 bp, synthetic construct
  source 1..18: mol_type = other DNA
taatgtgacatactatag

SEQ ID NO: 16881 - DNA, 18 bp, synthetic construct
  source 1..18: mol_type = other DNA
taatgtgactctctagag

SEQ ID NO: 16882 - DNA, 18 bp, synthetic construct
  source 1..18: mol_type = other DNA
taatgtgattcacaatag

SEQ ID NO: 16883 - DNA, 18 bp, synthetic construct
  source 1..18: mol_type = other DNA
taatgttactaactatag

SEQ ID NO: 16884 - DNA, 18 bp, synthetic construct
  source 1..18: mol_type = other DNA
tacaacgactctctgtag

SEQ ID NO: 16885 - DNA, 18 bp, synthetic construct
  source 1..18: mol_type = other DNA
tacaacgagtcacaatag

SEQ ID NO: 16886 - DNA, 18 bp, synthetic construct
  source 1..18: mol_type = other DNA
tacagcgactcacaatag

SEQ ID NO: 16887 - DNA, 18 bp, synthetic construct
  source 1..18: mol_type = other DNA
tacagcgactcactacag

SEQ ID NO: 16888 - DNA, 18 bp, synthetic construct
  source 1..18: mol_type = other DNA
taccacgactctttatag

SEQ ID NO: 16889 - DNA, 18 bp, synthetic construct
  source 1..18: mol_type = other DNA
taccacggctcacaatag

SEQ ID NO: 16890 - DNA, 18 bp, synthetic construct
  source 1..18: mol_type = other DNA
tactaagacacaatatag

SEQ ID NO: 16891 - DNA, 18 bp, synthetic construct
  source 1..18: mol_type = other DNA
tactaagactcactctcg

SEQ ID NO: 16892 - DNA, 18 bp, synthetic construct
  source 1..18: mol_type = other DNA
tactacaacacaccatag

SEQ ID NO: 16893 - DNA, 18 bp, synthetic construct
  source 1..18: mol_type = other DNA
tactacaactcaacatag

SEQ ID NO: 16894 - DNA, 18 bp, synthetic construct
  source 1..18: mol_type = other DNA
tactacaagacactatag

SEQ ID NO: 16895 - DNA, 18 bp, synthetic construct
  source 1..18: mol_type = other DNA
tactacaattcagtatag

SEQ ID NO: 16896 - DNA, 18 bp, synthetic construct
  source 1..18: mol_type = other DNA
tactaccacccactacag

SEQ ID NO: 16897 - DNA, 18 bp, synthetic construct
  source 1..18: mol_type = other DNA
tactaccactacctatag

SEQ ID NO: 16898 - DNA, 18 bp, synthetic construct
  source 1..18: mol_type = other DNA
tactaccactcacaacag

SEQ ID NO: 16899 - DNA, 18 bp, synthetic construct
  source 1..18: mol_type = other DNA
tactacctctcaatatag

SEQ ID NO: 16900 - DNA, 18 bp, synthetic construct
  source 1..18: mol_type = other DNA
tactacgaatcattctag

SEQ ID NO: 16901 - DNA, 18 bp, synthetic construct
  source 1..18: mol_type = other DNA
tactacgacgcacattag

SEQ ID NO: 16902 - DNA, 18 bp, synthetic construct
  source 1..18: mol_type = other DNA
tactacgagacactttag

SEQ ID NO: 16903 - DNA, 18 bp, synthetic construct
  source 1..18: mol_type = other DNA
tactacgatccactctag

SEQ ID NO: 16904 - DNA, 18 bp, synthetic construct
  source 1..18: mol_type = other DNA
tactacggctcaatctag

SEQ ID NO: 16905 - DNA, 18 bp, synthetic construct
  source 1..18: mol_type = other DNA
tactacgtatcaccatag

SEQ ID NO: 16906 - DNA, 18 bp, synthetic construct
  source 1..18: mol_type = other DNA
tactacgtctcaacatag

SEQ ID NO: 16907 - DNA, 18 bp, synthetic construct
  source 1..18: mol_type = other DNA
tactacgtctcacattag

SEQ ID NO: 16908 - DNA, 18 bp, synthetic construct
  source 1..18: mol_type = other DNA
tactacgtctcactagcg

SEQ ID NO: 16909 - DNA, 18 bp, synthetic construct
  source 1..18: mol_type = other DNA
tactactacacaccatag

SEQ ID NO: 16910 - DNA, 18 bp, synthetic construct
  source 1..18: mol_type = other DNA
tactacttctcacgatag

SEQ ID NO: 16911 - DNA, 18 bp, synthetic construct
  source 1..18: mol_type = other DNA
tactaggactcacagtag

SEQ ID NO: 16912 - DNA, 18 bp, synthetic construct
  source 1..18: mol_type = other DNA
tactaggactcacttcag

SEQ ID NO: 16913 - DNA, 18 bp, synthetic construct
  source 1..18: mol_type = other DNA
tactatgactaagtatag

SEQ ID NO: 16914 - DNA, 18 bp, synthetic construct
  source 1..18: mol_type = other DNA
tactatggctcagtatag

SEQ ID NO: 16915 - DNA, 18 bp, synthetic construct
  source 1..18: mol_type = other DNA
tactccaactccctatag

SEQ ID NO: 16916 - DNA, 18 bp, synthetic construct
  source 1..18: mol_type = other DNA
tactcggactcactaaag

SEQ ID NO: 16917 - DNA, 18 bp, synthetic construct
  source 1..18: mol_type = other DNA
tactgccacacactatag

SEQ ID NO: 16918 - DNA, 18 bp, synthetic construct
  source 1..18: mol_type = other DNA
tactgcgactaaatatag

SEQ ID NO: 16919 - DNA, 18 bp, synthetic construct
  source 1..18: mol_type = other DNA
tagaactacacactatag

SEQ ID NO: 16920 - DNA, 18 bp, synthetic construct
  source 1..18: mol_type = other DNA
tagcgcgactcaatatag

SEQ ID NO: 16921 - DNA, 18 bp, synthetic construct
  source 1..18: mol_type = other DNA
taggacgccacactatag

SEQ ID NO: 16922 - DNA, 18 bp, synthetic construct
  source 1..18: mol_type = other DNA
taggaggactaactatag

SEQ ID NO: 16923 - DNA, 18 bp, synthetic construct
  source 1..18: mol_type = other DNA
tagtaagaccctctatag

SEQ ID NO: 16924 - DNA, 18 bp, synthetic construct
  source 1..18: mol_type = other DNA
tagtaagagtcactttag

SEQ ID NO: 16925 - DNA, 18 bp, synthetic construct
  source 1..18: mol_type = other DNA
tagtaagcctctctatag

SEQ ID NO: 16926 - DNA, 18 bp, synthetic construct
  source 1..18: mol_type = other DNA
tagtacgaatcacattag

SEQ ID NO: 16927 - DNA, 18 bp, synthetic construct
  source 1..18: mol_type = other DNA
tagtacgaatttctatag

SEQ ID NO: 16928 - DNA, 18 bp, synthetic construct
  source 1..18: mol_type = other DNA
tagtacgactaacttcag

SEQ ID NO: 16929 - DNA, 18 bp, synthetic construct
  source 1..18: mol_type = other DNA
tagtacgactaattctag

SEQ ID NO: 16930 - DNA, 18 bp, synthetic construct
  source 1..18: mol_type = other DNA
tagtacgactcacccgag

SEQ ID NO: 16931 - DNA, 18 bp, synthetic construct
  source 1..18: mol_type = other DNA
tagtacgactgaatacag

SEQ ID NO: 16932 - DNA, 18 bp, synthetic construct
  source 1..18: mol_type = other DNA
tagtacgagccactacag

SEQ ID NO: 16933 - DNA, 18 bp, synthetic construct
  source 1..18: mol_type = other DNA
tagtacgatgcattatag

SEQ ID NO: 16934 - DNA, 18 bp, synthetic construct
  source 1..18: mol_type = other DNA
tagtacgcctcagtatgg

SEQ ID NO: 16935 - DNA, 18 bp, synthetic construct
  source 1..18: mol_type = other DNA
tagtacgtatcactgtag

SEQ ID NO: 16936 - DNA, 18 bp, synthetic construct
  source 1..18: mol_type = other DNA
tagtacgtctaactaaag

SEQ ID NO: 16937 - DNA, 18 bp, synthetic construct
  source 1..18: mol_type = other DNA
tagtagacctcactatag

SEQ ID NO: 16938 - DNA, 18 bp, synthetic construct
  source 1..18: mol_type = other DNA
tagtccgactcattttag

SEQ ID NO: 16939 - DNA, 18 bp, synthetic construct
  source 1..18: mol_type = other DNA
tagtgcgacccactaaag

SEQ ID NO: 16940 - DNA, 18 bp, synthetic construct
  source 1..18: mol_type = other DNA
tagtgcgtctaactatag

SEQ ID NO: 16941 - DNA, 18 bp, synthetic construct
  source 1..18: mol_type = other DNA
tataacaactccctatag

SEQ ID NO: 16942 - DNA, 18 bp, synthetic construct
  source 1..18: mol_type = other DNA
tataacgactcaccatcg

SEQ ID NO: 16943 - DNA, 18 bp, synthetic construct
  source 1..18: mol_type = other DNA
tataatgactgactatag

SEQ ID NO: 16944 - DNA, 18 bp, synthetic construct
  source 1..18: mol_type = other DNA
tataccgcctcactatag

SEQ ID NO: 16945 - DNA, 18 bp, synthetic construct
  source 1..18: mol_type = other DNA
tatcaagacgcactatag

SEQ ID NO: 16946 - DNA, 18 bp, synthetic construct
  source 1..18: mol_type = other DNA
tatcacgacacactatgg

SEQ ID NO: 16947 - DNA, 18 bp, synthetic construct
  source 1..18: mol_type = other DNA
tatcacgactaactatcg

SEQ ID NO: 16948 - DNA, 18 bp, synthetic construct
  source 1..18: mol_type = other DNA
tatcacgattcagtatag

SEQ ID NO: 16949 - DNA, 18 bp, synthetic construct
  source 1..18: mol_type = other DNA
tatcactactcattatag

SEQ ID NO: 16950 - DNA, 18 bp, synthetic construct
  source 1..18: mol_type = other DNA
tatcgcaactcactatag

SEQ ID NO: 16951 - DNA, 18 bp, synthetic construct
  source 1..18: mol_type = other DNA
tatgacaactcactatcg

SEQ ID NO: 16952 - DNA, 18 bp, synthetic construct
  source 1..18: mol_type = other DNA
tatgacgactcaccacag

SEQ ID NO: 16953 - DNA, 18 bp, synthetic construct
  source 1..18: mol_type = other DNA
tatggagactcactatag

SEQ ID NO: 16954 - DNA, 18 bp, synthetic construct
  source 1..18: mol_type = other DNA
tattaacactccctatag

SEQ ID NO: 16955 - DNA, 18 bp, synthetic construct
  source 1..18: mol_type = other DNA
tattaacgctcactatag

SEQ ID NO: 16956 - DNA, 18 bp, synthetic construct
  source 1..18: mol_type = other DNA
tattaagactcagaatag

SEQ ID NO: 16957 - DNA, 18 bp, synthetic construct
  source 1..18: mol_type = other DNA
tattaagcctgactatag

SEQ ID NO: 16958 - DNA, 18 bp, synthetic construct
  source 1..18: mol_type = other DNA
tattacaactcaatatgg

SEQ ID NO: 16959 - DNA, 18 bp, synthetic construct
  source 1..18: mol_type = other DNA
tattacacctcactacag

SEQ ID NO: 16960 - DNA, 18 bp, synthetic construct
  source 1..18: mol_type = other DNA
tattaccaatcactatcg

SEQ ID NO: 16961 - DNA, 18 bp, synthetic construct
  source 1..18: mol_type = other DNA
tattaccactaactgtag

SEQ ID NO: 16962 - DNA, 18 bp, synthetic construct
  source 1..18: mol_type = other DNA
tattaccacttagtatag

SEQ ID NO: 16963 - DNA, 18 bp, synthetic construct
  source 1..18: mol_type = other DNA
tattacgaacaactatag

SEQ ID NO: 16964 - DNA, 18 bp, synthetic construct
  source 1..18: mol_type = other DNA
tattacgaagcactgtag

SEQ ID NO: 16965 - DNA, 18 bp, synthetic construct
  source 1..18: mol_type = other DNA
tattacgaatcaccatcg

SEQ ID NO: 16966 - DNA, 18 bp, synthetic construct
  source 1..18: mol_type = other DNA
tattacgaatccgtatag

SEQ ID NO: 16967 - DNA, 18 bp, synthetic construct
  source 1..18: mol_type = other DNA
tattacgacagactctag

SEQ ID NO: 16968 - DNA, 18 bp, synthetic construct
  source 1..18: mol_type = other DNA
tattacgacatactatgg

SEQ ID NO: 16969 - DNA, 18 bp, synthetic construct
  source 1..18: mol_type = other DNA
tattacgacgcactgaag

SEQ ID NO: 16970 - DNA, 18 bp, synthetic construct
  source 1..18: mol_type = other DNA
tattacgactatctatcg

SEQ ID NO: 16971 - DNA, 18 bp, synthetic construct
  source 1..18: mol_type = other DNA
tattacgactccctgtcg

SEQ ID NO: 16972 - DNA, 18 bp, synthetic construct
  source 1..18: mol_type = other DNA
tattacgactctcagtag

SEQ ID NO: 16973 - DNA, 18 bp, synthetic construct
  source 1..18: mol_type = other DNA
tattacgactgacactag

SEQ ID NO: 16974 - DNA, 18 bp, synthetic construct
  source 1..18: mol_type = other DNA
tattacgagttactagag

SEQ ID NO: 16975 - DNA, 18 bp, synthetic construct
  source 1..18: mol_type = other DNA
tattacgcccctctatag

SEQ ID NO: 16976 - DNA, 18 bp, synthetic construct
  source 1..18: mol_type = other DNA
tattacgccttactagag

SEQ ID NO: 16977 - DNA, 18 bp, synthetic construct
  source 1..18: mol_type = other DNA
tattacggctcaatgtag

SEQ ID NO: 16978 - DNA, 18 bp, synthetic construct
  source 1..18: mol_type = other DNA
tattacgtctcactctcg

SEQ ID NO: 16979 - DNA, 18 bp, synthetic construct
  source 1..18: mol_type = other DNA
tattacgtctcattacag

SEQ ID NO: 16980 - DNA, 18 bp, synthetic construct
  source 1..18: mol_type = other DNA
tattactactcaccacag

SEQ ID NO: 16981 - DNA, 18 bp, synthetic construct
  source 1..18: mol_type = other DNA
tattactactcactttcg

SEQ ID NO: 16982 - DNA, 18 bp, synthetic construct
  source 1..18: mol_type = other DNA
tattactagtcagtatag

SEQ ID NO: 16983 - DNA, 18 bp, synthetic construct
  source 1..18: mol_type = other DNA
tattaggaccccctatag

SEQ ID NO: 16984 - DNA, 18 bp, synthetic construct
  source 1..18: mol_type = other DNA
tattaggactcacggtag

SEQ ID NO: 16985 - DNA, 18 bp, synthetic construct
  source 1..18: mol_type = other DNA
tattaggactcattatcg

SEQ ID NO: 16986 - DNA, 18 bp, synthetic construct
  source 1..18: mol_type = other DNA
tattaggcctcactctag

SEQ ID NO: 16987 - DNA, 18 bp, synthetic construct
  source 1..18: mol_type = other DNA
tattatgacgctctatag

SEQ ID NO: 16988 - DNA, 18 bp, synthetic construct
  source 1..18: mol_type = other DNA
tattatgactcaatgtag

SEQ ID NO: 16989 - DNA, 18 bp, synthetic construct
  source 1..18: mol_type = other DNA
tattatgactcactgtcg

SEQ ID NO: 16990 - DNA, 18 bp, synthetic construct
  source 1..18: mol_type = other DNA
tattatggcccactatag

SEQ ID NO: 16991 - DNA, 18 bp, synthetic construct
  source 1..18: mol_type = other DNA
tattatggctcactgtag

SEQ ID NO: 16992 - DNA, 18 bp, synthetic construct
  source 1..18: mol_type = other DNA
tattccccctcactatag

SEQ ID NO: 16993 - DNA, 18 bp, synthetic construct
  source 1..18: mol_type = other DNA
tattccgactcaccctag

SEQ ID NO: 16994 - DNA, 18 bp, synthetic construct
  source 1..18: mol_type = other DNA
tattcggaatcactatag

SEQ ID NO: 16995 - DNA, 18 bp, synthetic construct
  source 1..18: mol_type = other DNA
tattgagacccactatag

SEQ ID NO: 16996 - DNA, 18 bp, synthetic construct
  source 1..18: mol_type = other DNA
tattgagactcactacag

SEQ ID NO: 16997 - DNA, 18 bp, synthetic construct
  source 1..18: mol_type = other DNA
tattgctactcactctag

SEQ ID NO: 16998 - DNA, 18 bp, synthetic construct
  source 1..18: mol_type = other DNA
tcaaaccactcactacag

SEQ ID NO: 16999 - DNA, 18 bp, synthetic construct
  source 1..18: mol_type = other DNA
tcaaacgcatcactatag

SEQ ID NO: 17000 - DNA, 18 bp, synthetic construct
  source 1..18: mol_type = other DNA
tcaaaggactcactatcg

SEQ ID NO: 17001 - DNA, 18 bp, synthetic construct
  source 1..18: mol_type = other DNA
tcaaccgactcactacag

SEQ ID NO: 17002 - DNA, 18 bp, synthetic construct
  source 1..18: mol_type = other DNA
tcacacgacactctatag

SEQ ID NO: 17003 - DNA, 18 bp, synthetic construct
  source 1..18: mol_type = other DNA
tcacacgactcactttgg

SEQ ID NO: 17004 - DNA, 18 bp, synthetic construct
  source 1..18: mol_type = other DNA
tcagaccacttactatag

SEQ ID NO: 17005 - DNA, 18 bp, synthetic construct
  source 1..18: mol_type = other DNA
tcagccgactcactatgg

SEQ ID NO: 17006 - DNA, 18 bp, synthetic construct
  source 1..18: mol_type = other DNA
tcataatactcacaatag

SEQ ID NO: 17007 - DNA, 18 bp, synthetic construct
  source 1..18: mol_type = other DNA
tcataatactctctatag

SEQ ID NO: 17008 - DNA, 18 bp, synthetic construct
  source 1..18: mol_type = other DNA
tcatacaagtcaatatag

SEQ ID NO: 17009 - DNA, 18 bp, synthetic construct
  source 1..18: mol_type = other DNA
tcataccacacactaaag

SEQ ID NO: 17010 - DNA, 18 bp, synthetic construct
  source 1..18: mol_type = other DNA
tcataccactcacaaaag

SEQ ID NO: 17011 - DNA, 18 bp, synthetic construct
  source 1..18: mol_type = other DNA
tcatacctctcactgtag

SEQ ID NO: 17012 - DNA, 18 bp, synthetic construct
  source 1..18: mol_type = other DNA
tcatacgactatctaaag

SEQ ID NO: 17013 - DNA, 18 bp, synthetic construct
  source 1..18: mol_type = other DNA
tcatacgagtcattgtag

SEQ ID NO: 17014 - DNA, 18 bp, synthetic construct
  source 1..18: mol_type = other DNA
tcatacggcccactatcg

SEQ ID NO: 17015 - DNA, 18 bp, synthetic construct
  source 1..18: mol_type = other DNA
tcatacggctctctatgg

SEQ ID NO: 17016 - DNA, 18 bp, synthetic construct
  source 1..18: mol_type = other DNA
tcatacgtatcacaatag

SEQ ID NO: 17017 - DNA, 18 bp, synthetic construct
  source 1..18: mol_type = other DNA
tcatacgtctcactttcg

SEQ ID NO: 17018 - DNA, 18 bp, synthetic construct
  source 1..18: mol_type = other DNA
tcatactacccactttag

SEQ ID NO: 17019 - DNA, 18 bp, synthetic construct
  source 1..18: mol_type = other DNA
tcatactattcaatatag

SEQ ID NO: 17020 - DNA, 18 bp, synthetic construct
  source 1..18: mol_type = other DNA
tcataggactgtctatag

SEQ ID NO: 17021 - DNA, 18 bp, synthetic construct
  source 1..18: mol_type = other DNA
tcatatgtatcactatag

SEQ ID NO: 17022 - DNA, 18 bp, synthetic construct
  source 1..18: mol_type = other DNA
tcatccgacatactatag

SEQ ID NO: 17023 - DNA, 18 bp, synthetic construct
  source 1..18: mol_type = other DNA
tcatccgaccctctatag

SEQ ID NO: 17024 - DNA, 18 bp, synthetic construct
  source 1..18: mol_type = other DNA
tcatgcgacttactaaag

SEQ ID NO: 17025 - DNA, 18 bp, synthetic construct
  source 1..18: mol_type = other DNA
tcatgctaatcactatag

SEQ ID NO: 17026 - DNA, 18 bp, synthetic construct
  source 1..18: mol_type = other DNA
tcgtacgacagactatag

SEQ ID NO: 17027 - DNA, 18 bp, synthetic construct
  source 1..18: mol_type = other DNA
tcgtatgactcaccatag

SEQ ID NO: 17028 - DNA, 18 bp, synthetic construct
  source 1..18: mol_type = other DNA
tcttaagactcactagag

SEQ ID NO: 17029 - DNA, 18 bp, synthetic construct
  source 1..18: mol_type = other DNA
tcttacgaatcactgtag

SEQ ID NO: 17030 - DNA, 18 bp, synthetic construct
  source 1..18: mol_type = other DNA
tcttccgcctcactatag

SEQ ID NO: 17031 - DNA, 18 bp, synthetic construct
  source 1..18: mol_type = other DNA
tcttgcgacacactatag

SEQ ID NO: 17032 - DNA, 18 bp, synthetic construct
  source 1..18: mol_type = other DNA
tgaaacgaatccctatag

SEQ ID NO: 17033 - DNA, 18 bp, synthetic construct
  source 1..18: mol_type = other DNA
tgaaacgactcactgaag

SEQ ID NO: 17034 - DNA, 18 bp, synthetic construct
  source 1..18: mol_type = other DNA
tgaaacggcttactatag

SEQ ID NO: 17035 - DNA, 18 bp, synthetic construct
  source 1..18: mol_type = other DNA
tgaaatgactccctatag

SEQ ID NO: 17036 - DNA, 18 bp, synthetic construct
  source 1..18: mol_type = other DNA
tgacacaactgactatag

SEQ ID NO: 17037 - DNA, 18 bp, synthetic construct
  source 1..18: mol_type = other DNA
tgacgcgactcactttag

SEQ ID NO: 17038 - DNA, 18 bp, synthetic construct
  source 1..18: mol_type = other DNA
tgataaaactcaccatag

SEQ ID NO: 17039 - DNA, 18 bp, synthetic construct
  source 1..18: mol_type = other DNA
tgataagactcactctcg

SEQ ID NO: 17040 - DNA, 18 bp, synthetic construct
  source 1..18: mol_type = other DNA
tgatacaaatcactagag

SEQ ID NO: 17041 - DNA, 18 bp, synthetic construct
  source 1..18: mol_type = other DNA
tgatacaaattactatag

SEQ ID NO: 17042 - DNA, 18 bp, synthetic construct
  source 1..18: mol_type = other DNA
tgatacaacacacgatag

SEQ ID NO: 17043 - DNA, 18 bp, synthetic construct
  source 1..18: mol_type = other DNA
tgatacaactctctaaag

SEQ ID NO: 17044 - DNA, 18 bp, synthetic construct
  source 1..18: mol_type = other DNA
tgataccacactctatag

SEQ ID NO: 17045 - DNA, 18 bp, synthetic construct
  source 1..18: mol_type = other DNA
tgataccactctccatag

SEQ ID NO: 17046 - DNA, 18 bp, synthetic construct
  source 1..18: mol_type = other DNA
tgatacgacactttatag

SEQ ID NO: 17047 - DNA, 18 bp, synthetic construct
  source 1..18: mol_type = other DNA
tgatacgactaattgtag

SEQ ID NO: 17048 - DNA, 18 bp, synthetic construct
  source 1..18: mol_type = other DNA
tgatacgactcactacct

SEQ ID NO: 17049 - DNA, 18 bp, synthetic construct
  source 1..18: mol_type = other DNA
tgatacgactcatgctag

SEQ ID NO: 17050 - DNA, 18 bp, synthetic construct
  source 1..18: mol_type = other DNA
tgatacgactgtctttag

SEQ ID NO: 17051 - DNA, 18 bp, synthetic construct
  source 1..18: mol_type = other DNA
tgatacggctgaccatag

SEQ ID NO: 17052 - DNA, 18 bp, synthetic construct
  source 1..18: mol_type = other DNA
tgatacgtctcactagcg

SEQ ID NO: 17053 - DNA, 18 bp, synthetic construct
  source 1..18: mol_type = other DNA
tgatacgtcttactctag

SEQ ID NO: 17054 - DNA, 18 bp, synthetic construct
  source 1..18: mol_type = other DNA
tgatactacgcactgtag

SEQ ID NO: 17055 - DNA, 18 bp, synthetic construct
  source 1..18: mol_type = other DNA
tgatactactcaatacag

SEQ ID NO: 17056 - DNA, 18 bp, synthetic construct
  source 1..18: mol_type = other DNA
tgatactactcacttaag

SEQ ID NO: 17057 - DNA, 18 bp, synthetic construct
  source 1..18: mol_type = other DNA
tgatactactcataatag

SEQ ID NO: 17058 - DNA, 18 bp, synthetic construct
  source 1..18: mol_type = other DNA
tgataggacacacaatag

SEQ ID NO: 17059 - DNA, 18 bp, synthetic construct
  source 1..18: mol_type = other DNA
tgatagggctcaccatag

SEQ ID NO: 17060 - DNA, 18 bp, synthetic construct
  source 1..18: mol_type = other DNA
tgatatcactcactatcg

SEQ ID NO: 17061 - DNA, 18 bp, synthetic construct
  source 1..18: mol_type = other DNA
tgatatgacagactatag

SEQ ID NO: 17062 - DNA, 18 bp, synthetic construct
  source 1..18: mol_type = other DNA
tgatatgactcaatatgg

SEQ ID NO: 17063 - DNA, 18 bp, synthetic construct
  source 1..18: mol_type = other DNA
tgatatgagtcactatgg

SEQ ID NO: 17064 - DNA, 18 bp, synthetic construct
  source 1..18: mol_type = other DNA
tgatatgattcaatatag

SEQ ID NO: 17065 - DNA, 18 bp, synthetic construct
  source 1..18: mol_type = other DNA
tgatccgacacactacag

SEQ ID NO: 17066 - DNA, 18 bp, synthetic construct
  source 1..18: mol_type = other DNA
tgatccgacttactttag

SEQ ID NO: 17067 - DNA, 18 bp, synthetic construct
  source 1..18: mol_type = other DNA
tgatcctactaactatag

SEQ ID NO: 17068 - DNA, 18 bp, synthetic construct
  source 1..18: mol_type = other DNA
tgatgcgaatcactatgg

SEQ ID NO: 17069 - DNA, 18 bp, synthetic construct
  source 1..18: mol_type = other DNA
tgatgggactcactaaag

SEQ ID NO: 17070 - DNA, 18 bp, synthetic construct
  source 1..18: mol_type = other DNA
tgcaacgactcactttag

SEQ ID NO: 17071 - DNA, 18 bp, synthetic construct
  source 1..18: mol_type = other DNA
tgctgcgactcattatag

SEQ ID NO: 17072 - DNA, 18 bp, synthetic construct
  source 1..18: mol_type = other DNA
tgctgctactcactatag

SEQ ID NO: 17073 - DNA, 18 bp, synthetic construct
  source 1..18: mol_type = other DNA
tggtaagacacactatag

SEQ ID NO: 17074 - DNA, 18 bp, synthetic construct
  source 1..18: mol_type = other DNA
tggtacgtctcactgtag

SEQ ID NO: 17075 - DNA, 18 bp, synthetic construct
  source 1..18: mol_type = other DNA
tgttaagactcaccatag

SEQ ID NO: 17076 - DNA, 18 bp, synthetic construct
  source 1..18: mol_type = other DNA
tgttaatactcactatag

SEQ ID NO: 17077 - DNA, 18 bp, synthetic construct
  source 1..18: mol_type = other DNA
tgttacgacccagtatag

SEQ ID NO: 17078 - DNA, 18 bp, synthetic construct
  source 1..18: mol_type = other DNA
tgttacgactgactatcg

SEQ ID NO: 17079 - DNA, 18 bp, synthetic construct
  source 1..18: mol_type = other DNA
tgttatgcctcactatag

SEQ ID NO: 17080 - DNA, 18 bp, synthetic construct
  source 1..18: mol_type = other DNA
ttaaaagactcactagag

SEQ ID NO: 17081 - DNA, 18 bp, synthetic construct
  source 1..18: mol_type = other DNA
ttaaacgactaactatcg

SEQ ID NO: 17082 - DNA, 18 bp, synthetic construct
  source 1..18: mol_type = other DNA
ttaaacgactcaatatcg

SEQ ID NO: 17083 - DNA, 18 bp, synthetic construct
  source 1..18: mol_type = other DNA
ttaaacgactcactctcg

SEQ ID NO: 17084 - DNA, 18 bp, synthetic construct
  source 1..18: mol_type = other DNA
ttaaacgagtcactagag

SEQ ID NO: 17085 - DNA, 18 bp, synthetic construct
  source 1..18: mol_type = other DNA
ttaaacgcctcaatatag

SEQ ID NO: 17086 - DNA, 18 bp, synthetic construct
  source 1..18: mol_type = other DNA
ttacacgagtcactgtag

SEQ ID NO: 17087 - DNA, 18 bp, synthetic construct
  source 1..18: mol_type = other DNA
ttacccaactcactatag

SEQ ID NO: 17088 - DNA, 18 bp, synthetic construct
  source 1..18: mol_type = other DNA
ttagactactcagtatag

SEQ ID NO: 17089 - DNA, 18 bp, synthetic construct
  source 1..18: mol_type = other DNA
ttagaggactcattatag

SEQ ID NO: 17090 - DNA, 18 bp, synthetic construct
  source 1..18: mol_type = other DNA
ttaggcgactcaccatag

SEQ ID NO: 17091 - DNA, 18 bp, synthetic construct
  source 1..18: mol_type = other DNA
ttataagaatcactagag

SEQ ID NO: 17092 - DNA, 18 bp, synthetic construct
  source 1..18: mol_type = other DNA
ttataagactcacaatgg

SEQ ID NO: 17093 - DNA, 18 bp, synthetic construct
  source 1..18: mol_type = other DNA
ttataagactcatcatag

SEQ ID NO: 17094 - DNA, 18 bp, synthetic construct
  source 1..18: mol_type = other DNA
ttataagactctctctag

SEQ ID NO: 17095 - DNA, 18 bp, synthetic construct
  source 1..18: mol_type = other DNA
ttataagtctcactatcg

SEQ ID NO: 17096 - DNA, 18 bp, synthetic construct
  source 1..18: mol_type = other DNA
ttatacaactcaccatcg

SEQ ID NO: 17097 - DNA, 18 bp, synthetic construct
  source 1..18: mol_type = other DNA
ttatacaactcactgcag

SEQ ID NO: 17098 - DNA, 18 bp, synthetic construct
  source 1..18: mol_type = other DNA
ttatacaagtcactataa

SEQ ID NO: 17099 - DNA, 18 bp, synthetic construct
  source 1..18: mol_type = other DNA
ttataccacgcactatcg

SEQ ID NO: 17100 - DNA, 18 bp, synthetic construct
  source 1..18: mol_type = other DNA
ttataccactctctgtag

SEQ ID NO: 17101 - DNA, 18 bp, synthetic construct
  source 1..18: mol_type = other DNA
ttatacgacatactacag

SEQ ID NO: 17102 - DNA, 18 bp, synthetic construct
  source 1..18: mol_type = other DNA
ttatacgacccactacgg

SEQ ID NO: 17103 - DNA, 18 bp, synthetic construct
  source 1..18: mol_type = other DNA
ttatacgactcaccttgg

SEQ ID NO: 17104 - DNA, 18 bp, synthetic construct
  source 1..18: mol_type = other DNA
ttatacgattcattgtag

SEQ ID NO: 17105 - DNA, 18 bp, synthetic construct
  source 1..18: mol_type = other DNA
ttatacgcctcacgctag

SEQ ID NO: 17106 - DNA, 18 bp, synthetic construct
  source 1..18: mol_type = other DNA
ttatacggctcaatgtag

SEQ ID NO: 17107 - DNA, 18 bp, synthetic construct
  source 1..18: mol_type = other DNA
ttatacggcttacaatag

SEQ ID NO: 17108 - DNA, 18 bp, synthetic construct
  source 1..18: mol_type = other DNA
ttatacgtctcacaataa

SEQ ID NO: 17109 - DNA, 18 bp, synthetic construct
  source 1..18: mol_type = other DNA
ttatagaactcactatgg

SEQ ID NO: 17110 - DNA, 18 bp, synthetic construct
  source 1..18: mol_type = other DNA
ttatagtactccctatag

SEQ ID NO: 17111 - DNA, 18 bp, synthetic construct
  source 1..18: mol_type = other DNA
ttatatgacttcctatag

SEQ ID NO: 17112 - DNA, 18 bp, synthetic construct
  source 1..18: mol_type = other DNA
ttatatgattcactttag

SEQ ID NO: 17113 - DNA, 18 bp, synthetic construct
  source 1..18: mol_type = other DNA
ttatccaagtcactatag

SEQ ID NO: 17114 - DNA, 18 bp, synthetic construct
  source 1..18: mol_type = other DNA
ttatccgactcattacag

SEQ ID NO: 17115 - DNA, 18 bp, synthetic construct
  source 1..18: mol_type = other DNA
ttatccgacttactgtag

SEQ ID NO: 17116 - DNA, 18 bp, synthetic construct
  source 1..18: mol_type = other DNA
ttatcctattcactatag

SEQ ID NO: 17117 - DNA, 18 bp, synthetic construct
  source 1..18: mol_type = other DNA
ttatcggacttactatag

SEQ ID NO: 17118 - DNA, 18 bp, synthetic construct
  source 1..18: mol_type = other DNA
ttatctaactcactatag

SEQ ID NO: 17119 - DNA, 18 bp, synthetic construct
  source 1..18: mol_type = other DNA
ttatgcgaagcactatag

SEQ ID NO: 17120 - DNA, 18 bp, synthetic construct
  source 1..18: mol_type = other DNA
ttatgcgacgtactatag

SEQ ID NO: 17121 - DNA, 18 bp, synthetic construct
  source 1..18: mol_type = other DNA
ttatgcgactcaatgtag

SEQ ID NO: 17122 - DNA, 18 bp, synthetic construct
  source 1..18: mol_type = other DNA
ttatgtgactcactttag

SEQ ID NO: 17123 - DNA, 18 bp, synthetic construct
  source 1..18: mol_type = other DNA
ttctacgacggactatag

SEQ ID NO: 17124 - DNA, 18 bp, synthetic construct
  source 1..18: mol_type = other DNA
ttctactacttactatag

SEQ ID NO: 17125 - DNA, 18 bp, synthetic construct
  source 1..18: mol_type = other DNA
ttggacgacgcactatag

SEQ ID NO: 17126 - DNA, 18 bp, synthetic construct
  source 1..18: mol_type = other DNA
ttgtacgactctctatcg

SEQ ID NO: 17127 - DNA, 18 bp, synthetic construct
  source 1..18: mol_type = other DNA
ttgtacgcctcaccatag

SEQ ID NO: 17128 - DNA, 18 bp, synthetic construct
  source 1..18: mol_type = other DNA
ttgtacgtctgactatag

SEQ ID NO: 17129 - DNA, 18 bp, synthetic construct
  source 1..18: mol_type = other DNA
ttttacgagtcattatag

SEQ ID NO: 17130 - DNA, 18 bp, synthetic construct
  source 1..18: mol_type = other DNA
taaaacgtgtcactaaag

SEQ ID NO: 17131 - DNA, 18 bp, synthetic construct
  source 1..18: mol_type = other DNA
tataaagactcactaaag

SEQ ID NO: 17132 - DNA, 18 bp, synthetic construct
  source 1..18: mol_type = other DNA
ttaaacgtctcactattg

SEQ ID NO: 17133 - DNA, 18 bp, synthetic construct
  source 1..18: mol_type = other DNA
taaaatgactcacttttg

SEQ ID NO: 17134 - DNA, 18 bp, synthetic construct
  source 1..18: mol_type = other DNA
taattggactcacattag

SEQ ID NO: 17135 - DNA, 18 bp, synthetic construct
  source 1..18: mol_type = other DNA
tattttgactcactagag

SEQ ID NO: 17136 - DNA, 18 bp, synthetic construct
  source 1..18: mol_type = other DNA
agttaggactcactatag

SEQ ID NO: 17137 - DNA, 18 bp, synthetic construct
  source 1..18: mol_type = other DNA
tattataactcactacag

SEQ ID NO: 17138 - DNA, 18 bp, synthetic construct
  source 1..18: mol_type = other DNA
taaatcgactcgctttag

SEQ ID NO: 17139 - DNA, 18 bp, synthetic construct
  source 1..18: mol_type = other DNA
ttattagactcactgtag

SEQ ID NO: 17140 - DNA, 18 bp, synthetic construct
  source 1..18: mol_type = other DNA
taattaaactcgctatag

SEQ ID NO: 17141 - DNA, 18 bp, synthetic construct
  source 1..18: mol_type = other DNA
taattcgactcaatactg

SEQ ID NO: 17142 - DNA, 18 bp, synthetic construct
  source 1..18: mol_type = other DNA
aaattcgactcactctcg

SEQ ID NO: 17143 - DNA, 18 bp, synthetic construct
  source 1..18: mol_type = other DNA
tatttcgactctatatag

SEQ ID NO: 17144 - DNA, 18 bp, synthetic construct
  source 1..18: mol_type = other DNA
tatttggactcactatgg

SEQ ID NO: 17145 - DNA, 18 bp, synthetic construct
  source 1..18: mol_type = other DNA
tcattcgactctctatgg

SEQ ID NO: 17146 - DNA, 18 bp, synthetic construct
  source 1..18: mol_type = other DNA
tgatttgtctcactatag

SEQ ID NO: 17147 - DNA, 18 bp, synthetic construct
  source 1..18: mol_type = other DNA
ttaaacaactcgctatag

SEQ ID NO: 17148 - DNA, 18 bp, synthetic construct
  source 1..18: mol_type = other DNA
ttataaggctcactattg

SEQ ID NO: 17149 - DNA, 18 bp, synthetic construct
  source 1..18: mol_type = other DNA
ttatacggctcaataaag

SEQ ID NO: 17150 - DNA, 18 bp, synthetic construct
  source 1..18: mol_type = other DNA
ttatatgacgcactacag

SEQ ID NO: 17151 - DNA, 18 bp, synthetic construct
  source 1..18: mol_type = other DNA
ttgttcgactcacaatag

SEQ ID NO: 17152 - DNA, 18 bp, synthetic construct
  source 1..18: mol_type = other DNA
taataagactcccactag

SEQ ID NO: 17153 - DNA, 18 bp, synthetic construct
  source 1..18: mol_type = other DNA
taattggactcacaaaag

SEQ ID NO: 17154 - DNA, 18 bp, synthetic construct
  source 1..18: mol_type = other DNA
ttaaacaactcactaaag

SEQ ID NO: 17155 - DNA, 18 bp, synthetic construct
  source 1..18: mol_type = other DNA
ttattcgactcaccattg

SEQ ID NO: 17156 - DNA, 18 bp, synthetic construct
  source 1..18: mol_type = other DNA
aaattcgcctcactaaag

SEQ ID NO: 17157 - DNA, 18 bp, synthetic construct
  source 1..18: mol_type = other DNA
acataggactcgctatag

SEQ ID NO: 17158 - DNA, 18 bp, synthetic construct
  source 1..18: mol_type = other DNA
caattcgactcattaaag

SEQ ID NO: 17159 - DNA, 18 bp, synthetic construct
  source 1..18: mol_type = other DNA
cattacgactcactcttg

SEQ ID NO: 17160 - DNA, 18 bp, synthetic construct
  source 1..18: mol_type = other DNA
taactctactcacaatag

SEQ ID NO: 17161 - DNA, 18 bp, synthetic construct
  source 1..18: mol_type = other DNA
taatgcgactaacaattg

SEQ ID NO: 17162 - DNA, 18 bp, synthetic construct
  source 1..18: mol_type = other DNA
tacttcatctcactatag

SEQ ID NO: 17163 - DNA, 18 bp, synthetic construct
  source 1..18: mol_type = other DNA
tagtgcgacccactattg

SEQ ID NO: 17164 - DNA, 18 bp, synthetic construct
  source 1..18: mol_type = other DNA
tcataccactcacaattg

SEQ ID NO: 17165 - DNA, 18 bp, synthetic construct
  source 1..18: mol_type = other DNA
tgattcgtctcactatcg

SEQ ID NO: 17166 - DNA, 18 bp, synthetic construct
  source 1..18: mol_type = other DNA
aaatacgactatctatcg

SEQ ID NO: 17167 - DNA, 18 bp, synthetic construct
  source 1..18: mol_type = other DNA
aaatagaactcactatgg

SEQ ID NO: 17168 - DNA, 18 bp, synthetic construct
  source 1..18: mol_type = other DNA
gataacgtctcactatag

SEQ ID NO: 17169 - DNA, 18 bp, synthetic construct
  source 1..18: mol_type = other DNA
taaacggactcactaaag

SEQ ID NO: 17170 - DNA, 18 bp, synthetic construct
  source 1..18: mol_type = other DNA
taataacagtcactaaag

SEQ ID NO: 17171 - DNA, 18 bp, synthetic construct
  source 1..18: mol_type = other DNA
taatacgccacactttcg

SEQ ID NO: 17172 - DNA, 18 bp, synthetic construct
  source 1..18: mol_type = other DNA
taatacttctgactatcg

SEQ ID NO: 17173 - DNA, 18 bp, synthetic construct
  source 1..18: mol_type = other DNA
taataggtctctctaaag

SEQ ID NO: 17174 - DNA, 18 bp, synthetic construct
  source 1..18: mol_type = other DNA
tataacgagtcacaatag

SEQ ID NO: 17175 - DNA, 18 bp, synthetic construct
  source 1..18: mol_type = other DNA
tcttacgactcattttag

SEQ ID NO: 17176 - DNA, 18 bp, synthetic construct
  source 1..18: mol_type = other DNA
tgatacgactctctgtcg

SEQ ID NO: 17177 - DNA, 18 bp, synthetic construct
  source 1..18: mol_type = other DNA
ttaaacgactcacttgag

SEQ ID NO: 17178 - DNA, 18 bp, synthetic construct
  source 1..18: mol_type = other DNA
ttaaccgactcactctag

SEQ ID NO: 17179 - DNA, 18 bp, synthetic construct
  source 1..18: mol_type = other DNA
tattacgcctcactaatg

SEQ ID NO: 17180 - DNA, 18 bp, synthetic construct
  source 1..18: mol_type = other DNA
taatacgatactctttag

SEQ ID NO: 17181 - DNA, 18 bp, synthetic construct
  source 1..18: mol_type = other DNA
ttatccgtctcactgtag

SEQ ID NO: 17182 - DNA, 18 bp, synthetic construct
  source 1..18: mol_type = other DNA
ttttacgactcacaacag

SEQ ID NO: 17183 - DNA, 18 bp, synthetic construct
  source 1..18: mol_type = other DNA
aatttcgcctcactatag

SEQ ID NO: 17184 - DNA, 18 bp, synthetic construct
  source 1..18: mol_type = other DNA
ttattcgactcactttcg

SEQ ID NO: 17185 - DNA, 18 bp, synthetic construct
  source 1..18: mol_type = other DNA
aaataaggctcactatcg

SEQ ID NO: 17186 - DNA, 18 bp, synthetic construct
  source 1..18: mol_type = other DNA
aataacgactcactttag

SEQ ID NO: 17187 - DNA, 18 bp, synthetic construct
  source 1..18: mol_type = other DNA
acttacgactcactaaag

SEQ ID NO: 17188 - DNA, 18 bp, synthetic construct
  source 1..18: mol_type = other DNA
tattacgtctcacactag

SEQ ID NO: 17189 - DNA, 18 bp, synthetic construct
  source 1..18: mol_type = other DNA
tgaaacgtctcactgtag

SEQ ID NO: 17190 - DNA, 18 bp, synthetic construct
  source 1..18: mol_type = other DNA
ttaaacgactcactaatg

SEQ ID NO: 17191 - DNA, 18 bp, synthetic construct
  source 1..18: mol_type = other DNA
taattcgactcgctgtcg

SEQ ID NO: 17192 - DNA, 18 bp, synthetic construct
  source 1..18: mol_type = other DNA
tagttcgactcactgttg

SEQ ID NO: 17193 - DNA, 18 bp, synthetic construct
  source 1..18: mol_type = other DNA
tcattagactcactattg

SEQ ID NO: 17194 - DNA, 18 bp, synthetic construct
  source 1..18: mol_type = other DNA
aaacaggactcactattg

SEQ ID NO: 17195 - DNA, 18 bp, synthetic construct
  source 1..18: mol_type = other DNA
aaatacgatgcgctatag

SEQ ID NO: 17196 - DNA, 18 bp, synthetic construct
  source 1..18: mol_type = other DNA
acatacgactcacaattg

SEQ ID NO: 17197 - DNA, 18 bp, synthetic construct
  source 1..18: mol_type = other DNA
acatacgactcgctatcg

SEQ ID NO: 17198 - DNA, 18 bp, synthetic construct
  source 1..18: mol_type = other DNA
cgattcgactcacgatag

SEQ ID NO: 17199 - DNA, 18 bp, synthetic construct
  source 1..18: mol_type = other DNA
taactcgactctctagag

SEQ ID NO: 17200 - DNA, 18 bp, synthetic construct
  source 1..18: mol_type = other DNA
taataagacgcaccattg

SEQ ID NO: 17201 - DNA, 18 bp, synthetic construct
  source 1..18: mol_type = other DNA
taatacaaatggctatag

SEQ ID NO: 17202 - DNA, 18 bp, synthetic construct
  source 1..18: mol_type = other DNA
taatacgaaacgctagag

SEQ ID NO: 17203 - DNA, 18 bp, synthetic construct
  source 1..18: mol_type = other DNA
taatacgaatcaccactg

SEQ ID NO: 17204 - DNA, 18 bp, synthetic construct
  source 1..18: mol_type = other DNA
taatacgactctctaata

SEQ ID NO: 17205 - DNA, 18 bp, synthetic construct
  source 1..18: mol_type = other DNA
taatacgcctaattattg

SEQ ID NO: 17206 - DNA, 18 bp, synthetic construct
  source 1..18: mol_type = other DNA
taatacgccttactcttg

SEQ ID NO: 17207 - DNA, 18 bp, synthetic construct
  source 1..18: mol_type = other DNA
taattcgaaccactacag

SEQ ID NO: 17208 - DNA, 18 bp, synthetic construct
  source 1..18: mol_type = other DNA
taattcgacataatatag

SEQ ID NO: 17209 - DNA, 18 bp, synthetic construct
  source 1..18: mol_type = other DNA
taattcgacttacactag

SEQ ID NO: 17210 - DNA, 18 bp, synthetic construct
  source 1..18: mol_type = other DNA
taattcgatttactctag

SEQ ID NO: 17211 - DNA, 18 bp, synthetic construct
  source 1..18: mol_type = other DNA
taattcgtctctttatag

SEQ ID NO: 17212 - DNA, 18 bp, synthetic construct
  source 1..18: mol_type = other DNA
taatttgacacactatgg

SEQ ID NO: 17213 - DNA, 18 bp, synthetic construct
  source 1..18: mol_type = other DNA
taggaagactcactattg

SEQ ID NO: 17214 - DNA, 18 bp, synthetic construct
  source 1..18: mol_type = other DNA
tataacgactcactcttg

SEQ ID NO: 17215 - DNA, 18 bp, synthetic construct
  source 1..18: mol_type = other DNA
tatttcggctcactacag

SEQ ID NO: 17216 - DNA, 18 bp, synthetic construct
  source 1..18: mol_type = other DNA
tcatccgactcagtattg

SEQ ID NO: 17217 - DNA, 18 bp, synthetic construct
  source 1..18: mol_type = other DNA
tcattcgattcactgtag

SEQ ID NO: 17218 - DNA, 18 bp, synthetic construct
  source 1..18: mol_type = other DNA
tcattctgctcactatag

SEQ ID NO: 17219 - DNA, 18 bp, synthetic construct
  source 1..18: mol_type = other DNA
tgattcgtctcactacag

SEQ ID NO: 17220 - DNA, 18 bp, synthetic construct
  source 1..18: mol_type = other DNA
ttagtcaactcactatag

SEQ ID NO: 17221 - DNA, 18 bp, synthetic construct
  source 1..18: mol_type = other DNA
ttatacgactcagtagtg

SEQ ID NO: 17222 - DNA, 18 bp, synthetic construct
  source 1..18: mol_type = other DNA
ttattcgactgacgatag

SEQ ID NO: 17223 - DNA, 18 bp, synthetic construct
  source 1..18: mol_type = other DNA
ttattcggctcactttag

SEQ ID NO: 17224 - DNA, 18 bp, synthetic construct
  source 1..18: mol_type = other DNA
ttctccgactcactattg

SEQ ID NO: 17225 - DNA, 18 bp, synthetic construct
  source 1..18: mol_type = other DNA
aaatacaactgacaatag

SEQ ID NO: 17226 - DNA, 18 bp, synthetic construct
  source 1..18: mol_type = other DNA
aaataccactaacaatag

SEQ ID NO: 17227 - DNA, 18 bp, synthetic construct
  source 1..18: mol_type = other DNA
aaatacgacatactctag

SEQ ID NO: 17228 - DNA, 18 bp, synthetic construct
  source 1..18: mol_type = other DNA
aaatatgactgactctag

SEQ ID NO: 17229 - DNA, 18 bp, synthetic construct
  source 1..18: mol_type = other DNA
aaatatggctcactaaag

SEQ ID NO: 17230 - DNA, 18 bp, synthetic construct
  source 1..18: mol_type = other DNA
aagtacgactcccaatag

SEQ ID NO: 17231 - DNA, 18 bp, synthetic construct
  source 1..18: mol_type = other DNA
atatacgcctcacaatag

SEQ ID NO: 17232 - DNA, 18 bp, synthetic construct
  source 1..18: mol_type = other DNA
caatacgactctgtagag

SEQ ID NO: 17233 - DNA, 18 bp, synthetic construct
  source 1..18: mol_type = other DNA
cgatatgattcactatag

SEQ ID NO: 17234 - DNA, 18 bp, synthetic construct
  source 1..18: mol_type = other DNA
gtaaacgtctcactatag

SEQ ID NO: 17235 - DNA, 18 bp, synthetic construct
  source 1..18: mol_type = other DNA
taaaacaactcattgtag

SEQ ID NO: 17236 - DNA, 18 bp, synthetic construct
  source 1..18: mol_type = other DNA
taaaaccactaactttag

SEQ ID NO: 17237 - DNA, 18 bp, synthetic construct
  source 1..18: mol_type = other DNA
taaaacgactcagtcaag

SEQ ID NO: 17238 - DNA, 18 bp, synthetic construct
  source 1..18: mol_type = other DNA
taaaacgatacactatcg

SEQ ID NO: 17239 - DNA, 18 bp, synthetic construct
  source 1..18: mol_type = other DNA
taaaactagccactatag

SEQ ID NO: 17240 - DNA, 18 bp, synthetic construct
  source 1..18: mol_type = other DNA
taaaattacacactatag

SEQ ID NO: 17241 - DNA, 18 bp, synthetic construct
  source 1..18: mol_type = other DNA
taacacgacatactgtag

SEQ ID NO: 17242 - DNA, 18 bp, synthetic construct
  source 1..18: mol_type = other DNA
taacacgacgctctttag

SEQ ID NO: 17243 - DNA, 18 bp, synthetic construct
  source 1..18: mol_type = other DNA
taacacgagtcaataaag

SEQ ID NO: 17244 - DNA, 18 bp, synthetic construct
  source 1..18: mol_type = other DNA
taacacgagtcactttcg

SEQ ID NO: 17245 - DNA, 18 bp, synthetic construct
  source 1..18: mol_type = other DNA
taacacggatcacaatag

SEQ ID NO: 17246 - DNA, 18 bp, synthetic construct
  source 1..18: mol_type = other DNA
taacatgatttactatag

SEQ ID NO: 17247 - DNA, 18 bp, synthetic construct
  source 1..18: mol_type = other DNA
taagacatctcagtatag

SEQ ID NO: 17248 - DNA, 18 bp, synthetic construct
  source 1..18: mol_type = other DNA
taataaggttcaccatag

SEQ ID NO: 17249 - DNA, 18 bp, synthetic construct
  source 1..18: mol_type = other DNA
taatacaaagaactatag

SEQ ID NO: 17250 - DNA, 18 bp, synthetic construct
  source 1..18: mol_type = other DNA
taatacaactcccaatcg

SEQ ID NO: 17251 - DNA, 18 bp, synthetic construct
  source 1..18: mol_type = other DNA
taataccataccctatag

SEQ ID NO: 17252 - DNA, 18 bp, synthetic construct
  source 1..18: mol_type = other DNA
taatacgaagaactaaag

SEQ ID NO: 17253 - DNA, 18 bp, synthetic construct
  source 1..18: mol_type = other DNA
taatacgacctacaaaag

SEQ ID NO: 17254 - DNA, 18 bp, synthetic construct
  source 1..18: mol_type = other DNA
taatacggctgtccatag

SEQ ID NO: 17255 - DNA, 18 bp, synthetic construct
  source 1..18: mol_type = other DNA
taatacgtcccattttag

SEQ ID NO: 17256 - DNA, 18 bp, synthetic construct
  source 1..18: mol_type = other DNA
taatacgtcgcacgagag

SEQ ID NO: 17257 - DNA, 18 bp, synthetic construct
  source 1..18: mol_type = other DNA
taatacgtctaattctag

SEQ ID NO: 17258 - DNA, 18 bp, synthetic construct
  source 1..18: mol_type = other DNA
taatactactcaacatgg

SEQ ID NO: 17259 - DNA, 18 bp, synthetic construct
  source 1..18: mol_type = other DNA
taatatgactcaataacg

SEQ ID NO: 17260 - DNA, 18 bp, synthetic construct
  source 1..18: mol_type = other DNA
taatatgactctatgtag

SEQ ID NO: 17261 - DNA, 18 bp, synthetic construct
  source 1..18: mol_type = other DNA
taatatgactctccttag

SEQ ID NO: 17262 - DNA, 18 bp, synthetic construct
  source 1..18: mol_type = other DNA
taatccaacacactaaag

SEQ ID NO: 17263 - DNA, 18 bp, synthetic construct
  source 1..18: mol_type = other DNA
taatccgtctgactttag

SEQ ID NO: 17264 - DNA, 18 bp, synthetic construct
  source 1..18: mol_type = other DNA
taatgagactatctatag

SEQ ID NO: 17265 - DNA, 18 bp, synthetic construct
  source 1..18: mol_type = other DNA
taatgagactcattacag

SEQ ID NO: 17266 - DNA, 18 bp, synthetic construct
  source 1..18: mol_type = other DNA
taatgcgaatgacaatag

SEQ ID NO: 17267 - DNA, 18 bp, synthetic construct
  source 1..18: mol_type = other DNA
tactacgtctcaatctag

SEQ ID NO: 17268 - DNA, 18 bp, synthetic construct
  source 1..18: mol_type = other DNA
tagaacgacacaatatag

SEQ ID NO: 17269 - DNA, 18 bp, synthetic construct
  source 1..18: mol_type = other DNA
tagaacgactcagtatgg

SEQ ID NO: 17270 - DNA, 18 bp, synthetic construct
  source 1..18: mol_type = other DNA
tagtacaacaaactatag

SEQ ID NO: 17271 - DNA, 18 bp, synthetic construct
  source 1..18: mol_type = other DNA
tagtccgactcacaatgg

SEQ ID NO: 17272 - DNA, 18 bp, synthetic construct
  source 1..18: mol_type = other DNA
tattacaactcagtctag

SEQ ID NO: 17273 - DNA, 18 bp, synthetic construct
  source 1..18: mol_type = other DNA
tcatacgactctccacag

SEQ ID NO: 17274 - DNA, 18 bp, synthetic construct
  source 1..18: mol_type = other DNA
tcatacgacttcctacag

SEQ ID NO: 17275 - DNA, 18 bp, synthetic construct
  source 1..18: mol_type = other DNA
tcgtacgattcactatcg

SEQ ID NO: 17276 - DNA, 18 bp, synthetic construct
  source 1..18: mol_type = other DNA
tcgtacgcctcagtatag

SEQ ID NO: 17277 - DNA, 18 bp, synthetic construct
  source 1..18: mol_type = other DNA
tgaagcgtctcactatag

SEQ ID NO: 17278 - DNA, 18 bp, synthetic construct
  source 1..18: mol_type = other DNA
tgatacgactaattatgg

SEQ ID NO: 17279 - DNA, 18 bp, synthetic construct
  source 1..18: mol_type = other DNA
tgatacgactgtcaatag

SEQ ID NO: 17280 - DNA, 18 bp, synthetic construct
  source 1..18: mol_type = other DNA
tgatacgtctcactgaag

SEQ ID NO: 17281 - DNA, 18 bp, synthetic construct
  source 1..18: mol_type = other DNA
ttagactactaactatag

SEQ ID NO: 17282 - DNA, 18 bp, synthetic construct
  source 1..18: mol_type = other DNA
ttataggattcactatgg

SEQ ID NO: 17283 - DNA, 18 bp, synthetic construct
  source 1..18: mol_type = other DNA
ttctacggcacactatag

SEQ ID NO: 17284 - DNA, 18 bp, synthetic construct
  source 1..18: mol_type = other DNA
ttgtacgacactctatag

SEQ ID NO: 17285 - DNA, 18 bp, synthetic construct
  source 1..18: mol_type = other DNA
ttttacgactcactgtcg

SEQ ID NO: 17286 - DNA, 18 bp, synthetic construct
  source 1..18: mol_type = other DNA
ttatacgtctcactaatg

SEQ ID NO: 17287 - DNA, 18 bp, synthetic construct
  source 1..18: mol_type = other DNA
taaatcgtctcactttag

SEQ ID NO: 17288 - DNA, 18 bp, synthetic construct
  source 1..18: mol_type = other DNA
ttatacgactctctactg

SEQ ID NO: 17289 - DNA, 18 bp, synthetic construct
  source 1..18: mol_type = other DNA
ttatacggctaactattg

SEQ ID NO: 17290 - DNA, 18 bp, synthetic construct
  source 1..18: mol_type = other DNA
ttatactactgactattg

SEQ ID NO: 17291 - DNA, 18 bp, synthetic construct
  source 1..18: mol_type = other DNA
taatacttttcaatatag

SEQ ID NO: 17292 - DNA, 18 bp, synthetic construct
  source 1..18: mol_type = other DNA
ttattcgtctcactattg

SEQ ID NO: 17293 - DNA, 18 bp, synthetic construct
  source 1..18: mol_type = other DNA
taatccgacttgctattg

SEQ ID NO: 17294 - DNA, 18 bp, synthetic construct
  source 1..18: mol_type = other DNA
gattacgactcactaatg

SEQ ID NO: 17295 - DNA, 18 bp, synthetic construct
  source 1..18: mol_type = other DNA
taatccaactcgccatag

SEQ ID NO: 17296 - DNA, 18 bp, synthetic construct
  source 1..18: mol_type = other DNA
tactacaactccctattg

SEQ ID NO: 17297 - DNA, 18 bp, synthetic construct
  source 1..18: mol_type = other DNA
ttttacgactcactgttg

SEQ ID NO: 17298 - DNA, 18 bp, synthetic construct
  source 1..18: mol_type = other DNA
aaatacgaaacactatcg

SEQ ID NO: 17299 - DNA, 18 bp, synthetic construct
  source 1..18: mol_type = other DNA
aaatacgactgcctttag

SEQ ID NO: 17300 - DNA, 18 bp, synthetic construct
  source 1..18: mol_type = other DNA
aaatacgagacaatatag

SEQ ID NO: 17301 - DNA, 18 bp, synthetic construct
  source 1..18: mol_type = other DNA
aaatacgagtgtctatag

SEQ ID NO: 17302 - DNA, 18 bp, synthetic construct
  source 1..18: mol_type = other DNA
aaatactaatccctatag

SEQ ID NO: 17303 - DNA, 18 bp, synthetic construct
  source 1..18: mol_type = other DNA
aattacgtctcactacag

SEQ ID NO: 17304 - DNA, 18 bp, synthetic construct
  source 1..18: mol_type = other DNA
acaaacgattcactatag

SEQ ID NO: 17305 - DNA, 18 bp, synthetic construct
  source 1..18: mol_type = other DNA
atatacgactcagtaaag

SEQ ID NO: 17306 - DNA, 18 bp, synthetic construct
  source 1..18: mol_type = other DNA
caatacaactcaccttag

SEQ ID NO: 17307 - DNA, 18 bp, synthetic construct
  source 1..18: mol_type = other DNA
ctatacgcatcactatag

SEQ ID NO: 17308 - DNA, 18 bp, synthetic construct
  source 1..18: mol_type = other DNA
gaataatactcactttag

SEQ ID NO: 17309 - DNA, 18 bp, synthetic construct
  source 1..18: mol_type = other DNA
gaatacaagtcactttag

SEQ ID NO: 17310 - DNA, 18 bp, synthetic construct
  source 1..18: mol_type = other DNA
taaaacgacttacgttag

SEQ ID NO: 17311 - DNA, 18 bp, synthetic construct
  source 1..18: mol_type = other DNA
taaaacttttcactatag

SEQ ID NO: 17312 - DNA, 18 bp, synthetic construct
  source 1..18: mol_type = other DNA
taaaccaactcactaaag

SEQ ID NO: 17313 - DNA, 18 bp, synthetic construct
  source 1..18: mol_type = other DNA
taataagactcacttccg

SEQ ID NO: 17314 - DNA, 18 bp, synthetic construct
  source 1..18: mol_type = other DNA
taatacaaattcctatag

SEQ ID NO: 17315 - DNA, 18 bp, synthetic construct
  source 1..18: mol_type = other DNA
taatacagctcacaaaag

SEQ ID NO: 17316 - DNA, 18 bp, synthetic construct
  source 1..18: mol_type = other DNA
taatacggcttcttatag

SEQ ID NO: 17317 - DNA, 18 bp, synthetic construct
  source 1..18: mol_type = other DNA
taatagaactcactttcg

SEQ ID NO: 17318 - DNA, 18 bp, synthetic construct
  source 1..18: mol_type = other DNA
tactactactcaaaatag

SEQ ID NO: 17319 - DNA, 18 bp, synthetic construct
  source 1..18: mol_type = other DNA
tataacgactgtctatag

SEQ ID NO: 17320 - DNA, 18 bp, synthetic construct
  source 1..18: mol_type = other DNA
tattacgaccctatatag

SEQ ID NO: 17321 - DNA, 18 bp, synthetic construct
  source 1..18: mol_type = other DNA
tattacgaccctttatag

SEQ ID NO: 17322 - DNA, 18 bp, synthetic construct
  source 1..18: mol_type = other DNA
ttatgcgactcagtaaag

SEQ ID NO: 17323 - DNA, 18 bp, synthetic construct
  source 1..18: mol_type = other DNA
taattcaactctttatag

SEQ ID NO: 17324 - DNA, 18 bp, synthetic construct
  source 1..18: mol_type = other DNA
taatacgactcgcatttg

SEQ ID NO: 17325 - DNA, 18 bp, synthetic construct
  source 1..18: mol_type = other DNA
ttaagcgactcactattg

SEQ ID NO: 17326 - DNA, 18 bp, synthetic construct
  source 1..18: mol_type = other DNA
tattccgaaccactatag

SEQ ID NO: 17327 - DNA, 18 bp, synthetic construct
  source 1..18: mol_type = other DNA
tttcacgactcactatcg

SEQ ID NO: 17328 - DNA, 18 bp, synthetic construct
  source 1..18: mol_type = other DNA
taattaaactcactattg

SEQ ID NO: 17329 - DNA, 18 bp, synthetic construct
  source 1..18: mol_type = other DNA
caatgcgacacactattg

SEQ ID NO: 17330 - DNA, 18 bp, synthetic construct
  source 1..18: mol_type = other DNA
ttttaagactcactattg

SEQ ID NO: 17331 - DNA, 18 bp, synthetic construct
  source 1..18: mol_type = other DNA
taatacgtctcacttacg

SEQ ID NO: 17332 - DNA, 18 bp, synthetic construct
  source 1..18: mol_type = other DNA
taattcgtctctctattg

SEQ ID NO: 17333 - DNA, 18 bp, synthetic construct
  source 1..18: mol_type = other DNA
ttttacgtctcactattg

SEQ ID NO: 17334 - DNA, 18 bp, synthetic construct
  source 1..18: mol_type = other DNA
ttttacgactctctattg

SEQ ID NO: 17335 - DNA, 18 bp, synthetic construct
  source 1..18: mol_type = other DNA
taatacgaatttctttag

SEQ ID NO: 17336 - DNA, 18 bp, synthetic construct
  source 1..18: mol_type = other DNA
taattcgtctcacttcag

SEQ ID NO: 17337 - DNA, 18 bp, synthetic construct
  source 1..18: mol_type = other DNA
tattacgtctcactaatg

SEQ ID NO: 17338 - DNA, 18 bp, synthetic construct
  source 1..18: mol_type = other DNA
tattacgtctcactactg

SEQ ID NO: 17339 - DNA, 18 bp, synthetic construct
  source 1..18: mol_type = other DNA
tttttcgtctcactatag

SEQ ID NO: 17340 - DNA, 18 bp, synthetic construct
  source 1..18: mol_type = other DNA
taaatcgactcactactg

SEQ ID NO: 17341 - DNA, 18 bp, synthetic construct
  source 1..18: mol_type = other DNA
tatttggactcactattg

SEQ ID NO: 17342 - DNA, 18 bp, synthetic construct
  source 1..18: mol_type = other DNA
aattgcgactcgctatag

SEQ ID NO: 17343 - DNA, 18 bp, synthetic construct
  source 1..18: mol_type = other DNA
caattctactcactttag

SEQ ID NO: 17344 - DNA, 18 bp, synthetic construct
  source 1..18: mol_type = other DNA
taaaacgacttgccatag

SEQ ID NO: 17345 - DNA, 18 bp, synthetic construct
  source 1..18: mol_type = other DNA
taataagactcgcattag

SEQ ID NO: 17346 - DNA, 18 bp, synthetic construct
  source 1..18: mol_type = other DNA
taattcgactttttatag

SEQ ID NO: 17347 - DNA, 18 bp, synthetic construct
  source 1..18: mol_type = other DNA
tatctcgactcactttag

SEQ ID NO: 17348 - DNA, 18 bp, synthetic construct
  source 1..18: mol_type = other DNA
tattaggactcactaatg

SEQ ID NO: 17349 - DNA, 18 bp, synthetic construct
  source 1..18: mol_type = other DNA
ttacacgactcactgttg

SEQ ID NO: 17350 - DNA, 18 bp, synthetic construct
  source 1..18: mol_type = other DNA
taaacctactctctatag

SEQ ID NO: 17351 - DNA, 18 bp, synthetic construct
  source 1..18: mol_type = other DNA
taatacgaaacattaaag

SEQ ID NO: 17352 - DNA, 18 bp, synthetic construct
  source 1..18: mol_type = other DNA
taatacgactatataaag

SEQ ID NO: 17353 - DNA, 18 bp, synthetic construct
  source 1..18: mol_type = other DNA
taatactaattattatag

SEQ ID NO: 17354 - DNA, 18 bp, synthetic construct
  source 1..18: mol_type = other DNA
taataggaatcactcaag

SEQ ID NO: 17355 - DNA, 18 bp, synthetic construct
  source 1..18: mol_type = other DNA
taatccgaataaccatag

SEQ ID NO: 17356 - DNA, 18 bp, synthetic construct
  source 1..18: mol_type = other DNA
taatgcaacgcactatcg

SEQ ID NO: 17357 - DNA, 18 bp, synthetic construct
  source 1..18: mol_type = other DNA
tattaggactcactaagg

SEQ ID NO: 17358 - DNA, 18 bp, synthetic construct
  source 1..18: mol_type = other DNA
tattgcgagtcacaatag

SEQ ID NO: 17359 - DNA, 18 bp, synthetic construct
  source 1..18: mol_type = other DNA
tgatattactcactaaag

SEQ ID NO: 17360 - DNA, 18 bp, synthetic construct
  source 1..18: mol_type = other DNA
ttaaactgctcactatag

SEQ ID NO: 17361 - DNA, 18 bp, synthetic construct
  source 1..18: mol_type = other DNA
ttacacgactcacaatcg

SEQ ID NO: 17362 - DNA, 18 bp, synthetic construct
  source 1..18: mol_type = other DNA
ttacgcgactcactaaag

SEQ ID NO: 17363 - DNA, 18 bp, synthetic construct
  source 1..18: mol_type = other DNA
ttatacgacttcctatgg

SEQ ID NO: 17364 - DNA, 18 bp, synthetic construct
  source 1..18: mol_type = other DNA
taattcgacgcgctattg

SEQ ID NO: 17365 - DNA, 18 bp, synthetic construct
  source 1..18: mol_type = other DNA
aaattcgactcgttatag

SEQ ID NO: 17366 - DNA, 18 bp, synthetic construct
  source 1..18: mol_type = other DNA
caattcgactcggtatag

SEQ ID NO: 17367 - DNA, 18 bp, synthetic construct
  source 1..18: mol_type = other DNA
taaatcgactcgctacag

SEQ ID NO: 17368 - DNA, 18 bp, synthetic construct
  source 1..18: mol_type = other DNA
taactcgactagctatag

SEQ ID NO: 17369 - DNA, 18 bp, synthetic construct
  source 1..18: mol_type = other DNA
taataagactcgctcttg

SEQ ID NO: 17370 - DNA, 18 bp, synthetic construct
  source 1..18: mol_type = other DNA
taatacagctcgctattg

SEQ ID NO: 17371 - DNA, 18 bp, synthetic construct
  source 1..18: mol_type = other DNA
taataccacccgctattg

SEQ ID NO: 17372 - DNA, 18 bp, synthetic construct
  source 1..18: mol_type = other DNA
taatacgactagcaattg

SEQ ID NO: 17373 - DNA, 18 bp, synthetic construct
  source 1..18: mol_type = other DNA
taatacgcctcgctaatg

SEQ ID NO: 17374 - DNA, 18 bp, synthetic construct
  source 1..18: mol_type = other DNA
taatgcgactcgctgttg

SEQ ID NO: 17375 - DNA, 18 bp, synthetic construct
  source 1..18: mol_type = other DNA
taattcaactcactaatg

SEQ ID NO: 17376 - DNA, 18 bp, synthetic construct
  source 1..18: mol_type = other DNA
taattcgactaaccattg

SEQ ID NO: 17377 - DNA, 18 bp, synthetic construct
  source 1..18: mol_type = other DNA
taattcgactctcgattg

SEQ ID NO: 17378 - DNA, 18 bp, synthetic construct
  source 1..18: mol_type = other DNA
taattcgagtcaatattg

SEQ ID NO: 17379 - DNA, 18 bp, synthetic construct
  source 1..18: mol_type = other DNA
taattcggctcagtattg

SEQ ID NO: 17380 - DNA, 18 bp, synthetic construct
  source 1..18: mol_type = other DNA
taattctactcgccatag

SEQ ID NO: 17381 - DNA, 18 bp, synthetic construct
  source 1..18: mol_type = other DNA
taattggactcgctctag

SEQ ID NO: 17382 - DNA, 18 bp, synthetic construct
  source 1..18: mol_type = other DNA
tacttcgactagctatag

SEQ ID NO: 17383 - DNA, 18 bp, synthetic construct
  source 1..18: mol_type = other DNA
tacttcgactcattattg

SEQ ID NO: 17384 - DNA, 18 bp, synthetic construct
  source 1..18: mol_type = other DNA
aaatacgactcattatta

SEQ ID NO: 17385 - DNA, 18 bp, synthetic construct
  source 1..18: mol_type = other DNA
aaatacgactcgatagag

SEQ ID NO: 17386 - DNA, 18 bp, synthetic construct
  source 1..18: mol_type = other DNA
aaatacgactcgcttaag

SEQ ID NO: 17387 - DNA, 18 bp, synthetic construct
  source 1..18: mol_type = other DNA
aaatacggatcgctatag

SEQ ID NO: 17388 - DNA, 18 bp, synthetic construct
  source 1..18: mol_type = other DNA
aaatatgactcactatta

SEQ ID NO: 17389 - DNA, 18 bp, synthetic construct
  source 1..18: mol_type = other DNA
aaattcgaccccctatag

SEQ ID NO: 17390 - DNA, 18 bp, synthetic construct
  source 1..18: mol_type = other DNA
aagatcgactcactatag

SEQ ID NO: 17391 - DNA, 18 bp, synthetic construct
  source 1..18: mol_type = other DNA
aattaccactcactattg

SEQ ID NO: 17392 - DNA, 18 bp, synthetic construct
  source 1..18: mol_type = other DNA
caagacgacacactattg

SEQ ID NO: 17393 - DNA, 18 bp, synthetic construct
  source 1..18: mol_type = other DNA
caagtcaactcactatag

SEQ ID NO: 17394 - DNA, 18 bp, synthetic construct
  source 1..18: mol_type = other DNA
caataaaactcactattg

SEQ ID NO: 17395 - DNA, 18 bp, synthetic construct
  source 1..18: mol_type = other DNA
caatacgacccactgttg

SEQ ID NO: 17396 - DNA, 18 bp, synthetic construct
  source 1..18: mol_type = other DNA
caatacgactcaattttg

SEQ ID NO: 17397 - DNA, 18 bp, synthetic construct
  source 1..18: mol_type = other DNA
caatacgactcggtctag

SEQ ID NO: 17398 - DNA, 18 bp, synthetic construct
  source 1..18: mol_type = other DNA
caatacgactgcctattg

SEQ ID NO: 17399 - DNA, 18 bp, synthetic construct
  source 1..18: mol_type = other DNA
caatctgactcgctatag

SEQ ID NO: 17400 - DNA, 18 bp, synthetic construct
  source 1..18: mol_type = other DNA
caattcgactcactaagg

SEQ ID NO: 17401 - DNA, 18 bp, synthetic construct
  source 1..18: mol_type = other DNA
caattcgattcactttag

SEQ ID NO: 17402 - DNA, 18 bp, synthetic construct
  source 1..18: mol_type = other DNA
caattcgattcattatag

SEQ ID NO: 17403 - DNA, 18 bp, synthetic construct
  source 1..18: mol_type = other DNA
caattctacttactatag

SEQ ID NO: 17404 - DNA, 18 bp, synthetic construct
  source 1..18: mol_type = other DNA
ccatactactcgctatag

SEQ ID NO: 17405 - DNA, 18 bp, synthetic construct
  source 1..18: mol_type = other DNA
ccattcgactcactacag

SEQ ID NO: 17406 - DNA, 18 bp, synthetic construct
  source 1..18: mol_type = other DNA
gaaaacgactctctattg

SEQ ID NO: 17407 - DNA, 18 bp, synthetic construct
  source 1..18: mol_type = other DNA
gaattagactaactatag

SEQ ID NO: 17408 - DNA, 18 bp, synthetic construct
  source 1..18: mol_type = other DNA
gagttcgactcagtatag

SEQ ID NO: 17409 - DNA, 18 bp, synthetic construct
  source 1..18: mol_type = other DNA
gattacgactccctattg

SEQ ID NO: 17410 - DNA, 18 bp, synthetic construct
  source 1..18: mol_type = other DNA
gatttcgacacactatag

SEQ ID NO: 17411 - DNA, 18 bp, synthetic construct
  source 1..18: mol_type = other DNA
gtatacgacacactattg

SEQ ID NO: 17412 - DNA, 18 bp, synthetic construct
  source 1..18: mol_type = other DNA
taaaacgactcacgtttg

SEQ ID NO: 17413 - DNA, 18 bp, synthetic construct
  source 1..18: mol_type = other DNA
taaaacgactcattgttg

SEQ ID NO: 17414 - DNA, 18 bp, synthetic construct
  source 1..18: mol_type = other DNA
taaaacgactcgacatag

SEQ ID NO: 17415 - DNA, 18 bp, synthetic construct
  source 1..18: mol_type = other DNA
taaaacgactcgatatcg

SEQ ID NO: 17416 - DNA, 18 bp, synthetic construct
  source 1..18: mol_type = other DNA
taaaacgatacgctatag

SEQ ID NO: 17417 - DNA, 18 bp, synthetic construct
  source 1..18: mol_type = other DNA
taaaacggctcactcttg

SEQ ID NO: 17418 - DNA, 18 bp, synthetic construct
  source 1..18: mol_type = other DNA
taaaacggttcactattg

SEQ ID NO: 17419 - DNA, 18 bp, synthetic construct
  source 1..18: mol_type = other DNA
taaaactactcactcttg

SEQ ID NO: 17420 - DNA, 18 bp, synthetic construct
  source 1..18: mol_type = other DNA
taaaactactcgctatgg

SEQ ID NO: 17421 - DNA, 18 bp, synthetic construct
  source 1..18: mol_type = other DNA
taaagcgactcgatatag

SEQ ID NO: 17422 - DNA, 18 bp, synthetic construct
  source 1..18: mol_type = other DNA
taaatcgacccactatcg

SEQ ID NO: 17423 - DNA, 18 bp, synthetic construct
  source 1..18: mol_type = other DNA
taaatcgactcagtaaag

SEQ ID NO: 17424 - DNA, 18 bp, synthetic construct
  source 1..18: mol_type = other DNA
taaatcgtctcactatcg

SEQ ID NO: 17425 - DNA, 18 bp, synthetic construct
  source 1..18: mol_type = other DNA
taacaagactcaatattg

SEQ ID NO: 17426 - DNA, 18 bp, synthetic construct
  source 1..18: mol_type = other DNA
taacaccactcactgttg

SEQ ID NO: 17427 - DNA, 18 bp, synthetic construct
  source 1..18: mol_type = other DNA
taacacgaattactattg

SEQ ID NO: 17428 - DNA, 18 bp, synthetic construct
  source 1..18: mol_type = other DNA
taacacgacttactcttg

SEQ ID NO: 17429 - DNA, 18 bp, synthetic construct
  source 1..18: mol_type = other DNA
taacacgcatcactattg

SEQ ID NO: 17430 - DNA, 18 bp, synthetic construct
  source 1..18: mol_type = other DNA
taacatgactcactgttg

SEQ ID NO: 17431 - DNA, 18 bp, synthetic construct
  source 1..18: mol_type = other DNA
taacccgactaactattg

SEQ ID NO: 17432 - DNA, 18 bp, synthetic construct
  source 1..18: mol_type = other DNA
taactcgaatcactatcg

SEQ ID NO: 17433 - DNA, 18 bp, synthetic construct
  source 1..18: mol_type = other DNA
taactcgactcattctag

SEQ ID NO: 17434 - DNA, 18 bp, synthetic construct
  source 1..18: mol_type = other DNA
taactcgactctctctag

SEQ ID NO: 17435 - DNA, 18 bp, synthetic construct
  source 1..18: mol_type = other DNA
taactcgagtcacaatag

SEQ ID NO: 17436 - DNA, 18 bp, synthetic construct
  source 1..18: mol_type = other DNA
taactcggctcactttag

SEQ ID NO: 17437 - DNA, 18 bp, synthetic construct
  source 1..18: mol_type = other DNA
taagaagactccctattg

SEQ ID NO: 17438 - DNA, 18 bp, synthetic construct
  source 1..18: mol_type = other DNA
taagacaactcacttttg

SEQ ID NO: 17439 - DNA, 18 bp, synthetic construct
  source 1..18: mol_type = other DNA
taagacgaatcgcgatag

SEQ ID NO: 17440 - DNA, 18 bp, synthetic construct
  source 1..18: mol_type = other DNA
taagacgacatactattg

SEQ ID NO: 17441 - DNA, 18 bp, synthetic construct
  source 1..18: mol_type = other DNA
taagacgattcacttttg

SEQ ID NO: 17442 - DNA, 18 bp, synthetic construct
  source 1..18: mol_type = other DNA
taagccggctcgctatag

SEQ ID NO: 17443 - DNA, 18 bp, synthetic construct
  source 1..18: mol_type = other DNA
taagtctacccactatag

SEQ ID NO: 17444 - DNA, 18 bp, synthetic construct
  source 1..18: mol_type = other DNA
taataagactcagtagtg

SEQ ID NO: 17445 - DNA, 18 bp, synthetic construct
  source 1..18: mol_type = other DNA
taataagactggctttag

SEQ ID NO: 17446 - DNA, 18 bp, synthetic construct
  source 1..18: mol_type = other DNA
taataagagtcacttttg

SEQ ID NO: 17447 - DNA, 18 bp, synthetic construct
  source 1..18: mol_type = other DNA
taataagtcacgctatag

SEQ ID NO: 17448 - DNA, 18 bp, synthetic construct
  source 1..18: mol_type = other DNA
taataatactcaccattg

SEQ ID NO: 17449 - DNA, 18 bp, synthetic construct
  source 1..18: mol_type = other DNA
taatacaactcagtgttg

SEQ ID NO: 17450 - DNA, 18 bp, synthetic construct
  source 1..18: mol_type = other DNA
taatacaactccctcttg

SEQ ID NO: 17451 - DNA, 18 bp, synthetic construct
  source 1..18: mol_type = other DNA
taatacaacttactgttg

SEQ ID NO: 17452 - DNA, 18 bp, synthetic construct
  source 1..18: mol_type = other DNA
taatacacctcggtatag

SEQ ID NO: 17453 - DNA, 18 bp, synthetic construct
  source 1..18: mol_type = other DNA
taatacagctcactactg

SEQ ID NO: 17454 - DNA, 18 bp, synthetic construct
  source 1..18: mol_type = other DNA
taataccactcacctttg

SEQ ID NO: 17455 - DNA, 18 bp, synthetic construct
  source 1..18: mol_type = other DNA
taataccagtaactattg

SEQ ID NO: 17456 - DNA, 18 bp, synthetic construct
  source 1..18: mol_type = other DNA
taatacgaagcagtattg

SEQ ID NO: 17457 - DNA, 18 bp, synthetic construct
  source 1..18: mol_type = other DNA
taatacgacgcggaatag

SEQ ID NO: 17458 - DNA, 18 bp, synthetic construct
  source 1..18: mol_type = other DNA
taatacgactcaatcgtg

SEQ ID NO: 17459 - DNA, 18 bp, synthetic construct
  source 1..18: mol_type = other DNA
taatacgactcagcatta

SEQ ID NO: 17460 - DNA, 18 bp, synthetic construct
  source 1..18: mol_type = other DNA
taatacgactcgtttaag

SEQ ID NO: 17461 - DNA, 18 bp, synthetic construct
  source 1..18: mol_type = other DNA
taatacgactctttgttg

SEQ ID NO: 17462 - DNA, 18 bp, synthetic construct
  source 1..18: mol_type = other DNA
taatacgacttacaagtg

SEQ ID NO: 17463 - DNA, 18 bp, synthetic construct
  source 1..18: mol_type = other DNA
taatacgagttgctctag

SEQ ID NO: 17464 - DNA, 18 bp, synthetic construct
  source 1..18: mol_type = other DNA
taatacgatacgatatag

SEQ ID NO: 17465 - DNA, 18 bp, synthetic construct
  source 1..18: mol_type = other DNA
taatacgattagctgtag

SEQ ID NO: 17466 - DNA, 18 bp, synthetic construct
  source 1..18: mol_type = other DNA
taatacggatcacaattg

SEQ ID NO: 17467 - DNA, 18 bp, synthetic construct
  source 1..18: mol_type = other DNA
taatacggctcggtacag

SEQ ID NO: 17468 - DNA, 18 bp, synthetic construct
  source 1..18: mol_type = other DNA
taatacggctgactactg

SEQ ID NO: 17469 - DNA, 18 bp, synthetic construct
  source 1..18: mol_type = other DNA
taatacgtctggctaaag

SEQ ID NO: 17470 - DNA, 18 bp, synthetic construct
  source 1..18: mol_type = other DNA
taatacgtttcgctgtag

SEQ ID NO: 17471 - DNA, 18 bp, synthetic construct
  source 1..18: mol_type = other DNA
taatactactgaatattg

SEQ ID NO: 17472 - DNA, 18 bp, synthetic construct
  source 1..18: mol_type = other DNA
taatactacttactcttg

SEQ ID NO: 17473 - DNA, 18 bp, synthetic construct
  source 1..18: mol_type = other DNA
taatactcatcgctatag

SEQ ID NO: 17474 - DNA, 18 bp, synthetic construct
  source 1..18: mol_type = other DNA
taatagaactcgctagag

SEQ ID NO: 17475 - DNA, 18 bp, synthetic construct
  source 1..18: mol_type = other DNA
taataggactcacttctg

SEQ ID NO: 17476 - DNA, 18 bp, synthetic construct
  source 1..18: mol_type = other DNA
taataggactcataattg

SEQ ID NO: 17477 - DNA, 18 bp, synthetic construct
  source 1..18: mol_type = other DNA
taataggactcgctaccg

SEQ ID NO: 17478 - DNA, 18 bp, synthetic construct
  source 1..18: mol_type = other DNA
taataggactctctcttg

SEQ ID NO: 17479 - DNA, 18 bp, synthetic construct
  source 1..18: mol_type = other DNA
taataggcctctctattg

SEQ ID NO: 17480 - DNA, 18 bp, synthetic construct
  source 1..18: mol_type = other DNA
taatagggatcactattg

SEQ ID NO: 17481 - DNA, 18 bp, synthetic construct
  source 1..18: mol_type = other DNA
taatatatctcgctatag

SEQ ID NO: 17482 - DNA, 18 bp, synthetic construct
  source 1..18: mol_type = other DNA
taatatcactctctattg

SEQ ID NO: 17483 - DNA, 18 bp, synthetic construct
  source 1..18: mol_type = other DNA
taatatgaatccctattg

SEQ ID NO: 17484 - DNA, 18 bp, synthetic construct
  source 1..18: mol_type = other DNA
taatatgactcgctctcg

SEQ ID NO: 17485 - DNA, 18 bp, synthetic construct
  source 1..18: mol_type = other DNA
taatatgattcgccatag

SEQ ID NO: 17486 - DNA, 18 bp, synthetic construct
  source 1..18: mol_type = other DNA
taatatgattcgctctag

SEQ ID NO: 17487 - DNA, 18 bp, synthetic construct
  source 1..18: mol_type = other DNA
taatcagacacactattg

SEQ ID NO: 17488 - DNA, 18 bp, synthetic construct
  source 1..18: mol_type = other DNA
taatcagactcgctaaag

SEQ ID NO: 17489 - DNA, 18 bp, synthetic construct
  source 1..18: mol_type = other DNA
taatccgactcgctggag

SEQ ID NO: 17490 - DNA, 18 bp, synthetic construct
  source 1..18: mol_type = other DNA
taatgcgacgaactattg

SEQ ID NO: 17491 - DNA, 18 bp, synthetic construct
  source 1..18: mol_type = other DNA
taatgcgactcaaaattg

SEQ ID NO: 17492 - DNA, 18 bp, synthetic construct
  source 1..18: mol_type = other DNA
taatgcgcctcactagtg

SEQ ID NO: 17493 - DNA, 18 bp, synthetic construct
  source 1..18: mol_type = other DNA
taatgcggctgactattg

SEQ ID NO: 17494 - DNA, 18 bp, synthetic construct
  source 1..18: mol_type = other DNA
taatgtgactcactaatg

SEQ ID NO: 17495 - DNA, 18 bp, synthetic construct
  source 1..18: mol_type = other DNA
taattagactctccatag

SEQ ID NO: 17496 - DNA, 18 bp, synthetic construct
  source 1..18: mol_type = other DNA
taattcaactcactaacg

SEQ ID NO: 17497 - DNA, 18 bp, synthetic construct
  source 1..18: mol_type = other DNA
taattcaattcactatgg

SEQ ID NO: 17498 - DNA, 18 bp, synthetic construct
  source 1..18: mol_type = other DNA
taattccactcactggag

SEQ ID NO: 17499 - DNA, 18 bp, synthetic construct
  source 1..18: mol_type = other DNA
taattccactgactttag

SEQ ID NO: 17500 - DNA, 18 bp, synthetic construct
  source 1..18: mol_type = other DNA
taattcccctcactaaag

SEQ ID NO: 17501 - DNA, 18 bp, synthetic construct
  source 1..18: mol_type = other DNA
taattccgctcaatatag

SEQ ID NO: 17502 - DNA, 18 bp, synthetic construct
  source 1..18: mol_type = other DNA
taattcctcccactatag

SEQ ID NO: 17503 - DNA, 18 bp, synthetic construct
  source 1..18: mol_type = other DNA
taattcgaatcccaatag

SEQ ID NO: 17504 - DNA, 18 bp, synthetic construct
  source 1..18: mol_type = other DNA
taattcgactcaacttag

SEQ ID NO: 17505 - DNA, 18 bp, synthetic construct
  source 1..18: mol_type = other DNA
taattcgactcacttacg

SEQ ID NO: 17506 - DNA, 18 bp, synthetic construct
  source 1..18: mol_type = other DNA
taattcgactccataaag

SEQ ID NO: 17507 - DNA, 18 bp, synthetic construct
  source 1..18: mol_type = other DNA
taattcgactctcaatcg

SEQ ID NO: 17508 - DNA, 18 bp, synthetic construct
  source 1..18: mol_type = other DNA
taattcgactctccatcg

SEQ ID NO: 17509 - DNA, 18 bp, synthetic construct
  source 1..18: mol_type = other DNA
taattcgactgaatttag

SEQ ID NO: 17510 - DNA, 18 bp, synthetic construct
  source 1..18: mol_type = other DNA
taattcgacttaccacag

SEQ ID NO: 17511 - DNA, 18 bp, synthetic construct
  source 1..18: mol_type = other DNA
taattcgacttacttcag

SEQ ID NO: 17512 - DNA, 18 bp, synthetic construct
  source 1..18: mol_type = other DNA
taattcgagtcattacag

SEQ ID NO: 17513 - DNA, 18 bp, synthetic construct
  source 1..18: mol_type = other DNA
taattcgcctcattacag

SEQ ID NO: 17514 - DNA, 18 bp, synthetic construct
  source 1..18: mol_type = other DNA
taattcgcgacactatag

SEQ ID NO: 17515 - DNA, 18 bp, synthetic construct
  source 1..18: mol_type = other DNA
taattcgctgcactatag

SEQ ID NO: 17516 - DNA, 18 bp, synthetic construct
  source 1..18: mol_type = other DNA
taattcggctcaccaaag

SEQ ID NO: 17517 - DNA, 18 bp, synthetic construct
  source 1..18: mol_type = other DNA
taattcgtatcactatcg

SEQ ID NO: 17518 - DNA, 18 bp, synthetic construct
  source 1..18: mol_type = other DNA
taattcgtcccagtatag

SEQ ID NO: 17519 - DNA, 18 bp, synthetic construct
  source 1..18: mol_type = other DNA
taattcgtcgcacgatag

SEQ ID NO: 17520 - DNA, 18 bp, synthetic construct
  source 1..18: mol_type = other DNA
taattcgtctcacagtag

SEQ ID NO: 17521 - DNA, 18 bp, synthetic construct
  source 1..18: mol_type = other DNA
taattctaatccctatag

SEQ ID NO: 17522 - DNA, 18 bp, synthetic construct
  source 1..18: mol_type = other DNA
taattctactcacaatcg

SEQ ID NO: 17523 - DNA, 18 bp, synthetic construct
  source 1..18: mol_type = other DNA
taattctactcactctcg

SEQ ID NO: 17524 - DNA, 18 bp, synthetic construct
  source 1..18: mol_type = other DNA
taattctggtcactatag

SEQ ID NO: 17525 - DNA, 18 bp, synthetic construct
  source 1..18: mol_type = other DNA
taattggacacactatcg

SEQ ID NO: 17526 - DNA, 18 bp, synthetic construct
  source 1..18: mol_type = other DNA
taattggacacactatgg

SEQ ID NO: 17527 - DNA, 18 bp, synthetic construct
  source 1..18: mol_type = other DNA
taattggacactctatag

SEQ ID NO: 17528 - DNA, 18 bp, synthetic construct
  source 1..18: mol_type = other DNA
taattggacttactaaag

SEQ ID NO: 17529 - DNA, 18 bp, synthetic construct
  source 1..18: mol_type = other DNA
taattggattcattatag

SEQ ID NO: 17530 - DNA, 18 bp, synthetic construct
  source 1..18: mol_type = other DNA
taattgggctcactatgg

SEQ ID NO: 17531 - DNA, 18 bp, synthetic construct
  source 1..18: mol_type = other DNA
taatttacctcactatag

SEQ ID NO: 17532 - DNA, 18 bp, synthetic construct
  source 1..18: mol_type = other DNA
taatttgacttactgtag

SEQ ID NO: 17533 - DNA, 18 bp, synthetic construct
  source 1..18: mol_type = other DNA
taatttgtctcaccatag

SEQ ID NO: 17534 - DNA, 18 bp, synthetic construct
  source 1..18: mol_type = other DNA
tacatcgactcacgatag

SEQ ID NO: 17535 - DNA, 18 bp, synthetic construct
  source 1..18: mol_type = other DNA
tacatcgagtcactatag

SEQ ID NO: 17536 - DNA, 18 bp, synthetic construct
  source 1..18: mol_type = other DNA
tactacaactcactactg

SEQ ID NO: 17537 - DNA, 18 bp, synthetic construct
  source 1..18: mol_type = other DNA
tactaccactcactaatg

SEQ ID NO: 17538 - DNA, 18 bp, synthetic construct
  source 1..18: mol_type = other DNA
tactacgaatctctattg

SEQ ID NO: 17539 - DNA, 18 bp, synthetic construct
  source 1..18: mol_type = other DNA
tactacgacacactaatg

SEQ ID NO: 17540 - DNA, 18 bp, synthetic construct
  source 1..18: mol_type = other DNA
tactacgaccagctatag

SEQ ID NO: 17541 - DNA, 18 bp, synthetic construct
  source 1..18: mol_type = other DNA
tactacgagtcaatattg

SEQ ID NO: 17542 - DNA, 18 bp, synthetic construct
  source 1..18: mol_type = other DNA
tactagaactcactattg

SEQ ID NO: 17543 - DNA, 18 bp, synthetic construct
  source 1..18: mol_type = other DNA
tactatggctcactattg

SEQ ID NO: 17544 - DNA, 18 bp, synthetic construct
  source 1..18: mol_type = other DNA
tacttcgactcagtaaag

SEQ ID NO: 17545 - DNA, 18 bp, synthetic construct
  source 1..18: mol_type = other DNA
tacttcgactctttatag

SEQ ID NO: 17546 - DNA, 18 bp, synthetic construct
  source 1..18: mol_type = other DNA
tacttcgacttattatag

SEQ ID NO: 17547 - DNA, 18 bp, synthetic construct
  source 1..18: mol_type = other DNA
tacttcgatccactatag

SEQ ID NO: 17548 - DNA, 18 bp, synthetic construct
  source 1..18: mol_type = other DNA
tacttcgattaactatag

SEQ ID NO: 17549 - DNA, 18 bp, synthetic construct
  source 1..18: mol_type = other DNA
tagaacgactcgatatag

SEQ ID NO: 17550 - DNA, 18 bp, synthetic construct
  source 1..18: mol_type = other DNA
tagatcgactcactgtag

SEQ ID NO: 17551 - DNA, 18 bp, synthetic construct
  source 1..18: mol_type = other DNA
tagcacaactcgctatag

SEQ ID NO: 17552 - DNA, 18 bp, synthetic construct
  source 1..18: mol_type = other DNA
tagtaccactcgctttag

SEQ ID NO: 17553 - DNA, 18 bp, synthetic construct
  source 1..18: mol_type = other DNA
tagtacgactaagtattg

SEQ ID NO: 17554 - DNA, 18 bp, synthetic construct
  source 1..18: mol_type = other DNA
tagtacgactcaatgttg

SEQ ID NO: 17555 - DNA, 18 bp, synthetic construct
  source 1..18: mol_type = other DNA
tagtacgactcgatttag

SEQ ID NO: 17556 - DNA, 18 bp, synthetic construct
  source 1..18: mol_type = other DNA
tagtacggctctctattg

SEQ ID NO: 17557 - DNA, 18 bp, synthetic construct
  source 1..18: mol_type = other DNA
tagtatgactcggtatag

SEQ ID NO: 17558 - DNA, 18 bp, synthetic construct
  source 1..18: mol_type = other DNA
tagtccgagtcgctatag

SEQ ID NO: 17559 - DNA, 18 bp, synthetic construct
  source 1..18: mol_type = other DNA
tagttcgactgacaatag

SEQ ID NO: 17560 - DNA, 18 bp, synthetic construct
  source 1..18: mol_type = other DNA
tagttcgacttactatcg

SEQ ID NO: 17561 - DNA, 18 bp, synthetic construct
  source 1..18: mol_type = other DNA
tagttcgtctcactgtag

SEQ ID NO: 17562 - DNA, 18 bp, synthetic construct
  source 1..18: mol_type = other DNA
tataaggactcgctatag

SEQ ID NO: 17563 - DNA, 18 bp, synthetic construct
  source 1..18: mol_type = other DNA
tatcacgactcactgttg

SEQ ID NO: 17564 - DNA, 18 bp, synthetic construct
  source 1..18: mol_type = other DNA
tattaccactcgctagag

SEQ ID NO: 17565 - DNA, 18 bp, synthetic construct
  source 1..18: mol_type = other DNA
tattacgaatcacgattg

SEQ ID NO: 17566 - DNA, 18 bp, synthetic construct
  source 1..18: mol_type = other DNA
tattacgactcgtcatag

SEQ ID NO: 17567 - DNA, 18 bp, synthetic construct
  source 1..18: mol_type = other DNA
tattacgacttgcaatag

SEQ ID NO: 17568 - DNA, 18 bp, synthetic construct
  source 1..18: mol_type = other DNA
tattacgatccactattg

SEQ ID NO: 17569 - DNA, 18 bp, synthetic construct
  source 1..18: mol_type = other DNA
tattacgtcgcgctatag

SEQ ID NO: 17570 - DNA, 18 bp, synthetic construct
  source 1..18: mol_type = other DNA
tattacgtctgactattg

SEQ ID NO: 17571 - DNA, 18 bp, synthetic construct
  source 1..18: mol_type = other DNA
tattgcaactcgctatag

SEQ ID NO: 17572 - DNA, 18 bp, synthetic construct
  source 1..18: mol_type = other DNA
tattgcgactcaccattg

SEQ ID NO: 17573 - DNA, 18 bp, synthetic construct
  source 1..18: mol_type = other DNA
tatttcgactcactctcg

SEQ ID NO: 17574 - DNA, 18 bp, synthetic construct
  source 1..18: mol_type = other DNA
tatttcggcacactatag

SEQ ID NO: 17575 - DNA, 18 bp, synthetic construct
  source 1..18: mol_type = other DNA
tattttaactcactatag

SEQ ID NO: 17576 - DNA, 18 bp, synthetic construct
  source 1..18: mol_type = other DNA
tattttgactcactgtag

SEQ ID NO: 17577 - DNA, 18 bp, synthetic construct
  source 1..18: mol_type = other DNA
tcactcgactcactatcg

SEQ ID NO: 17578 - DNA, 18 bp, synthetic construct
  source 1..18: mol_type = other DNA
tcatacgacttactgttg

SEQ ID NO: 17579 - DNA, 18 bp, synthetic construct
  source 1..18: mol_type = other DNA
tcatacgattcgctatgg

SEQ ID NO: 17580 - DNA, 18 bp, synthetic construct
  source 1..18: mol_type = other DNA
tcattccactgactatag

SEQ ID NO: 17581 - DNA, 18 bp, synthetic construct
  source 1..18: mol_type = other DNA
tcattccattcactatag

SEQ ID NO: 17582 - DNA, 18 bp, synthetic construct
  source 1..18: mol_type = other DNA
tcattcgactcacttgag

SEQ ID NO: 17583 - DNA, 18 bp, synthetic construct
  source 1..18: mol_type = other DNA
tcattcgagtcacaatag

SEQ ID NO: 17584 - DNA, 18 bp, synthetic construct
  source 1..18: mol_type = other DNA
tcattcggctcactttag

SEQ ID NO: 17585 - DNA, 18 bp, synthetic construct
  source 1..18: mol_type = other DNA
tcattggactcactaaag

SEQ ID NO: 17586 - DNA, 18 bp, synthetic construct
  source 1..18: mol_type = other DNA
tccttctactcactatag

SEQ ID NO: 17587 - DNA, 18 bp, synthetic construct
  source 1..18: mol_type = other DNA
tcgttagactcactatag

SEQ ID NO: 17588 - DNA, 18 bp, synthetic construct
  source 1..18: mol_type = other DNA
tgatacgactggttatag

SEQ ID NO: 17589 - DNA, 18 bp, synthetic construct
  source 1..18: mol_type = other DNA
tgatgcgtctcgctatag

SEQ ID NO: 17590 - DNA, 18 bp, synthetic construct
  source 1..18: mol_type = other DNA
tgattcgaatcacaatag

SEQ ID NO: 17591 - DNA, 18 bp, synthetic construct
  source 1..18: mol_type = other DNA
tgattcgactcagtacag

SEQ ID NO: 17592 - DNA, 18 bp, synthetic construct
  source 1..18: mol_type = other DNA
tgattcgactcattacag

SEQ ID NO: 17593 - DNA, 18 bp, synthetic construct
  source 1..18: mol_type = other DNA
tgattcgtctaactatag

SEQ ID NO: 17594 - DNA, 18 bp, synthetic construct
  source 1..18: mol_type = other DNA
tgatttgactcaatatag

SEQ ID NO: 17595 - DNA, 18 bp, synthetic construct
  source 1..18: mol_type = other DNA
tggtacgactgactattg

SEQ ID NO: 17596 - DNA, 18 bp, synthetic construct
  source 1..18: mol_type = other DNA
ttaaaagactcgctatag

SEQ ID NO: 17597 - DNA, 18 bp, synthetic construct
  source 1..18: mol_type = other DNA
ttataagaatcgctatag

SEQ ID NO: 17598 - DNA, 18 bp, synthetic construct
  source 1..18: mol_type = other DNA
ttataagactcgccatag

SEQ ID NO: 17599 - DNA, 18 bp, synthetic construct
  source 1..18: mol_type = other DNA
ttataccacccgctatag

SEQ ID NO: 17600 - DNA, 18 bp, synthetic construct
  source 1..18: mol_type = other DNA
ttatacgacaagctatag

SEQ ID NO: 17601 - DNA, 18 bp, synthetic construct
  source 1..18: mol_type = other DNA
ttatacgactcaccatta

SEQ ID NO: 17602 - DNA, 18 bp, synthetic construct
  source 1..18: mol_type = other DNA
ttatacgactcactaata

SEQ ID NO: 17603 - DNA, 18 bp, synthetic construct
  source 1..18: mol_type = other DNA
ttatacgactcattactg

SEQ ID NO: 17604 - DNA, 18 bp, synthetic construct
  source 1..18: mol_type = other DNA
ttatacgactcgaaatag

SEQ ID NO: 17605 - DNA, 18 bp, synthetic construct
  source 1..18: mol_type = other DNA
ttatacgactcgacatag

SEQ ID NO: 17606 - DNA, 18 bp, synthetic construct
  source 1..18: mol_type = other DNA
ttataggactcgcaatag

SEQ ID NO: 17607 - DNA, 18 bp, synthetic construct
  source 1..18: mol_type = other DNA
ttatccgactcactgttg

SEQ ID NO: 17608 - DNA, 18 bp, synthetic construct
  source 1..18: mol_type = other DNA
ttatctgactcactattg

SEQ ID NO: 17609 - DNA, 18 bp, synthetic construct
  source 1..18: mol_type = other DNA
ttatgcgacccactattg

SEQ ID NO: 17610 - DNA, 18 bp, synthetic construct
  source 1..18: mol_type = other DNA
ttattcgactcactgaag

SEQ ID NO: 17611 - DNA, 18 bp, synthetic construct
  source 1..18: mol_type = other DNA
ttattcgactcactttgg

SEQ ID NO: 17612 - DNA, 18 bp, synthetic construct
  source 1..18: mol_type = other DNA
ttattcgcatcactatag

SEQ ID NO: 17613 - DNA, 18 bp, synthetic construct
  source 1..18: mol_type = other DNA
ttatttgactcacgatag

SEQ ID NO: 17614 - DNA, 18 bp, synthetic construct
  source 1..18: mol_type = other DNA
ttttacgactcaccattg

SEQ ID NO: 17615 - DNA, 18 bp, synthetic construct
  source 1..18: mol_type = other DNA
aaaaacgacccactgtag

SEQ ID NO: 17616 - DNA, 18 bp, synthetic construct
  source 1..18: mol_type = other DNA
aaaaacgactcactttcg

SEQ ID NO: 17617 - DNA, 18 bp, synthetic construct
  source 1..18: mol_type = other DNA
aaaaactagtcactatag

SEQ ID NO: 17618 - DNA, 18 bp, synthetic construct
  source 1..18: mol_type = other DNA
aaacaccactcattatag

SEQ ID NO: 17619 - DNA, 18 bp, synthetic construct
  source 1..18: mol_type = other DNA
aaagactactcactctag

SEQ ID NO: 17620 - DNA, 18 bp, synthetic construct
  source 1..18: mol_type = other DNA
aaataagactcactctgg

SEQ ID NO: 17621 - DNA, 18 bp, synthetic construct
  source 1..18: mol_type = other DNA
aaatacaaagcactatag

SEQ ID NO: 17622 - DNA, 18 bp, synthetic construct
  source 1..18: mol_type = other DNA
aaatacgaacgactatag

SEQ ID NO: 17623 - DNA, 18 bp, synthetic construct
  source 1..18: mol_type = other DNA
aaatacgaatcacaatcg

SEQ ID NO: 17624 - DNA, 18 bp, synthetic construct
  source 1..18: mol_type = other DNA
aaatacgacccaccaaag

SEQ ID NO: 17625 - DNA, 18 bp, synthetic construct
  source 1..18: mol_type = other DNA
aaatacgactaccaatag

SEQ ID NO: 17626 - DNA, 18 bp, synthetic construct
  source 1..18: mol_type = other DNA
aaatacgactcctaatag

SEQ ID NO: 17627 - DNA, 18 bp, synthetic construct
  source 1..18: mol_type = other DNA
aaatacgactctatataa

SEQ ID NO: 17628 - DNA, 18 bp, synthetic construct
  source 1..18: mol_type = other DNA
aaatacgacttactgtcg

SEQ ID NO: 17629 - DNA, 18 bp, synthetic construct
  source 1..18: mol_type = other DNA
aaatacgactttccatag

SEQ ID NO: 17630 - DNA, 18 bp, synthetic construct
  source 1..18: mol_type = other DNA
aaatacgatacacgatag

SEQ ID NO: 17631 - DNA, 18 bp, synthetic construct
  source 1..18: mol_type = other DNA
aaatacgcctcacgatgg

SEQ ID NO: 17632 - DNA, 18 bp, synthetic construct
  source 1..18: mol_type = other DNA
aaatacgtgttactatag

SEQ ID NO: 17633 - DNA, 18 bp, synthetic construct
  source 1..18: mol_type = other DNA
aaatactactgattatag

SEQ ID NO: 17634 - DNA, 18 bp, synthetic construct
  source 1..18: mol_type = other DNA
aaatactcctcactaaag

SEQ ID NO: 17635 - DNA, 18 bp, synthetic construct
  source 1..18: mol_type = other DNA
aaatactgctcacgatag

SEQ ID NO: 17636 - DNA, 18 bp, synthetic construct
  source 1..18: mol_type = other DNA
aaatatagctcactatag

SEQ ID NO: 17637 - DNA, 18 bp, synthetic construct
  source 1..18: mol_type = other DNA
aaatcagactcactttag

SEQ ID NO: 17638 - DNA, 18 bp, synthetic construct
  source 1..18: mol_type = other DNA
aaatccgactcaatagag

SEQ ID NO: 17639 - DNA, 18 bp, synthetic construct
  source 1..18: mol_type = other DNA
aaatgcaactcattatag

SEQ ID NO: 17640 - DNA, 18 bp, synthetic construct
  source 1..18: mol_type = other DNA
aaatgcgactcactcaag

SEQ ID NO: 17641 - DNA, 18 bp, synthetic construct
  source 1..18: mol_type = other DNA
aaatgcgacttactagag

SEQ ID NO: 17642 - DNA, 18 bp, synthetic construct
  source 1..18: mol_type = other DNA
aaatgcgcatcactatag

SEQ ID NO: 17643 - DNA, 18 bp, synthetic construct
  source 1..18: mol_type = other DNA
aaatgctactcactgtag

SEQ ID NO: 17644 - DNA, 18 bp, synthetic construct
  source 1..18: mol_type = other DNA
aaccacgactctctatag

SEQ ID NO: 17645 - DNA, 18 bp, synthetic construct
  source 1..18: mol_type = other DNA
aactacaactgactatag

SEQ ID NO: 17646 - DNA, 18 bp, synthetic construct
  source 1..18: mol_type = other DNA
aactaccactcactatgg

SEQ ID NO: 17647 - DNA, 18 bp, synthetic construct
  source 1..18: mol_type = other DNA
aactacgactcacaatgg

SEQ ID NO: 17648 - DNA, 18 bp, synthetic construct
  source 1..18: mol_type = other DNA
aactgcgaatcactatag

SEQ ID NO: 17649 - DNA, 18 bp, synthetic construct
  source 1..18: mol_type = other DNA
aagcacgactcaccatag

SEQ ID NO: 17650 - DNA, 18 bp, synthetic construct
  source 1..18: mol_type = other DNA
aagtacaactcacgatag

SEQ ID NO: 17651 - DNA, 18 bp, synthetic construct
  source 1..18: mol_type = other DNA
aagtacgactcacgatgg

SEQ ID NO: 17652 - DNA, 18 bp, synthetic construct
  source 1..18: mol_type = other DNA
aattaccactcagtatag

SEQ ID NO: 17653 - DNA, 18 bp, synthetic construct
  source 1..18: mol_type = other DNA
aattacgactcactgaag

SEQ ID NO: 17654 - DNA, 18 bp, synthetic construct
  source 1..18: mol_type = other DNA
aattacgtcccactatag

SEQ ID NO: 17655 - DNA, 18 bp, synthetic construct
  source 1..18: mol_type = other DNA
aattccgactcactatcg

SEQ ID NO: 17656 - DNA, 18 bp, synthetic construct
  source 1..18: mol_type = other DNA
acaaacgactcactctag

SEQ ID NO: 17657 - DNA, 18 bp, synthetic construct
  source 1..18: mol_type = other DNA
acatacgattcattatag

SEQ ID NO: 17658 - DNA, 18 bp, synthetic construct
  source 1..18: mol_type = other DNA
acatatgagtcactatag

SEQ ID NO: 17659 - DNA, 18 bp, synthetic construct
  source 1..18: mol_type = other DNA
agacaccactcactatag

SEQ ID NO: 17660 - DNA, 18 bp, synthetic construct
  source 1..18: mol_type = other DNA
agatacgactcaccttag

SEQ ID NO: 17661 - DNA, 18 bp, synthetic construct
  source 1..18: mol_type = other DNA
agatacgcctcactgtag

SEQ ID NO: 17662 - DNA, 18 bp, synthetic construct
  source 1..18: mol_type = other DNA
atatacagctcactatag

SEQ ID NO: 17663 - DNA, 18 bp, synthetic construct
  source 1..18: mol_type = other DNA
atatacgaattactatag

SEQ ID NO: 17664 - DNA, 18 bp, synthetic construct
  source 1..18: mol_type = other DNA
atatacgacaccctatag

SEQ ID NO: 17665 - DNA, 18 bp, synthetic construct
  source 1..18: mol_type = other DNA
atatacgactcacggtag

SEQ ID NO: 17666 - DNA, 18 bp, synthetic construct
  source 1..18: mol_type = other DNA
atatacgactcattctag

SEQ ID NO: 17667 - DNA, 18 bp, synthetic construct
  source 1..18: mol_type = other DNA
caaaaccactctctatag

SEQ ID NO: 17668 - DNA, 18 bp, synthetic construct
  source 1..18: mol_type = other DNA
caaaacgaccgactatag

SEQ ID NO: 17669 - DNA, 18 bp, synthetic construct
  source 1..18: mol_type = other DNA
caaaacgtatcactatag

SEQ ID NO: 17670 - DNA, 18 bp, synthetic construct
  source 1..18: mol_type = other DNA
caacaaaactcactatag

SEQ ID NO: 17671 - DNA, 18 bp, synthetic construct
  source 1..18: mol_type = other DNA
caacaagacacactatag

SEQ ID NO: 17672 - DNA, 18 bp, synthetic construct
  source 1..18: mol_type = other DNA
caagaagacttactatag

SEQ ID NO: 17673 - DNA, 18 bp, synthetic construct
  source 1..18: mol_type = other DNA
caataagactcacaatgg

SEQ ID NO: 17674 - DNA, 18 bp, synthetic construct
  source 1..18: mol_type = other DNA
caatacaactctcaatag

SEQ ID NO: 17675 - DNA, 18 bp, synthetic construct
  source 1..18: mol_type = other DNA
caatacaacttaccatag

SEQ ID NO: 17676 - DNA, 18 bp, synthetic construct
  source 1..18: mol_type = other DNA
caataccactcacaatgg

SEQ ID NO: 17677 - DNA, 18 bp, synthetic construct
  source 1..18: mol_type = other DNA
caatacgaatttctatag

SEQ ID NO: 17678 - DNA, 18 bp, synthetic construct
  source 1..18: mol_type = other DNA
caatacgactctcggtag

SEQ ID NO: 17679 - DNA, 18 bp, synthetic construct
  source 1..18: mol_type = other DNA
caatacgactgataatag

SEQ ID NO: 17680 - DNA, 18 bp, synthetic construct
  source 1..18: mol_type = other DNA
caatacgatccactatcg

SEQ ID NO: 17681 - DNA, 18 bp, synthetic construct
  source 1..18: mol_type = other DNA
caatacgattcaaaatag

SEQ ID NO: 17682 - DNA, 18 bp, synthetic construct
  source 1..18: mol_type = other DNA
caatactactctctacag

SEQ ID NO: 17683 - DNA, 18 bp, synthetic construct
  source 1..18: mol_type = other DNA
caatactagtcactatcg

SEQ ID NO: 17684 - DNA, 18 bp, synthetic construct
  source 1..18: mol_type = other DNA
caatataactcactatcg

SEQ ID NO: 17685 - DNA, 18 bp, synthetic construct
  source 1..18: mol_type = other DNA
caatatgattcactagag

SEQ ID NO: 17686 - DNA, 18 bp, synthetic construct
  source 1..18: mol_type = other DNA
caatccgactccctatcg

SEQ ID NO: 17687 - DNA, 18 bp, synthetic construct
  source 1..18: mol_type = other DNA
caatccgacttagtatag

SEQ ID NO: 17688 - DNA, 18 bp, synthetic construct
  source 1..18: mol_type = other DNA
caatccgcctcactttag

SEQ ID NO: 17689 - DNA, 18 bp, synthetic construct
  source 1..18: mol_type = other DNA
caatgagactgactatag

SEQ ID NO: 17690 - DNA, 18 bp, synthetic construct
  source 1..18: mol_type = other DNA
caatgctactcactgtag

SEQ ID NO: 17691 - DNA, 18 bp, synthetic construct
  source 1..18: mol_type = other DNA
caatgctattcactatag

SEQ ID NO: 17692 - DNA, 18 bp, synthetic construct
  source 1..18: mol_type = other DNA
cactccgactcactaaag

SEQ ID NO: 17693 - DNA, 18 bp, synthetic construct
  source 1..18: mol_type = other DNA
cagtaccactcactttag

SEQ ID NO: 17694 - DNA, 18 bp, synthetic construct
  source 1..18: mol_type = other DNA
cagtacgattcacaatag

SEQ ID NO: 17695 - DNA, 18 bp, synthetic construct
  source 1..18: mol_type = other DNA
cattacgacgcactttag

SEQ ID NO: 17696 - DNA, 18 bp, synthetic construct
  source 1..18: mol_type = other DNA
cattacgactcactacgg

SEQ ID NO: 17697 - DNA, 18 bp, synthetic construct
  source 1..18: mol_type = other DNA
cattacgactcatcatag

SEQ ID NO: 17698 - DNA, 18 bp, synthetic construct
  source 1..18: mol_type = other DNA
cattactactcactaaag

SEQ ID NO: 17699 - DNA, 18 bp, synthetic construct
  source 1..18: mol_type = other DNA
cattaggaatcactatag

SEQ ID NO: 17700 - DNA, 18 bp, synthetic construct
  source 1..18: mol_type = other DNA
ccatacaactctctatag

SEQ ID NO: 17701 - DNA, 18 bp, synthetic construct
  source 1..18: mol_type = other DNA
ccatacgactcaataaag

SEQ ID NO: 17702 - DNA, 18 bp, synthetic construct
  source 1..18: mol_type = other DNA
ccatactactcactgtag

SEQ ID NO: 17703 - DNA, 18 bp, synthetic construct
  source 1..18: mol_type = other DNA
ccttaccactcactatag

SEQ ID NO: 17704 - DNA, 18 bp, synthetic construct
  source 1..18: mol_type = other DNA
cgatacgactcaaaatag

SEQ ID NO: 17705 - DNA, 18 bp, synthetic construct
  source 1..18: mol_type = other DNA
cgatacgactcattaaag

SEQ ID NO: 17706 - DNA, 18 bp, synthetic construct
  source 1..18: mol_type = other DNA
cgatacgtcgcactatag

SEQ ID NO: 17707 - DNA, 18 bp, synthetic construct
  source 1..18: mol_type = other DNA
cgatacgtctcagtatag

SEQ ID NO: 17708 - DNA, 18 bp, synthetic construct
  source 1..18: mol_type = other DNA
ctaaacgtctcactatag

SEQ ID NO: 17709 - DNA, 18 bp, synthetic construct
  source 1..18: mol_type = other DNA
ctatacccctcactatag

SEQ ID NO: 17710 - DNA, 18 bp, synthetic construct
  source 1..18: mol_type = other DNA
gaaaacaattcactatag

SEQ ID NO: 17711 - DNA, 18 bp, synthetic construct
  source 1..18: mol_type = other DNA
gaaaacgactaactatcg

SEQ ID NO: 17712 - DNA, 18 bp, synthetic construct
  source 1..18: mol_type = other DNA
gaataagattaactatag

SEQ ID NO: 17713 - DNA, 18 bp, synthetic construct
  source 1..18: mol_type = other DNA
gaatacgaatctctacag

SEQ ID NO: 17714 - DNA, 18 bp, synthetic construct
  source 1..18: mol_type = other DNA
gaatacgactcaatcgag

SEQ ID NO: 17715 - DNA, 18 bp, synthetic construct
  source 1..18: mol_type = other DNA
gaatacgactccccgtag

SEQ ID NO: 17716 - DNA, 18 bp, synthetic construct
  source 1..18: mol_type = other DNA
gaatacgactgtctagag

SEQ ID NO: 17717 - DNA, 18 bp, synthetic construct
  source 1..18: mol_type = other DNA
gaatacgacttaccaaag

SEQ ID NO: 17718 - DNA, 18 bp, synthetic construct
  source 1..18: mol_type = other DNA
gaatacgagtaaccatag

SEQ ID NO: 17719 - DNA, 18 bp, synthetic construct
  source 1..18: mol_type = other DNA
gaatatgacacacgatag

SEQ ID NO: 17720 - DNA, 18 bp, synthetic construct
  source 1..18: mol_type = other DNA
gaatatgtttcactatag

SEQ ID NO: 17721 - DNA, 18 bp, synthetic construct
  source 1..18: mol_type = other DNA
gaatccgacacacaatag

SEQ ID NO: 17722 - DNA, 18 bp, synthetic construct
  source 1..18: mol_type = other DNA
gaatccgatttactatag

SEQ ID NO: 17723 - DNA, 18 bp, synthetic construct
  source 1..18: mol_type = other DNA
gattacgactcaatatcg

SEQ ID NO: 17724 - DNA, 18 bp, synthetic construct
  source 1..18: mol_type = other DNA
gattacgactcattttag

SEQ ID NO: 17725 - DNA, 18 bp, synthetic construct
  source 1..18: mol_type = other DNA
gtacacgacacactatag

SEQ ID NO: 17726 - DNA, 18 bp, synthetic construct
  source 1..18: mol_type = other DNA
taaaaagacctactatag

SEQ ID NO: 17727 - DNA, 18 bp, synthetic construct
  source 1..18: mol_type = other DNA
taaaaagactcaataaag

SEQ ID NO: 17728 - DNA, 18 bp, synthetic construct
  source 1..18: mol_type = other DNA
taaaaagactccctatgg

SEQ ID NO: 17729 - DNA, 18 bp, synthetic construct
  source 1..18: mol_type = other DNA
taaaaccattcactaaag

SEQ ID NO: 17730 - DNA, 18 bp, synthetic construct
  source 1..18: mol_type = other DNA
taaaacgaatcaagatag

SEQ ID NO: 17731 - DNA, 18 bp, synthetic construct
  source 1..18: mol_type = other DNA
taaaacgaatcaatatcg

SEQ ID NO: 17732 - DNA, 18 bp, synthetic construct
  source 1..18: mol_type = other DNA
taaaacgacgcacaatcg

SEQ ID NO: 17733 - DNA, 18 bp, synthetic construct
  source 1..18: mol_type = other DNA
taaaacgactaattatgg

SEQ ID NO: 17734 - DNA, 18 bp, synthetic construct
  source 1..18: mol_type = other DNA
taaaacgactcaccgaag

SEQ ID NO: 17735 - DNA, 18 bp, synthetic construct
  source 1..18: mol_type = other DNA
taaaacgactcactcagg

SEQ ID NO: 17736 - DNA, 18 bp, synthetic construct
  source 1..18: mol_type = other DNA
taaaacgactcagagtag

SEQ ID NO: 17737 - DNA, 18 bp, synthetic construct
  source 1..18: mol_type = other DNA
taaaacgactcagcatgg

SEQ ID NO: 17738 - DNA, 18 bp, synthetic construct
  source 1..18: mol_type = other DNA
taaaacgactctgtttag

SEQ ID NO: 17739 - DNA, 18 bp, synthetic construct
  source 1..18: mol_type = other DNA
taaaacgacttacaatat

SEQ ID NO: 17740 - DNA, 18 bp, synthetic construct
  source 1..18: mol_type = other DNA
taaaacgacttccaatag

SEQ ID NO: 17741 - DNA, 18 bp, synthetic construct
  source 1..18: mol_type = other DNA
taaaacgaggcactgtag

SEQ ID NO: 17742 - DNA, 18 bp, synthetic construct
  source 1..18: mol_type = other DNA
taaaacgagtcactttcg

SEQ ID NO: 17743 - DNA, 18 bp, synthetic construct
  source 1..18: mol_type = other DNA
taaaacgattcagtacag

SEQ ID NO: 17744 - DNA, 18 bp, synthetic construct
  source 1..18: mol_type = other DNA
taaaacgattccctaaag

SEQ ID NO: 17745 - DNA, 18 bp, synthetic construct
  source 1..18: mol_type = other DNA
taaaacgcctccctctag

SEQ ID NO: 17746 - DNA, 18 bp, synthetic construct
  source 1..18: mol_type = other DNA
taaaacggctaactatcg

SEQ ID NO: 17747 - DNA, 18 bp, synthetic construct
  source 1..18: mol_type = other DNA
taaaactacacactatcg

SEQ ID NO: 17748 - DNA, 18 bp, synthetic construct
  source 1..18: mol_type = other DNA
taaaactactaacgatag

SEQ ID NO: 17749 - DNA, 18 bp, synthetic construct
  source 1..18: mol_type = other DNA
taaaactactgactatgg

SEQ ID NO: 17750 - DNA, 18 bp, synthetic construct
  source 1..18: mol_type = other DNA
taaaactacttactctag

SEQ ID NO: 17751 - DNA, 18 bp, synthetic construct
  source 1..18: mol_type = other DNA
taaaactcctcattatag

SEQ ID NO: 17752 - DNA, 18 bp, synthetic construct
  source 1..18: mol_type = other DNA
taaaagcaatcactatag

SEQ ID NO: 17753 - DNA, 18 bp, synthetic construct
  source 1..18: mol_type = other DNA
taaaatgacccagtatag

SEQ ID NO: 17754 - DNA, 18 bp, synthetic construct
  source 1..18: mol_type = other DNA
taaaatgactcaacatag

SEQ ID NO: 17755 - DNA, 18 bp, synthetic construct
  source 1..18: mol_type = other DNA
taaaatgcctctctatag

SEQ ID NO: 17756 - DNA, 18 bp, synthetic construct
  source 1..18: mol_type = other DNA
taaaccgaatcacaatag

SEQ ID NO: 17757 - DNA, 18 bp, synthetic construct
  source 1..18: mol_type = other DNA
taaagcggctcactacag

SEQ ID NO: 17758 - DNA, 18 bp, synthetic construct
  source 1..18: mol_type = other DNA
taaagcggctcactctag

SEQ ID NO: 17759 - DNA, 18 bp, synthetic construct
  source 1..18: mol_type = other DNA
taacaagacacacaatag

SEQ ID NO: 17760 - DNA, 18 bp, synthetic construct
  source 1..18: mol_type = other DNA
taacaagacgcattatag

SEQ ID NO: 17761 - DNA, 18 bp, synthetic construct
  source 1..18: mol_type = other DNA
taacaagactcacttcag

SEQ ID NO: 17762 - DNA, 18 bp, synthetic construct
  source 1..18: mol_type = other DNA
taacacaacgcactttag

SEQ ID NO: 17763 - DNA, 18 bp, synthetic construct
  source 1..18: mol_type = other DNA
taacacgaatctctctag

SEQ ID NO: 17764 - DNA, 18 bp, synthetic construct
  source 1..18: mol_type = other DNA
taacacgacactgtatag

SEQ ID NO: 17765 - DNA, 18 bp, synthetic construct
  source 1..18: mol_type = other DNA
taacacgaccttctatag

SEQ ID NO: 17766 - DNA, 18 bp, synthetic construct
  source 1..18: mol_type = other DNA
taacacgacgctctatcg

SEQ ID NO: 17767 - DNA, 18 bp, synthetic construct
  source 1..18: mol_type = other DNA
taacacgaggcacaatag

SEQ ID NO: 17768 - DNA, 18 bp, synthetic construct
  source 1..18: mol_type = other DNA
taacacgattaactaaag

SEQ ID NO: 17769 - DNA, 18 bp, synthetic construct
  source 1..18: mol_type = other DNA
taacacgcctcagtaaag

SEQ ID NO: 17770 - DNA, 18 bp, synthetic construct
  source 1..18: mol_type = other DNA
taacacgcctgacgatag

SEQ ID NO: 17771 - DNA, 18 bp, synthetic construct
  source 1..18: mol_type = other DNA
taacacgcgtcactagag

SEQ ID NO: 17772 - DNA, 18 bp, synthetic construct
  source 1..18: mol_type = other DNA
taacacggctatctatag

SEQ ID NO: 17773 - DNA, 18 bp, synthetic construct
  source 1..18: mol_type = other DNA
taacacggctcaccgtag

SEQ ID NO: 17774 - DNA, 18 bp, synthetic construct
  source 1..18: mol_type = other DNA
taacacgtctcaggatag

SEQ ID NO: 17775 - DNA, 18 bp, synthetic construct
  source 1..18: mol_type = other DNA
taacacgtctgactaaag

SEQ ID NO: 17776 - DNA, 18 bp, synthetic construct
  source 1..18: mol_type = other DNA
taacacgtgtcactgtag

SEQ ID NO: 17777 - DNA, 18 bp, synthetic construct
  source 1..18: mol_type = other DNA
taacacttctcactatcg

SEQ ID NO: 17778 - DNA, 18 bp, synthetic construct
  source 1..18: mol_type = other DNA
taacatgactcaccttag

SEQ ID NO: 17779 - DNA, 18 bp, synthetic construct
  source 1..18: mol_type = other DNA
taacatgacttactacag

SEQ ID NO: 17780 - DNA, 18 bp, synthetic construct
  source 1..18: mol_type = other DNA
taacatgagtcactaaag

SEQ ID NO: 17781 - DNA, 18 bp, synthetic construct
  source 1..18: mol_type = other DNA
taacatgtttcactatag

SEQ ID NO: 17782 - DNA, 18 bp, synthetic construct
  source 1..18: mol_type = other DNA
taacccgactgactaaag

SEQ ID NO: 17783 - DNA, 18 bp, synthetic construct
  source 1..18: mol_type = other DNA
taaccctactcattatag

SEQ ID NO: 17784 - DNA, 18 bp, synthetic construct
  source 1..18: mol_type = other DNA
taacgcgacagactatag

SEQ ID NO: 17785 - DNA, 18 bp, synthetic construct
  source 1..18: mol_type = other DNA
taacgcgtcacactatag

SEQ ID NO: 17786 - DNA, 18 bp, synthetic construct
  source 1..18: mol_type = other DNA
taagaagactaactttag

SEQ ID NO: 17787 - DNA, 18 bp, synthetic construct
  source 1..18: mol_type = other DNA
taagacgaatatctatag

SEQ ID NO: 17788 - DNA, 18 bp, synthetic construct
  source 1..18: mol_type = other DNA
taagacgacaccctacag

SEQ ID NO: 17789 - DNA, 18 bp, synthetic construct
  source 1..18: mol_type = other DNA
taagacgacatactgtag

SEQ ID NO: 17790 - DNA, 18 bp, synthetic construct
  source 1..18: mol_type = other DNA
taagacgactctaaatag

SEQ ID NO: 17791 - DNA, 18 bp, synthetic construct
  source 1..18: mol_type = other DNA
taagacgactgacttaag

SEQ ID NO: 17792 - DNA, 18 bp, synthetic construct
  source 1..18: mol_type = other DNA
taagacgataaactatag

SEQ ID NO: 17793 - DNA, 18 bp, synthetic construct
  source 1..18: mol_type = other DNA
taagacggctcacaaaag

SEQ ID NO: 17794 - DNA, 18 bp, synthetic construct
  source 1..18: mol_type = other DNA
taagacgtctccttatag

SEQ ID NO: 17795 - DNA, 18 bp, synthetic construct
  source 1..18: mol_type = other DNA
taagacgtctctctttag

SEQ ID NO: 17796 - DNA, 18 bp, synthetic construct
  source 1..18: mol_type = other DNA
taagatcagtcactatag

SEQ ID NO: 17797 - DNA, 18 bp, synthetic construct
  source 1..18: mol_type = other DNA
taagccgactaattatag

SEQ ID NO: 17798 - DNA, 18 bp, synthetic construct
  source 1..18: mol_type = other DNA
taataaaaatcactatgg

SEQ ID NO: 17799 - DNA, 18 bp, synthetic construct
  source 1..18: mol_type = other DNA
taataaaacacactctag

SEQ ID NO: 17800 - DNA, 18 bp, synthetic construct
  source 1..18: mol_type = other DNA
taataaaacccactatcg

SEQ ID NO: 17801 - DNA, 18 bp, synthetic construct
  source 1..18: mol_type = other DNA
taataacacccactgtag

SEQ ID NO: 17802 - DNA, 18 bp, synthetic construct
  source 1..18: mol_type = other DNA
taataacactcacaatcg

SEQ ID NO: 17803 - DNA, 18 bp, synthetic construct
  source 1..18: mol_type = other DNA
taataagaatcactctcg

SEQ ID NO: 17804 - DNA, 18 bp, synthetic construct
  source 1..18: mol_type = other DNA
taataagacacactccag

SEQ ID NO: 17805 - DNA, 18 bp, synthetic construct
  source 1..18: mol_type = other DNA
taataagacaccctctag

SEQ ID NO: 17806 - DNA, 18 bp, synthetic construct
  source 1..18: mol_type = other DNA
taataagactaacaatcg

SEQ ID NO: 17807 - DNA, 18 bp, synthetic construct
  source 1..18: mol_type = other DNA
taataagactccttgtag

SEQ ID NO: 17808 - DNA, 18 bp, synthetic construct
  source 1..18: mol_type = other DNA
taataagactttctacag

SEQ ID NO: 17809 - DNA, 18 bp, synthetic construct
  source 1..18: mol_type = other DNA
taataagattcacgaaag

SEQ ID NO: 17810 - DNA, 18 bp, synthetic construct
  source 1..18: mol_type = other DNA
taataagatttacaatag

SEQ ID NO: 17811 - DNA, 18 bp, synthetic construct
  source 1..18: mol_type = other DNA
taataagtaccactatag

SEQ ID NO: 17812 - DNA, 18 bp, synthetic construct
  source 1..18: mol_type = other DNA
taataagtctcacgacag

SEQ ID NO: 17813 - DNA, 18 bp, synthetic construct
  source 1..18: mol_type = other DNA
taataagtctcactttgg

SEQ ID NO: 17814 - DNA, 18 bp, synthetic construct
  source 1..18: mol_type = other DNA
taataataatcaatatag

SEQ ID NO: 17815 - DNA, 18 bp, synthetic construct
  source 1..18: mol_type = other DNA
taatacaaccctttatag

SEQ ID NO: 17816 - DNA, 18 bp, synthetic construct
  source 1..18: mol_type = other DNA
taatacaactaacaacag

SEQ ID NO: 17817 - DNA, 18 bp, synthetic construct
  source 1..18: mol_type = other DNA
taatacaactcacagtgg

SEQ ID NO: 17818 - DNA, 18 bp, synthetic construct
  source 1..18: mol_type = other DNA
taatacaactcagggtag

SEQ ID NO: 17819 - DNA, 18 bp, synthetic construct
  source 1..18: mol_type = other DNA
taatacaactcccattag

SEQ ID NO: 17820 - DNA, 18 bp, synthetic construct
  source 1..18: mol_type = other DNA
taatacaactgaaaatag

SEQ ID NO: 17821 - DNA, 18 bp, synthetic construct
  source 1..18: mol_type = other DNA
taatacaagtctgtatag

SEQ ID NO: 17822 - DNA, 18 bp, synthetic construct
  source 1..18: mol_type = other DNA
taatacaataccctatag

SEQ ID NO: 17823 - DNA, 18 bp, synthetic construct
  source 1..18: mol_type = other DNA
taatacaatctactatag

SEQ ID NO: 17824 - DNA, 18 bp, synthetic construct
  source 1..18: mol_type = other DNA
taatacaattacctatag

SEQ ID NO: 17825 - DNA, 18 bp, synthetic construct
  source 1..18: mol_type = other DNA
taatacacctcaatacag

SEQ ID NO: 17826 - DNA, 18 bp, synthetic construct
  source 1..18: mol_type = other DNA
taatacacctcacgctag

SEQ ID NO: 17827 - DNA, 18 bp, synthetic construct
  source 1..18: mol_type = other DNA
taatacatcccactacag

SEQ ID NO: 17828 - DNA, 18 bp, synthetic construct
  source 1..18: mol_type = other DNA
taatacatctcattatgg

SEQ ID NO: 17829 - DNA, 18 bp, synthetic construct
  source 1..18: mol_type = other DNA
taataccaataattatag

SEQ ID NO: 17830 - DNA, 18 bp, synthetic construct
  source 1..18: mol_type = other DNA
taataccactcaccttcg

SEQ ID NO: 17831 - DNA, 18 bp, synthetic construct
  source 1..18: mol_type = other DNA
taataccactctccatgg

SEQ ID NO: 17832 - DNA, 18 bp, synthetic construct
  source 1..18: mol_type = other DNA
taataccgcacactacag

SEQ ID NO: 17833 - DNA, 18 bp, synthetic construct
  source 1..18: mol_type = other DNA
taatacgaaacactgaag

SEQ ID NO: 17834 - DNA, 18 bp, synthetic construct
  source 1..18: mol_type = other DNA
taatacgaatcagttaag

SEQ ID NO: 17835 - DNA, 18 bp, synthetic construct
  source 1..18: mol_type = other DNA
taatacgaatcattttgg

SEQ ID NO: 17836 - DNA, 18 bp, synthetic construct
  source 1..18: mol_type = other DNA
taatacgacaccatttag

SEQ ID NO: 17837 - DNA, 18 bp, synthetic construct
  source 1..18: mol_type = other DNA
taatacgacactatacag

SEQ ID NO: 17838 - DNA, 18 bp, synthetic construct
  source 1..18: mol_type = other DNA
taatacgacactatatcg

SEQ ID NO: 17839 - DNA, 18 bp, synthetic construct
  source 1..18: mol_type = other DNA
taatacgacccatttaag

SEQ ID NO: 17840 - DNA, 18 bp, synthetic construct
  source 1..18: mol_type = other DNA
taatacgaccctgaatag

SEQ ID NO: 17841 - DNA, 18 bp, synthetic construct
  source 1..18: mol_type = other DNA
taatacgaccgtctttag

SEQ ID NO: 17842 - DNA, 18 bp, synthetic construct
  source 1..18: mol_type = other DNA
taatacgaccgtttatag

SEQ ID NO: 17843 - DNA, 18 bp, synthetic construct
  source 1..18: mol_type = other DNA
taatacgactatcactag

SEQ ID NO: 17844 - DNA, 18 bp, synthetic construct
  source 1..18: mol_type = other DNA
taatacgactctaaatgg

SEQ ID NO: 17845 - DNA, 18 bp, synthetic construct
  source 1..18: mol_type = other DNA
taatacgactctccttgg

SEQ ID NO: 17846 - DNA, 18 bp, synthetic construct
  source 1..18: mol_type = other DNA
taatacgactctttacgg

SEQ ID NO: 17847 - DNA, 18 bp, synthetic construct
  source 1..18: mol_type = other DNA
taatacgacttaataagg

SEQ ID NO: 17848 - DNA, 18 bp, synthetic construct
  source 1..18: mol_type = other DNA
taatacgacttacagaag

SEQ ID NO: 17849 - DNA, 18 bp, synthetic construct
  source 1..18: mol_type = other DNA
taatacgacttatcatgg

SEQ ID NO: 17850 - DNA, 18 bp, synthetic construct
  source 1..18: mol_type = other DNA
taatacgacttcaaatag

SEQ ID NO: 17851 - DNA, 18 bp, synthetic construct
  source 1..18: mol_type = other DNA
taatacgactttctaccg

SEQ ID NO: 17852 - DNA, 18 bp, synthetic construct
  source 1..18: mol_type = other DNA
taatacgactttgtacag

SEQ ID NO: 17853 - DNA, 18 bp, synthetic construct
  source 1..18: mol_type = other DNA
taatacgagcctcgatag

SEQ ID NO: 17854 - DNA, 18 bp, synthetic construct
  source 1..18: mol_type = other DNA
taatacgagtcactgacg

SEQ ID NO: 17855 - DNA, 18 bp, synthetic construct
  source 1..18: mol_type = other DNA
taatacgagtcccgatcg

SEQ ID NO: 17856 - DNA, 18 bp, synthetic construct
  source 1..18: mol_type = other DNA
taatacgatcgactacag

SEQ ID NO: 17857 - DNA, 18 bp, synthetic construct
  source 1..18: mol_type = other DNA
taatacgatgctatatag

SEQ ID NO: 17858 - DNA, 18 bp, synthetic construct
  source 1..18: mol_type = other DNA
taatacgattaactttcg

SEQ ID NO: 17859 - DNA, 18 bp, synthetic construct
  source 1..18: mol_type = other DNA
taatacgattcacagtgg

SEQ ID NO: 17860 - DNA, 18 bp, synthetic construct
  source 1..18: mol_type = other DNA
taatacgattcacttcgg

SEQ ID NO: 17861 - DNA, 18 bp, synthetic construct
  source 1..18: mol_type = other DNA
taatacgatttagaatag

SEQ ID NO: 17862 - DNA, 18 bp, synthetic construct
  source 1..18: mol_type = other DNA
taatacgcaacactaaag

SEQ ID NO: 17863 - DNA, 18 bp, synthetic construct
  source 1..18: mol_type = other DNA
taatacgcatctgtatag

SEQ ID NO: 17864 - DNA, 18 bp, synthetic construct
  source 1..18: mol_type = other DNA
taatacgcccccctagag

SEQ ID NO: 17865 - DNA, 18 bp, synthetic construct
  source 1..18: mol_type = other DNA
taatacgccgtacaatag

SEQ ID NO: 17866 - DNA, 18 bp, synthetic construct
  source 1..18: mol_type = other DNA
taatacgccgtactgtag

SEQ ID NO: 17867 - DNA, 18 bp, synthetic construct
  source 1..18: mol_type = other DNA
taatacgccttattacag

SEQ ID NO: 17868 - DNA, 18 bp, synthetic construct
  source 1..18: mol_type = other DNA
taatacgcgttactacag

SEQ ID NO: 17869 - DNA, 18 bp, synthetic construct
  source 1..18: mol_type = other DNA
taatacgcttcaataaag

SEQ ID NO: 17870 - DNA, 18 bp, synthetic construct
  source 1..18: mol_type = other DNA
taatacggctctaaatag

SEQ ID NO: 17871 - DNA, 18 bp, synthetic construct
  source 1..18: mol_type = other DNA
taatacggcttcccatag

SEQ ID NO: 17872 - DNA, 18 bp, synthetic construct
  source 1..18: mol_type = other DNA
taatacggctttcaatag

SEQ ID NO: 17873 - DNA, 18 bp, synthetic construct
  source 1..18: mol_type = other DNA
taatacgtcacattagag

SEQ ID NO: 17874 - DNA, 18 bp, synthetic construct
  source 1..18: mol_type = other DNA
taatacgtccaactttag

SEQ ID NO: 17875 - DNA, 18 bp, synthetic construct
  source 1..18: mol_type = other DNA
taatacgtcgcaaaatag

SEQ ID NO: 17876 - DNA, 18 bp, synthetic construct
  source 1..18: mol_type = other DNA
taatacgtctatccatag

SEQ ID NO: 17877 - DNA, 18 bp, synthetic construct
  source 1..18: mol_type = other DNA
taatacgtctcaatgaag

SEQ ID NO: 17878 - DNA, 18 bp, synthetic construct
  source 1..18: mol_type = other DNA
taatacgtctcactacct

SEQ ID NO: 17879 - DNA, 18 bp, synthetic construct
  source 1..18: mol_type = other DNA
taatacgtctcagaagag

SEQ ID NO: 17880 - DNA, 18 bp, synthetic construct
  source 1..18: mol_type = other DNA
taatacgtcttactaagg

SEQ ID NO: 17881 - DNA, 18 bp, synthetic construct
  source 1..18: mol_type = other DNA
taatacgtcttagtacag

SEQ ID NO: 17882 - DNA, 18 bp, synthetic construct
  source 1..18: mol_type = other DNA
taatactacatactctag

SEQ ID NO: 17883 - DNA, 18 bp, synthetic construct
  source 1..18: mol_type = other DNA
taatactacccattttag

SEQ ID NO: 17884 - DNA, 18 bp, synthetic construct
  source 1..18: mol_type = other DNA
taatactacgctatatag

SEQ ID NO: 17885 - DNA, 18 bp, synthetic construct
  source 1..18: mol_type = other DNA
taatactactccccctag

SEQ ID NO: 17886 - DNA, 18 bp, synthetic construct
  source 1..18: mol_type = other DNA
taatactactctctaaaa

SEQ ID NO: 17887 - DNA, 18 bp, synthetic construct
  source 1..18: mol_type = other DNA
taatactactctttagag

SEQ ID NO: 17888 - DNA, 18 bp, synthetic construct
  source 1..18: mol_type = other DNA
taatacttcgcactaaag

SEQ ID NO: 17889 - DNA, 18 bp, synthetic construct
  source 1..18: mol_type = other DNA
taatagaaatctctatag

SEQ ID NO: 17890 - DNA, 18 bp, synthetic construct
  source 1..18: mol_type = other DNA
taatagaacccacaatag

SEQ ID NO: 17891 - DNA, 18 bp, synthetic construct
  source 1..18: mol_type = other DNA
taataggactgattttag

SEQ ID NO: 17892 - DNA, 18 bp, synthetic construct
  source 1..18: mol_type = other DNA
taataggacttattacag

SEQ ID NO: 17893 - DNA, 18 bp, synthetic construct
  source 1..18: mol_type = other DNA
taataggactttcaatag

SEQ ID NO: 17894 - DNA, 18 bp, synthetic construct
  source 1..18: mol_type = other DNA
taataggattaactgtag

SEQ ID NO: 17895 - DNA, 18 bp, synthetic construct
  source 1..18: mol_type = other DNA
taataggattgtctatag

SEQ ID NO: 17896 - DNA, 18 bp, synthetic construct
  source 1..18: mol_type = other DNA
taatagggcacaatatag

SEQ ID NO: 17897 - DNA, 18 bp, synthetic construct
  source 1..18: mol_type = other DNA
taataggtctcacttgag

SEQ ID NO: 17898 - DNA, 18 bp, synthetic construct
  source 1..18: mol_type = other DNA
taataggttacactatag

SEQ ID NO: 17899 - DNA, 18 bp, synthetic construct
  source 1..18: mol_type = other DNA
taatataacgcactttag

SEQ ID NO: 17900 - DNA, 18 bp, synthetic construct
  source 1..18: mol_type = other DNA
taatataactaactttag

SEQ ID NO: 17901 - DNA, 18 bp, synthetic construct
  source 1..18: mol_type = other DNA
taatataactcacagtag

SEQ ID NO: 17902 - DNA, 18 bp, synthetic construct
  source 1..18: mol_type = other DNA
taatataactcacgatgg

SEQ ID NO: 17903 - DNA, 18 bp, synthetic construct
  source 1..18: mol_type = other DNA
taatataactcattctag

SEQ ID NO: 17904 - DNA, 18 bp, synthetic construct
  source 1..18: mol_type = other DNA
taatataagacactatag

SEQ ID NO: 17905 - DNA, 18 bp, synthetic construct
  source 1..18: mol_type = other DNA
taatatacttcactatag

SEQ ID NO: 17906 - DNA, 18 bp, synthetic construct
  source 1..18: mol_type = other DNA
taatatatctcagtatag

SEQ ID NO: 17907 - DNA, 18 bp, synthetic construct
  source 1..18: mol_type = other DNA
taatatcactcactgtcg

SEQ ID NO: 17908 - DNA, 18 bp, synthetic construct
  source 1..18: mol_type = other DNA
taatatccctcactatgg

SEQ ID NO: 17909 - DNA, 18 bp, synthetic construct
  source 1..18: mol_type = other DNA
taatatgaaccaccatag

SEQ ID NO: 17910 - DNA, 18 bp, synthetic construct
  source 1..18: mol_type = other DNA
taatatgaatgactatcg

SEQ ID NO: 17911 - DNA, 18 bp, synthetic construct
  source 1..18: mol_type = other DNA
taatatgactaaccatcg

SEQ ID NO: 17912 - DNA, 18 bp, synthetic construct
  source 1..18: mol_type = other DNA
taatatgactaactctcg

SEQ ID NO: 17913 - DNA, 18 bp, synthetic construct
  source 1..18: mol_type = other DNA
taatatgactatccatag

SEQ ID NO: 17914 - DNA, 18 bp, synthetic construct
  source 1..18: mol_type = other DNA
taatatgactatctttag

SEQ ID NO: 17915 - DNA, 18 bp, synthetic construct
  source 1..18: mol_type = other DNA
taatatgactccatatgg

SEQ ID NO: 17916 - DNA, 18 bp, synthetic construct
  source 1..18: mol_type = other DNA
taatatgacttattatcg

SEQ ID NO: 17917 - DNA, 18 bp, synthetic construct
  source 1..18: mol_type = other DNA
taatatgatccactttag

SEQ ID NO: 17918 - DNA, 18 bp, synthetic construct
  source 1..18: mol_type = other DNA
taatatgatgaactatag

SEQ ID NO: 17919 - DNA, 18 bp, synthetic construct
  source 1..18: mol_type = other DNA
taatatgattcagtgtag

SEQ ID NO: 17920 - DNA, 18 bp, synthetic construct
  source 1..18: mol_type = other DNA
taatatggcacactagag

SEQ ID NO: 17921 - DNA, 18 bp, synthetic construct
  source 1..18: mol_type = other DNA
taatatgtcctactatag

SEQ ID NO: 17922 - DNA, 18 bp, synthetic construct
  source 1..18: mol_type = other DNA
taatatgtctctctatgg

SEQ ID NO: 17923 - DNA, 18 bp, synthetic construct
  source 1..18: mol_type = other DNA
taatattactcaatatgg

SEQ ID NO: 17924 - DNA, 18 bp, synthetic construct
  source 1..18: mol_type = other DNA
taatattactcaccttag

SEQ ID NO: 17925 - DNA, 18 bp, synthetic construct
  source 1..18: mol_type = other DNA
taatattagtcactaaag

SEQ ID NO: 17926 - DNA, 18 bp, synthetic construct
  source 1..18: mol_type = other DNA
taatattattgactatag

SEQ ID NO: 17927 - DNA, 18 bp, synthetic construct
  source 1..18: mol_type = other DNA
taatatttctcaccatag

SEQ ID NO: 17928 - DNA, 18 bp, synthetic construct
  source 1..18: mol_type = other DNA
taatcaaactcactatcg

SEQ ID NO: 17929 - DNA, 18 bp, synthetic construct
  source 1..18: mol_type = other DNA
taatcaaacttactatag

SEQ ID NO: 17930 - DNA, 18 bp, synthetic construct
  source 1..18: mol_type = other DNA
taatcagactctctttag

SEQ ID NO: 17931 - DNA, 18 bp, synthetic construct
  source 1..18: mol_type = other DNA
taatcagattcactatcg

SEQ ID NO: 17932 - DNA, 18 bp, synthetic construct
  source 1..18: mol_type = other DNA
taatccaacccactgtag

SEQ ID NO: 17933 - DNA, 18 bp, synthetic construct
  source 1..18: mol_type = other DNA
taatccaactccctttag

SEQ ID NO: 17934 - DNA, 18 bp, synthetic construct
  source 1..18: mol_type = other DNA
taatccaacttactatcg

SEQ ID NO: 17935 - DNA, 18 bp, synthetic construct
  source 1..18: mol_type = other DNA
taatccaattaactatag

SEQ ID NO: 17936 - DNA, 18 bp, synthetic construct
  source 1..18: mol_type = other DNA
taatcccacccactctag

SEQ ID NO: 17937 - DNA, 18 bp, synthetic construct
  source 1..18: mol_type = other DNA
taatccgaatcaatacag

SEQ ID NO: 17938 - DNA, 18 bp, synthetic construct
  source 1..18: mol_type = other DNA
taatccgactaaccatcg

SEQ ID NO: 17939 - DNA, 18 bp, synthetic construct
  source 1..18: mol_type = other DNA
taatccgactacctttag

SEQ ID NO: 17940 - DNA, 18 bp, synthetic construct
  source 1..18: mol_type = other DNA
taatccgacttcttatag

SEQ ID NO: 17941 - DNA, 18 bp, synthetic construct
  source 1..18: mol_type = other DNA
taatccgagttactaaag

SEQ ID NO: 17942 - DNA, 18 bp, synthetic construct
  source 1..18: mol_type = other DNA
taatccgataaactatag

SEQ ID NO: 17943 - DNA, 18 bp, synthetic construct
  source 1..18: mol_type = other DNA
taatccgcctcactccag

SEQ ID NO: 17944 - DNA, 18 bp, synthetic construct
  source 1..18: mol_type = other DNA
taatccgccttaatatag

SEQ ID NO: 17945 - DNA, 18 bp, synthetic construct
  source 1..18: mol_type = other DNA
taatccggcttacaatag

SEQ ID NO: 17946 - DNA, 18 bp, synthetic construct
  source 1..18: mol_type = other DNA
taatccgtctcaatatcg

SEQ ID NO: 17947 - DNA, 18 bp, synthetic construct
  source 1..18: mol_type = other DNA
taatccgtctctctacag

SEQ ID NO: 17948 - DNA, 18 bp, synthetic construct
  source 1..18: mol_type = other DNA
taatccgtgacactatag

SEQ ID NO: 17949 - DNA, 18 bp, synthetic construct
  source 1..18: mol_type = other DNA
taatcctactcactaacg

SEQ ID NO: 17950 - DNA, 18 bp, synthetic construct
  source 1..18: mol_type = other DNA
taatcctactcattacag

SEQ ID NO: 17951 - DNA, 18 bp, synthetic construct
  source 1..18: mol_type = other DNA
taatcctattcactttag

SEQ ID NO: 17952 - DNA, 18 bp, synthetic construct
  source 1..18: mol_type = other DNA
taatcggacacacaatag

SEQ ID NO: 17953 - DNA, 18 bp, synthetic construct
  source 1..18: mol_type = other DNA
taatcggactcaataaag

SEQ ID NO: 17954 - DNA, 18 bp, synthetic construct
  source 1..18: mol_type = other DNA
taatctgacacactttag

SEQ ID NO: 17955 - DNA, 18 bp, synthetic construct
  source 1..18: mol_type = other DNA
taatctgacccactagag

SEQ ID NO: 17956 - DNA, 18 bp, synthetic construct
  source 1..18: mol_type = other DNA
taatgacaatcactatag

SEQ ID NO: 17957 - DNA, 18 bp, synthetic construct
  source 1..18: mol_type = other DNA
taatgacactcactaaag

SEQ ID NO: 17958 - DNA, 18 bp, synthetic construct
  source 1..18: mol_type = other DNA
taatgagaatctctatag

SEQ ID NO: 17959 - DNA, 18 bp, synthetic construct
  source 1..18: mol_type = other DNA
taatgagacatactatag

SEQ ID NO: 17960 - DNA, 18 bp, synthetic construct
  source 1..18: mol_type = other DNA
taatgagactcaaaatag

SEQ ID NO: 17961 - DNA, 18 bp, synthetic construct
  source 1..18: mol_type = other DNA
taatgagactctatatag

SEQ ID NO: 17962 - DNA, 18 bp, synthetic construct
  source 1..18: mol_type = other DNA
taatgcaactaactaaag

SEQ ID NO: 17963 - DNA, 18 bp, synthetic construct
  source 1..18: mol_type = other DNA
taatgcatctcagtatag

SEQ ID NO: 17964 - DNA, 18 bp, synthetic construct
  source 1..18: mol_type = other DNA
taatgccactcactttcg

SEQ ID NO: 17965 - DNA, 18 bp, synthetic construct
  source 1..18: mol_type = other DNA
taatgccactctctttag

SEQ ID NO: 17966 - DNA, 18 bp, synthetic construct
  source 1..18: mol_type = other DNA
taatgcgaccaaatatag

SEQ ID NO: 17967 - DNA, 18 bp, synthetic construct
  source 1..18: mol_type = other DNA
taatgcgacgcactgaag

SEQ ID NO: 17968 - DNA, 18 bp, synthetic construct
  source 1..18: mol_type = other DNA
taatgcgacgctctatcg

SEQ ID NO: 17969 - DNA, 18 bp, synthetic construct
  source 1..18: mol_type = other DNA
taatgcgactccccttag

SEQ ID NO: 17970 - DNA, 18 bp, synthetic construct
  source 1..18: mol_type = other DNA
taatgcgactcctcatag

SEQ ID NO: 17971 - DNA, 18 bp, synthetic construct
  source 1..18: mol_type = other DNA
taatgcgactctctaagg

SEQ ID NO: 17972 - DNA, 18 bp, synthetic construct
  source 1..18: mol_type = other DNA
taatgcgacttactcgag

SEQ ID NO: 17973 - DNA, 18 bp, synthetic construct
  source 1..18: mol_type = other DNA
taatgcgattcactcaag

SEQ ID NO: 17974 - DNA, 18 bp, synthetic construct
  source 1..18: mol_type = other DNA
taatgcgcctcattttag

SEQ ID NO: 17975 - DNA, 18 bp, synthetic construct
  source 1..18: mol_type = other DNA
taatgcgcctctctacag

SEQ ID NO: 17976 - DNA, 18 bp, synthetic construct
  source 1..18: mol_type = other DNA
taatgcgtctctctaaag

SEQ ID NO: 17977 - DNA, 18 bp, synthetic construct
  source 1..18: mol_type = other DNA
taatgctgctaactatag

SEQ ID NO: 17978 - DNA, 18 bp, synthetic construct
  source 1..18: mol_type = other DNA
taatggcactcactaaag

SEQ ID NO: 17979 - DNA, 18 bp, synthetic construct
  source 1..18: mol_type = other DNA
taatgtaacacactatag

SEQ ID NO: 17980 - DNA, 18 bp, synthetic construct
  source 1..18: mol_type = other DNA
taatgtgacccacaatag

SEQ ID NO: 17981 - DNA, 18 bp, synthetic construct
  source 1..18: mol_type = other DNA
taatgtgactcacaatgg

SEQ ID NO: 17982 - DNA, 18 bp, synthetic construct
  source 1..18: mol_type = other DNA
taatgtgactcacattag

SEQ ID NO: 17983 - DNA, 18 bp, synthetic construct
  source 1..18: mol_type = other DNA
taatgtgtctcactagag

SEQ ID NO: 17984 - DNA, 18 bp, synthetic construct
  source 1..18: mol_type = other DNA
tacaacaaatcactatag

SEQ ID NO: 17985 - DNA, 18 bp, synthetic construct
  source 1..18: mol_type = other DNA
tacaacgactcaaaatag

SEQ ID NO: 17986 - DNA, 18 bp, synthetic construct
  source 1..18: mol_type = other DNA
tacaacgactcactgaag

SEQ ID NO: 17987 - DNA, 18 bp, synthetic construct
  source 1..18: mol_type = other DNA
tactaacactcactacag

SEQ ID NO: 17988 - DNA, 18 bp, synthetic construct
  source 1..18: mol_type = other DNA
tactaagagtcaccatag

SEQ ID NO: 17989 - DNA, 18 bp, synthetic construct
  source 1..18: mol_type = other DNA
tactaccacactctatag

SEQ ID NO: 17990 - DNA, 18 bp, synthetic construct
  source 1..18: mol_type = other DNA
tactacccctcactatgg

SEQ ID NO: 17991 - DNA, 18 bp, synthetic construct
  source 1..18: mol_type = other DNA
tactacgacaatctatag

SEQ ID NO: 17992 - DNA, 18 bp, synthetic construct
  source 1..18: mol_type = other DNA
tactacgacgctttatag

SEQ ID NO: 17993 - DNA, 18 bp, synthetic construct
  source 1..18: mol_type = other DNA
tactacgtcttactgtag

SEQ ID NO: 17994 - DNA, 18 bp, synthetic construct
  source 1..18: mol_type = other DNA
tactactacccattatag

SEQ ID NO: 17995 - DNA, 18 bp, synthetic construct
  source 1..18: mol_type = other DNA
tactactattcaatatag

SEQ ID NO: 17996 - DNA, 18 bp, synthetic construct
  source 1..18: mol_type = other DNA
tactatgactccctaaag

SEQ ID NO: 17997 - DNA, 18 bp, synthetic construct
  source 1..18: mol_type = other DNA
tactccgacttactatcg

SEQ ID NO: 17998 - DNA, 18 bp, synthetic construct
  source 1..18: mol_type = other DNA
tactgtgactctctatag

SEQ ID NO: 17999 - DNA, 18 bp, synthetic construct
  source 1..18: mol_type = other DNA
tagaaacactcactatag

SEQ ID NO: 18000 - DNA, 18 bp, synthetic construct
  source 1..18: mol_type = other DNA
tagaacgactccctatgg

SEQ ID NO: 18001 - DNA, 18 bp, synthetic construct
  source 1..18: mol_type = other DNA
tagcacgactcactaacg

SEQ ID NO: 18002 - DNA, 18 bp, synthetic construct
  source 1..18: mol_type = other DNA
tagcacgacttattatag

SEQ ID NO: 18003 - DNA, 18 bp, synthetic construct
  source 1..18: mol_type = other DNA
tagcactactcactacag

SEQ ID NO: 18004 - DNA, 18 bp, synthetic construct
  source 1..18: mol_type = other DNA
tagtaaccctcactatag

SEQ ID NO: 18005 - DNA, 18 bp, synthetic construct
  source 1..18: mol_type = other DNA
tagtaagactcagtaaag

SEQ ID NO: 18006 - DNA, 18 bp, synthetic construct
  source 1..18: mol_type = other DNA
tagtaagacttactttag

SEQ ID NO: 18007 - DNA, 18 bp, synthetic construct
  source 1..18: mol_type = other DNA
tagtacaactcagtaaag

SEQ ID NO: 18008 - DNA, 18 bp, synthetic construct
  source 1..18: mol_type = other DNA
tagtacaactctccatag

SEQ ID NO: 18009 - DNA, 18 bp, synthetic construct
  source 1..18: mol_type = other DNA
tagtacgaatcattatcg

SEQ ID NO: 18010 - DNA, 18 bp, synthetic construct
  source 1..18: mol_type = other DNA
tagtacgacactctaaag

SEQ ID NO: 18011 - DNA, 18 bp, synthetic construct
  source 1..18: mol_type = other DNA
tagtacgactcacaacgg

SEQ ID NO: 18012 - DNA, 18 bp, synthetic construct
  source 1..18: mol_type = other DNA
tagtacgatttattatag

SEQ ID NO: 18013 - DNA, 18 bp, synthetic construct
  source 1..18: mol_type = other DNA
tagtacgatttcctatag

SEQ ID NO: 18014 - DNA, 18 bp, synthetic construct
  source 1..18: mol_type = other DNA
tagtacgcctcaatacag

SEQ ID NO: 18015 - DNA, 18 bp, synthetic construct
  source 1..18: mol_type = other DNA
tagtacggctcataatag

SEQ ID NO: 18016 - DNA, 18 bp, synthetic construct
  source 1..18: mol_type = other DNA
tagtactactccccatag

SEQ ID NO: 18017 - DNA, 18 bp, synthetic construct
  source 1..18: mol_type = other DNA
tagtaggacacagtatag

SEQ ID NO: 18018 - DNA, 18 bp, synthetic construct
  source 1..18: mol_type = other DNA
tagtatgagttactatag

SEQ ID NO: 18019 - DNA, 18 bp, synthetic construct
  source 1..18: mol_type = other DNA
tagtatgattcactacag

SEQ ID NO: 18020 - DNA, 18 bp, synthetic construct
  source 1..18: mol_type = other DNA
tagtccgactctctaaag

SEQ ID NO: 18021 - DNA, 18 bp, synthetic construct
  source 1..18: mol_type = other DNA
tagtccgacttacaatag

SEQ ID NO: 18022 - DNA, 18 bp, synthetic construct
  source 1..18: mol_type = other DNA
tagtgcgtctcactatcg

SEQ ID NO: 18023 - DNA, 18 bp, synthetic construct
  source 1..18: mol_type = other DNA
tagtgctactcactacag

SEQ ID NO: 18024 - DNA, 18 bp, synthetic construct
  source 1..18: mol_type = other DNA
tataccgactcaatatag

SEQ ID NO: 18025 - DNA, 18 bp, synthetic construct
  source 1..18: mol_type = other DNA
tataccgactgactatag

SEQ ID NO: 18026 - DNA, 18 bp, synthetic construct
  source 1..18: mol_type = other DNA
tatcacggttcactatag

SEQ ID NO: 18027 - DNA, 18 bp, synthetic construct
  source 1..18: mol_type = other DNA
tatcacgtctcacgatag

SEQ ID NO: 18028 - DNA, 18 bp, synthetic construct
  source 1..18: mol_type = other DNA
tatgacgattccctatag

SEQ ID NO: 18029 - DNA, 18 bp, synthetic construct
  source 1..18: mol_type = other DNA
tatgacggctcaccatag

SEQ ID NO: 18030 - DNA, 18 bp, synthetic construct
  source 1..18: mol_type = other DNA
tattaagactaactgtag

SEQ ID NO: 18031 - DNA, 18 bp, synthetic construct
  source 1..18: mol_type = other DNA
tattaagcctcactagag

SEQ ID NO: 18032 - DNA, 18 bp, synthetic construct
  source 1..18: mol_type = other DNA
tattacaactcaccaaag

SEQ ID NO: 18033 - DNA, 18 bp, synthetic construct
  source 1..18: mol_type = other DNA
tattaccacgcactatcg

SEQ ID NO: 18034 - DNA, 18 bp, synthetic construct
  source 1..18: mol_type = other DNA
tattaccccccactatag

SEQ ID NO: 18035 - DNA, 18 bp, synthetic construct
  source 1..18: mol_type = other DNA
tattaccgctcactttag

SEQ ID NO: 18036 - DNA, 18 bp, synthetic construct
  source 1..18: mol_type = other DNA
tattacgaaacactatgg

SEQ ID NO: 18037 - DNA, 18 bp, synthetic construct
  source 1..18: mol_type = other DNA
tattacgaaacactctag

SEQ ID NO: 18038 - DNA, 18 bp, synthetic construct
  source 1..18: mol_type = other DNA
tattacgaccgactaaag

SEQ ID NO: 18039 - DNA, 18 bp, synthetic construct
  source 1..18: mol_type = other DNA
tattacgacgcacgaaag

SEQ ID NO: 18040 - DNA, 18 bp, synthetic construct
  source 1..18: mol_type = other DNA
tattacgactaattctag

SEQ ID NO: 18041 - DNA, 18 bp, synthetic construct
  source 1..18: mol_type = other DNA
tattacgactcaattgag

SEQ ID NO: 18042 - DNA, 18 bp, synthetic construct
  source 1..18: mol_type = other DNA
tattacgactcagtctgg

SEQ ID NO: 18043 - DNA, 18 bp, synthetic construct
  source 1..18: mol_type = other DNA
tattacgacttaatctag

SEQ ID NO: 18044 - DNA, 18 bp, synthetic construct
  source 1..18: mol_type = other DNA
tattacgacttatgatag

SEQ ID NO: 18045 - DNA, 18 bp, synthetic construct
  source 1..18: mol_type = other DNA
tattacgacttattacag

SEQ ID NO: 18046 - DNA, 18 bp, synthetic construct
  source 1..18: mol_type = other DNA
tattacgattccctttag

SEQ ID NO: 18047 - DNA, 18 bp, synthetic construct
  source 1..18: mol_type = other DNA
tattacgcctcaatctag

SEQ ID NO: 18048 - DNA, 18 bp, synthetic construct
  source 1..18: mol_type = other DNA
tattacgcctcacactag

SEQ ID NO: 18049 - DNA, 18 bp, synthetic construct
  source 1..18: mol_type = other DNA
tattacggctcaatatcg

SEQ ID NO: 18050 - DNA, 18 bp, synthetic construct
  source 1..18: mol_type = other DNA
tattacggctcacaatcg

SEQ ID NO: 18051 - DNA, 18 bp, synthetic construct
  source 1..18: mol_type = other DNA
tattacgtctcaccatcg

SEQ ID NO: 18052 - DNA, 18 bp, synthetic construct
  source 1..18: mol_type = other DNA
tattactacgcattatag

SEQ ID NO: 18053 - DNA, 18 bp, synthetic construct
  source 1..18: mol_type = other DNA
tattaggacacactacag

SEQ ID NO: 18054 - DNA, 18 bp, synthetic construct
  source 1..18: mol_type = other DNA
tattaggactaactaaag

SEQ ID NO: 18055 - DNA, 18 bp, synthetic construct
  source 1..18: mol_type = other DNA
tattaggactcacaatgg

SEQ ID NO: 18056 - DNA, 18 bp, synthetic construct
  source 1..18: mol_type = other DNA
tattaggatccactatag

SEQ ID NO: 18057 - DNA, 18 bp, synthetic construct
  source 1..18: mol_type = other DNA
tattatgactctctagag

SEQ ID NO: 18058 - DNA, 18 bp, synthetic construct
  source 1..18: mol_type = other DNA
tattatgcctcactaaag

SEQ ID NO: 18059 - DNA, 18 bp, synthetic construct
  source 1..18: mol_type = other DNA
tattccgtctctctatag

SEQ ID NO: 18060 - DNA, 18 bp, synthetic construct
  source 1..18: mol_type = other DNA
tattgagattcactatag

SEQ ID NO: 18061 - DNA, 18 bp, synthetic construct
  source 1..18: mol_type = other DNA
tattgcaactcactttag

SEQ ID NO: 18062 - DNA, 18 bp, synthetic construct
  source 1..18: mol_type = other DNA
tattgccaatcactatag

SEQ ID NO: 18063 - DNA, 18 bp, synthetic construct
  source 1..18: mol_type = other DNA
tattgcgacacactatcg

SEQ ID NO: 18064 - DNA, 18 bp, synthetic construct
  source 1..18: mol_type = other DNA
tattgcgactttctatag

SEQ ID NO: 18065 - DNA, 18 bp, synthetic construct
  source 1..18: mol_type = other DNA
tattgcgattctctatag

SEQ ID NO: 18066 - DNA, 18 bp, synthetic construct
  source 1..18: mol_type = other DNA
tattgcgcgtcactatag

SEQ ID NO: 18067 - DNA, 18 bp, synthetic construct
  source 1..18: mol_type = other DNA
tcaaaagactcaccatag

SEQ ID NO: 18068 - DNA, 18 bp, synthetic construct
  source 1..18: mol_type = other DNA
tcaaacgacacattatag

SEQ ID NO: 18069 - DNA, 18 bp, synthetic construct
  source 1..18: mol_type = other DNA
tcacacgaaacactatag

SEQ ID NO: 18070 - DNA, 18 bp, synthetic construct
  source 1..18: mol_type = other DNA
tcagacgatttactatag

SEQ ID NO: 18071 - DNA, 18 bp, synthetic construct
  source 1..18: mol_type = other DNA
tcataacactcactacag

SEQ ID NO: 18072 - DNA, 18 bp, synthetic construct
  source 1..18: mol_type = other DNA
tcatacaactaactaaag

SEQ ID NO: 18073 - DNA, 18 bp, synthetic construct
  source 1..18: mol_type = other DNA
tcatacaactacctatag

SEQ ID NO: 18074 - DNA, 18 bp, synthetic construct
  source 1..18: mol_type = other DNA
tcatacaactcacttaag

SEQ ID NO: 18075 - DNA, 18 bp, synthetic construct
  source 1..18: mol_type = other DNA
tcatacatctgactatag

SEQ ID NO: 18076 - DNA, 18 bp, synthetic construct
  source 1..18: mol_type = other DNA
tcatacgactcacttgcg

SEQ ID NO: 18077 - DNA, 18 bp, synthetic construct
  source 1..18: mol_type = other DNA
tcatacgagtcacattag

SEQ ID NO: 18078 - DNA, 18 bp, synthetic construct
  source 1..18: mol_type = other DNA
tcatacgccttactatcg

SEQ ID NO: 18079 - DNA, 18 bp, synthetic construct
  source 1..18: mol_type = other DNA
tcatacgccttcctatag

SEQ ID NO: 18080 - DNA, 18 bp, synthetic construct
  source 1..18: mol_type = other DNA
tcatacggctcacaaaag

SEQ ID NO: 18081 - DNA, 18 bp, synthetic construct
  source 1..18: mol_type = other DNA
tcatacgtctctctgtag

SEQ ID NO: 18082 - DNA, 18 bp, synthetic construct
  source 1..18: mol_type = other DNA
tcatactactcactctgg

SEQ ID NO: 18083 - DNA, 18 bp, synthetic construct
  source 1..18: mol_type = other DNA
tcatagtactgactatag

SEQ ID NO: 18084 - DNA, 18 bp, synthetic construct
  source 1..18: mol_type = other DNA
tcatatgaatcactaaag

SEQ ID NO: 18085 - DNA, 18 bp, synthetic construct
  source 1..18: mol_type = other DNA
tcatatgactcaggatag

SEQ ID NO: 18086 - DNA, 18 bp, synthetic construct
  source 1..18: mol_type = other DNA
tcatccgacccagtatag

SEQ ID NO: 18087 - DNA, 18 bp, synthetic construct
  source 1..18: mol_type = other DNA
tcatcctactcaatatag

SEQ ID NO: 18088 - DNA, 18 bp, synthetic construct
  source 1..18: mol_type = other DNA
tcatgcgacgaactatag

SEQ ID NO: 18089 - DNA, 18 bp, synthetic construct
  source 1..18: mol_type = other DNA
tcatgcgactcacttaag

SEQ ID NO: 18090 - DNA, 18 bp, synthetic construct
  source 1..18: mol_type = other DNA
tcatgcgactttctatag

SEQ ID NO: 18091 - DNA, 18 bp, synthetic construct
  source 1..18: mol_type = other DNA
tcatgcgccgcactatag

SEQ ID NO: 18092 - DNA, 18 bp, synthetic construct
  source 1..18: mol_type = other DNA
tcctacgacttactatcg

SEQ ID NO: 18093 - DNA, 18 bp, synthetic construct
  source 1..18: mol_type = other DNA
tcctacgattcactaaag

SEQ ID NO: 18094 - DNA, 18 bp, synthetic construct
  source 1..18: mol_type = other DNA
tcctacgattcactctag

SEQ ID NO: 18095 - DNA, 18 bp, synthetic construct
  source 1..18: mol_type = other DNA
tcctatgacacactatag

SEQ ID NO: 18096 - DNA, 18 bp, synthetic construct
  source 1..18: mol_type = other DNA
tcgaacgactctctatag

SEQ ID NO: 18097 - DNA, 18 bp, synthetic construct
  source 1..18: mol_type = other DNA
tcttaccactcacaatag

SEQ ID NO: 18098 - DNA, 18 bp, synthetic construct
  source 1..18: mol_type = other DNA
tcttacgaatcactaaag

SEQ ID NO: 18099 - DNA, 18 bp, synthetic construct
  source 1..18: mol_type = other DNA
tcttacgactcaccacag

SEQ ID NO: 18100 - DNA, 18 bp, synthetic construct
  source 1..18: mol_type = other DNA
tcttacgactccatatag

SEQ ID NO: 18101 - DNA, 18 bp, synthetic construct
  source 1..18: mol_type = other DNA
tcttacgactctctctag

SEQ ID NO: 18102 - DNA, 18 bp, synthetic construct
  source 1..18: mol_type = other DNA
tcttacgtctcacgatag

SEQ ID NO: 18103 - DNA, 18 bp, synthetic construct
  source 1..18: mol_type = other DNA
tcttacttctcactatag

SEQ ID NO: 18104 - DNA, 18 bp, synthetic construct
  source 1..18: mol_type = other DNA
tgaaacgacacattatag

SEQ ID NO: 18105 - DNA, 18 bp, synthetic construct
  source 1..18: mol_type = other DNA
tgaaacgactcacttaag

SEQ ID NO: 18106 - DNA, 18 bp, synthetic construct
  source 1..18: mol_type = other DNA
tgaaacgactctctatcg

SEQ ID NO: 18107 - DNA, 18 bp, synthetic construct
  source 1..18: mol_type = other DNA
tgaaacgcctaactatag

SEQ ID NO: 18108 - DNA, 18 bp, synthetic construct
  source 1..18: mol_type = other DNA
tgaagcgactcaatatag

SEQ ID NO: 18109 - DNA, 18 bp, synthetic construct
  source 1..18: mol_type = other DNA
tgagacgacacattatag

SEQ ID NO: 18110 - DNA, 18 bp, synthetic construct
  source 1..18: mol_type = other DNA
tgataaaactaactatag

SEQ ID NO: 18111 - DNA, 18 bp, synthetic construct
  source 1..18: mol_type = other DNA
tgatacaactcaccaaag

SEQ ID NO: 18112 - DNA, 18 bp, synthetic construct
  source 1..18: mol_type = other DNA
tgataccaataactatag

SEQ ID NO: 18113 - DNA, 18 bp, synthetic construct
  source 1..18: mol_type = other DNA
tgataccacacactttag

SEQ ID NO: 18114 - DNA, 18 bp, synthetic construct
  source 1..18: mol_type = other DNA
tgataccactcactaacg

SEQ ID NO: 18115 - DNA, 18 bp, synthetic construct
  source 1..18: mol_type = other DNA
tgatacgaaagactatag

SEQ ID NO: 18116 - DNA, 18 bp, synthetic construct
  source 1..18: mol_type = other DNA
tgatacgaagcactatgg

SEQ ID NO: 18117 - DNA, 18 bp, synthetic construct
  source 1..18: mol_type = other DNA
tgatacgaatcactttgg

SEQ ID NO: 18118 - DNA, 18 bp, synthetic construct
  source 1..18: mol_type = other DNA
tgatacgacacactcaag

SEQ ID NO: 18119 - DNA, 18 bp, synthetic construct
  source 1..18: mol_type = other DNA
tgatacgacttagtaaag

SEQ ID NO: 18120 - DNA, 18 bp, synthetic construct
  source 1..18: mol_type = other DNA
tgatacgagtctctacag

SEQ ID NO: 18121 - DNA, 18 bp, synthetic construct
  source 1..18: mol_type = other DNA
tgatacgattaaatatag

SEQ ID NO: 18122 - DNA, 18 bp, synthetic construct
  source 1..18: mol_type = other DNA
tgatacgattccctttag

SEQ ID NO: 18123 - DNA, 18 bp, synthetic construct
  source 1..18: mol_type = other DNA
tgatacgatttactttag

SEQ ID NO: 18124 - DNA, 18 bp, synthetic construct
  source 1..18: mol_type = other DNA
tgatacggctcactctgg

SEQ ID NO: 18125 - DNA, 18 bp, synthetic construct
  source 1..18: mol_type = other DNA
tgatacgtctcaatatgg

SEQ ID NO: 18126 - DNA, 18 bp, synthetic construct
  source 1..18: mol_type = other DNA
tgatactactcagtaaag

SEQ ID NO: 18127 - DNA, 18 bp, synthetic construct
  source 1..18: mol_type = other DNA
tgataggacttaatatag

SEQ ID NO: 18128 - DNA, 18 bp, synthetic construct
  source 1..18: mol_type = other DNA
tgataggattcacaatag

SEQ ID NO: 18129 - DNA, 18 bp, synthetic construct
  source 1..18: mol_type = other DNA
tgatatgactcaataaag

SEQ ID NO: 18130 - DNA, 18 bp, synthetic construct
  source 1..18: mol_type = other DNA
tgatattacccactatag

SEQ ID NO: 18131 - DNA, 18 bp, synthetic construct
  source 1..18: mol_type = other DNA
tgatgtgtctcactatag

SEQ ID NO: 18132 - DNA, 18 bp, synthetic construct
  source 1..18: mol_type = other DNA
tgctaagactcactaaag

SEQ ID NO: 18133 - DNA, 18 bp, synthetic construct
  source 1..18: mol_type = other DNA
tgctacgactaactgtag

SEQ ID NO: 18134 - DNA, 18 bp, synthetic construct
  source 1..18: mol_type = other DNA
tgctacgactcacttgag

SEQ ID NO: 18135 - DNA, 18 bp, synthetic construct
  source 1..18: mol_type = other DNA
tggtatgtctcactatag

SEQ ID NO: 18136 - DNA, 18 bp, synthetic construct
  source 1..18: mol_type = other DNA
tgtcacgactctctatag

SEQ ID NO: 18137 - DNA, 18 bp, synthetic construct
  source 1..18: mol_type = other DNA
tgttacaactcacaatag

SEQ ID NO: 18138 - DNA, 18 bp, synthetic construct
  source 1..18: mol_type = other DNA
tgttacaactcactctag

SEQ ID NO: 18139 - DNA, 18 bp, synthetic construct
  source 1..18: mol_type = other DNA
tgttaccacttactatag

SEQ ID NO: 18140 - DNA, 18 bp, synthetic construct
  source 1..18: mol_type = other DNA
ttaaacgacgcattatag

SEQ ID NO: 18141 - DNA, 18 bp, synthetic construct
  source 1..18: mol_type = other DNA
ttaaacgactcactgtgg

SEQ ID NO: 18142 - DNA, 18 bp, synthetic construct
  source 1..18: mol_type = other DNA
ttaaacgagtcactacag

SEQ ID NO: 18143 - DNA, 18 bp, synthetic construct
  source 1..18: mol_type = other DNA
ttaaacgattcactctag

SEQ ID NO: 18144 - DNA, 18 bp, synthetic construct
  source 1..18: mol_type = other DNA
ttaaaggactcactacag

SEQ ID NO: 18145 - DNA, 18 bp, synthetic construct
  source 1..18: mol_type = other DNA
ttaaaggcctcactatag

SEQ ID NO: 18146 - DNA, 18 bp, synthetic construct
  source 1..18: mol_type = other DNA
ttaagcgcctcactatag

SEQ ID NO: 18147 - DNA, 18 bp, synthetic construct
  source 1..18: mol_type = other DNA
ttaagcggctcactatag

SEQ ID NO: 18148 - DNA, 18 bp, synthetic construct
  source 1..18: mol_type = other DNA
ttacacatctcactatag

SEQ ID NO: 18149 - DNA, 18 bp, synthetic construct
  source 1..18: mol_type = other DNA
ttacacgactcacttcag

SEQ ID NO: 18150 - DNA, 18 bp, synthetic construct
  source 1..18: mol_type = other DNA
ttacacgacttaccatag

SEQ ID NO: 18151 - DNA, 18 bp, synthetic construct
  source 1..18: mol_type = other DNA
ttagacttctcactatag

SEQ ID NO: 18152 - DNA, 18 bp, synthetic construct
  source 1..18: mol_type = other DNA
ttataagcatcactatag

SEQ ID NO: 18153 - DNA, 18 bp, synthetic construct
  source 1..18: mol_type = other DNA
ttatacaacgtactatag

SEQ ID NO: 18154 - DNA, 18 bp, synthetic construct
  source 1..18: mol_type = other DNA
ttataccactaactaaag

SEQ ID NO: 18155 - DNA, 18 bp, synthetic construct
  source 1..18: mol_type = other DNA
ttataccactaactatcg

SEQ ID NO: 18156 - DNA, 18 bp, synthetic construct
  source 1..18: mol_type = other DNA
ttataccactcaccttag

SEQ ID NO: 18157 - DNA, 18 bp, synthetic construct
  source 1..18: mol_type = other DNA
ttataccactgactttag

SEQ ID NO: 18158 - DNA, 18 bp, synthetic construct
  source 1..18: mol_type = other DNA
ttatacgaatcaagatag

SEQ ID NO: 18159 - DNA, 18 bp, synthetic construct
  source 1..18: mol_type = other DNA
ttatacgacacaccctag

SEQ ID NO: 18160 - DNA, 18 bp, synthetic construct
  source 1..18: mol_type = other DNA
ttatacgacactctacag

SEQ ID NO: 18161 - DNA, 18 bp, synthetic construct
  source 1..18: mol_type = other DNA
ttatacgactcacaagcg

SEQ ID NO: 18162 - DNA, 18 bp, synthetic construct
  source 1..18: mol_type = other DNA
ttatacgactcagaagag

SEQ ID NO: 18163 - DNA, 18 bp, synthetic construct
  source 1..18: mol_type = other DNA
ttatacgactccccatgg

SEQ ID NO: 18164 - DNA, 18 bp, synthetic construct
  source 1..18: mol_type = other DNA
ttatacgactctttctag

SEQ ID NO: 18165 - DNA, 18 bp, synthetic construct
  source 1..18: mol_type = other DNA
ttatacgagtaaccatag

SEQ ID NO: 18166 - DNA, 18 bp, synthetic construct
  source 1..18: mol_type = other DNA
ttatacgagtcactagcg

SEQ ID NO: 18167 - DNA, 18 bp, synthetic construct
  source 1..18: mol_type = other DNA
ttatacgagtccctttag

SEQ ID NO: 18168 - DNA, 18 bp, synthetic construct
  source 1..18: mol_type = other DNA
ttatacgagtctctatcg

SEQ ID NO: 18169 - DNA, 18 bp, synthetic construct
  source 1..18: mol_type = other DNA
ttatacgattccctacag

SEQ ID NO: 18170 - DNA, 18 bp, synthetic construct
  source 1..18: mol_type = other DNA
ttatacgcccctctatag

SEQ ID NO: 18171 - DNA, 18 bp, synthetic construct
  source 1..18: mol_type = other DNA
ttatacgcgccactatag

SEQ ID NO: 18172 - DNA, 18 bp, synthetic construct
  source 1..18: mol_type = other DNA
ttatacgcgtcactttag

SEQ ID NO: 18173 - DNA, 18 bp, synthetic construct
  source 1..18: mol_type = other DNA
ttatacggctcattaaag

SEQ ID NO: 18174 - DNA, 18 bp, synthetic construct
  source 1..18: mol_type = other DNA
ttatacggctcattatgg

SEQ ID NO: 18175 - DNA, 18 bp, synthetic construct
  source 1..18: mol_type = other DNA
ttatacggctctatatag

SEQ ID NO: 18176 - DNA, 18 bp, synthetic construct
  source 1..18: mol_type = other DNA
ttatacgtcccagtatag

SEQ ID NO: 18177 - DNA, 18 bp, synthetic construct
  source 1..18: mol_type = other DNA
ttatactacgaactatag

SEQ ID NO: 18178 - DNA, 18 bp, synthetic construct
  source 1..18: mol_type = other DNA
ttatactactaactatcg

SEQ ID NO: 18179 - DNA, 18 bp, synthetic construct
  source 1..18: mol_type = other DNA
ttatactactcactaccg

SEQ ID NO: 18180 - DNA, 18 bp, synthetic construct
  source 1..18: mol_type = other DNA
ttatactactcactgtgg

SEQ ID NO: 18181 - DNA, 18 bp, synthetic construct
  source 1..18: mol_type = other DNA
ttatactactcagtgtag

SEQ ID NO: 18182 - DNA, 18 bp, synthetic construct
  source 1..18: mol_type = other DNA
ttatactactgaatatag

SEQ ID NO: 18183 - DNA, 18 bp, synthetic construct
  source 1..18: mol_type = other DNA
ttatactaggcactatag

SEQ ID NO: 18184 - DNA, 18 bp, synthetic construct
  source 1..18: mol_type = other DNA
ttataggagttactatag

SEQ ID NO: 18185 - DNA, 18 bp, synthetic construct
  source 1..18: mol_type = other DNA
ttataggcctcactctag

SEQ ID NO: 18186 - DNA, 18 bp, synthetic construct
  source 1..18: mol_type = other DNA
ttatatcactcactatgg

SEQ ID NO: 18187 - DNA, 18 bp, synthetic construct
  source 1..18: mol_type = other DNA
ttatatgactcaccatcg

SEQ ID NO: 18188 - DNA, 18 bp, synthetic construct
  source 1..18: mol_type = other DNA
ttatatgactcactagcg

SEQ ID NO: 18189 - DNA, 18 bp, synthetic construct
  source 1..18: mol_type = other DNA
ttatccgactcagtatgg

SEQ ID NO: 18190 - DNA, 18 bp, synthetic construct
  source 1..18: mol_type = other DNA
ttatccgacttcctatag

SEQ ID NO: 18191 - DNA, 18 bp, synthetic construct
  source 1..18: mol_type = other DNA
ttatgcgactcaaaatag

SEQ ID NO: 18192 - DNA, 18 bp, synthetic construct
  source 1..18: mol_type = other DNA
ttatgggactctctatag

SEQ ID NO: 18193 - DNA, 18 bp, synthetic construct
  source 1..18: mol_type = other DNA
ttctaagactcactatgg

SEQ ID NO: 18194 - DNA, 18 bp, synthetic construct
  source 1..18: mol_type = other DNA
ttctacaactcaccatag

SEQ ID NO: 18195 - DNA, 18 bp, synthetic construct
  source 1..18: mol_type = other DNA
ttctacgactaaccatag

SEQ ID NO: 18196 - DNA, 18 bp, synthetic construct
  source 1..18: mol_type = other DNA
ttctacgccccactatag

SEQ ID NO: 18197 - DNA, 18 bp, synthetic construct
  source 1..18: mol_type = other DNA
ttgcacgactcagtatag

SEQ ID NO: 18198 - DNA, 18 bp, synthetic construct
  source 1..18: mol_type = other DNA
ttggaagactcactatag

SEQ ID NO: 18199 - DNA, 18 bp, synthetic construct
  source 1..18: mol_type = other DNA
ttgtacgacacactttag

SEQ ID NO: 18200 - DNA, 18 bp, synthetic construct
  source 1..18: mol_type = other DNA
ttgtacgactaactaaag

SEQ ID NO: 18201 - DNA, 18 bp, synthetic construct
  source 1..18: mol_type = other DNA
ttgtacgactcactaacg

SEQ ID NO: 18202 - DNA, 18 bp, synthetic construct
  source 1..18: mol_type = other DNA
ttgtacgactcattaaag

SEQ ID NO: 18203 - DNA, 18 bp, synthetic construct
  source 1..18: mol_type = other DNA
ttgtacgcctcactacag

SEQ ID NO: 18204 - DNA, 18 bp, synthetic construct
  source 1..18: mol_type = other DNA
ttgtacggctcactacag

SEQ ID NO: 18205 - DNA, 18 bp, synthetic construct
  source 1..18: mol_type = other DNA
ttgtgcgactcactatcg

SEQ ID NO: 18206 - DNA, 18 bp, synthetic construct
  source 1..18: mol_type = other DNA
ttttaagactcagtatag

SEQ ID NO: 18207 - DNA, 18 bp, synthetic construct
  source 1..18: mol_type = other DNA
ttttataactcactatag

SEQ ID NO: 18208 - DNA, 18 bp, synthetic construct
  source 1..18: mol_type = other DNA
ttttatcactcactatag

SEQ ID NO: 18209 - DNA, 18 bp, synthetic construct
  source 1..18: mol_type = other DNA
ttttatgactgactatag

SEQ ID NO: 18210 - DNA, 18 bp, synthetic construct
  source 1..18: mol_type = other DNA
ttttccgactcactatcg

SEQ ID NO: 18211 - DNA, 18 bp, synthetic construct
  source 1..18: mol_type = other DNA
ttttccgactcactttag

SEQ ID NO: 18212 - DNA, 18 bp, synthetic construct
  source 1..18: mol_type = other DNA
ttaaaagactcactattg

SEQ ID NO: 18213 - DNA, 18 bp, synthetic construct
  source 1..18: mol_type = other DNA
aattacgactcacttttg

SEQ ID NO: 18214 - DNA, 18 bp, synthetic construct
  source 1..18: mol_type = other DNA
aaattcgactcacaaaag

SEQ ID NO: 18215 - DNA, 18 bp, synthetic construct
  source 1..18: mol_type = other DNA
tttaacgtctcactatag

SEQ ID NO: 18216 - DNA, 18 bp, synthetic construct
  source 1..18: mol_type = other DNA
taattggactcacttaag

SEQ ID NO: 18217 - DNA, 18 bp, synthetic construct
  source 1..18: mol_type = other DNA
ttattcggctcactgtag

SEQ ID NO: 18218 - DNA, 18 bp, synthetic construct
  source 1..18: mol_type = other DNA
aaacacggctcactattg

SEQ ID NO: 18219 - DNA, 18 bp, synthetic construct
  source 1..18: mol_type = other DNA
aaatatgactcactgttg

SEQ ID NO: 18220 - DNA, 18 bp, synthetic construct
  source 1..18: mol_type = other DNA
taattcttatcactatag

SEQ ID NO: 18221 - DNA, 18 bp, synthetic construct
  source 1..18: mol_type = other DNA
taattgaactcacaatag

SEQ ID NO: 18222 - DNA, 18 bp, synthetic construct
  source 1..18: mol_type = other DNA
taatttgactcactcaag

SEQ ID NO: 18223 - DNA, 18 bp, synthetic construct
  source 1..18: mol_type = other DNA
tgattcgtctcactaaag

SEQ ID NO: 18224 - DNA, 18 bp, synthetic construct
  source 1..18: mol_type = other DNA
ttattcgactcactgtgg

SEQ ID NO: 18225 - DNA, 18 bp, synthetic construct
  source 1..18: mol_type = other DNA
gaatacaattcactaaag

SEQ ID NO: 18226 - DNA, 18 bp, synthetic construct
  source 1..18: mol_type = other DNA
taaaacgacttacaaaag

SEQ ID NO: 18227 - DNA, 18 bp, synthetic construct
  source 1..18: mol_type = other DNA
taatacgaataaatctag

SEQ ID NO: 18228 - DNA, 18 bp, synthetic construct
  source 1..18: mol_type = other DNA
ttcaacgactcactgtag

SEQ ID NO: 18229 - DNA, 18 bp, synthetic construct
  source 1..18: mol_type = other DNA
taataagactcgccattg

SEQ ID NO: 18230 - DNA, 18 bp, synthetic construct
  source 1..18: mol_type = other DNA
ttatacgactggctattg

SEQ ID NO: 18231 - DNA, 18 bp, synthetic construct
  source 1..18: mol_type = other DNA
taaaacgactcagtgttg

SEQ ID NO: 18232 - DNA, 18 bp, synthetic construct
  source 1..18: mol_type = other DNA
taatacgcgacactattg

SEQ ID NO: 18233 - DNA, 18 bp, synthetic construct
  source 1..18: mol_type = other DNA
taatagaactcacttttg

SEQ ID NO: 18234 - DNA, 18 bp, synthetic construct
  source 1..18: mol_type = other DNA
taataggactcacttatg

SEQ ID NO: 18235 - DNA, 18 bp, synthetic construct
  source 1..18: mol_type = other DNA
taattagtctcaatatag

SEQ ID NO: 18236 - DNA, 18 bp, synthetic construct
  source 1..18: mol_type = other DNA
taattgaactcaccatag

SEQ ID NO: 18237 - DNA, 18 bp, synthetic construct
  source 1..18: mol_type = other DNA
tgtttcgactcactaaag

SEQ ID NO: 18238 - DNA, 18 bp, synthetic construct
  source 1..18: mol_type = other DNA
ttataggactcgctttag

SEQ ID NO: 18239 - DNA, 18 bp, synthetic construct
  source 1..18: mol_type = other DNA
aaaaacgactcattaaag

SEQ ID NO: 18240 - DNA, 18 bp, synthetic construct
  source 1..18: mol_type = other DNA
aaacaccactcactttag

SEQ ID NO: 18241 - DNA, 18 bp, synthetic construct
  source 1..18: mol_type = other DNA
aaatactacccactttag

SEQ ID NO: 18242 - DNA, 18 bp, synthetic construct
  source 1..18: mol_type = other DNA
atttgcgactcactatag

SEQ ID NO: 18243 - DNA, 18 bp, synthetic construct
  source 1..18: mol_type = other DNA
caatacgactcaatccag

SEQ ID NO: 18244 - DNA, 18 bp, synthetic construct
  source 1..18: mol_type = other DNA
gaaagcgtctcactatag

SEQ ID NO: 18245 - DNA, 18 bp, synthetic construct
  source 1..18: mol_type = other DNA
taataagactcacattgg

SEQ ID NO: 18246 - DNA, 18 bp, synthetic construct
  source 1..18: mol_type = other DNA
taatacgtgtcacaaaag

SEQ ID NO: 18247 - DNA, 18 bp, synthetic construct
  source 1..18: mol_type = other DNA
taatagatctctctatag

SEQ ID NO: 18248 - DNA, 18 bp, synthetic construct
  source 1..18: mol_type = other DNA
taatatgattctctacag

SEQ ID NO: 18249 - DNA, 18 bp, synthetic construct
  source 1..18: mol_type = other DNA
tattatgacatactatag

SEQ ID NO: 18250 - DNA, 18 bp, synthetic construct
  source 1..18: mol_type = other DNA
tcacactactcactaaag

SEQ ID NO: 18251 - DNA, 18 bp, synthetic construct
  source 1..18: mol_type = other DNA
ttataagactctctgtag

SEQ ID NO: 18252 - DNA, 18 bp, synthetic construct
  source 1..18: mol_type = other DNA
tattccgacttactattg

SEQ ID NO: 18253 - DNA, 18 bp, synthetic construct
  source 1..18: mol_type = other DNA
taatacgtctgtccatag

SEQ ID NO: 18254 - DNA, 18 bp, synthetic construct
  source 1..18: mol_type = other DNA
ttttacgtctcagtatag

SEQ ID NO: 18255 - DNA, 18 bp, synthetic construct
  source 1..18: mol_type = other DNA
taataagtctcgctattg

SEQ ID NO: 18256 - DNA, 18 bp, synthetic construct
  source 1..18: mol_type = other DNA
taataagacacgctattg

SEQ ID NO: 18257 - DNA, 18 bp, synthetic construct
  source 1..18: mol_type = other DNA
taatttgactcactactg

SEQ ID NO: 18258 - DNA, 18 bp, synthetic construct
  source 1..18: mol_type = other DNA
ttatacgactcgctgttg

SEQ ID NO: 18259 - DNA, 18 bp, synthetic construct
  source 1..18: mol_type = other DNA
aaaatcgaatcactatag

SEQ ID NO: 18260 - DNA, 18 bp, synthetic construct
  source 1..18: mol_type = other DNA
aaattcgactcacactag

SEQ ID NO: 18261 - DNA, 18 bp, synthetic construct
  source 1..18: mol_type = other DNA
caatccgactcactaatg

SEQ ID NO: 18262 - DNA, 18 bp, synthetic construct
  source 1..18: mol_type = other DNA
caattcaactcattatag

SEQ ID NO: 18263 - DNA, 18 bp, synthetic construct
  source 1..18: mol_type = other DNA
taaaaacactcactattg

SEQ ID NO: 18264 - DNA, 18 bp, synthetic construct
  source 1..18: mol_type = other DNA
taacacgatacactattg

SEQ ID NO: 18265 - DNA, 18 bp, synthetic construct
  source 1..18: mol_type = other DNA
taatacaactcacccttg

SEQ ID NO: 18266 - DNA, 18 bp, synthetic construct
  source 1..18: mol_type = other DNA
taatacgtatcaccattg

SEQ ID NO: 18267 - DNA, 18 bp, synthetic construct
  source 1..18: mol_type = other DNA
taatagaactcactaatg

SEQ ID NO: 18268 - DNA, 18 bp, synthetic construct
  source 1..18: mol_type = other DNA
taataggtctcagtattg

SEQ ID NO: 18269 - DNA, 18 bp, synthetic construct
  source 1..18: mol_type = other DNA
taatccgacaaactattg

SEQ ID NO: 18270 - DNA, 18 bp, synthetic construct
  source 1..18: mol_type = other DNA
taatgccactcactaatg

SEQ ID NO: 18271 - DNA, 18 bp, synthetic construct
  source 1..18: mol_type = other DNA
taattagtgtcactatag

SEQ ID NO: 18272 - DNA, 18 bp, synthetic construct
  source 1..18: mol_type = other DNA
taattccacttacaatag

SEQ ID NO: 18273 - DNA, 18 bp, synthetic construct
  source 1..18: mol_type = other DNA
taattcgactaaccaaag

SEQ ID NO: 18274 - DNA, 18 bp, synthetic construct
  source 1..18: mol_type = other DNA
taattcgactcaatgcag

SEQ ID NO: 18275 - DNA, 18 bp, synthetic construct
  source 1..18: mol_type = other DNA
taattcgtctaactctag

SEQ ID NO: 18276 - DNA, 18 bp, synthetic construct
  source 1..18: mol_type = other DNA
taattcgtctcactgcag

SEQ ID NO: 18277 - DNA, 18 bp, synthetic construct
  source 1..18: mol_type = other DNA
tagcacgagtcactattg

SEQ ID NO: 18278 - DNA, 18 bp, synthetic construct
  source 1..18: mol_type = other DNA
tagtacgacttgttatag

SEQ ID NO: 18279 - DNA, 18 bp, synthetic construct
  source 1..18: mol_type = other DNA
tagttcgactcactaagg

SEQ ID NO: 18280 - DNA, 18 bp, synthetic construct
  source 1..18: mol_type = other DNA
tattacgactcactgatg

SEQ ID NO: 18281 - DNA, 18 bp, synthetic construct
  source 1..18: mol_type = other DNA
tattaggacgcactattg

SEQ ID NO: 18282 - DNA, 18 bp, synthetic construct
  source 1..18: mol_type = other DNA
tatttcgtctcactctag

SEQ ID NO: 18283 - DNA, 18 bp, synthetic construct
  source 1..18: mol_type = other DNA
tcatacgaatcacttttg

SEQ ID NO: 18284 - DNA, 18 bp, synthetic construct
  source 1..18: mol_type = other DNA
tcatacgacttagtattg

SEQ ID NO: 18285 - DNA, 18 bp, synthetic construct
  source 1..18: mol_type = other DNA
tcgtacgacacactattg

SEQ ID NO: 18286 - DNA, 18 bp, synthetic construct
  source 1..18: mol_type = other DNA
tgatacaactcattattg

SEQ ID NO: 18287 - DNA, 18 bp, synthetic construct
  source 1..18: mol_type = other DNA
tgattcgacttactaaag

SEQ ID NO: 18288 - DNA, 18 bp, synthetic construct
  source 1..18: mol_type = other DNA
ttctacggctcactattg

SEQ ID NO: 18289 - DNA, 18 bp, synthetic construct
  source 1..18: mol_type = other DNA
tttttcgactcaccatag

SEQ ID NO: 18290 - DNA, 18 bp, synthetic construct
  source 1..18: mol_type = other DNA
tttttcgactcacgatag

SEQ ID NO: 18291 - DNA, 18 bp, synthetic construct
  source 1..18: mol_type = other DNA
aaaaacgtgtcactatag

SEQ ID NO: 18292 - DNA, 18 bp, synthetic construct
  source 1..18: mol_type = other DNA
aaatacggcttactttag

SEQ ID NO: 18293 - DNA, 18 bp, synthetic construct
  source 1..18: mol_type = other DNA
aaatatgaatcactttag

SEQ ID NO: 18294 - DNA, 18 bp, synthetic construct
  source 1..18: mol_type = other DNA
aaatatgactctctagag

SEQ ID NO: 18295 - DNA, 18 bp, synthetic construct
  source 1..18: mol_type = other DNA
aaatgccacttactatag

SEQ ID NO: 18296 - DNA, 18 bp, synthetic construct
  source 1..18: mol_type = other DNA
acttacgactcactacag

SEQ ID NO: 18297 - DNA, 18 bp, synthetic construct
  source 1..18: mol_type = other DNA
agctacgactcacaatag

SEQ ID NO: 18298 - DNA, 18 bp, synthetic construct
  source 1..18: mol_type = other DNA
atgtacgactcactatgg

SEQ ID NO: 18299 - DNA, 18 bp, synthetic construct
  source 1..18: mol_type = other DNA
caatacgacccacaagag

SEQ ID NO: 18300 - DNA, 18 bp, synthetic construct
  source 1..18: mol_type = other DNA
caatactacactctatag

SEQ ID NO: 18301 - DNA, 18 bp, synthetic construct
  source 1..18: mol_type = other DNA
caatactattcactttag

SEQ ID NO: 18302 - DNA, 18 bp, synthetic construct
  source 1..18: mol_type = other DNA
caatccgacccactttag

SEQ ID NO: 18303 - DNA, 18 bp, synthetic construct
  source 1..18: mol_type = other DNA
caatctgactcaccatag

SEQ ID NO: 18304 - DNA, 18 bp, synthetic construct
  source 1..18: mol_type = other DNA
caatgcgtctcactgtag

SEQ ID NO: 18305 - DNA, 18 bp, synthetic construct
  source 1..18: mol_type = other DNA
cgaaacgactcaccatag

SEQ ID NO: 18306 - DNA, 18 bp, synthetic construct
  source 1..18: mol_type = other DNA
gaatacgactctcttcag

SEQ ID NO: 18307 - DNA, 18 bp, synthetic construct
  source 1..18: mol_type = other DNA
gattactactctctatag

SEQ ID NO: 18308 - DNA, 18 bp, synthetic construct
  source 1..18: mol_type = other DNA
gtagacgtctcactatag

SEQ ID NO: 18309 - DNA, 18 bp, synthetic construct
  source 1..18: mol_type = other DNA
taaaacgactcaatccag

SEQ ID NO: 18310 - DNA, 18 bp, synthetic construct
  source 1..18: mol_type = other DNA
taaaactactaaatatag

SEQ ID NO: 18311 - DNA, 18 bp, synthetic construct
  source 1..18: mol_type = other DNA
taaaatcactcactaaag

SEQ ID NO: 18312 - DNA, 18 bp, synthetic construct
  source 1..18: mol_type = other DNA
taaagcgactgactaaag

SEQ ID NO: 18313 - DNA, 18 bp, synthetic construct
  source 1..18: mol_type = other DNA
taacaagaatctctatag

SEQ ID NO: 18314 - DNA, 18 bp, synthetic construct
  source 1..18: mol_type = other DNA
taacacaactgactaaag

SEQ ID NO: 18315 - DNA, 18 bp, synthetic construct
  source 1..18: mol_type = other DNA
taacacgagtccctaaag

SEQ ID NO: 18316 - DNA, 18 bp, synthetic construct
  source 1..18: mol_type = other DNA
taacatgtctcactacag

SEQ ID NO: 18317 - DNA, 18 bp, synthetic construct
  source 1..18: mol_type = other DNA
taagacgtctaactgtag

SEQ ID NO: 18318 - DNA, 18 bp, synthetic construct
  source 1..18: mol_type = other DNA
taataaaactcacagtag

SEQ ID NO: 18319 - DNA, 18 bp, synthetic construct
  source 1..18: mol_type = other DNA
taataagacgctctttag

SEQ ID NO: 18320 - DNA, 18 bp, synthetic construct
  source 1..18: mol_type = other DNA
taataagactttctgtag

SEQ ID NO: 18321 - DNA, 18 bp, synthetic construct
  source 1..18: mol_type = other DNA
taataagattctctacag

SEQ ID NO: 18322 - DNA, 18 bp, synthetic construct
  source 1..18: mol_type = other DNA
taatacagcttacaatag

SEQ ID NO: 18323 - DNA, 18 bp, synthetic construct
  source 1..18: mol_type = other DNA
taataccaattagtatag

SEQ ID NO: 18324 - DNA, 18 bp, synthetic construct
  source 1..18: mol_type = other DNA
taatacgactaagactag

SEQ ID NO: 18325 - DNA, 18 bp, synthetic construct
  source 1..18: mol_type = other DNA
taatacgacttattaagg

SEQ ID NO: 18326 - DNA, 18 bp, synthetic construct
  source 1..18: mol_type = other DNA
taatacgagacactttgg

SEQ ID NO: 18327 - DNA, 18 bp, synthetic construct
  source 1..18: mol_type = other DNA
taatacgtagcactttag

SEQ ID NO: 18328 - DNA, 18 bp, synthetic construct
  source 1..18: mol_type = other DNA
taatacgtatcaaaatag

SEQ ID NO: 18329 - DNA, 18 bp, synthetic construct
  source 1..18: mol_type = other DNA
taatacgtcaccctacag

SEQ ID NO: 18330 - DNA, 18 bp, synthetic construct
  source 1..18: mol_type = other DNA
taatacgtctcatgaaag

SEQ ID NO: 18331 - DNA, 18 bp, synthetic construct
  source 1..18: mol_type = other DNA
taatacgtgttactttag

SEQ ID NO: 18332 - DNA, 18 bp, synthetic construct
  source 1..18: mol_type = other DNA
taatacgttttactatgg

SEQ ID NO: 18333 - DNA, 18 bp, synthetic construct
  source 1..18: mol_type = other DNA
taatactactcatcttag

SEQ ID NO: 18334 - DNA, 18 bp, synthetic construct
  source 1..18: mol_type = other DNA
taatactgctatctatag

SEQ ID NO: 18335 - DNA, 18 bp, synthetic construct
  source 1..18: mol_type = other DNA
taatacttctcactaggg

SEQ ID NO: 18336 - DNA, 18 bp, synthetic construct
  source 1..18: mol_type = other DNA
taataggcctcacaaaag

SEQ ID NO: 18337 - DNA, 18 bp, synthetic construct
  source 1..18: mol_type = other DNA
taatatgaatcataatag

SEQ ID NO: 18338 - DNA, 18 bp, synthetic construct
  source 1..18: mol_type = other DNA
taatcttactaactatag

SEQ ID NO: 18339 - DNA, 18 bp, synthetic construct
  source 1..18: mol_type = other DNA
taatgcgactgactgtcg

SEQ ID NO: 18340 - DNA, 18 bp, synthetic construct
  source 1..18: mol_type = other DNA
tacaacgactcacaagag

SEQ ID NO: 18341 - DNA, 18 bp, synthetic construct
  source 1..18: mol_type = other DNA
tacaccgactcacaatag

SEQ ID NO: 18342 - DNA, 18 bp, synthetic construct
  source 1..18: mol_type = other DNA
tacgacaacacactatag

SEQ ID NO: 18343 - DNA, 18 bp, synthetic construct
  source 1..18: mol_type = other DNA
tagtacttctctctatag

SEQ ID NO: 18344 - DNA, 18 bp, synthetic construct
  source 1..18: mol_type = other DNA
tatagcgaatcactatag

SEQ ID NO: 18345 - DNA, 18 bp, synthetic construct
  source 1..18: mol_type = other DNA
tatcacgccccactatag

SEQ ID NO: 18346 - DNA, 18 bp, synthetic construct
  source 1..18: mol_type = other DNA
tatcccgactcactatcg

SEQ ID NO: 18347 - DNA, 18 bp, synthetic construct
  source 1..18: mol_type = other DNA
tatgacgattcactttag

SEQ ID NO: 18348 - DNA, 18 bp, synthetic construct
  source 1..18: mol_type = other DNA
tattacgaatcaatgtag

SEQ ID NO: 18349 - DNA, 18 bp, synthetic construct
  source 1..18: mol_type = other DNA
tattacgacatattatag

SEQ ID NO: 18350 - DNA, 18 bp, synthetic construct
  source 1..18: mol_type = other DNA
tattacgactcccttcag

SEQ ID NO: 18351 - DNA, 18 bp, synthetic construct
  source 1..18: mol_type = other DNA
tattacgccacaatatag

SEQ ID NO: 18352 - DNA, 18 bp, synthetic construct
  source 1..18: mol_type = other DNA
tattatgactcacgctag

SEQ ID NO: 18353 - DNA, 18 bp, synthetic construct
  source 1..18: mol_type = other DNA
tcctacggctcactatcg

SEQ ID NO: 18354 - DNA, 18 bp, synthetic construct
  source 1..18: mol_type = other DNA
tgagacgactcagtacag

SEQ ID NO: 18355 - DNA, 18 bp, synthetic construct
  source 1..18: mol_type = other DNA
tgatacgactcaccgcag

SEQ ID NO: 18356 - DNA, 18 bp, synthetic construct
  source 1..18: mol_type = other DNA
tgatacgactcagtgcag

SEQ ID NO: 18357 - DNA, 18 bp, synthetic construct
  source 1..18: mol_type = other DNA
tgatacgcttcactagag

SEQ ID NO: 18358 - DNA, 18 bp, synthetic construct
  source 1..18: mol_type = other DNA
tgataggacgcactatgg

SEQ ID NO: 18359 - DNA, 18 bp, synthetic construct
  source 1..18: mol_type = other DNA
tgatattactcactacag

SEQ ID NO: 18360 - DNA, 18 bp, synthetic construct
  source 1..18: mol_type = other DNA
tgtaacgcctcactatag

SEQ ID NO: 18361 - DNA, 18 bp, synthetic construct
  source 1..18: mol_type = other DNA
tgttacgaatcactatcg

SEQ ID NO: 18362 - DNA, 18 bp, synthetic construct
  source 1..18: mol_type = other DNA
tgttacggctaactatag

SEQ ID NO: 18363 - DNA, 18 bp, synthetic construct
  source 1..18: mol_type = other DNA
ttaaacgactcagtagag

SEQ ID NO: 18364 - DNA, 18 bp, synthetic construct
  source 1..18: mol_type = other DNA
ttacacgacacactacag

SEQ ID NO: 18365 - DNA, 18 bp, synthetic construct
  source 1..18: mol_type = other DNA
ttatacagctcaccatag

SEQ ID NO: 18366 - DNA, 18 bp, synthetic construct
  source 1..18: mol_type = other DNA
ttatacgcgtcattatag

SEQ ID NO: 18367 - DNA, 18 bp, synthetic construct
  source 1..18: mol_type = other DNA
ttatatgactcactcaag

SEQ ID NO: 18368 - DNA, 18 bp, synthetic construct
  source 1..18: mol_type = other DNA
ttatgtaactcactatag

SEQ ID NO: 18369 - DNA, 18 bp, synthetic construct
  source 1..18: mol_type = other DNA
ttctacgattcaccatag

SEQ ID NO: 18370 - DNA, 18 bp, synthetic construct
  source 1..18: mol_type = other DNA
ttttaagactcactacag

SEQ ID NO: 18371 - DNA, 18 bp, synthetic construct
  source 1..18: mol_type = other DNA
ttaatagactcactatag

SEQ ID NO: 18372 - DNA, 18 bp, synthetic construct
  source 1..18: mol_type = other DNA
taattcgactctttattg

SEQ ID NO: 18373 - DNA, 18 bp, synthetic construct
  source 1..18: mol_type = other DNA
tatttcgactcgctctag

SEQ ID NO: 18374 - DNA, 18 bp, synthetic construct
  source 1..18: mol_type = other DNA
taattcgactcacactgg

SEQ ID NO: 18375 - DNA, 18 bp, synthetic construct
  source 1..18: mol_type = other DNA
ttatgagactcactattg

SEQ ID NO: 18376 - DNA, 18 bp, synthetic construct
  source 1..18: mol_type = other DNA
ttattggtctcactatag

SEQ ID NO: 18377 - DNA, 18 bp, synthetic construct
  source 1..18: mol_type = other DNA
ttttacgactcgctctag

SEQ ID NO: 18378 - DNA, 18 bp, synthetic construct
  source 1..18: mol_type = other DNA
aaaaacgactctatatag

SEQ ID NO: 18379 - DNA, 18 bp, synthetic construct
  source 1..18: mol_type = other DNA
aagaacaactcactatag

SEQ ID NO: 18380 - DNA, 18 bp, synthetic construct
  source 1..18: mol_type = other DNA
aattgcgtctcactatag

SEQ ID NO: 18381 - DNA, 18 bp, synthetic construct
  source 1..18: mol_type = other DNA
taaaaagtatcactatag

SEQ ID NO: 18382 - DNA, 18 bp, synthetic construct
  source 1..18: mol_type = other DNA
taatacgagtatctatgg

SEQ ID NO: 18383 - DNA, 18 bp, synthetic construct
  source 1..18: mol_type = other DNA
tacaacgattcactacag

SEQ ID NO: 18384 - DNA, 18 bp, synthetic construct
  source 1..18: mol_type = other DNA
tgacccgactcacaatag

SEQ ID NO: 18385 - DNA, 18 bp, synthetic construct
  source 1..18: mol_type = other DNA
tgataaggctcactatgg

SEQ ID NO: 18386 - DNA, 18 bp, synthetic construct
  source 1..18: mol_type = other DNA
ttataagactcacttcag

SEQ ID NO: 18387 - DNA, 18 bp, synthetic construct
  source 1..18: mol_type = other DNA
ttatacgaatctatatag

SEQ ID NO: 18388 - DNA, 18 bp, synthetic construct
  source 1..18: mol_type = other DNA
ttatgcgactcaataaag

SEQ ID NO: 18389 - DNA, 18 bp, synthetic construct
  source 1..18: mol_type = other DNA
tattccaactcactctag

SEQ ID NO: 18390 - DNA, 18 bp, synthetic construct
  source 1..18: mol_type = other DNA
taattagactcactgttg

SEQ ID NO: 18391 - DNA, 18 bp, synthetic construct
  source 1..18: mol_type = other DNA
taattcgactcgacatag

SEQ ID NO: 18392 - DNA, 18 bp, synthetic construct
  source 1..18: mol_type = other DNA
taattcggatcactattg

SEQ ID NO: 18393 - DNA, 18 bp, synthetic construct
  source 1..18: mol_type = other DNA
caaaactactcactattg

SEQ ID NO: 18394 - DNA, 18 bp, synthetic construct
  source 1..18: mol_type = other DNA
tatttcgactgcctatag

SEQ ID NO: 18395 - DNA, 18 bp, synthetic construct
  source 1..18: mol_type = other DNA
tttttcgactcactctag

SEQ ID NO: 18396 - DNA, 18 bp, synthetic construct
  source 1..18: mol_type = other DNA
aaaaaggactcactgtag

SEQ ID NO: 18397 - DNA, 18 bp, synthetic construct
  source 1..18: mol_type = other DNA
atataggactcactctag

SEQ ID NO: 18398 - DNA, 18 bp, synthetic construct
  source 1..18: mol_type = other DNA
caatatgacagactatag

SEQ ID NO: 18399 - DNA, 18 bp, synthetic construct
  source 1..18: mol_type = other DNA
taaaacgactcataatcg

SEQ ID NO: 18400 - DNA, 18 bp, synthetic construct
  source 1..18: mol_type = other DNA
taatacgaataaatttag

SEQ ID NO: 18401 - DNA, 18 bp, synthetic construct
  source 1..18: mol_type = other DNA
tcatacgtctccctttag

SEQ ID NO: 18402 - DNA, 18 bp, synthetic construct
  source 1..18: mol_type = other DNA
tgaaacgtctcactctag

SEQ ID NO: 18403 - DNA, 18 bp, synthetic construct
  source 1..18: mol_type = other DNA
ttttacgtctcactagag

SEQ ID NO: 18404 - DNA, 18 bp, synthetic construct
  source 1..18: mol_type = other DNA
ttatacgtctcacttaag

SEQ ID NO: 18405 - DNA, 18 bp, synthetic construct
  source 1..18: mol_type = other DNA
taattcggcacactttag

SEQ ID NO: 18406 - DNA, 18 bp, synthetic construct
  source 1..18: mol_type = other DNA
ctttacgtctcactatag

SEQ ID NO: 18407 - DNA, 18 bp, synthetic construct
  source 1..18: mol_type = other DNA
taatacgactttcttaag

SEQ ID NO: 18408 - DNA, 18 bp, synthetic construct
  source 1..18: mol_type = other DNA
ttaaacgactcacttaag

SEQ ID NO: 18409 - DNA, 18 bp, synthetic construct
  source 1..18: mol_type = other DNA
taaatagactcactctag

SEQ ID NO: 18410 - DNA, 18 bp, synthetic construct
  source 1..18: mol_type = other DNA
aagtacgactaactttag

SEQ ID NO: 18411 - DNA, 18 bp, synthetic construct
  source 1..18: mol_type = other DNA
taataaaactcacttaag

SEQ ID NO: 18412 - DNA, 18 bp, synthetic construct
  source 1..18: mol_type = other DNA
taaatcgtctcactattg

SEQ ID NO: 18413 - DNA, 18 bp, synthetic construct
  source 1..18: mol_type = other DNA
taattcgactagctaaag

SEQ ID NO: 18414 - DNA, 18 bp, synthetic construct
  source 1..18: mol_type = other DNA
ttatacgactagctattg

SEQ ID NO: 18415 - DNA, 18 bp, synthetic construct
  source 1..18: mol_type = other DNA
ttattcgcctcgctatag

SEQ ID NO: 18416 - DNA, 18 bp, synthetic construct
  source 1..18: mol_type = other DNA
atatacaactcgctatag

SEQ ID NO: 18417 - DNA, 18 bp, synthetic construct
  source 1..18: mol_type = other DNA
gatttcgactcactaaag

SEQ ID NO: 18418 - DNA, 18 bp, synthetic construct
  source 1..18: mol_type = other DNA
taaatcccctcactatag

SEQ ID NO: 18419 - DNA, 18 bp, synthetic construct
  source 1..18: mol_type = other DNA
taatacgactcaattatg

SEQ ID NO: 18420 - DNA, 18 bp, synthetic construct
  source 1..18: mol_type = other DNA
taattctactcactttgg

SEQ ID NO: 18421 - DNA, 18 bp, synthetic construct
  source 1..18: mol_type = other DNA
tgtttcgcctcactatag

SEQ ID NO: 18422 - DNA, 18 bp, synthetic construct
  source 1..18: mol_type = other DNA
ttatacgactcactgatg

SEQ ID NO: 18423 - DNA, 18 bp, synthetic construct
  source 1..18: mol_type = other DNA
aaatacgacttaccctag

SEQ ID NO: 18424 - DNA, 18 bp, synthetic construct
  source 1..18: mol_type = other DNA
aaatacggttcattatag

SEQ ID NO: 18425 - DNA, 18 bp, synthetic construct
  source 1..18: mol_type = other DNA
taaaacgagtcacagtag

SEQ ID NO: 18426 - DNA, 18 bp, synthetic construct
  source 1..18: mol_type = other DNA
taaaacggatcacaatag

SEQ ID NO: 18427 - DNA, 18 bp, synthetic construct
  source 1..18: mol_type = other DNA
taacaccactcaaaatag

SEQ ID NO: 18428 - DNA, 18 bp, synthetic construct
  source 1..18: mol_type = other DNA
taacataactcattatag

SEQ ID NO: 18429 - DNA, 18 bp, synthetic construct
  source 1..18: mol_type = other DNA
taatacgacattccatag

SEQ ID NO: 18430 - DNA, 18 bp, synthetic construct
  source 1..18: mol_type = other DNA
taatgcgtctcaataaag

SEQ ID NO: 18431 - DNA, 18 bp, synthetic construct
  source 1..18: mol_type = other DNA
tataatgactcaatatag

SEQ ID NO: 18432 - DNA, 18 bp, synthetic construct
  source 1..18: mol_type = other DNA
tattacgagacactaaag

SEQ ID NO: 18433 - DNA, 18 bp, synthetic construct
  source 1..18: mol_type = other DNA
tattacgtctctctacag

SEQ ID NO: 18434 - DNA, 18 bp, synthetic construct
  source 1..18: mol_type = other DNA
tattgcgtctcactctag

SEQ ID NO: 18435 - DNA, 18 bp, synthetic construct
  source 1..18: mol_type = other DNA
ttataagatacactatag

SEQ ID NO: 18436 - DNA, 18 bp, synthetic construct
  source 1..18: mol_type = other DNA
ttgtacgtctcactaaag

SEQ ID NO: 18437 - DNA, 18 bp, synthetic construct
  source 1..18: mol_type = other DNA
aaaaacgactcgctattg

SEQ ID NO: 18438 - DNA, 18 bp, synthetic construct
  source 1..18: mol_type = other DNA
aaattcgactcactcttg

SEQ ID NO: 18439 - DNA, 18 bp, synthetic construct
  source 1..18: mol_type = other DNA
atatacgactcgctattg

SEQ ID NO: 18440 - DNA, 18 bp, synthetic construct
  source 1..18: mol_type = other DNA
caattcgactcgatatag

SEQ ID NO: 18441 - DNA, 18 bp, synthetic construct
  source 1..18: mol_type = other DNA
taaaacgactcgctgttg

SEQ ID NO: 18442 - DNA, 18 bp, synthetic construct
  source 1..18: mol_type = other DNA
taacatgactcgctattg

SEQ ID NO: 18443 - DNA, 18 bp, synthetic construct
  source 1..18: mol_type = other DNA
taactcgacccactattg

SEQ ID NO: 18444 - DNA, 18 bp, synthetic construct
  source 1..18: mol_type = other DNA
taataagactcgctaatg

SEQ ID NO: 18445 - DNA, 18 bp, synthetic construct
  source 1..18: mol_type = other DNA
taatacaactcgttattg

SEQ ID NO: 18446 - DNA, 18 bp, synthetic construct
  source 1..18: mol_type = other DNA
taatacgactcgcttatg

SEQ ID NO: 18447 - DNA, 18 bp, synthetic construct
  source 1..18: mol_type = other DNA
taatacggctcgcttttg

SEQ ID NO: 18448 - DNA, 18 bp, synthetic construct
  source 1..18: mol_type = other DNA
taattagactcactagtg

SEQ ID NO: 18449 - DNA, 18 bp, synthetic construct
  source 1..18: mol_type = other DNA
taattagactcgctctag

SEQ ID NO: 18450 - DNA, 18 bp, synthetic construct
  source 1..18: mol_type = other DNA
taattagacttgctatag

SEQ ID NO: 18451 - DNA, 18 bp, synthetic construct
  source 1..18: mol_type = other DNA
taattcgaccgactattg

SEQ ID NO: 18452 - DNA, 18 bp, synthetic construct
  source 1..18: mol_type = other DNA
taattcgattcgctacag

SEQ ID NO: 18453 - DNA, 18 bp, synthetic construct
  source 1..18: mol_type = other DNA
taattcgccacgctatag

SEQ ID NO: 18454 - DNA, 18 bp, synthetic construct
  source 1..18: mol_type = other DNA
tacttcgactcgctttag

SEQ ID NO: 18455 - DNA, 18 bp, synthetic construct
  source 1..18: mol_type = other DNA
tatttcgactcgatatag

SEQ ID NO: 18456 - DNA, 18 bp, synthetic construct
  source 1..18: mol_type = other DNA
tcattcgactcgctatcg

SEQ ID NO: 18457 - DNA, 18 bp, synthetic construct
  source 1..18: mol_type = other DNA
tcattcgacttactattg

SEQ ID NO: 18458 - DNA, 18 bp, synthetic construct
  source 1..18: mol_type = other DNA
tcattcgacttgctatag

SEQ ID NO: 18459 - DNA, 18 bp, synthetic construct
  source 1..18: mol_type = other DNA
ttatacgactcgctatta

SEQ ID NO: 18460 - DNA, 18 bp, synthetic construct
  source 1..18: mol_type = other DNA
ttgtacgactcgctattg

SEQ ID NO: 18461 - DNA, 18 bp, synthetic construct
  source 1..18: mol_type = other DNA
aaagacgactcattattg

SEQ ID NO: 18462 - DNA, 18 bp, synthetic construct
  source 1..18: mol_type = other DNA
aaatacgactgattattg

SEQ ID NO: 18463 - DNA, 18 bp, synthetic construct
  source 1..18: mol_type = other DNA
aaatacgcttcgctatag

SEQ ID NO: 18464 - DNA, 18 bp, synthetic construct
  source 1..18: mol_type = other DNA
aaatacgtctcgcgatag

SEQ ID NO: 18465 - DNA, 18 bp, synthetic construct
  source 1..18: mol_type = other DNA
aaataggaatcactattg

SEQ ID NO: 18466 - DNA, 18 bp, synthetic construct
  source 1..18: mol_type = other DNA
aaattcggctaactatag

SEQ ID NO: 18467 - DNA, 18 bp, synthetic construct
  source 1..18: mol_type = other DNA
aagtacgactcagtattg

SEQ ID NO: 18468 - DNA, 18 bp, synthetic construct
  source 1..18: mol_type = other DNA
acatactactcgctatag

SEQ ID NO: 18469 - DNA, 18 bp, synthetic construct
  source 1..18: mol_type = other DNA
agattcgactcattatag

SEQ ID NO: 18470 - DNA, 18 bp, synthetic construct
  source 1..18: mol_type = other DNA
atatacgactggctatag

SEQ ID NO: 18471 - DNA, 18 bp, synthetic construct
  source 1..18: mol_type = other DNA
atattcgactcactatcg

SEQ ID NO: 18472 - DNA, 18 bp, synthetic construct
  source 1..18: mol_type = other DNA
caaaacgagtcactattg

SEQ ID NO: 18473 - DNA, 18 bp, synthetic construct
  source 1..18: mol_type = other DNA
caaatcgactgactatag

SEQ ID NO: 18474 - DNA, 18 bp, synthetic construct
  source 1..18: mol_type = other DNA
caagacgactcacaattg

SEQ ID NO: 18475 - DNA, 18 bp, synthetic construct
  source 1..18: mol_type = other DNA
caataccactcgctatcg

SEQ ID NO: 18476 - DNA, 18 bp, synthetic construct
  source 1..18: mol_type = other DNA
caatacctctcgctatag

SEQ ID NO: 18477 - DNA, 18 bp, synthetic construct
  source 1..18: mol_type = other DNA
caataggactaactattg

SEQ ID NO: 18478 - DNA, 18 bp, synthetic construct
  source 1..18: mol_type = other DNA
caataggactcgctttag

SEQ ID NO: 18479 - DNA, 18 bp, synthetic construct
  source 1..18: mol_type = other DNA
caatgcgaatcactattg

SEQ ID NO: 18480 - DNA, 18 bp, synthetic construct
  source 1..18: mol_type = other DNA
caattcggctcacaatag

SEQ ID NO: 18481 - DNA, 18 bp, synthetic construct
  source 1..18: mol_type = other DNA
caattcgtctcaccatag

SEQ ID NO: 18482 - DNA, 18 bp, synthetic construct
  source 1..18: mol_type = other DNA
caatttgactaactatag

SEQ ID NO: 18483 - DNA, 18 bp, synthetic construct
  source 1..18: mol_type = other DNA
cacttcgacacactatag

SEQ ID NO: 18484 - DNA, 18 bp, synthetic construct
  source 1..18: mol_type = other DNA
ctatacgaatcactattg

SEQ ID NO: 18485 - DNA, 18 bp, synthetic construct
  source 1..18: mol_type = other DNA
ctatacgactcgctaaag

SEQ ID NO: 18486 - DNA, 18 bp, synthetic construct
  source 1..18: mol_type = other DNA
gaaaactactcactattg

SEQ ID NO: 18487 - DNA, 18 bp, synthetic construct
  source 1..18: mol_type = other DNA
gaactcgactcactaaag

SEQ ID NO: 18488 - DNA, 18 bp, synthetic construct
  source 1..18: mol_type = other DNA
gaatatcactcactattg

SEQ ID NO: 18489 - DNA, 18 bp, synthetic construct
  source 1..18: mol_type = other DNA
gaattccactaactatag

SEQ ID NO: 18490 - DNA, 18 bp, synthetic construct
  source 1..18: mol_type = other DNA
gaattcgagtcactgtag

SEQ ID NO: 18491 - DNA, 18 bp, synthetic construct
  source 1..18: mol_type = other DNA
gcattcgacacactatag

SEQ ID NO: 18492 - DNA, 18 bp, synthetic construct
  source 1..18: mol_type = other DNA
taaaacaactcgctttag

SEQ ID NO: 18493 - DNA, 18 bp, synthetic construct
  source 1..18: mol_type = other DNA
taaaacgactagctctag

SEQ ID NO: 18494 - DNA, 18 bp, synthetic construct
  source 1..18: mol_type = other DNA
taaaacgactctccattg

SEQ ID NO: 18495 - DNA, 18 bp, synthetic construct
  source 1..18: mol_type = other DNA
taaaactactcactactg

SEQ ID NO: 18496 - DNA, 18 bp, synthetic construct
  source 1..18: mol_type = other DNA
taaaccgactcactatta

SEQ ID NO: 18497 - DNA, 18 bp, synthetic construct
  source 1..18: mol_type = other DNA
taaaccgactcagtattg

SEQ ID NO: 18498 - DNA, 18 bp, synthetic construct
  source 1..18: mol_type = other DNA
taaatcgaatcaccatag

SEQ ID NO: 18499 - DNA, 18 bp, synthetic construct
  source 1..18: mol_type = other DNA
taaatcgattccctatag

SEQ ID NO: 18500 - DNA, 18 bp, synthetic construct
  source 1..18: mol_type = other DNA
taaatcgcctcactatcg

SEQ ID NO: 18501 - DNA, 18 bp, synthetic construct
  source 1..18: mol_type = other DNA
taaattgacgcactatag

SEQ ID NO: 18502 - DNA, 18 bp, synthetic construct
  source 1..18: mol_type = other DNA
taacaagactcgctaaag

SEQ ID NO: 18503 - DNA, 18 bp, synthetic construct
  source 1..18: mol_type = other DNA
taacactactcactcttg

SEQ ID NO: 18504 - DNA, 18 bp, synthetic construct
  source 1..18: mol_type = other DNA
taactcccctcactatag

SEQ ID NO: 18505 - DNA, 18 bp, synthetic construct
  source 1..18: mol_type = other DNA
taactcgactcataatag

SEQ ID NO: 18506 - DNA, 18 bp, synthetic construct
  source 1..18: mol_type = other DNA
taactcgactctccatag

SEQ ID NO: 18507 - DNA, 18 bp, synthetic construct
  source 1..18: mol_type = other DNA
taacttgactcactaaag

SEQ ID NO: 18508 - DNA, 18 bp, synthetic construct
  source 1..18: mol_type = other DNA
taagacgacacactagtg

SEQ ID NO: 18509 - DNA, 18 bp, synthetic construct
  source 1..18: mol_type = other DNA
taagacgagtcattattg

SEQ ID NO: 18510 - DNA, 18 bp, synthetic construct
  source 1..18: mol_type = other DNA
taagactactcgcaatag

SEQ ID NO: 18511 - DNA, 18 bp, synthetic construct
  source 1..18: mol_type = other DNA
taataaaactcactactg

SEQ ID NO: 18512 - DNA, 18 bp, synthetic construct
  source 1..18: mol_type = other DNA
taataagacacgctctag

SEQ ID NO: 18513 - DNA, 18 bp, synthetic construct
  source 1..18: mol_type = other DNA
taataagactccgtattg

SEQ ID NO: 18514 - DNA, 18 bp, synthetic construct
  source 1..18: mol_type = other DNA
taataagactcgctaacg

SEQ ID NO: 18515 - DNA, 18 bp, synthetic construct
  source 1..18: mol_type = other DNA
taataagagtcgctatcg

SEQ ID NO: 18516 - DNA, 18 bp, synthetic construct
  source 1..18: mol_type = other DNA
taataatacacgctatag

SEQ ID NO: 18517 - DNA, 18 bp, synthetic construct
  source 1..18: mol_type = other DNA
taatacaacacgctgtag

SEQ ID NO: 18518 - DNA, 18 bp, synthetic construct
  source 1..18: mol_type = other DNA
taatacaacgctctattg

SEQ ID NO: 18519 - DNA, 18 bp, synthetic construct
  source 1..18: mol_type = other DNA
taatacaactcacgtttg

SEQ ID NO: 18520 - DNA, 18 bp, synthetic construct
  source 1..18: mol_type = other DNA
taatacacctcactactg

SEQ ID NO: 18521 - DNA, 18 bp, synthetic construct
  source 1..18: mol_type = other DNA
taataccaatcacgattg

SEQ ID NO: 18522 - DNA, 18 bp, synthetic construct
  source 1..18: mol_type = other DNA
taataccaccctctattg

SEQ ID NO: 18523 - DNA, 18 bp, synthetic construct
  source 1..18: mol_type = other DNA
taataccactccctgttg

SEQ ID NO: 18524 - DNA, 18 bp, synthetic construct
  source 1..18: mol_type = other DNA
taatacgaaaccctattg

SEQ ID NO: 18525 - DNA, 18 bp, synthetic construct
  source 1..18: mol_type = other DNA
taatacgacacactgctg

SEQ ID NO: 18526 - DNA, 18 bp, synthetic construct
  source 1..18: mol_type = other DNA
taatacgacacagtaatg

SEQ ID NO: 18527 - DNA, 18 bp, synthetic construct
  source 1..18: mol_type = other DNA
taatacgacacgatgtag

SEQ ID NO: 18528 - DNA, 18 bp, synthetic construct
  source 1..18: mol_type = other DNA
taatacgacagacgattg

SEQ ID NO: 18529 - DNA, 18 bp, synthetic construct
  source 1..18: mol_type = other DNA
taatacgacccactcatg

SEQ ID NO: 18530 - DNA, 18 bp, synthetic construct
  source 1..18: mol_type = other DNA
taatacgacgctatattg

SEQ ID NO: 18531 - DNA, 18 bp, synthetic construct
  source 1..18: mol_type = other DNA
taatacgacgtaatattg

SEQ ID NO: 18532 - DNA, 18 bp, synthetic construct
  source 1..18: mol_type = other DNA
taatacgactaacttctg

SEQ ID NO: 18533 - DNA, 18 bp, synthetic construct
  source 1..18: mol_type = other DNA
taatacgactagatacag

SEQ ID NO: 18534 - DNA, 18 bp, synthetic construct
  source 1..18: mol_type = other DNA
taatacgactaggtgtag

SEQ ID NO: 18535 - DNA, 18 bp, synthetic construct
  source 1..18: mol_type = other DNA
taatacgactagttatgg

SEQ ID NO: 18536 - DNA, 18 bp, synthetic construct
  source 1..18: mol_type = other DNA
taatacgactcagtcatg

SEQ ID NO: 18537 - DNA, 18 bp, synthetic construct
  source 1..18: mol_type = other DNA
taatacgactctccagtg

SEQ ID NO: 18538 - DNA, 18 bp, synthetic construct
  source 1..18: mol_type = other DNA
taatacgactgcatattg

SEQ ID NO: 18539 - DNA, 18 bp, synthetic construct
  source 1..18: mol_type = other DNA
taatacgacttgctcaag

SEQ ID NO: 18540 - DNA, 18 bp, synthetic construct
  source 1..18: mol_type = other DNA
taatacgagacattattg

SEQ ID NO: 18541 - DNA, 18 bp, synthetic construct
  source 1..18: mol_type = other DNA
taatacgagtttctattg

SEQ ID NO: 18542 - DNA, 18 bp, synthetic construct
  source 1..18: mol_type = other DNA
taatacgattagcaatag

SEQ ID NO: 18543 - DNA, 18 bp, synthetic construct
  source 1..18: mol_type = other DNA
taatacgattcacttctg

SEQ ID NO: 18544 - DNA, 18 bp, synthetic construct
  source 1..18: mol_type = other DNA
taatacgattcgatatcg

SEQ ID NO: 18545 - DNA, 18 bp, synthetic construct
  source 1..18: mol_type = other DNA
taatacgcgtcagtattg

SEQ ID NO: 18546 - DNA, 18 bp, synthetic construct
  source 1..18: mol_type = other DNA
taatacgtctcgctccag

SEQ ID NO: 18547 - DNA, 18 bp, synthetic construct
  source 1..18: mol_type = other DNA
taatacgtgtaactattg

SEQ ID NO: 18548 - DNA, 18 bp, synthetic construct
  source 1..18: mol_type = other DNA
taatacgtgtcactcttg

SEQ ID NO: 18549 - DNA, 18 bp, synthetic construct
  source 1..18: mol_type = other DNA
taatactaccgactattg

SEQ ID NO: 18550 - DNA, 18 bp, synthetic construct
  source 1..18: mol_type = other DNA
taatactacgcgccatag

SEQ ID NO: 18551 - DNA, 18 bp, synthetic construct
  source 1..18: mol_type = other DNA
taatactactcagaattg

SEQ ID NO: 18552 - DNA, 18 bp, synthetic construct
  source 1..18: mol_type = other DNA
taatactactccctgttg

SEQ ID NO: 18553 - DNA, 18 bp, synthetic construct
  source 1..18: mol_type = other DNA
taatactactcgatctag

SEQ ID NO: 18554 - DNA, 18 bp, synthetic construct
  source 1..18: mol_type = other DNA
taatactattcattattg

SEQ ID NO: 18555 - DNA, 18 bp, synthetic construct
  source 1..18: mol_type = other DNA
taatactgctcaccattg

SEQ ID NO: 18556 - DNA, 18 bp, synthetic construct
  source 1..18: mol_type = other DNA
taataggactcattaatg

SEQ ID NO: 18557 - DNA, 18 bp, synthetic construct
  source 1..18: mol_type = other DNA
taatatgactagctacag

SEQ ID NO: 18558 - DNA, 18 bp, synthetic construct
  source 1..18: mol_type = other DNA
taatatgactcgttacag

SEQ ID NO: 18559 - DNA, 18 bp, synthetic construct
  source 1..18: mol_type = other DNA
taatatgacttactgttg

SEQ ID NO: 18560 - DNA, 18 bp, synthetic construct
  source 1..18: mol_type = other DNA
taatatgattcacgattg

SEQ ID NO: 18561 - DNA, 18 bp, synthetic construct
  source 1..18: mol_type = other DNA
taatatgtctcacgattg

SEQ ID NO: 18562 - DNA, 18 bp, synthetic construct
  source 1..18: mol_type = other DNA
taatccaactggctatag

SEQ ID NO: 18563 - DNA, 18 bp, synthetic construct
  source 1..18: mol_type = other DNA
taatccgactcccttttg

SEQ ID NO: 18564 - DNA, 18 bp, synthetic construct
  source 1..18: mol_type = other DNA
taatccgacttacgattg

SEQ ID NO: 18565 - DNA, 18 bp, synthetic construct
  source 1..18: mol_type = other DNA
taatcttactcgctatag

SEQ ID NO: 18566 - DNA, 18 bp, synthetic construct
  source 1..18: mol_type = other DNA
taatgcgacgctctattg

SEQ ID NO: 18567 - DNA, 18 bp, synthetic construct
  source 1..18: mol_type = other DNA
taatgctactaactattg

SEQ ID NO: 18568 - DNA, 18 bp, synthetic construct
  source 1..18: mol_type = other DNA
taatgggactcacaattg

SEQ ID NO: 18569 - DNA, 18 bp, synthetic construct
  source 1..18: mol_type = other DNA
taattagaaacactatag

SEQ ID NO: 18570 - DNA, 18 bp, synthetic construct
  source 1..18: mol_type = other DNA
taattagactcattgtag

SEQ ID NO: 18571 - DNA, 18 bp, synthetic construct
  source 1..18: mol_type = other DNA
taattaggctcaccatag

SEQ ID NO: 18572 - DNA, 18 bp, synthetic construct
  source 1..18: mol_type = other DNA
taattcaactcacgagag

SEQ ID NO: 18573 - DNA, 18 bp, synthetic construct
  source 1..18: mol_type = other DNA
taattcaactcacgatcg

SEQ ID NO: 18574 - DNA, 18 bp, synthetic construct
  source 1..18: mol_type = other DNA
taattccactctccatag

SEQ ID NO: 18575 - DNA, 18 bp, synthetic construct
  source 1..18: mol_type = other DNA
taattcgaataaatatag

SEQ ID NO: 18576 - DNA, 18 bp, synthetic construct
  source 1..18: mol_type = other DNA
taattcgacaaaatatag

SEQ ID NO: 18577 - DNA, 18 bp, synthetic construct
  source 1..18: mol_type = other DNA
taattcgacccactaacg

SEQ ID NO: 18578 - DNA, 18 bp, synthetic construct
  source 1..18: mol_type = other DNA
taattcgaccgactttag

SEQ ID NO: 18579 - DNA, 18 bp, synthetic construct
  source 1..18: mol_type = other DNA
taattcgactcatcatgg

SEQ ID NO: 18580 - DNA, 18 bp, synthetic construct
  source 1..18: mol_type = other DNA
taattcgactcatgaaag

SEQ ID NO: 18581 - DNA, 18 bp, synthetic construct
  source 1..18: mol_type = other DNA
taattcgactctatatgg

SEQ ID NO: 18582 - DNA, 18 bp, synthetic construct
  source 1..18: mol_type = other DNA
taattcgactctgaatag

SEQ ID NO: 18583 - DNA, 18 bp, synthetic construct
  source 1..18: mol_type = other DNA
taattcgactctttatcg

SEQ ID NO: 18584 - DNA, 18 bp, synthetic construct
  source 1..18: mol_type = other DNA
taattcgacttagcatag

SEQ ID NO: 18585 - DNA, 18 bp, synthetic construct
  source 1..18: mol_type = other DNA
taattcgggacactatag

SEQ ID NO: 18586 - DNA, 18 bp, synthetic construct
  source 1..18: mol_type = other DNA
taattcgtctcactcaag

SEQ ID NO: 18587 - DNA, 18 bp, synthetic construct
  source 1..18: mol_type = other DNA
taattcgtgccactatag

SEQ ID NO: 18588 - DNA, 18 bp, synthetic construct
  source 1..18: mol_type = other DNA
taattctattaactatag

SEQ ID NO: 18589 - DNA, 18 bp, synthetic construct
  source 1..18: mol_type = other DNA
taattctgctcactatgg

SEQ ID NO: 18590 - DNA, 18 bp, synthetic construct
  source 1..18: mol_type = other DNA
taattggactcacaagag

SEQ ID NO: 18591 - DNA, 18 bp, synthetic construct
  source 1..18: mol_type = other DNA
taattggactcactgaag

SEQ ID NO: 18592 - DNA, 18 bp, synthetic construct
  source 1..18: mol_type = other DNA
taattggacttacaatag

SEQ ID NO: 18593 - DNA, 18 bp, synthetic construct
  source 1..18: mol_type = other DNA
taatttgacccactctag

SEQ ID NO: 18594 - DNA, 18 bp, synthetic construct
  source 1..18: mol_type = other DNA
tacaacgactcactcttg

SEQ ID NO: 18595 - DNA, 18 bp, synthetic construct
  source 1..18: mol_type = other DNA
tacaacgactcgccatag

SEQ ID NO: 18596 - DNA, 18 bp, synthetic construct
  source 1..18: mol_type = other DNA
tacagcgactcgctatag

SEQ ID NO: 18597 - DNA, 18 bp, synthetic construct
  source 1..18: mol_type = other DNA
tacctcgacacactatag

SEQ ID NO: 18598 - DNA, 18 bp, synthetic construct
  source 1..18: mol_type = other DNA
tactacgactcccaattg

SEQ ID NO: 18599 - DNA, 18 bp, synthetic construct
  source 1..18: mol_type = other DNA
tactacgactcgcaacag

SEQ ID NO: 18600 - DNA, 18 bp, synthetic construct
  source 1..18: mol_type = other DNA
tactacgactcgtcatag

SEQ ID NO: 18601 - DNA, 18 bp, synthetic construct
  source 1..18: mol_type = other DNA
tactactactccctattg

SEQ ID NO: 18602 - DNA, 18 bp, synthetic construct
  source 1..18: mol_type = other DNA
tactaggactcgctacag

SEQ ID NO: 18603 - DNA, 18 bp, synthetic construct
  source 1..18: mol_type = other DNA
tactatgcctcactattg

SEQ ID NO: 18604 - DNA, 18 bp, synthetic construct
  source 1..18: mol_type = other DNA
tacttcgactctctgtag

SEQ ID NO: 18605 - DNA, 18 bp, synthetic construct
  source 1..18: mol_type = other DNA
tagctcgactcattatag

SEQ ID NO: 18606 - DNA, 18 bp, synthetic construct
  source 1..18: mol_type = other DNA
tagtacaacccgctatag

SEQ ID NO: 18607 - DNA, 18 bp, synthetic construct
  source 1..18: mol_type = other DNA
tagtacgaatcgctaaag

SEQ ID NO: 18608 - DNA, 18 bp, synthetic construct
  source 1..18: mol_type = other DNA
tagtacgactcaatactg

SEQ ID NO: 18609 - DNA, 18 bp, synthetic construct
  source 1..18: mol_type = other DNA
tagtacgtctcgctttag

SEQ ID NO: 18610 - DNA, 18 bp, synthetic construct
  source 1..18: mol_type = other DNA
tagtacgtctctctattg

SEQ ID NO: 18611 - DNA, 18 bp, synthetic construct
  source 1..18: mol_type = other DNA
tagtatgactctctattg

SEQ ID NO: 18612 - DNA, 18 bp, synthetic construct
  source 1..18: mol_type = other DNA
tagtccgactcattattg

SEQ ID NO: 18613 - DNA, 18 bp, synthetic construct
  source 1..18: mol_type = other DNA
tagttagtctcactatag

SEQ ID NO: 18614 - DNA, 18 bp, synthetic construct
  source 1..18: mol_type = other DNA
tagttcgactaacaatag

SEQ ID NO: 18615 - DNA, 18 bp, synthetic construct
  source 1..18: mol_type = other DNA
tagttcgactcaccgtag

SEQ ID NO: 18616 - DNA, 18 bp, synthetic construct
  source 1..18: mol_type = other DNA
tagttcgattcagtatag

SEQ ID NO: 18617 - DNA, 18 bp, synthetic construct
  source 1..18: mol_type = other DNA
tagttcgatttactatag

SEQ ID NO: 18618 - DNA, 18 bp, synthetic construct
  source 1..18: mol_type = other DNA
tataacgactcactaatg

SEQ ID NO: 18619 - DNA, 18 bp, synthetic construct
  source 1..18: mol_type = other DNA
tattacaacttgctatag

SEQ ID NO: 18620 - DNA, 18 bp, synthetic construct
  source 1..18: mol_type = other DNA
tattaccactcgctaaag

SEQ ID NO: 18621 - DNA, 18 bp, synthetic construct
  source 1..18: mol_type = other DNA
tattacgaatcgcaatag

SEQ ID NO: 18622 - DNA, 18 bp, synthetic construct
  source 1..18: mol_type = other DNA
tattacgacccaccattg

SEQ ID NO: 18623 - DNA, 18 bp, synthetic construct
  source 1..18: mol_type = other DNA
tattacgactcacgactg

SEQ ID NO: 18624 - DNA, 18 bp, synthetic construct
  source 1..18: mol_type = other DNA
tattacgactcgataaag

SEQ ID NO: 18625 - DNA, 18 bp, synthetic construct
  source 1..18: mol_type = other DNA
tattacgaggcactattg

SEQ ID NO: 18626 - DNA, 18 bp, synthetic construct
  source 1..18: mol_type = other DNA
tattacggctcgccatag

SEQ ID NO: 18627 - DNA, 18 bp, synthetic construct
  source 1..18: mol_type = other DNA
tattactacccactattg

SEQ ID NO: 18628 - DNA, 18 bp, synthetic construct
  source 1..18: mol_type = other DNA
tattatgattcgctatag

SEQ ID NO: 18629 - DNA, 18 bp, synthetic construct
  source 1..18: mol_type = other DNA
tattgcgagtcactattg

SEQ ID NO: 18630 - DNA, 18 bp, synthetic construct
  source 1..18: mol_type = other DNA
tattgggactcactattg

SEQ ID NO: 18631 - DNA, 18 bp, synthetic construct
  source 1..18: mol_type = other DNA
tattgtgactcactattg

SEQ ID NO: 18632 - DNA, 18 bp, synthetic construct
  source 1..18: mol_type = other DNA
tatttagactgactatag

SEQ ID NO: 18633 - DNA, 18 bp, synthetic construct
  source 1..18: mol_type = other DNA
tatttcgactcactttcg

SEQ ID NO: 18634 - DNA, 18 bp, synthetic construct
  source 1..18: mol_type = other DNA
tatttcgactccctatcg

SEQ ID NO: 18635 - DNA, 18 bp, synthetic construct
  source 1..18: mol_type = other DNA
tatttcgactgaatatag

SEQ ID NO: 18636 - DNA, 18 bp, synthetic construct
  source 1..18: mol_type = other DNA
tatttcggctgactatag

SEQ ID NO: 18637 - DNA, 18 bp, synthetic construct
  source 1..18: mol_type = other DNA
tatttcgtctcactaaag

SEQ ID NO: 18638 - DNA, 18 bp, synthetic construct
  source 1..18: mol_type = other DNA
tcaatcgactcactatgg

SEQ ID NO: 18639 - DNA, 18 bp, synthetic construct
  source 1..18: mol_type = other DNA
tcatacgactcattaatg

SEQ ID NO: 18640 - DNA, 18 bp, synthetic construct
  source 1..18: mol_type = other DNA
tcatcctactcactattg

SEQ ID NO: 18641 - DNA, 18 bp, synthetic construct
  source 1..18: mol_type = other DNA
tcatgcgactcagtattg

SEQ ID NO: 18642 - DNA, 18 bp, synthetic construct
  source 1..18: mol_type = other DNA
tcatgcgactcgctctag

SEQ ID NO: 18643 - DNA, 18 bp, synthetic construct
  source 1..18: mol_type = other DNA
tcattcgaatcactacag

SEQ ID NO: 18644 - DNA, 18 bp, synthetic construct
  source 1..18: mol_type = other DNA
tcattcgagtaactatag

SEQ ID NO: 18645 - DNA, 18 bp, synthetic construct
  source 1..18: mol_type = other DNA
tcattctcctcactatag

SEQ ID NO: 18646 - DNA, 18 bp, synthetic construct
  source 1..18: mol_type = other DNA
tcattggactcaatatag

SEQ ID NO: 18647 - DNA, 18 bp, synthetic construct
  source 1..18: mol_type = other DNA
tccttcaactcactatag

SEQ ID NO: 18648 - DNA, 18 bp, synthetic construct
  source 1..18: mol_type = other DNA
tcgttcgactcactaaag

SEQ ID NO: 18649 - DNA, 18 bp, synthetic construct
  source 1..18: mol_type = other DNA
tgaaacgacttactattg

SEQ ID NO: 18650 - DNA, 18 bp, synthetic construct
  source 1..18: mol_type = other DNA
tgaatcgactcagtatag

SEQ ID NO: 18651 - DNA, 18 bp, synthetic construct
  source 1..18: mol_type = other DNA
tgaatcgattcactatag

SEQ ID NO: 18652 - DNA, 18 bp, synthetic construct
  source 1..18: mol_type = other DNA
tgacaccactcactattg

SEQ ID NO: 18653 - DNA, 18 bp, synthetic construct
  source 1..18: mol_type = other DNA
tgactcgactcagtatag

SEQ ID NO: 18654 - DNA, 18 bp, synthetic construct
  source 1..18: mol_type = other DNA
tgataagcctcactattg

SEQ ID NO: 18655 - DNA, 18 bp, synthetic construct
  source 1..18: mol_type = other DNA
tgatacgactctctgttg

SEQ ID NO: 18656 - DNA, 18 bp, synthetic construct
  source 1..18: mol_type = other DNA
tgatgagactcactattg

SEQ ID NO: 18657 - DNA, 18 bp, synthetic construct
  source 1..18: mol_type = other DNA
tgatgcgactaactattg

SEQ ID NO: 18658 - DNA, 18 bp, synthetic construct
  source 1..18: mol_type = other DNA
tgattcaacgcactatag

SEQ ID NO: 18659 - DNA, 18 bp, synthetic construct
  source 1..18: mol_type = other DNA
tgattcgaatctctatag

SEQ ID NO: 18660 - DNA, 18 bp, synthetic construct
  source 1..18: mol_type = other DNA
tgattcgactaactatcg

SEQ ID NO: 18661 - DNA, 18 bp, synthetic construct
  source 1..18: mol_type = other DNA
tgattcgacttaccatag

SEQ ID NO: 18662 - DNA, 18 bp, synthetic construct
  source 1..18: mol_type = other DNA
tgattcgcatcactatag

SEQ ID NO: 18663 - DNA, 18 bp, synthetic construct
  source 1..18: mol_type = other DNA
tgattggactcattatag

SEQ ID NO: 18664 - DNA, 18 bp, synthetic construct
  source 1..18: mol_type = other DNA
tggtacgacccactattg

SEQ ID NO: 18665 - DNA, 18 bp, synthetic construct
  source 1..18: mol_type = other DNA
ttaaaccactcactattg

SEQ ID NO: 18666 - DNA, 18 bp, synthetic construct
  source 1..18: mol_type = other DNA
ttaaactactcgctatag

SEQ ID NO: 18667 - DNA, 18 bp, synthetic construct
  source 1..18: mol_type = other DNA
ttaatcgactcactttag

SEQ ID NO: 18668 - DNA, 18 bp, synthetic construct
  source 1..18: mol_type = other DNA
ttataagactcaatattg

SEQ ID NO: 18669 - DNA, 18 bp, synthetic construct
  source 1..18: mol_type = other DNA
ttataccgctcactattg

SEQ ID NO: 18670 - DNA, 18 bp, synthetic construct
  source 1..18: mol_type = other DNA
ttatacgaatcgatatag

SEQ ID NO: 18671 - DNA, 18 bp, synthetic construct
  source 1..18: mol_type = other DNA
ttatacgaatcgttatag

SEQ ID NO: 18672 - DNA, 18 bp, synthetic construct
  source 1..18: mol_type = other DNA
ttatacgactcattagtg

SEQ ID NO: 18673 - DNA, 18 bp, synthetic construct
  source 1..18: mol_type = other DNA
ttatacgactcgccttag

SEQ ID NO: 18674 - DNA, 18 bp, synthetic construct
  source 1..18: mol_type = other DNA
ttatacgcctagctatag

SEQ ID NO: 18675 - DNA, 18 bp, synthetic construct
  source 1..18: mol_type = other DNA
ttatccgactcactcttg

SEQ ID NO: 18676 - DNA, 18 bp, synthetic construct
  source 1..18: mol_type = other DNA
ttatccgcctcactattg

SEQ ID NO: 18677 - DNA, 18 bp, synthetic construct
  source 1..18: mol_type = other DNA
ttatgcgaatcactattg

SEQ ID NO: 18678 - DNA, 18 bp, synthetic construct
  source 1..18: mol_type = other DNA
ttattcgactcaccacag

SEQ ID NO: 18679 - DNA, 18 bp, synthetic construct
  source 1..18: mol_type = other DNA
ttattcgtctcactttag

SEQ ID NO: 18680 - DNA, 18 bp, synthetic construct
  source 1..18: mol_type = other DNA
ttctacgactaactattg

SEQ ID NO: 18681 - DNA, 18 bp, synthetic construct
  source 1..18: mol_type = other DNA
ttttacgacccgctatag

SEQ ID NO: 18682 - DNA, 18 bp, synthetic construct
  source 1..18: mol_type = other DNA
aaaaacgacctactatag

SEQ ID NO: 18683 - DNA, 18 bp, synthetic construct
  source 1..18: mol_type = other DNA
aaaaacgactcactcgag

SEQ ID NO: 18684 - DNA, 18 bp, synthetic construct
  source 1..18: mol_type = other DNA
aaaaacgactctgtatag

SEQ ID NO: 18685 - DNA, 18 bp, synthetic construct
  source 1..18: mol_type = other DNA
aaaaccgacttactatag

SEQ ID NO: 18686 - DNA, 18 bp, synthetic construct
  source 1..18: mol_type = other DNA
aaacacggctcactacag

SEQ ID NO: 18687 - DNA, 18 bp, synthetic construct
  source 1..18: mol_type = other DNA
aaagacgactttctatag

SEQ ID NO: 18688 - DNA, 18 bp, synthetic construct
  source 1..18: mol_type = other DNA
aaataaaactcaccatag

SEQ ID NO: 18689 - DNA, 18 bp, synthetic construct
  source 1..18: mol_type = other DNA
aaataacactcactttag

SEQ ID NO: 18690 - DNA, 18 bp, synthetic construct
  source 1..18: mol_type = other DNA
aaataagactcacactag

SEQ ID NO: 18691 - DNA, 18 bp, synthetic construct
  source 1..18: mol_type = other DNA
aaataagactgaccatag

SEQ ID NO: 18692 - DNA, 18 bp, synthetic construct
  source 1..18: mol_type = other DNA
aaataagagtcactacag

SEQ ID NO: 18693 - DNA, 18 bp, synthetic construct
  source 1..18: mol_type = other DNA
aaatacaaatcactttag

SEQ ID NO: 18694 - DNA, 18 bp, synthetic construct
  source 1..18: mol_type = other DNA
aaatacaagtcactatgg

SEQ ID NO: 18695 - DNA, 18 bp, synthetic construct
  source 1..18: mol_type = other DNA
aaatacaatacactatag

SEQ ID NO: 18696 - DNA, 18 bp, synthetic construct
  source 1..18: mol_type = other DNA
aaatacacctctctatag

SEQ ID NO: 18697 - DNA, 18 bp, synthetic construct
  source 1..18: mol_type = other DNA
aaatacgaatcagtaaag

SEQ ID NO: 18698 - DNA, 18 bp, synthetic construct
  source 1..18: mol_type = other DNA
aaatacgaccaacaatag

SEQ ID NO: 18699 - DNA, 18 bp, synthetic construct
  source 1..18: mol_type = other DNA
aaatacgactaaccatgg

SEQ ID NO: 18700 - DNA, 18 bp, synthetic construct
  source 1..18: mol_type = other DNA
aaatacgactctgtatgg

SEQ ID NO: 18701 - DNA, 18 bp, synthetic construct
  source 1..18: mol_type = other DNA
aaatacgactgattagag

SEQ ID NO: 18702 - DNA, 18 bp, synthetic construct
  source 1..18: mol_type = other DNA
aaatacgagtcattaaag

SEQ ID NO: 18703 - DNA, 18 bp, synthetic construct
  source 1..18: mol_type = other DNA
aaatacgagtcattacag

SEQ ID NO: 18704 - DNA, 18 bp, synthetic construct
  source 1..18: mol_type = other DNA
aaatacgatccaatatag

SEQ ID NO: 18705 - DNA, 18 bp, synthetic construct
  source 1..18: mol_type = other DNA
aaatacgattaactgtag

SEQ ID NO: 18706 - DNA, 18 bp, synthetic construct
  source 1..18: mol_type = other DNA
aaatacgattaagtatag

SEQ ID NO: 18707 - DNA, 18 bp, synthetic construct
  source 1..18: mol_type = other DNA
aaatacgattgtctatag

SEQ ID NO: 18708 - DNA, 18 bp, synthetic construct
  source 1..18: mol_type = other DNA
aaatacgcgtcactttag

SEQ ID NO: 18709 - DNA, 18 bp, synthetic construct
  source 1..18: mol_type = other DNA
aaatacggcacactctag

SEQ ID NO: 18710 - DNA, 18 bp, synthetic construct
  source 1..18: mol_type = other DNA
aaatacgtcccactctag

SEQ ID NO: 18711 - DNA, 18 bp, synthetic construct
  source 1..18: mol_type = other DNA
aaatacgtctcacttgag

SEQ ID NO: 18712 - DNA, 18 bp, synthetic construct
  source 1..18: mol_type = other DNA
aaatactactcactcaag

SEQ ID NO: 18713 - DNA, 18 bp, synthetic construct
  source 1..18: mol_type = other DNA
aaatactactcattttag

SEQ ID NO: 18714 - DNA, 18 bp, synthetic construct
  source 1..18: mol_type = other DNA
aaataggactatctatag

SEQ ID NO: 18715 - DNA, 18 bp, synthetic construct
  source 1..18: mol_type = other DNA
aaataggtctcattatag

SEQ ID NO: 18716 - DNA, 18 bp, synthetic construct
  source 1..18: mol_type = other DNA
aaatataactgactatag

SEQ ID NO: 18717 - DNA, 18 bp, synthetic construct
  source 1..18: mol_type = other DNA
aaatatgactcacgctag

SEQ ID NO: 18718 - DNA, 18 bp, synthetic construct
  source 1..18: mol_type = other DNA
aaatatgactcagtagag

SEQ ID NO: 18719 - DNA, 18 bp, synthetic construct
  source 1..18: mol_type = other DNA
aaatcagactaactatag

SEQ ID NO: 18720 - DNA, 18 bp, synthetic construct
  source 1..18: mol_type = other DNA
aaatccgacggactatag

SEQ ID NO: 18721 - DNA, 18 bp, synthetic construct
  source 1..18: mol_type = other DNA
aaatcggactcactttag

SEQ ID NO: 18722 - DNA, 18 bp, synthetic construct
  source 1..18: mol_type = other DNA
aaatgagactcactaaag

SEQ ID NO: 18723 - DNA, 18 bp, synthetic construct
  source 1..18: mol_type = other DNA
aaatgctattcactatag

SEQ ID NO: 18724 - DNA, 18 bp, synthetic construct
  source 1..18: mol_type = other DNA
aaatgtcactcactatag

SEQ ID NO: 18725 - DNA, 18 bp, synthetic construct
  source 1..18: mol_type = other DNA
aaccacgactcactaaag

SEQ ID NO: 18726 - DNA, 18 bp, synthetic construct
  source 1..18: mol_type = other DNA
aactacaactcactttag

SEQ ID NO: 18727 - DNA, 18 bp, synthetic construct
  source 1..18: mol_type = other DNA
aactacgacttactttag

SEQ ID NO: 18728 - DNA, 18 bp, synthetic construct
  source 1..18: mol_type = other DNA
aactacgcctcaatatag

SEQ ID NO: 18729 - DNA, 18 bp, synthetic construct
  source 1..18: mol_type = other DNA
aactgcgactcaatatag

SEQ ID NO: 18730 - DNA, 18 bp, synthetic construct
  source 1..18: mol_type = other DNA
aagcacgagtcactatag

SEQ ID NO: 18731 - DNA, 18 bp, synthetic construct
  source 1..18: mol_type = other DNA
aagtacgacttcctatag

SEQ ID NO: 18732 - DNA, 18 bp, synthetic construct
  source 1..18: mol_type = other DNA
aagtactactctctatag

SEQ ID NO: 18733 - DNA, 18 bp, synthetic construct
  source 1..18: mol_type = other DNA
aagtatgactcactacag

SEQ ID NO: 18734 - DNA, 18 bp, synthetic construct
  source 1..18: mol_type = other DNA
aataatgactcactatag

SEQ ID NO: 18735 - DNA, 18 bp, synthetic construct
  source 1..18: mol_type = other DNA
aattaggactctctatag

SEQ ID NO: 18736 - DNA, 18 bp, synthetic construct
  source 1..18: mol_type = other DNA
aattatgactcactatcg

SEQ ID NO: 18737 - DNA, 18 bp, synthetic construct
  source 1..18: mol_type = other DNA
acatacgaatcagtatag

SEQ ID NO: 18738 - DNA, 18 bp, synthetic construct
  source 1..18: mol_type = other DNA
acatacgacacactacag

SEQ ID NO: 18739 - DNA, 18 bp, synthetic construct
  source 1..18: mol_type = other DNA
acatacgactcaaaatag

SEQ ID NO: 18740 - DNA, 18 bp, synthetic construct
  source 1..18: mol_type = other DNA
acctacgacacactatag

SEQ ID NO: 18741 - DNA, 18 bp, synthetic construct
  source 1..18: mol_type = other DNA
agacacgactcactaaag

SEQ ID NO: 18742 - DNA, 18 bp, synthetic construct
  source 1..18: mol_type = other DNA
agataagacacactatag

SEQ ID NO: 18743 - DNA, 18 bp, synthetic construct
  source 1..18: mol_type = other DNA
agatacaactcactttag

SEQ ID NO: 18744 - DNA, 18 bp, synthetic construct
  source 1..18: mol_type = other DNA
agatactacacactatag

SEQ ID NO: 18745 - DNA, 18 bp, synthetic construct
  source 1..18: mol_type = other DNA
agatactactcaatatag

SEQ ID NO: 18746 - DNA, 18 bp, synthetic construct
  source 1..18: mol_type = other DNA
agataggacccactatag

SEQ ID NO: 18747 - DNA, 18 bp, synthetic construct
  source 1..18: mol_type = other DNA
agatccgtctcactatag

SEQ ID NO: 18748 - DNA, 18 bp, synthetic construct
  source 1..18: mol_type = other DNA
agatcctactcactatag

SEQ ID NO: 18749 - DNA, 18 bp, synthetic construct
  source 1..18: mol_type = other DNA
agctgcgactcactatag

SEQ ID NO: 18750 - DNA, 18 bp, synthetic construct
  source 1..18: mol_type = other DNA
atacacgagtcactatag

SEQ ID NO: 18751 - DNA, 18 bp, synthetic construct
  source 1..18: mol_type = other DNA
atataagactcactatgg

SEQ ID NO: 18752 - DNA, 18 bp, synthetic construct
  source 1..18: mol_type = other DNA
atatacgacccaccatag

SEQ ID NO: 18753 - DNA, 18 bp, synthetic construct
  source 1..18: mol_type = other DNA
atatacgcctcactacag

SEQ ID NO: 18754 - DNA, 18 bp, synthetic construct
  source 1..18: mol_type = other DNA
atatacggctcattatag

SEQ ID NO: 18755 - DNA, 18 bp, synthetic construct
  source 1..18: mol_type = other DNA
atgtacgactcacaatag

SEQ ID NO: 18756 - DNA, 18 bp, synthetic construct
  source 1..18: mol_type = other DNA
caaaacgactcaatatcg

SEQ ID NO: 18757 - DNA, 18 bp, synthetic construct
  source 1..18: mol_type = other DNA
caaaacgactcactaacg

SEQ ID NO: 18758 - DNA, 18 bp, synthetic construct
  source 1..18: mol_type = other DNA
caaaacgactctctatgg

SEQ ID NO: 18759 - DNA, 18 bp, synthetic construct
  source 1..18: mol_type = other DNA
caacacgactcataatag

SEQ ID NO: 18760 - DNA, 18 bp, synthetic construct
  source 1..18: mol_type = other DNA
caatacaactcacattag

SEQ ID NO: 18761 - DNA, 18 bp, synthetic construct
  source 1..18: mol_type = other DNA
caatacgaatcattacag

SEQ ID NO: 18762 - DNA, 18 bp, synthetic construct
  source 1..18: mol_type = other DNA
caatacgaatgactacag

SEQ ID NO: 18763 - DNA, 18 bp, synthetic construct
  source 1..18: mol_type = other DNA
caatacgacccaacatag

SEQ ID NO: 18764 - DNA, 18 bp, synthetic construct
  source 1..18: mol_type = other DNA
caatacgactaaggatag

SEQ ID NO: 18765 - DNA, 18 bp, synthetic construct
  source 1..18: mol_type = other DNA
caatacgactaataatag

SEQ ID NO: 18766 - DNA, 18 bp, synthetic construct
  source 1..18: mol_type = other DNA
caatacgacttactcaag

SEQ ID NO: 18767 - DNA, 18 bp, synthetic construct
  source 1..18: mol_type = other DNA
caatacgagtttctatag

SEQ ID NO: 18768 - DNA, 18 bp, synthetic construct
  source 1..18: mol_type = other DNA
caatacggctcactttgg

SEQ ID NO: 18769 - DNA, 18 bp, synthetic construct
  source 1..18: mol_type = other DNA
caatacgtctctccatag

SEQ ID NO: 18770 - DNA, 18 bp, synthetic construct
  source 1..18: mol_type = other DNA
caatactactcagcatag

SEQ ID NO: 18771 - DNA, 18 bp, synthetic construct
  source 1..18: mol_type = other DNA
caatactgcttactatag

SEQ ID NO: 18772 - DNA, 18 bp, synthetic construct
  source 1..18: mol_type = other DNA
caatccgtctgactatag

SEQ ID NO: 18773 - DNA, 18 bp, synthetic construct
  source 1..18: mol_type = other DNA
caatgccactcactttag

SEQ ID NO: 18774 - DNA, 18 bp, synthetic construct
  source 1..18: mol_type = other DNA
caccacgacttactatag

SEQ ID NO: 18775 - DNA, 18 bp, synthetic construct
  source 1..18: mol_type = other DNA
cagtacgactcattttag

SEQ ID NO: 18776 - DNA, 18 bp, synthetic construct
  source 1..18: mol_type = other DNA
cataacgactcactgtag

SEQ ID NO: 18777 - DNA, 18 bp, synthetic construct
  source 1..18: mol_type = other DNA
cattaccactcactaaag

SEQ ID NO: 18778 - DNA, 18 bp, synthetic construct
  source 1..18: mol_type = other DNA
cattaccactccctatag

SEQ ID NO: 18779 - DNA, 18 bp, synthetic construct
  source 1..18: mol_type = other DNA
cattacgactcccaatag

SEQ ID NO: 18780 - DNA, 18 bp, synthetic construct
  source 1..18: mol_type = other DNA
cattacggctcagtatag

SEQ ID NO: 18781 - DNA, 18 bp, synthetic construct
  source 1..18: mol_type = other DNA
ccatacgactcaacatag

SEQ ID NO: 18782 - DNA, 18 bp, synthetic construct
  source 1..18: mol_type = other DNA
ccatacgactctctagag

SEQ ID NO: 18783 - DNA, 18 bp, synthetic construct
  source 1..18: mol_type = other DNA
ccatactactcactaaag

SEQ ID NO: 18784 - DNA, 18 bp, synthetic construct
  source 1..18: mol_type = other DNA
cgatatgactctctatag

SEQ ID NO: 18785 - DNA, 18 bp, synthetic construct
  source 1..18: mol_type = other DNA
ctatacaactcagtatag

SEQ ID NO: 18786 - DNA, 18 bp, synthetic construct
  source 1..18: mol_type = other DNA
ctatccgactaactatag

SEQ ID NO: 18787 - DNA, 18 bp, synthetic construct
  source 1..18: mol_type = other DNA
ctatgcgactcacgatag

SEQ ID NO: 18788 - DNA, 18 bp, synthetic construct
  source 1..18: mol_type = other DNA
gaaaaggactcactatgg

SEQ ID NO: 18789 - DNA, 18 bp, synthetic construct
  source 1..18: mol_type = other DNA
gaacactactcattatag

SEQ ID NO: 18790 - DNA, 18 bp, synthetic construct
  source 1..18: mol_type = other DNA
gaatacatcttactatag

SEQ ID NO: 18791 - DNA, 18 bp, synthetic construct
  source 1..18: mol_type = other DNA
gaataccacacactagag

SEQ ID NO: 18792 - DNA, 18 bp, synthetic construct
  source 1..18: mol_type = other DNA
gaataccactcactttgg

SEQ ID NO: 18793 - DNA, 18 bp, synthetic construct
  source 1..18: mol_type = other DNA
gaatacgactcacagtgg

SEQ ID NO: 18794 - DNA, 18 bp, synthetic construct
  source 1..18: mol_type = other DNA
gaatacgacttatcatag

SEQ ID NO: 18795 - DNA, 18 bp, synthetic construct
  source 1..18: mol_type = other DNA
gaatactactcactcgag

SEQ ID NO: 18796 - DNA, 18 bp, synthetic construct
  source 1..18: mol_type = other DNA
gaatactactgaccatag

SEQ ID NO: 18797 - DNA, 18 bp, synthetic construct
  source 1..18: mol_type = other DNA
gaatatgagtcactatcg

SEQ ID NO: 18798 - DNA, 18 bp, synthetic construct
  source 1..18: mol_type = other DNA
gaatatgattcattatag

SEQ ID NO: 18799 - DNA, 18 bp, synthetic construct
  source 1..18: mol_type = other DNA
gaccgcgactcactatag

SEQ ID NO: 18800 - DNA, 18 bp, synthetic construct
  source 1..18: mol_type = other DNA
gagtacgtctaactatag

SEQ ID NO: 18801 - DNA, 18 bp, synthetic construct
  source 1..18: mol_type = other DNA
gattatgactcacgatag

SEQ ID NO: 18802 - DNA, 18 bp, synthetic construct
  source 1..18: mol_type = other DNA
gcatacgactcattgtag

SEQ ID NO: 18803 - DNA, 18 bp, synthetic construct
  source 1..18: mol_type = other DNA
ggatccgactctctatag

SEQ ID NO: 18804 - DNA, 18 bp, synthetic construct
  source 1..18: mol_type = other DNA
gtagacgactcaatatag

SEQ ID NO: 18805 - DNA, 18 bp, synthetic construct
  source 1..18: mol_type = other DNA
gtatacgactcattatcg

SEQ ID NO: 18806 - DNA, 18 bp, synthetic construct
  source 1..18: mol_type = other DNA
gtttatgactcactatag

SEQ ID NO: 18807 - DNA, 18 bp, synthetic construct
  source 1..18: mol_type = other DNA
taaaaagcctgactatag

SEQ ID NO: 18808 - DNA, 18 bp, synthetic construct
  source 1..18: mol_type = other DNA
taaaacaactcagtagag

SEQ ID NO: 18809 - DNA, 18 bp, synthetic construct
  source 1..18: mol_type = other DNA
taaaacatctccctatag

SEQ ID NO: 18810 - DNA, 18 bp, synthetic construct
  source 1..18: mol_type = other DNA
taaaaccaatcattatag

SEQ ID NO: 18811 - DNA, 18 bp, synthetic construct
  source 1..18: mol_type = other DNA
taaaaccactcaatttag

SEQ ID NO: 18812 - DNA, 18 bp, synthetic construct
  source 1..18: mol_type = other DNA
taaaaccagtcaccatag

SEQ ID NO: 18813 - DNA, 18 bp, synthetic construct
  source 1..18: mol_type = other DNA
taaaacgacactctatcg

SEQ ID NO: 18814 - DNA, 18 bp, synthetic construct
  source 1..18: mol_type = other DNA
taaaacgacgcattatgg

SEQ ID NO: 18815 - DNA, 18 bp, synthetic construct
  source 1..18: mol_type = other DNA
taaaacgactaacttgag

SEQ ID NO: 18816 - DNA, 18 bp, synthetic construct
  source 1..18: mol_type = other DNA
taaaacgactaattctag

SEQ ID NO: 18817 - DNA, 18 bp, synthetic construct
  source 1..18: mol_type = other DNA
taaaacgactgaatatgg

SEQ ID NO: 18818 - DNA, 18 bp, synthetic construct
  source 1..18: mol_type = other DNA
taaaacgacttactctgg

SEQ ID NO: 18819 - DNA, 18 bp, synthetic construct
  source 1..18: mol_type = other DNA
taaaacgagtaaatatag

SEQ ID NO: 18820 - DNA, 18 bp, synthetic construct
  source 1..18: mol_type = other DNA
taaaacgcctcactcaag

SEQ ID NO: 18821 - DNA, 18 bp, synthetic construct
  source 1..18: mol_type = other DNA
taaaacggaacactatag

SEQ ID NO: 18822 - DNA, 18 bp, synthetic construct
  source 1..18: mol_type = other DNA
taaaacgtgtcactatcg

SEQ ID NO: 18823 - DNA, 18 bp, synthetic construct
  source 1..18: mol_type = other DNA
taaaacgtgtcactgtag

SEQ ID NO: 18824 - DNA, 18 bp, synthetic construct
  source 1..18: mol_type = other DNA
taaaactacacactatgg

SEQ ID NO: 18825 - DNA, 18 bp, synthetic construct
  source 1..18: mol_type = other DNA
taaaactacgcactgtag

SEQ ID NO: 18826 - DNA, 18 bp, synthetic construct
  source 1..18: mol_type = other DNA
taaaactacttagtatag

SEQ ID NO: 18827 - DNA, 18 bp, synthetic construct
  source 1..18: mol_type = other DNA
taaaactagtcactttag

SEQ ID NO: 18828 - DNA, 18 bp, synthetic construct
  source 1..18: mol_type = other DNA
taaaaggaatcaatatag

SEQ ID NO: 18829 - DNA, 18 bp, synthetic construct
  source 1..18: mol_type = other DNA
taaaaggcctcactacag

SEQ ID NO: 18830 - DNA, 18 bp, synthetic construct
  source 1..18: mol_type = other DNA
taaaatgcctcacaatag

SEQ ID NO: 18831 - DNA, 18 bp, synthetic construct
  source 1..18: mol_type = other DNA
taaagcggctaactatag

SEQ ID NO: 18832 - DNA, 18 bp, synthetic construct
  source 1..18: mol_type = other DNA
taacaagactgactaaag

SEQ ID NO: 18833 - DNA, 18 bp, synthetic construct
  source 1..18: mol_type = other DNA
taacacaagtcactttag

SEQ ID NO: 18834 - DNA, 18 bp, synthetic construct
  source 1..18: mol_type = other DNA
taacacaagttactatag

SEQ ID NO: 18835 - DNA, 18 bp, synthetic construct
  source 1..18: mol_type = other DNA
taacaccccacactatag

SEQ ID NO: 18836 - DNA, 18 bp, synthetic construct
  source 1..18: mol_type = other DNA
taacacgaatatctatag

SEQ ID NO: 18837 - DNA, 18 bp, synthetic construct
  source 1..18: mol_type = other DNA
taacacgacactctacag

SEQ ID NO: 18838 - DNA, 18 bp, synthetic construct
  source 1..18: mol_type = other DNA
taacacgacatactttag

SEQ ID NO: 18839 - DNA, 18 bp, synthetic construct
  source 1..18: mol_type = other DNA
taacacgagtcacattag

SEQ ID NO: 18840 - DNA, 18 bp, synthetic construct
  source 1..18: mol_type = other DNA
taacacgattaactgtag

SEQ ID NO: 18841 - DNA, 18 bp, synthetic construct
  source 1..18: mol_type = other DNA
taacacgcatcaccatag

SEQ ID NO: 18842 - DNA, 18 bp, synthetic construct
  source 1..18: mol_type = other DNA
taacacggctcacaatgg

SEQ ID NO: 18843 - DNA, 18 bp, synthetic construct
  source 1..18: mol_type = other DNA
taacacgttccactatag

SEQ ID NO: 18844 - DNA, 18 bp, synthetic construct
  source 1..18: mol_type = other DNA
taacaggattcacaatag

SEQ ID NO: 18845 - DNA, 18 bp, synthetic construct
  source 1..18: mol_type = other DNA
taacatgactcagcatag

SEQ ID NO: 18846 - DNA, 18 bp, synthetic construct
  source 1..18: mol_type = other DNA
taacatgcctcacaatag

SEQ ID NO: 18847 - DNA, 18 bp, synthetic construct
  source 1..18: mol_type = other DNA
taaccctacacactatag

SEQ ID NO: 18848 - DNA, 18 bp, synthetic construct
  source 1..18: mol_type = other DNA
taacctcactcactatag

SEQ ID NO: 18849 - DNA, 18 bp, synthetic construct
  source 1..18: mol_type = other DNA
taagaagtctcaatatag

SEQ ID NO: 18850 - DNA, 18 bp, synthetic construct
  source 1..18: mol_type = other DNA
taagacgactcattgtcg

SEQ ID NO: 18851 - DNA, 18 bp, synthetic construct
  source 1..18: mol_type = other DNA
taagacgactttatatag

SEQ ID NO: 18852 - DNA, 18 bp, synthetic construct
  source 1..18: mol_type = other DNA
taagacgccttacgatag

SEQ ID NO: 18853 - DNA, 18 bp, synthetic construct
  source 1..18: mol_type = other DNA
taagacggctcactcaag

SEQ ID NO: 18854 - DNA, 18 bp, synthetic construct
  source 1..18: mol_type = other DNA
taagacgtcgcactaaag

SEQ ID NO: 18855 - DNA, 18 bp, synthetic construct
  source 1..18: mol_type = other DNA
taagactacacaccatag

SEQ ID NO: 18856 - DNA, 18 bp, synthetic construct
  source 1..18: mol_type = other DNA
taagactcctcactttag

SEQ ID NO: 18857 - DNA, 18 bp, synthetic construct
  source 1..18: mol_type = other DNA
taagatgacacaccatag

SEQ ID NO: 18858 - DNA, 18 bp, synthetic construct
  source 1..18: mol_type = other DNA
taagatggctcaatatag

SEQ ID NO: 18859 - DNA, 18 bp, synthetic construct
  source 1..18: mol_type = other DNA
taagatggctcactttag

SEQ ID NO: 18860 - DNA, 18 bp, synthetic construct
  source 1..18: mol_type = other DNA
taagccgatacactatag

SEQ ID NO: 18861 - DNA, 18 bp, synthetic construct
  source 1..18: mol_type = other DNA
taaggcgacacacaatag

SEQ ID NO: 18862 - DNA, 18 bp, synthetic construct
  source 1..18: mol_type = other DNA
taataaaactcattagag

SEQ ID NO: 18863 - DNA, 18 bp, synthetic construct
  source 1..18: mol_type = other DNA
taataagacaaattatag

SEQ ID NO: 18864 - DNA, 18 bp, synthetic construct
  source 1..18: mol_type = other DNA
taataagactcaccgtcg

SEQ ID NO: 18865 - DNA, 18 bp, synthetic construct
  source 1..18: mol_type = other DNA
taataagatacactacag

SEQ ID NO: 18866 - DNA, 18 bp, synthetic construct
  source 1..18: mol_type = other DNA
taataagccgcactgtag

SEQ ID NO: 18867 - DNA, 18 bp, synthetic construct
  source 1..18: mol_type = other DNA
taataaggataactatag

SEQ ID NO: 18868 - DNA, 18 bp, synthetic construct
  source 1..18: mol_type = other DNA
taataagtttcactatgg

SEQ ID NO: 18869 - DNA, 18 bp, synthetic construct
  source 1..18: mol_type = other DNA
taataatacacactatgg

SEQ ID NO: 18870 - DNA, 18 bp, synthetic construct
  source 1..18: mol_type = other DNA
taataatactccctgtag

SEQ ID NO: 18871 - DNA, 18 bp, synthetic construct
  source 1..18: mol_type = other DNA
taatacaacaaactatgg

SEQ ID NO: 18872 - DNA, 18 bp, synthetic construct
  source 1..18: mol_type = other DNA
taatacaacaccatatag

SEQ ID NO: 18873 - DNA, 18 bp, synthetic construct
  source 1..18: mol_type = other DNA
taatacaacaccctctag

SEQ ID NO: 18874 - DNA, 18 bp, synthetic construct
  source 1..18: mol_type = other DNA
taatacaacagactatgg

SEQ ID NO: 18875 - DNA, 18 bp, synthetic construct
  source 1..18: mol_type = other DNA
taatacaacggactaaag

SEQ ID NO: 18876 - DNA, 18 bp, synthetic construct
  source 1..18: mol_type = other DNA
taatacaactcccactag

SEQ ID NO: 18877 - DNA, 18 bp, synthetic construct
  source 1..18: mol_type = other DNA
taatacaacttacaatcg

SEQ ID NO: 18878 - DNA, 18 bp, synthetic construct
  source 1..18: mol_type = other DNA
taatacaattaactttag

SEQ ID NO: 18879 - DNA, 18 bp, synthetic construct
  source 1..18: mol_type = other DNA
taatacaattcaatgtag

SEQ ID NO: 18880 - DNA, 18 bp, synthetic construct
  source 1..18: mol_type = other DNA
taatacaattcacgatcg

SEQ ID NO: 18881 - DNA, 18 bp, synthetic construct
  source 1..18: mol_type = other DNA
taatacaccacactacag

SEQ ID NO: 18882 - DNA, 18 bp, synthetic construct
  source 1..18: mol_type = other DNA
taatacacctcacagtag

SEQ ID NO: 18883 - DNA, 18 bp, synthetic construct
  source 1..18: mol_type = other DNA
taatacaggtcactctag

SEQ ID NO: 18884 - DNA, 18 bp, synthetic construct
  source 1..18: mol_type = other DNA
taataccaattacaatag

SEQ ID NO: 18885 - DNA, 18 bp, synthetic construct
  source 1..18: mol_type = other DNA
taataccacacacaagag

SEQ ID NO: 18886 - DNA, 18 bp, synthetic construct
  source 1..18: mol_type = other DNA
taataccacatacaatag

SEQ ID NO: 18887 - DNA, 18 bp, synthetic construct
  source 1..18: mol_type = other DNA
taataccactcatagtag

SEQ ID NO: 18888 - DNA, 18 bp, synthetic construct
  source 1..18: mol_type = other DNA
taataccactgaacatag

SEQ ID NO: 18889 - DNA, 18 bp, synthetic construct
  source 1..18: mol_type = other DNA
taataccacttacagtag

SEQ ID NO: 18890 - DNA, 18 bp, synthetic construct
  source 1..18: mol_type = other DNA
taataccatgaactatag

SEQ ID NO: 18891 - DNA, 18 bp, synthetic construct
  source 1..18: mol_type = other DNA
taataccattcacttcag

SEQ ID NO: 18892 - DNA, 18 bp, synthetic construct
  source 1..18: mol_type = other DNA
taatacctctcactaacg

SEQ ID NO: 18893 - DNA, 18 bp, synthetic construct
  source 1..18: mol_type = other DNA
taatacgaaacaaaatag

SEQ ID NO: 18894 - DNA, 18 bp, synthetic construct
  source 1..18: mol_type = other DNA
taatacgaaacaatagag

SEQ ID NO: 18895 - DNA, 18 bp, synthetic construct
  source 1..18: mol_type = other DNA
taatacgaaacacgttag

SEQ ID NO: 18896 - DNA, 18 bp, synthetic construct
  source 1..18: mol_type = other DNA
taatacgaaatagtatag

SEQ ID NO: 18897 - DNA, 18 bp, synthetic construct
  source 1..18: mol_type = other DNA
taatacgaactacaatag

SEQ ID NO: 18898 - DNA, 18 bp, synthetic construct
  source 1..18: mol_type = other DNA
taatacgaatcacattac

SEQ ID NO: 18899 - DNA, 18 bp, synthetic construct
  source 1..18: mol_type = other DNA
taatacgaatcagtacgg

SEQ ID NO: 18900 - DNA, 18 bp, synthetic construct
  source 1..18: mol_type = other DNA
taatacgaatctatatcg

SEQ ID NO: 18901 - DNA, 18 bp, synthetic construct
  source 1..18: mol_type = other DNA
taatacgaatgacattag

SEQ ID NO: 18902 - DNA, 18 bp, synthetic construct
  source 1..18: mol_type = other DNA
taatacgaattaatagag

SEQ ID NO: 18903 - DNA, 18 bp, synthetic construct
  source 1..18: mol_type = other DNA
taatacgacacccaacag

SEQ ID NO: 18904 - DNA, 18 bp, synthetic construct
  source 1..18: mol_type = other DNA
taatacgacactatgtag

SEQ ID NO: 18905 - DNA, 18 bp, synthetic construct
  source 1..18: mol_type = other DNA
taatacgacagaagatag

SEQ ID NO: 18906 - DNA, 18 bp, synthetic construct
  source 1..18: mol_type = other DNA
taatacgacatactttgg

SEQ ID NO: 18907 - DNA, 18 bp, synthetic construct
  source 1..18: mol_type = other DNA
taatacgaccatctctag

SEQ ID NO: 18908 - DNA, 18 bp, synthetic construct
  source 1..18: mol_type = other DNA
taatacgactaagttcag

SEQ ID NO: 18909 - DNA, 18 bp, synthetic construct
  source 1..18: mol_type = other DNA
taatacgactatcggtag

SEQ ID NO: 18910 - DNA, 18 bp, synthetic construct
  source 1..18: mol_type = other DNA
taatacgactcagagaag

SEQ ID NO: 18911 - DNA, 18 bp, synthetic construct
  source 1..18: mol_type = other DNA
taatacgactccgaacag

SEQ ID NO: 18912 - DNA, 18 bp, synthetic construct
  source 1..18: mol_type = other DNA
taatacgactccggttag

SEQ ID NO: 18913 - DNA, 18 bp, synthetic construct
  source 1..18: mol_type = other DNA
taatacgactctatatca

SEQ ID NO: 18914 - DNA, 18 bp, synthetic construct
  source 1..18: mol_type = other DNA
taatacgactctatcaag

SEQ ID NO: 18915 - DNA, 18 bp, synthetic construct
  source 1..18: mol_type = other DNA
taatacgactctctgacg

SEQ ID NO: 18916 - DNA, 18 bp, synthetic construct
  source 1..18: mol_type = other DNA
taatacgactcttaatcg

SEQ ID NO: 18917 - DNA, 18 bp, synthetic construct
  source 1..18: mol_type = other DNA
taatacgacttaacaaag

SEQ ID NO: 18918 - DNA, 18 bp, synthetic construct
  source 1..18: mol_type = other DNA
taatacgacttaagaaag

SEQ ID NO: 18919 - DNA, 18 bp, synthetic construct
  source 1..18: mol_type = other DNA
taatacgacttacgtaag

SEQ ID NO: 18920 - DNA, 18 bp, synthetic construct
  source 1..18: mol_type = other DNA
taatacgactttctaagg

SEQ ID NO: 18921 - DNA, 18 bp, synthetic construct
  source 1..18: mol_type = other DNA
taatacgagcatctatag

SEQ ID NO: 18922 - DNA, 18 bp, synthetic construct
  source 1..18: mol_type = other DNA
taatacgagccaacatag

SEQ ID NO: 18923 - DNA, 18 bp, synthetic construct
  source 1..18: mol_type = other DNA
taatacgagcgactgtag

SEQ ID NO: 18924 - DNA, 18 bp, synthetic construct
  source 1..18: mol_type = other DNA
taatacgaggcacattag

SEQ ID NO: 18925 - DNA, 18 bp, synthetic construct
  source 1..18: mol_type = other DNA
taatacgagtaattttag

SEQ ID NO: 18926 - DNA, 18 bp, synthetic construct
  source 1..18: mol_type = other DNA
taatacgagtctccgtag

SEQ ID NO: 18927 - DNA, 18 bp, synthetic construct
  source 1..18: mol_type = other DNA
taatacgagtctgtttag

SEQ ID NO: 18928 - DNA, 18 bp, synthetic construct
  source 1..18: mol_type = other DNA
taatacgattaataatag

SEQ ID NO: 18929 - DNA, 18 bp, synthetic construct
  source 1..18: mol_type = other DNA
taatacgattacctacag

SEQ ID NO: 18930 - DNA, 18 bp, synthetic construct
  source 1..18: mol_type = other DNA
taatacgattcagcagag

SEQ ID NO: 18931 - DNA, 18 bp, synthetic construct
  source 1..18: mol_type = other DNA
taatacgattccgtttag

SEQ ID NO: 18932 - DNA, 18 bp, synthetic construct
  source 1..18: mol_type = other DNA
taatacgcatcaataaag

SEQ ID NO: 18933 - DNA, 18 bp, synthetic construct
  source 1..18: mol_type = other DNA
taatacgccacacactag

SEQ ID NO: 18934 - DNA, 18 bp, synthetic construct
  source 1..18: mol_type = other DNA
taatacgccacactaacg

SEQ ID NO: 18935 - DNA, 18 bp, synthetic construct
  source 1..18: mol_type = other DNA
taatacgcctcacttacg

SEQ ID NO: 18936 - DNA, 18 bp, synthetic construct
  source 1..18: mol_type = other DNA
taatacgcttcccaatag

SEQ ID NO: 18937 - DNA, 18 bp, synthetic construct
  source 1..18: mol_type = other DNA
taatacggataattatag

SEQ ID NO: 18938 - DNA, 18 bp, synthetic construct
  source 1..18: mol_type = other DNA
taatacggctcacatcag

SEQ ID NO: 18939 - DNA, 18 bp, synthetic construct
  source 1..18: mol_type = other DNA
taatacggctcacgctgg

SEQ ID NO: 18940 - DNA, 18 bp, synthetic construct
  source 1..18: mol_type = other DNA
taatacggttttctatag

SEQ ID NO: 18941 - DNA, 18 bp, synthetic construct
  source 1..18: mol_type = other DNA
taatacgtcacactagcg

SEQ ID NO: 18942 - DNA, 18 bp, synthetic construct
  source 1..18: mol_type = other DNA
taatacgtccccctatcg

SEQ ID NO: 18943 - DNA, 18 bp, synthetic construct
  source 1..18: mol_type = other DNA
taatacgtctcaattcag

SEQ ID NO: 18944 - DNA, 18 bp, synthetic construct
  source 1..18: mol_type = other DNA
taatacgtctcacttggg

SEQ ID NO: 18945 - DNA, 18 bp, synthetic construct
  source 1..18: mol_type = other DNA
taatacgtcttactaccg

SEQ ID NO: 18946 - DNA, 18 bp, synthetic construct
  source 1..18: mol_type = other DNA
taatactaatcagtatcg

SEQ ID NO: 18947 - DNA, 18 bp, synthetic construct
  source 1..18: mol_type = other DNA
taatactaatcccaatag

SEQ ID NO: 18948 - DNA, 18 bp, synthetic construct
  source 1..18: mol_type = other DNA
taatactacacacttgag

SEQ ID NO: 18949 - DNA, 18 bp, synthetic construct
  source 1..18: mol_type = other DNA
taatactacacattaaag

SEQ ID NO: 18950 - DNA, 18 bp, synthetic construct
  source 1..18: mol_type = other DNA
taatactacgctctagag

SEQ ID NO: 18951 - DNA, 18 bp, synthetic construct
  source 1..18: mol_type = other DNA
taatactactaagcatag

SEQ ID NO: 18952 - DNA, 18 bp, synthetic construct
  source 1..18: mol_type = other DNA
taatactactatctctag

SEQ ID NO: 18953 - DNA, 18 bp, synthetic construct
  source 1..18: mol_type = other DNA
taatactactcagaatgg

SEQ ID NO: 18954 - DNA, 18 bp, synthetic construct
  source 1..18: mol_type = other DNA
taatactactccatatcg

SEQ ID NO: 18955 - DNA, 18 bp, synthetic construct
  source 1..18: mol_type = other DNA
taatactagtaagtatag

SEQ ID NO: 18956 - DNA, 18 bp, synthetic construct
  source 1..18: mol_type = other DNA
taatactagtctctttag

SEQ ID NO: 18957 - DNA, 18 bp, synthetic construct
  source 1..18: mol_type = other DNA
taatacttcttcctatag

SEQ ID NO: 18958 - DNA, 18 bp, synthetic construct
  source 1..18: mol_type = other DNA
taatagaaatcactctag

SEQ ID NO: 18959 - DNA, 18 bp, synthetic construct
  source 1..18: mol_type = other DNA
taatagaactctctgtag

SEQ ID NO: 18960 - DNA, 18 bp, synthetic construct
  source 1..18: mol_type = other DNA
taatagatctgactatag

SEQ ID NO: 18961 - DNA, 18 bp, synthetic construct
  source 1..18: mol_type = other DNA
taatagcactcattacag

SEQ ID NO: 18962 - DNA, 18 bp, synthetic construct
  source 1..18: mol_type = other DNA
taataggaataactttag

SEQ ID NO: 18963 - DNA, 18 bp, synthetic construct
  source 1..18: mol_type = other DNA
taataggacccccgatag

SEQ ID NO: 18964 - DNA, 18 bp, synthetic construct
  source 1..18: mol_type = other DNA
taataggactcaatttcg

SEQ ID NO: 18965 - DNA, 18 bp, synthetic construct
  source 1..18: mol_type = other DNA
taataggactctgtacag

SEQ ID NO: 18966 - DNA, 18 bp, synthetic construct
  source 1..18: mol_type = other DNA
taataggattcacaaaag

SEQ ID NO: 18967 - DNA, 18 bp, synthetic construct
  source 1..18: mol_type = other DNA
taataggattctgtatag

SEQ ID NO: 18968 - DNA, 18 bp, synthetic construct
  source 1..18: mol_type = other DNA
taatagggcacactttag

SEQ ID NO: 18969 - DNA, 18 bp, synthetic construct
  source 1..18: mol_type = other DNA
taatagggcttaatatag

SEQ ID NO: 18970 - DNA, 18 bp, synthetic construct
  source 1..18: mol_type = other DNA
taataggtatcactaaag

SEQ ID NO: 18971 - DNA, 18 bp, synthetic construct
  source 1..18: mol_type = other DNA
taatagtactaacaatag

SEQ ID NO: 18972 - DNA, 18 bp, synthetic construct
  source 1..18: mol_type = other DNA
taatagtactaactatcg

SEQ ID NO: 18973 - DNA, 18 bp, synthetic construct
  source 1..18: mol_type = other DNA
taatataactcaccctag

SEQ ID NO: 18974 - DNA, 18 bp, synthetic construct
  source 1..18: mol_type = other DNA
taatatcagtcactttag

SEQ ID NO: 18975 - DNA, 18 bp, synthetic construct
  source 1..18: mol_type = other DNA
taatatgaatacctatag

SEQ ID NO: 18976 - DNA, 18 bp, synthetic construct
  source 1..18: mol_type = other DNA
taatatgaattactaaag

SEQ ID NO: 18977 - DNA, 18 bp, synthetic construct
  source 1..18: mol_type = other DNA
taatatgacaccctatcg

SEQ ID NO: 18978 - DNA, 18 bp, synthetic construct
  source 1..18: mol_type = other DNA
taatatgactcaagagag

SEQ ID NO: 18979 - DNA, 18 bp, synthetic construct
  source 1..18: mol_type = other DNA
taatatgactgactttcg

SEQ ID NO: 18980 - DNA, 18 bp, synthetic construct
  source 1..18: mol_type = other DNA
taatatgacttaatatcg

SEQ ID NO: 18981 - DNA, 18 bp, synthetic construct
  source 1..18: mol_type = other DNA
taatatgagtcactgcag

SEQ ID NO: 18982 - DNA, 18 bp, synthetic construct
  source 1..18: mol_type = other DNA
taatatgtctcagaatag

SEQ ID NO: 18983 - DNA, 18 bp, synthetic construct
  source 1..18: mol_type = other DNA
taatatgtctcattacag

SEQ ID NO: 18984 - DNA, 18 bp, synthetic construct
  source 1..18: mol_type = other DNA
taatatgtctccgtatag

SEQ ID NO: 18985 - DNA, 18 bp, synthetic construct
  source 1..18: mol_type = other DNA
taatattactaagtatag

SEQ ID NO: 18986 - DNA, 18 bp, synthetic construct
  source 1..18: mol_type = other DNA
taatattacttactatcg

SEQ ID NO: 18987 - DNA, 18 bp, synthetic construct
  source 1..18: mol_type = other DNA
taatatttgtcactatag

SEQ ID NO: 18988 - DNA, 18 bp, synthetic construct
  source 1..18: mol_type = other DNA
taatcagaatcacaatag

SEQ ID NO: 18989 - DNA, 18 bp, synthetic construct
  source 1..18: mol_type = other DNA
taatcatactcactatcg

SEQ ID NO: 18990 - DNA, 18 bp, synthetic construct
  source 1..18: mol_type = other DNA
taatccatctcaatatag

SEQ ID NO: 18991 - DNA, 18 bp, synthetic construct
  source 1..18: mol_type = other DNA
taatccgaagcactatgg

SEQ ID NO: 18992 - DNA, 18 bp, synthetic construct
  source 1..18: mol_type = other DNA
taatccgaatcaccaaag

SEQ ID NO: 18993 - DNA, 18 bp, synthetic construct
  source 1..18: mol_type = other DNA
taatccgacagtctatag

SEQ ID NO: 18994 - DNA, 18 bp, synthetic construct
  source 1..18: mol_type = other DNA
taatccgacgcactgaag

SEQ ID NO: 18995 - DNA, 18 bp, synthetic construct
  source 1..18: mol_type = other DNA
taatccgactaacttaag

SEQ ID NO: 18996 - DNA, 18 bp, synthetic construct
  source 1..18: mol_type = other DNA
taatccgactcaacaaag

SEQ ID NO: 18997 - DNA, 18 bp, synthetic construct
  source 1..18: mol_type = other DNA
taatccgatccactttag

SEQ ID NO: 18998 - DNA, 18 bp, synthetic construct
  source 1..18: mol_type = other DNA
taatccgccacagtatag

SEQ ID NO: 18999 - DNA, 18 bp, synthetic construct
  source 1..18: mol_type = other DNA
taatcctacatactatag

SEQ ID NO: 19000 - DNA, 18 bp, synthetic construct
  source 1..18: mol_type = other DNA
taatcggacccattatag

SEQ ID NO: 19001 - DNA, 18 bp, synthetic construct
  source 1..18: mol_type = other DNA
taatctgactcaataaag

SEQ ID NO: 19002 - DNA, 18 bp, synthetic construct
  source 1..18: mol_type = other DNA
taatctgactcacaatgg

SEQ ID NO: 19003 - DNA, 18 bp, synthetic construct
  source 1..18: mol_type = other DNA
taatctgactctctagag

SEQ ID NO: 19004 - DNA, 18 bp, synthetic construct
  source 1..18: mol_type = other DNA
taatctgactctctatcg

SEQ ID NO: 19005 - DNA, 18 bp, synthetic construct
  source 1..18: mol_type = other DNA
taatgacacgcactatag

SEQ ID NO: 19006 - DNA, 18 bp, synthetic construct
  source 1..18: mol_type = other DNA
taatgagaatcaccatag

SEQ ID NO: 19007 - DNA, 18 bp, synthetic construct
  source 1..18: mol_type = other DNA
taatgagactcacactag

SEQ ID NO: 19008 - DNA, 18 bp, synthetic construct
  source 1..18: mol_type = other DNA
taatgagtcttactatag

SEQ ID NO: 19009 - DNA, 18 bp, synthetic construct
  source 1..18: mol_type = other DNA
taatgcaaatctctatag

SEQ ID NO: 19010 - DNA, 18 bp, synthetic construct
  source 1..18: mol_type = other DNA
taatgcatctcacaatag

SEQ ID NO: 19011 - DNA, 18 bp, synthetic construct
  source 1..18: mol_type = other DNA
taatgcatctctctatag

SEQ ID NO: 19012 - DNA, 18 bp, synthetic construct
  source 1..18: mol_type = other DNA
taatgccacacaccatag

SEQ ID NO: 19013 - DNA, 18 bp, synthetic construct
  source 1..18: mol_type = other DNA
taatgccacacactctag

SEQ ID NO: 19014 - DNA, 18 bp, synthetic construct
  source 1..18: mol_type = other DNA
taatgccattcactaaag

SEQ ID NO: 19015 - DNA, 18 bp, synthetic construct
  source 1..18: mol_type = other DNA
taatgcgaatcaccaaag

SEQ ID NO: 19016 - DNA, 18 bp, synthetic construct
  source 1..18: mol_type = other DNA
taatgcgacacactgcag

SEQ ID NO: 19017 - DNA, 18 bp, synthetic construct
  source 1..18: mol_type = other DNA
taatgcgactacctaaag

SEQ ID NO: 19018 - DNA, 18 bp, synthetic construct
  source 1..18: mol_type = other DNA
taatgcgactcaaaacag

SEQ ID NO: 19019 - DNA, 18 bp, synthetic construct
  source 1..18: mol_type = other DNA
taatgcgactcacgaccg

SEQ ID NO: 19020 - DNA, 18 bp, synthetic construct
  source 1..18: mol_type = other DNA
taatgcgactcataatgg

SEQ ID NO: 19021 - DNA, 18 bp, synthetic construct
  source 1..18: mol_type = other DNA
taatgcgactctacatag

SEQ ID NO: 19022 - DNA, 18 bp, synthetic construct
  source 1..18: mol_type = other DNA
taatgcgatgcactaaag

SEQ ID NO: 19023 - DNA, 18 bp, synthetic construct
  source 1..18: mol_type = other DNA
taatgcgattcaaaatag

SEQ ID NO: 19024 - DNA, 18 bp, synthetic construct
  source 1..18: mol_type = other DNA
taatgcgcatcaccatag

SEQ ID NO: 19025 - DNA, 18 bp, synthetic construct
  source 1..18: mol_type = other DNA
taatgcgtcacagtatag

SEQ ID NO: 19026 - DNA, 18 bp, synthetic construct
  source 1..18: mol_type = other DNA
taatgcgtcttactgtag

SEQ ID NO: 19027 - DNA, 18 bp, synthetic construct
  source 1..18: mol_type = other DNA
taatgcgtttcattatag

SEQ ID NO: 19028 - DNA, 18 bp, synthetic construct
  source 1..18: mol_type = other DNA
taatgctacacacaatag

SEQ ID NO: 19029 - DNA, 18 bp, synthetic construct
  source 1..18: mol_type = other DNA
taatgtaactcactctag

SEQ ID NO: 19030 - DNA, 18 bp, synthetic construct
  source 1..18: mol_type = other DNA
taatgtgtgtcactatag

SEQ ID NO: 19031 - DNA, 18 bp, synthetic construct
  source 1..18: mol_type = other DNA
taccaagactcattatag

SEQ ID NO: 19032 - DNA, 18 bp, synthetic construct
  source 1..18: mol_type = other DNA
taccacgacacactttag

SEQ ID NO: 19033 - DNA, 18 bp, synthetic construct
  source 1..18: mol_type = other DNA
taccacgccccactatag

SEQ ID NO: 19034 - DNA, 18 bp, synthetic construct
  source 1..18: mol_type = other DNA
taccaggacgcactatag

SEQ ID NO: 19035 - DNA, 18 bp, synthetic construct
  source 1..18: mol_type = other DNA
tactaactctcactatag

SEQ ID NO: 19036 - DNA, 18 bp, synthetic construct
  source 1..18: mol_type = other DNA
tactaagacttacgatag

SEQ ID NO: 19037 - DNA, 18 bp, synthetic construct
  source 1..18: mol_type = other DNA
tactacaactcactttcg

SEQ ID NO: 19038 - DNA, 18 bp, synthetic construct
  source 1..18: mol_type = other DNA
tactacgaatctctttag

SEQ ID NO: 19039 - DNA, 18 bp, synthetic construct
  source 1..18: mol_type = other DNA
tactacgacacacaatcg

SEQ ID NO: 19040 - DNA, 18 bp, synthetic construct
  source 1..18: mol_type = other DNA
tactacgaccaagtatag

SEQ ID NO: 19041 - DNA, 18 bp, synthetic construct
  source 1..18: mol_type = other DNA
tactacgactacgtatag

SEQ ID NO: 19042 - DNA, 18 bp, synthetic construct
  source 1..18: mol_type = other DNA
tactacgactctatagag

SEQ ID NO: 19043 - DNA, 18 bp, synthetic construct
  source 1..18: mol_type = other DNA
tactacgactgtcaatag

SEQ ID NO: 19044 - DNA, 18 bp, synthetic construct
  source 1..18: mol_type = other DNA
tactacgagttactttag

SEQ ID NO: 19045 - DNA, 18 bp, synthetic construct
  source 1..18: mol_type = other DNA
tactacgattatctatag

SEQ ID NO: 19046 - DNA, 18 bp, synthetic construct
  source 1..18: mol_type = other DNA
tactacgcctcacattag

SEQ ID NO: 19047 - DNA, 18 bp, synthetic construct
  source 1..18: mol_type = other DNA
tactacgcctctctttag

SEQ ID NO: 19048 - DNA, 18 bp, synthetic construct
  source 1..18: mol_type = other DNA
tactactactcaacatag

SEQ ID NO: 19049 - DNA, 18 bp, synthetic construct
  source 1..18: mol_type = other DNA
tactactactcactgtcg

SEQ ID NO: 19050 - DNA, 18 bp, synthetic construct
  source 1..18: mol_type = other DNA
tactaggagtcactaaag

SEQ ID NO: 19051 - DNA, 18 bp, synthetic construct
  source 1..18: mol_type = other DNA
tactaggcctcactttag

SEQ ID NO: 19052 - DNA, 18 bp, synthetic construct
  source 1..18: mol_type = other DNA
tactatgactcagtaaag

SEQ ID NO: 19053 - DNA, 18 bp, synthetic construct
  source 1..18: mol_type = other DNA
tactatgactcagtctag

SEQ ID NO: 19054 - DNA, 18 bp, synthetic construct
  source 1..18: mol_type = other DNA
tactccaactcactgtag

SEQ ID NO: 19055 - DNA, 18 bp, synthetic construct
  source 1..18: mol_type = other DNA
tactccggctcactaaag

SEQ ID NO: 19056 - DNA, 18 bp, synthetic construct
  source 1..18: mol_type = other DNA
tactgggactcattatag

SEQ ID NO: 19057 - DNA, 18 bp, synthetic construct
  source 1..18: mol_type = other DNA
tagaacgacggactatag

SEQ ID NO: 19058 - DNA, 18 bp, synthetic construct
  source 1..18: mol_type = other DNA
tagcacgactcccaatag

SEQ ID NO: 19059 - DNA, 18 bp, synthetic construct
  source 1..18: mol_type = other DNA
tagcactattcactatag

SEQ ID NO: 19060 - DNA, 18 bp, synthetic construct
  source 1..18: mol_type = other DNA
tagtaaaactcactatgg

SEQ ID NO: 19061 - DNA, 18 bp, synthetic construct
  source 1..18: mol_type = other DNA
tagtaagactcaatctag

SEQ ID NO: 19062 - DNA, 18 bp, synthetic construct
  source 1..18: mol_type = other DNA
tagtaagatgcactatag

SEQ ID NO: 19063 - DNA, 18 bp, synthetic construct
  source 1..18: mol_type = other DNA
tagtacaactcacttaag

SEQ ID NO: 19064 - DNA, 18 bp, synthetic construct
  source 1..18: mol_type = other DNA
tagtacaactcataatag

SEQ ID NO: 19065 - DNA, 18 bp, synthetic construct
  source 1..18: mol_type = other DNA
tagtacaactcattttag

SEQ ID NO: 19066 - DNA, 18 bp, synthetic construct
  source 1..18: mol_type = other DNA
tagtacaactctatatag

SEQ ID NO: 19067 - DNA, 18 bp, synthetic construct
  source 1..18: mol_type = other DNA
tagtaccacatactatag

SEQ ID NO: 19068 - DNA, 18 bp, synthetic construct
  source 1..18: mol_type = other DNA
tagtaccactcaccaaag

SEQ ID NO: 19069 - DNA, 18 bp, synthetic construct
  source 1..18: mol_type = other DNA
tagtacgaaacaatatag

SEQ ID NO: 19070 - DNA, 18 bp, synthetic construct
  source 1..18: mol_type = other DNA
tagtacgaatctctacag

SEQ ID NO: 19071 - DNA, 18 bp, synthetic construct
  source 1..18: mol_type = other DNA
tagtacgactaacaagag

SEQ ID NO: 19072 - DNA, 18 bp, synthetic construct
  source 1..18: mol_type = other DNA
tagtacgactaactttcg

SEQ ID NO: 19073 - DNA, 18 bp, synthetic construct
  source 1..18: mol_type = other DNA
tagtacgactccacatag

SEQ ID NO: 19074 - DNA, 18 bp, synthetic construct
  source 1..18: mol_type = other DNA
tagtacgagttcctatag

SEQ ID NO: 19075 - DNA, 18 bp, synthetic construct
  source 1..18: mol_type = other DNA
tagtacgattccgtatag

SEQ ID NO: 19076 - DNA, 18 bp, synthetic construct
  source 1..18: mol_type = other DNA
tagtacgcctaactttag

SEQ ID NO: 19077 - DNA, 18 bp, synthetic construct
  source 1..18: mol_type = other DNA
tagtacggctaactacag

SEQ ID NO: 19078 - DNA, 18 bp, synthetic construct
  source 1..18: mol_type = other DNA
tagtacggctcacaaaag

SEQ ID NO: 19079 - DNA, 18 bp, synthetic construct
  source 1..18: mol_type = other DNA
tagtacgtatcactctag

SEQ ID NO: 19080 - DNA, 18 bp, synthetic construct
  source 1..18: mol_type = other DNA
tagtacgtcagactatag

SEQ ID NO: 19081 - DNA, 18 bp, synthetic construct
  source 1..18: mol_type = other DNA
tagtacgtctcaccatgg

SEQ ID NO: 19082 - DNA, 18 bp, synthetic construct
  source 1..18: mol_type = other DNA
tagtacgtctcactttgg

SEQ ID NO: 19083 - DNA, 18 bp, synthetic construct
  source 1..18: mol_type = other DNA
tagtacgtctcattctag

SEQ ID NO: 19084 - DNA, 18 bp, synthetic construct
  source 1..18: mol_type = other DNA
tagtactactcaatttag

SEQ ID NO: 19085 - DNA, 18 bp, synthetic construct
  source 1..18: mol_type = other DNA
tagtactagtccctatag

SEQ ID NO: 19086 - DNA, 18 bp, synthetic construct
  source 1..18: mol_type = other DNA
tagtagtacacactatag

SEQ ID NO: 19087 - DNA, 18 bp, synthetic construct
  source 1..18: mol_type = other DNA
tagtatgattcacaatag

SEQ ID NO: 19088 - DNA, 18 bp, synthetic construct
  source 1..18: mol_type = other DNA
tagtattactcactatcg

SEQ ID NO: 19089 - DNA, 18 bp, synthetic construct
  source 1..18: mol_type = other DNA
tagtgaaactcactatag

SEQ ID NO: 19090 - DNA, 18 bp, synthetic construct
  source 1..18: mol_type = other DNA
tagtgcgaatcactatcg

SEQ ID NO: 19091 - DNA, 18 bp, synthetic construct
  source 1..18: mol_type = other DNA
tagtgcgtcgcactatag

SEQ ID NO: 19092 - DNA, 18 bp, synthetic construct
  source 1..18: mol_type = other DNA
tagtgctactctctatag

SEQ ID NO: 19093 - DNA, 18 bp, synthetic construct
  source 1..18: mol_type = other DNA
tataacgactcacgaaag

SEQ ID NO: 19094 - DNA, 18 bp, synthetic construct
  source 1..18: mol_type = other DNA
tataacgactccctgtag

SEQ ID NO: 19095 - DNA, 18 bp, synthetic construct
  source 1..18: mol_type = other DNA
tataacgactgaccatag

SEQ ID NO: 19096 - DNA, 18 bp, synthetic construct
  source 1..18: mol_type = other DNA
tataacgagtcattatag

SEQ ID NO: 19097 - DNA, 18 bp, synthetic construct
  source 1..18: mol_type = other DNA
tataaggactcactagag

SEQ ID NO: 19098 - DNA, 18 bp, synthetic construct
  source 1..18: mol_type = other DNA
tataccgactcattatag

SEQ ID NO: 19099 - DNA, 18 bp, synthetic construct
  source 1..18: mol_type = other DNA
tatcacgacccactctag

SEQ ID NO: 19100 - DNA, 18 bp, synthetic construct
  source 1..18: mol_type = other DNA
tatcaggactcaatatag

SEQ ID NO: 19101 - DNA, 18 bp, synthetic construct
  source 1..18: mol_type = other DNA
tatgacgaataactatag

SEQ ID NO: 19102 - DNA, 18 bp, synthetic construct
  source 1..18: mol_type = other DNA
tatggcgactctctatag

SEQ ID NO: 19103 - DNA, 18 bp, synthetic construct
  source 1..18: mol_type = other DNA
tattaagactcacggtag

SEQ ID NO: 19104 - DNA, 18 bp, synthetic construct
  source 1..18: mol_type = other DNA
tattaagactccttatag

SEQ ID NO: 19105 - DNA, 18 bp, synthetic construct
  source 1..18: mol_type = other DNA
tattaaggcttactatag

SEQ ID NO: 19106 - DNA, 18 bp, synthetic construct
  source 1..18: mol_type = other DNA
tattacaaatcacgatag

SEQ ID NO: 19107 - DNA, 18 bp, synthetic construct
  source 1..18: mol_type = other DNA
tattacaacgcactctag

SEQ ID NO: 19108 - DNA, 18 bp, synthetic construct
  source 1..18: mol_type = other DNA
tattacaactcaccatgg

SEQ ID NO: 19109 - DNA, 18 bp, synthetic construct
  source 1..18: mol_type = other DNA
tattacaacttactctag

SEQ ID NO: 19110 - DNA, 18 bp, synthetic construct
  source 1..18: mol_type = other DNA
tattaccaccaactatag

SEQ ID NO: 19111 - DNA, 18 bp, synthetic construct
  source 1..18: mol_type = other DNA
tattaccactaactttag

SEQ ID NO: 19112 - DNA, 18 bp, synthetic construct
  source 1..18: mol_type = other DNA
tattacgaaccactctag

SEQ ID NO: 19113 - DNA, 18 bp, synthetic construct
  source 1..18: mol_type = other DNA
tattacgaatcaatctag

SEQ ID NO: 19114 - DNA, 18 bp, synthetic construct
  source 1..18: mol_type = other DNA
tattacgacagaatatag

SEQ ID NO: 19115 - DNA, 18 bp, synthetic construct
  source 1..18: mol_type = other DNA
tattacgacatactagag

SEQ ID NO: 19116 - DNA, 18 bp, synthetic construct
  source 1..18: mol_type = other DNA
tattacgacatcctatag

SEQ ID NO: 19117 - DNA, 18 bp, synthetic construct
  source 1..18: mol_type = other DNA
tattacgacccagtaaag

SEQ ID NO: 19118 - DNA, 18 bp, synthetic construct
  source 1..18: mol_type = other DNA
tattacgactcattccag

SEQ ID NO: 19119 - DNA, 18 bp, synthetic construct
  source 1..18: mol_type = other DNA
tattacgactccctttgg

SEQ ID NO: 19120 - DNA, 18 bp, synthetic construct
  source 1..18: mol_type = other DNA
tattacgactccgaatag

SEQ ID NO: 19121 - DNA, 18 bp, synthetic construct
  source 1..18: mol_type = other DNA
tattacgactccttagag

SEQ ID NO: 19122 - DNA, 18 bp, synthetic construct
  source 1..18: mol_type = other DNA
tattacgactctatctag

SEQ ID NO: 19123 - DNA, 18 bp, synthetic construct
  source 1..18: mol_type = other DNA
tattacgactgactaacg

SEQ ID NO: 19124 - DNA, 18 bp, synthetic construct
  source 1..18: mol_type = other DNA
tattacggcacactatcg

SEQ ID NO: 19125 - DNA, 18 bp, synthetic construct
  source 1..18: mol_type = other DNA
tattacggctaactatcg

SEQ ID NO: 19126 - DNA, 18 bp, synthetic construct
  source 1..18: mol_type = other DNA
tattacgtcacactataa

SEQ ID NO: 19127 - DNA, 18 bp, synthetic construct
  source 1..18: mol_type = other DNA
tattacgtcccaatatag

SEQ ID NO: 19128 - DNA, 18 bp, synthetic construct
  source 1..18: mol_type = other DNA
tattacgtctgactaaag

SEQ ID NO: 19129 - DNA, 18 bp, synthetic construct
  source 1..18: mol_type = other DNA
tattacgtgtcactctag

SEQ ID NO: 19130 - DNA, 18 bp, synthetic construct
  source 1..18: mol_type = other DNA
tattactattcaccatag

SEQ ID NO: 19131 - DNA, 18 bp, synthetic construct
  source 1..18: mol_type = other DNA
tattaggactcaatctag

SEQ ID NO: 19132 - DNA, 18 bp, synthetic construct
  source 1..18: mol_type = other DNA
tattaggtcacactatag

SEQ ID NO: 19133 - DNA, 18 bp, synthetic construct
  source 1..18: mol_type = other DNA
tattaggtctcaatatag

SEQ ID NO: 19134 - DNA, 18 bp, synthetic construct
  source 1..18: mol_type = other DNA
tattatgacgcacgatag

SEQ ID NO: 19135 - DNA, 18 bp, synthetic construct
  source 1..18: mol_type = other DNA
tattatgactcacagtag

SEQ ID NO: 19136 - DNA, 18 bp, synthetic construct
  source 1..18: mol_type = other DNA
tattatgactccctctag

SEQ ID NO: 19137 - DNA, 18 bp, synthetic construct
  source 1..18: mol_type = other DNA
tattatgcctcagtatag

SEQ ID NO: 19138 - DNA, 18 bp, synthetic construct
  source 1..18: mol_type = other DNA
tattatgtctcactatgg

SEQ ID NO: 19139 - DNA, 18 bp, synthetic construct
  source 1..18: mol_type = other DNA
tattattgctcactatag

SEQ ID NO: 19140 - DNA, 18 bp, synthetic construct
  source 1..18: mol_type = other DNA
tattccgactcactcgag

SEQ ID NO: 19141 - DNA, 18 bp, synthetic construct
  source 1..18: mol_type = other DNA
tattccgactgacaatag

SEQ ID NO: 19142 - DNA, 18 bp, synthetic construct
  source 1..18: mol_type = other DNA
tattcctagtcactatag

SEQ ID NO: 19143 - DNA, 18 bp, synthetic construct
  source 1..18: mol_type = other DNA
tattgcgaatcacaatag

SEQ ID NO: 19144 - DNA, 18 bp, synthetic construct
  source 1..18: mol_type = other DNA
tattgcgactcactgaag

SEQ ID NO: 19145 - DNA, 18 bp, synthetic construct
  source 1..18: mol_type = other DNA
tattgcgactgactatcg

SEQ ID NO: 19146 - DNA, 18 bp, synthetic construct
  source 1..18: mol_type = other DNA
tcaaaccactcattatag

SEQ ID NO: 19147 - DNA, 18 bp, synthetic construct
  source 1..18: mol_type = other DNA
tcaaacgactccctttag

SEQ ID NO: 19148 - DNA, 18 bp, synthetic construct
  source 1..18: mol_type = other DNA
tcacacgacatactatag

SEQ ID NO: 19149 - DNA, 18 bp, synthetic construct
  source 1..18: mol_type = other DNA
tcataagaggcactatag

SEQ ID NO: 19150 - DNA, 18 bp, synthetic construct
  source 1..18: mol_type = other DNA
tcatacaactcactttgg

SEQ ID NO: 19151 - DNA, 18 bp, synthetic construct
  source 1..18: mol_type = other DNA
tcatacaattctctatag

SEQ ID NO: 19152 - DNA, 18 bp, synthetic construct
  source 1..18: mol_type = other DNA
tcatacgaatcacaacag

SEQ ID NO: 19153 - DNA, 18 bp, synthetic construct
  source 1..18: mol_type = other DNA
tcatacgacacagtaaag

SEQ ID NO: 19154 - DNA, 18 bp, synthetic construct
  source 1..18: mol_type = other DNA
tcatacgacccacttgag

SEQ ID NO: 19155 - DNA, 18 bp, synthetic construct
  source 1..18: mol_type = other DNA
tcatacgactcacactcg

SEQ ID NO: 19156 - DNA, 18 bp, synthetic construct
  source 1..18: mol_type = other DNA
tcatacgactcacgcaag

SEQ ID NO: 19157 - DNA, 18 bp, synthetic construct
  source 1..18: mol_type = other DNA
tcatacgactcatcgtag

SEQ ID NO: 19158 - DNA, 18 bp, synthetic construct
  source 1..18: mol_type = other DNA
tcatacgactcccttaag

SEQ ID NO: 19159 - DNA, 18 bp, synthetic construct
  source 1..18: mol_type = other DNA
tcatacgactgcctatgg

SEQ ID NO: 19160 - DNA, 18 bp, synthetic construct
  source 1..18: mol_type = other DNA
tcatacggctcacaacag

SEQ ID NO: 19161 - DNA, 18 bp, synthetic construct
  source 1..18: mol_type = other DNA
tcatacgtcccactaaag

SEQ ID NO: 19162 - DNA, 18 bp, synthetic construct
  source 1..18: mol_type = other DNA
tcatacgtctcagtacag

SEQ ID NO: 19163 - DNA, 18 bp, synthetic construct
  source 1..18: mol_type = other DNA
tcatactaatcattatag

SEQ ID NO: 19164 - DNA, 18 bp, synthetic construct
  source 1..18: mol_type = other DNA
tcatactaccgactatag

SEQ ID NO: 19165 - DNA, 18 bp, synthetic construct
  source 1..18: mol_type = other DNA
tcatactactctatatag

SEQ ID NO: 19166 - DNA, 18 bp, synthetic construct
  source 1..18: mol_type = other DNA
tcatatgcctcactctag

SEQ ID NO: 19167 - DNA, 18 bp, synthetic construct
  source 1..18: mol_type = other DNA
tcatccaactcactttag

SEQ ID NO: 19168 - DNA, 18 bp, synthetic construct
  source 1..18: mol_type = other DNA
tcatccgactcattttag

SEQ ID NO: 19169 - DNA, 18 bp, synthetic construct
  source 1..18: mol_type = other DNA
tcatctgacttactatag

SEQ ID NO: 19170 - DNA, 18 bp, synthetic construct
  source 1..18: mol_type = other DNA
tcatgcgattcacaatag

SEQ ID NO: 19171 - DNA, 18 bp, synthetic construct
  source 1..18: mol_type = other DNA
tccaacgactcacaatag

SEQ ID NO: 19172 - DNA, 18 bp, synthetic construct
  source 1..18: mol_type = other DNA
tcctacgacacactgtag

SEQ ID NO: 19173 - DNA, 18 bp, synthetic construct
  source 1..18: mol_type = other DNA
tcctacgacacactttag

SEQ ID NO: 19174 - DNA, 18 bp, synthetic construct
  source 1..18: mol_type = other DNA
tcctacgtctcacaatag

SEQ ID NO: 19175 - DNA, 18 bp, synthetic construct
  source 1..18: mol_type = other DNA
tcctatgcctcactatag

SEQ ID NO: 19176 - DNA, 18 bp, synthetic construct
  source 1..18: mol_type = other DNA
tcgaacgactcactatcg

SEQ ID NO: 19177 - DNA, 18 bp, synthetic construct
  source 1..18: mol_type = other DNA
tcgtacgaatcactctag

SEQ ID NO: 19178 - DNA, 18 bp, synthetic construct
  source 1..18: mol_type = other DNA
tcgtacgactcacaaaag

SEQ ID NO: 19179 - DNA, 18 bp, synthetic construct
  source 1..18: mol_type = other DNA
tcgtactactgactatag

SEQ ID NO: 19180 - DNA, 18 bp, synthetic construct
  source 1..18: mol_type = other DNA
tcgtatgactcacaatag

SEQ ID NO: 19181 - DNA, 18 bp, synthetic construct
  source 1..18: mol_type = other DNA
tctaacgactcactatcg

SEQ ID NO: 19182 - DNA, 18 bp, synthetic construct
  source 1..18: mol_type = other DNA
tcttacgacacactatcg

SEQ ID NO: 19183 - DNA, 18 bp, synthetic construct
  source 1..18: mol_type = other DNA
tcttacgactcaccagag

SEQ ID NO: 19184 - DNA, 18 bp, synthetic construct
  source 1..18: mol_type = other DNA
tcttactactcactacag

SEQ ID NO: 19185 - DNA, 18 bp, synthetic construct
  source 1..18: mol_type = other DNA
tgaaacgacctactatag

SEQ ID NO: 19186 - DNA, 18 bp, synthetic construct
  source 1..18: mol_type = other DNA
tgacacaactcactctag

SEQ ID NO: 19187 - DNA, 18 bp, synthetic construct
  source 1..18: mol_type = other DNA
tgagacgaatctctatag

SEQ ID NO: 19188 - DNA, 18 bp, synthetic construct
  source 1..18: mol_type = other DNA
tgataagactaacaatag

SEQ ID NO: 19189 - DNA, 18 bp, synthetic construct
  source 1..18: mol_type = other DNA
tgataagactcactccag

SEQ ID NO: 19190 - DNA, 18 bp, synthetic construct
  source 1..18: mol_type = other DNA
tgataagactcagtacag

SEQ ID NO: 19191 - DNA, 18 bp, synthetic construct
  source 1..18: mol_type = other DNA
tgatacaacgcactatcg

SEQ ID NO: 19192 - DNA, 18 bp, synthetic construct
  source 1..18: mol_type = other DNA
tgatacacctcaatatag

SEQ ID NO: 19193 - DNA, 18 bp, synthetic construct
  source 1..18: mol_type = other DNA
tgatacgaatcactaagg

SEQ ID NO: 19194 - DNA, 18 bp, synthetic construct
  source 1..18: mol_type = other DNA
tgatacgactcacagtgg

SEQ ID NO: 19195 - DNA, 18 bp, synthetic construct
  source 1..18: mol_type = other DNA
tgatacgactcagcttag

SEQ ID NO: 19196 - DNA, 18 bp, synthetic construct
  source 1..18: mol_type = other DNA
tgatacgactcatttgag

SEQ ID NO: 19197 - DNA, 18 bp, synthetic construct
  source 1..18: mol_type = other DNA
tgatacgactgacattag

SEQ ID NO: 19198 - DNA, 18 bp, synthetic construct
  source 1..18: mol_type = other DNA
tgatacgacttattttag

SEQ ID NO: 19199 - DNA, 18 bp, synthetic construct
  source 1..18: mol_type = other DNA
tgatacgagtcactgaag

SEQ ID NO: 19200 - DNA, 18 bp, synthetic construct
  source 1..18: mol_type = other DNA
tgatacgtctcacactag

SEQ ID NO: 19201 - DNA, 18 bp, synthetic construct
  source 1..18: mol_type = other DNA
tgatactactctctatcg

SEQ ID NO: 19202 - DNA, 18 bp, synthetic construct
  source 1..18: mol_type = other DNA
tgataggactcactttgg

SEQ ID NO: 19203 - DNA, 18 bp, synthetic construct
  source 1..18: mol_type = other DNA
tgatatgacacacaatag

SEQ ID NO: 19204 - DNA, 18 bp, synthetic construct
  source 1..18: mol_type = other DNA
tgatatgcctcagtatag

SEQ ID NO: 19205 - DNA, 18 bp, synthetic construct
  source 1..18: mol_type = other DNA
tgatattactcactataa

SEQ ID NO: 19206 - DNA, 18 bp, synthetic construct
  source 1..18: mol_type = other DNA
tgatctgactctctatag

SEQ ID NO: 19207 - DNA, 18 bp, synthetic construct
  source 1..18: mol_type = other DNA
tgatgcctctcactatag

SEQ ID NO: 19208 - DNA, 18 bp, synthetic construct
  source 1..18: mol_type = other DNA
tgatgcgacacactttag

SEQ ID NO: 19209 - DNA, 18 bp, synthetic construct
  source 1..18: mol_type = other DNA
tgatgcgactaaatatag

SEQ ID NO: 19210 - DNA, 18 bp, synthetic construct
  source 1..18: mol_type = other DNA
tgatgcgcctcactttag

SEQ ID NO: 19211 - DNA, 18 bp, synthetic construct
  source 1..18: mol_type = other DNA
tgccacgactcaatatag

SEQ ID NO: 19212 - DNA, 18 bp, synthetic construct
  source 1..18: mol_type = other DNA
tgctccgtctcactatag

SEQ ID NO: 19213 - DNA, 18 bp, synthetic construct
  source 1..18: mol_type = other DNA
tggtacggcacactatag

SEQ ID NO: 19214 - DNA, 18 bp, synthetic construct
  source 1..18: mol_type = other DNA
tgttacgagtcactctag

SEQ ID NO: 19215 - DNA, 18 bp, synthetic construct
  source 1..18: mol_type = other DNA
tgttatcactcactatag

SEQ ID NO: 19216 - DNA, 18 bp, synthetic construct
  source 1..18: mol_type = other DNA
tgttgcgtctcactatag

SEQ ID NO: 19217 - DNA, 18 bp, synthetic construct
  source 1..18: mol_type = other DNA
ttaaacctctcactatag

SEQ ID NO: 19218 - DNA, 18 bp, synthetic construct
  source 1..18: mol_type = other DNA
ttaaacgactaattatag

SEQ ID NO: 19219 - DNA, 18 bp, synthetic construct
  source 1..18: mol_type = other DNA
ttaaacgactctctacag

SEQ ID NO: 19220 - DNA, 18 bp, synthetic construct
  source 1..18: mol_type = other DNA
ttaaaggactcactatcg

SEQ ID NO: 19221 - DNA, 18 bp, synthetic construct
  source 1..18: mol_type = other DNA
ttacaagactctctatag

SEQ ID NO: 19222 - DNA, 18 bp, synthetic construct
  source 1..18: mol_type = other DNA
ttagacgacttactatcg

SEQ ID NO: 19223 - DNA, 18 bp, synthetic construct
  source 1..18: mol_type = other DNA
ttataagactaacgatag

SEQ ID NO: 19224 - DNA, 18 bp, synthetic construct
  source 1..18: mol_type = other DNA
ttataagactccgtatag

SEQ ID NO: 19225 - DNA, 18 bp, synthetic construct
  source 1..18: mol_type = other DNA
ttataagagtcactgtag

SEQ ID NO: 19226 - DNA, 18 bp, synthetic construct
  source 1..18: mol_type = other DNA
ttatacaactcaccacag

SEQ ID NO: 19227 - DNA, 18 bp, synthetic construct
  source 1..18: mol_type = other DNA
ttatacctctcactctag

SEQ ID NO: 19228 - DNA, 18 bp, synthetic construct
  source 1..18: mol_type = other DNA
ttatacgacacacactag

SEQ ID NO: 19229 - DNA, 18 bp, synthetic construct
  source 1..18: mol_type = other DNA
ttatacgacagagtatag

SEQ ID NO: 19230 - DNA, 18 bp, synthetic construct
  source 1..18: mol_type = other DNA
ttatacgactcacaaggg

SEQ ID NO: 19231 - DNA, 18 bp, synthetic construct
  source 1..18: mol_type = other DNA
ttatacgactcatcagag

SEQ ID NO: 19232 - DNA, 18 bp, synthetic construct
  source 1..18: mol_type = other DNA
ttatacgactctccgtag

SEQ ID NO: 19233 - DNA, 18 bp, synthetic construct
  source 1..18: mol_type = other DNA
ttatacgacttatcatag

SEQ ID NO: 19234 - DNA, 18 bp, synthetic construct
  source 1..18: mol_type = other DNA
ttatacgacttattagag

SEQ ID NO: 19235 - DNA, 18 bp, synthetic construct
  source 1..18: mol_type = other DNA
ttatacgagacactctag

SEQ ID NO: 19236 - DNA, 18 bp, synthetic construct
  source 1..18: mol_type = other DNA
ttatacgagtaactatcg

SEQ ID NO: 19237 - DNA, 18 bp, synthetic construct
  source 1..18: mol_type = other DNA
ttatacgattctccatag

SEQ ID NO: 19238 - DNA, 18 bp, synthetic construct
  source 1..18: mol_type = other DNA
ttatacgcatccctatag

SEQ ID NO: 19239 - DNA, 18 bp, synthetic construct
  source 1..18: mol_type = other DNA
ttatacggcccattatag

SEQ ID NO: 19240 - DNA, 18 bp, synthetic construct
  source 1..18: mol_type = other DNA
ttatacggctcaatacag

SEQ ID NO: 19241 - DNA, 18 bp, synthetic construct
  source 1..18: mol_type = other DNA
ttatacggctcacgatcg

SEQ ID NO: 19242 - DNA, 18 bp, synthetic construct
  source 1..18: mol_type = other DNA
ttatacgtctaactatcg

SEQ ID NO: 19243 - DNA, 18 bp, synthetic construct
  source 1..18: mol_type = other DNA
ttatacgtctcaatatcg

SEQ ID NO: 19244 - DNA, 18 bp, synthetic construct
  source 1..18: mol_type = other DNA
ttatacgtctcagtatcg

SEQ ID NO: 19245 - DNA, 18 bp, synthetic construct
  source 1..18: mol_type = other DNA
ttatacgtgtcactctag

SEQ ID NO: 19246 - DNA, 18 bp, synthetic construct
  source 1..18: mol_type = other DNA
ttatactactcacaatcg

SEQ ID NO: 19247 - DNA, 18 bp, synthetic construct
  source 1..18: mol_type = other DNA
ttatactgctcactttag

SEQ ID NO: 19248 - DNA, 18 bp, synthetic construct
  source 1..18: mol_type = other DNA
ttatagatctcactatag

SEQ ID NO: 19249 - DNA, 18 bp, synthetic construct
  source 1..18: mol_type = other DNA
ttataggacacactagag

SEQ ID NO: 19250 - DNA, 18 bp, synthetic construct
  source 1..18: mol_type = other DNA
ttataggactaactaaag

SEQ ID NO: 19251 - DNA, 18 bp, synthetic construct
  source 1..18: mol_type = other DNA
ttataggactcattttag

SEQ ID NO: 19252 - DNA, 18 bp, synthetic construct
  source 1..18: mol_type = other DNA
ttataggagccactatag

SEQ ID NO: 19253 - DNA, 18 bp, synthetic construct
  source 1..18: mol_type = other DNA
ttatagtactcactatgg

SEQ ID NO: 19254 - DNA, 18 bp, synthetic construct
  source 1..18: mol_type = other DNA
ttatatgactcaatatcg

SEQ ID NO: 19255 - DNA, 18 bp, synthetic construct
  source 1..18: mol_type = other DNA
ttatattactcaatatag

SEQ ID NO: 19256 - DNA, 18 bp, synthetic construct
  source 1..18: mol_type = other DNA
ttatccgacccactacag

SEQ ID NO: 19257 - DNA, 18 bp, synthetic construct
  source 1..18: mol_type = other DNA
ttatccgactcactccag

SEQ ID NO: 19258 - DNA, 18 bp, synthetic construct
  source 1..18: mol_type = other DNA
ttatccgtctcactacag

SEQ ID NO: 19259 - DNA, 18 bp, synthetic construct
  source 1..18: mol_type = other DNA
ttatgcgactaactttag

SEQ ID NO: 19260 - DNA, 18 bp, synthetic construct
  source 1..18: mol_type = other DNA
ttatgcgactcataatag

SEQ ID NO: 19261 - DNA, 18 bp, synthetic construct
  source 1..18: mol_type = other DNA
ttatgcgcctcactatgg

SEQ ID NO: 19262 - DNA, 18 bp, synthetic construct
  source 1..18: mol_type = other DNA
ttatgcgcctcactgtag

SEQ ID NO: 19263 - DNA, 18 bp, synthetic construct
  source 1..18: mol_type = other DNA
ttatgtgcctcactatag

SEQ ID NO: 19264 - DNA, 18 bp, synthetic construct
  source 1..18: mol_type = other DNA
ttccacgactcactacag

SEQ ID NO: 19265 - DNA, 18 bp, synthetic construct
  source 1..18: mol_type = other DNA
ttctaagcctcactatag

SEQ ID NO: 19266 - DNA, 18 bp, synthetic construct
  source 1..18: mol_type = other DNA
ttctacgactacctatag

SEQ ID NO: 19267 - DNA, 18 bp, synthetic construct
  source 1..18: mol_type = other DNA
ttctacgactcacaacag

SEQ ID NO: 19268 - DNA, 18 bp, synthetic construct
  source 1..18: mol_type = other DNA
ttctacgactcaggatag

SEQ ID NO: 19269 - DNA, 18 bp, synthetic construct
  source 1..18: mol_type = other DNA
ttctccgactcattatag

SEQ ID NO: 19270 - DNA, 18 bp, synthetic construct
  source 1..18: mol_type = other DNA
ttctgcgactctctatag

SEQ ID NO: 19271 - DNA, 18 bp, synthetic construct
  source 1..18: mol_type = other DNA
ttgaacgactccctatag

SEQ ID NO: 19272 - DNA, 18 bp, synthetic construct
  source 1..18: mol_type = other DNA
ttgtaagactcactaaag

SEQ ID NO: 19273 - DNA, 18 bp, synthetic construct
  source 1..18: mol_type = other DNA
ttgtaccgctcactatag

SEQ ID NO: 19274 - DNA, 18 bp, synthetic construct
  source 1..18: mol_type = other DNA
ttgtacgtcttactatag

SEQ ID NO: 19275 - DNA, 18 bp, synthetic construct
  source 1..18: mol_type = other DNA
ttttacgactcacaagag

SEQ ID NO: 19276 - DNA, 18 bp, synthetic construct
  source 1..18: mol_type = other DNA
ttttacgagtcactttag

SEQ ID NO: 19277 - DNA, 18 bp, synthetic construct
  source 1..18: mol_type = other DNA
ttttaggacccactatag

SEQ ID NO: 19278 - DNA, 18 bp, synthetic construct
  source 1..18: mol_type = other DNA
ttttaggactcactacag

SEQ ID NO: 19279 - DNA, 18 bp, synthetic construct
  source 1..18: mol_type = other DNA
ttttccgactctctatag

SEQ ID NO: 19280 - DNA, 18 bp, synthetic construct
  source 1..18: mol_type = other DNA
ttattcgtctcactacag

SEQ ID NO: 19281 - DNA, 18 bp, synthetic construct
  source 1..18: mol_type = other DNA
ctattagactcactatag

SEQ ID NO: 19282 - DNA, 18 bp, synthetic construct
  source 1..18: mol_type = other DNA
ttatacgactcattaatg

SEQ ID NO: 19283 - DNA, 18 bp, synthetic construct
  source 1..18: mol_type = other DNA
tgtaacgtctcactatag

SEQ ID NO: 19284 - DNA, 18 bp, synthetic construct
  source 1..18: mol_type = other DNA
caattcaactcactgtag

SEQ ID NO: 19285 - DNA, 18 bp, synthetic construct
  source 1..18: mol_type = other DNA
ttattagactcactttag

SEQ ID NO: 19286 - DNA, 18 bp, synthetic construct
  source 1..18: mol_type = other DNA
tttttcgactcactaaag

SEQ ID NO: 19287 - DNA, 18 bp, synthetic construct
  source 1..18: mol_type = other DNA
taatacgacactatattg

SEQ ID NO: 19288 - DNA, 18 bp, synthetic construct
  source 1..18: mol_type = other DNA
ctataagactcacaatag

SEQ ID NO: 19289 - DNA, 18 bp, synthetic construct
  source 1..18: mol_type = other DNA
tactacgactcacataag

SEQ ID NO: 19290 - DNA, 18 bp, synthetic construct
  source 1..18: mol_type = other DNA
tgttacgactaactaaag

SEQ ID NO: 19291 - DNA, 18 bp, synthetic construct
  source 1..18: mol_type = other DNA
ttgtacgattctctatag

SEQ ID NO: 19292 - DNA, 18 bp, synthetic construct
  source 1..18: mol_type = other DNA
ttgtactactcactaaag

SEQ ID NO: 19293 - DNA, 18 bp, synthetic construct
  source 1..18: mol_type = other DNA
atttacgactcactacag

SEQ ID NO: 19294 - DNA, 18 bp, synthetic construct
  source 1..18: mol_type = other DNA
tttaacgactcactttag

SEQ ID NO: 19295 - DNA, 18 bp, synthetic construct
  source 1..18: mol_type = other DNA
taattagactcactactg

SEQ ID NO: 19296 - DNA, 18 bp, synthetic construct
  source 1..18: mol_type = other DNA
taaaatgactcgctttag

SEQ ID NO: 19297 - DNA, 18 bp, synthetic construct
  source 1..18: mol_type = other DNA
taatacgactcgcttacg

SEQ ID NO: 19298 - DNA, 18 bp, synthetic construct
  source 1..18: mol_type = other DNA
taatacggctctctaatg

SEQ ID NO: 19299 - DNA, 18 bp, synthetic construct
  source 1..18: mol_type = other DNA
tcatacgaataactattg

SEQ ID NO: 19300 - DNA, 18 bp, synthetic construct
  source 1..18: mol_type = other DNA
tcatacggctctctattg

SEQ ID NO: 19301 - DNA, 18 bp, synthetic construct
  source 1..18: mol_type = other DNA
cattacgactcaatttag

SEQ ID NO: 19302 - DNA, 18 bp, synthetic construct
  source 1..18: mol_type = other DNA
taaaacgaaacagtatag

SEQ ID NO: 19303 - DNA, 18 bp, synthetic construct
  source 1..18: mol_type = other DNA
taaaacgtctcactacgg

SEQ ID NO: 19304 - DNA, 18 bp, synthetic construct
  source 1..18: mol_type = other DNA
taaaaggactcacagtag

SEQ ID NO: 19305 - DNA, 18 bp, synthetic construct
  source 1..18: mol_type = other DNA
taataagattcactttcg

SEQ ID NO: 19306 - DNA, 18 bp, synthetic construct
  source 1..18: mol_type = other DNA
taatactacaccatatag

SEQ ID NO: 19307 - DNA, 18 bp, synthetic construct
  source 1..18: mol_type = other DNA
taatatgtatcactaaag

SEQ ID NO: 19308 - DNA, 18 bp, synthetic construct
  source 1..18: mol_type = other DNA
taatcagtcacactatag

SEQ ID NO: 19309 - DNA, 18 bp, synthetic construct
  source 1..18: mol_type = other DNA
tattacgactcacggaag

SEQ ID NO: 19310 - DNA, 18 bp, synthetic construct
  source 1..18: mol_type = other DNA
tattacgactctctaagg

SEQ ID NO: 19311 - DNA, 18 bp, synthetic construct
  source 1..18: mol_type = other DNA
tattacggattactatag

SEQ ID NO: 19312 - DNA, 18 bp, synthetic construct
  source 1..18: mol_type = other DNA
tattcctacttactatag

SEQ ID NO: 19313 - DNA, 18 bp, synthetic construct
  source 1..18: mol_type = other DNA
tgttacgtctcactaaag

SEQ ID NO: 19314 - DNA, 18 bp, synthetic construct
  source 1..18: mol_type = other DNA
ttatcctactctctatag

SEQ ID NO: 19315 - DNA, 18 bp, synthetic construct
  source 1..18: mol_type = other DNA
ttgtactactcacaatag

SEQ ID NO: 19316 - DNA, 18 bp, synthetic construct
  source 1..18: mol_type = other DNA
ttttacgtatcactatag

SEQ ID NO: 19317 - DNA, 18 bp, synthetic construct
  source 1..18: mol_type = other DNA
atatacgactcacagtag

SEQ ID NO: 19318 - DNA, 18 bp, synthetic construct
  source 1..18: mol_type = other DNA
ttttacgactcactaatg

SEQ ID NO: 19319 - DNA, 18 bp, synthetic construct
  source 1..18: mol_type = other DNA
ttttacaactcactttag

SEQ ID NO: 19320 - DNA, 18 bp, synthetic construct
  source 1..18: mol_type = other DNA
ttattcgcctcactacag

SEQ ID NO: 19321 - DNA, 18 bp, synthetic construct
  source 1..18: mol_type = other DNA
taaaacgactcacctttg

SEQ ID NO: 19322 - DNA, 18 bp, synthetic construct
  source 1..18: mol_type = other DNA
tattacaactcactaatg

SEQ ID NO: 19323 - DNA, 18 bp, synthetic construct
  source 1..18: mol_type = other DNA
tattacgtctcacttaag

SEQ ID NO: 19324 - DNA, 18 bp, synthetic construct
  source 1..18: mol_type = other DNA
taatataactcgctattg

SEQ ID NO: 19325 - DNA, 18 bp, synthetic construct
  source 1..18: mol_type = other DNA
taattcgacccaccattg

SEQ ID NO: 19326 - DNA, 18 bp, synthetic construct
  source 1..18: mol_type = other DNA
taattcgattcagtattg

SEQ ID NO: 19327 - DNA, 18 bp, synthetic construct
  source 1..18: mol_type = other DNA
aaatacgaatcgccatag

SEQ ID NO: 19328 - DNA, 18 bp, synthetic construct
  source 1..18: mol_type = other DNA
aaataggactcactaatg

SEQ ID NO: 19329 - DNA, 18 bp, synthetic construct
  source 1..18: mol_type = other DNA
aaattcgtcccactatag

SEQ ID NO: 19330 - DNA, 18 bp, synthetic construct
  source 1..18: mol_type = other DNA
aaatttgactcattatag

SEQ ID NO: 19331 - DNA, 18 bp, synthetic construct
  source 1..18: mol_type = other DNA
atatacgactcacgattg

SEQ ID NO: 19332 - DNA, 18 bp, synthetic construct
  source 1..18: mol_type = other DNA
caactcgacgcactatag

SEQ ID NO: 19333 - DNA, 18 bp, synthetic construct
  source 1..18: mol_type = other DNA
cattacaactcactattg

SEQ ID NO: 19334 - DNA, 18 bp, synthetic construct
  source 1..18: mol_type = other DNA
cattatgactcactattg

SEQ ID NO: 19335 - DNA, 18 bp, synthetic construct
  source 1..18: mol_type = other DNA
ccatttgactcactatag

SEQ ID NO: 19336 - DNA, 18 bp, synthetic construct
  source 1..18: mol_type = other DNA
gaatacgacttactcttg

SEQ ID NO: 19337 - DNA, 18 bp, synthetic construct
  source 1..18: mol_type = other DNA
taaaacaactcgctctag

SEQ ID NO: 19338 - DNA, 18 bp, synthetic construct
  source 1..18: mol_type = other DNA
taaatcaactcactctag

SEQ ID NO: 19339 - DNA, 18 bp, synthetic construct
  source 1..18: mol_type = other DNA
taaatcgcgtcactatag

SEQ ID NO: 19340 - DNA, 18 bp, synthetic construct
  source 1..18: mol_type = other DNA
taataagactcacacttg

SEQ ID NO: 19341 - DNA, 18 bp, synthetic construct
  source 1..18: mol_type = other DNA
taatacacttcactattg

SEQ ID NO: 19342 - DNA, 18 bp, synthetic construct
  source 1..18: mol_type = other DNA
taatacctttcactattg

SEQ ID NO: 19343 - DNA, 18 bp, synthetic construct
  source 1..18: mol_type = other DNA
taatacgacacaccgttg

SEQ ID NO: 19344 - DNA, 18 bp, synthetic construct
  source 1..18: mol_type = other DNA
taatacgactttctgttg

SEQ ID NO: 19345 - DNA, 18 bp, synthetic construct
  source 1..18: mol_type = other DNA
taatacgtctcacccttg

SEQ ID NO: 19346 - DNA, 18 bp, synthetic construct
  source 1..18: mol_type = other DNA
taatacgtctcgccaaag

SEQ ID NO: 19347 - DNA, 18 bp, synthetic construct
  source 1..18: mol_type = other DNA
taatatgactcacatttg

SEQ ID NO: 19348 - DNA, 18 bp, synthetic construct
  source 1..18: mol_type = other DNA
taatccgactcactgatg

SEQ ID NO: 19349 - DNA, 18 bp, synthetic construct
  source 1..18: mol_type = other DNA
taattagacacactatgg

SEQ ID NO: 19350 - DNA, 18 bp, synthetic construct
  source 1..18: mol_type = other DNA
taattctacttactgtag

SEQ ID NO: 19351 - DNA, 18 bp, synthetic construct
  source 1..18: mol_type = other DNA
tacttcgactcaatacag

SEQ ID NO: 19352 - DNA, 18 bp, synthetic construct
  source 1..18: mol_type = other DNA
tactttgacacactatag

SEQ ID NO: 19353 - DNA, 18 bp, synthetic construct
  source 1..18: mol_type = other DNA
tatatcgactccctatag

SEQ ID NO: 19354 - DNA, 18 bp, synthetic construct
  source 1..18: mol_type = other DNA
tatgtcgtctcactatag

SEQ ID NO: 19355 - DNA, 18 bp, synthetic construct
  source 1..18: mol_type = other DNA
tattacgacgcacgattg

SEQ ID NO: 19356 - DNA, 18 bp, synthetic construct
  source 1..18: mol_type = other DNA
tcatacaactcacaattg

SEQ ID NO: 19357 - DNA, 18 bp, synthetic construct
  source 1..18: mol_type = other DNA
tgattctacccactatag

SEQ ID NO: 19358 - DNA, 18 bp, synthetic construct
  source 1..18: mol_type = other DNA
ttacacgactcactactg

SEQ ID NO: 19359 - DNA, 18 bp, synthetic construct
  source 1..18: mol_type = other DNA
ttatactagtcactattg

SEQ ID NO: 19360 - DNA, 18 bp, synthetic construct
  source 1..18: mol_type = other DNA
ttattcgactcacaagag

SEQ ID NO: 19361 - DNA, 18 bp, synthetic construct
  source 1..18: mol_type = other DNA
aaataagagtcacaatag

SEQ ID NO: 19362 - DNA, 18 bp, synthetic construct
  source 1..18: mol_type = other DNA
aaataccacacactagag

SEQ ID NO: 19363 - DNA, 18 bp, synthetic construct
  source 1..18: mol_type = other DNA
aaataccacccagtatag

SEQ ID NO: 19364 - DNA, 18 bp, synthetic construct
  source 1..18: mol_type = other DNA
aaatattaatcactatag

SEQ ID NO: 19365 - DNA, 18 bp, synthetic construct
  source 1..18: mol_type = other DNA
aattccgactctctatag

SEQ ID NO: 19366 - DNA, 18 bp, synthetic construct
  source 1..18: mol_type = other DNA
agatgcgactcattatag

SEQ ID NO: 19367 - DNA, 18 bp, synthetic construct
  source 1..18: mol_type = other DNA
caatacgattcagtaaag

SEQ ID NO: 19368 - DNA, 18 bp, synthetic construct
  source 1..18: mol_type = other DNA
caatacgtcccactgtag

SEQ ID NO: 19369 - DNA, 18 bp, synthetic construct
  source 1..18: mol_type = other DNA
caatctgactcactttag

SEQ ID NO: 19370 - DNA, 18 bp, synthetic construct
  source 1..18: mol_type = other DNA
caatgcaactaactatag

SEQ ID NO: 19371 - DNA, 18 bp, synthetic construct
  source 1..18: mol_type = other DNA
caatgcgattcactagag

SEQ ID NO: 19372 - DNA, 18 bp, synthetic construct
  source 1..18: mol_type = other DNA
gaatacgattcactaacg

SEQ ID NO: 19373 - DNA, 18 bp, synthetic construct
  source 1..18: mol_type = other DNA
gtttacgactcactaaag

SEQ ID NO: 19374 - DNA, 18 bp, synthetic construct
  source 1..18: mol_type = other DNA
taaaaaaactcactgtag

SEQ ID NO: 19375 - DNA, 18 bp, synthetic construct
  source 1..18: mol_type = other DNA
taaaacgactcagtgtcg

SEQ ID NO: 19376 - DNA, 18 bp, synthetic construct
  source 1..18: mol_type = other DNA
taaaacgactccctttaa

SEQ ID NO: 19377 - DNA, 18 bp, synthetic construct
  source 1..18: mol_type = other DNA
taacatgacacactatcg

SEQ ID NO: 19378 - DNA, 18 bp, synthetic construct
  source 1..18: mol_type = other DNA
taacatgactaaccatag

SEQ ID NO: 19379 - DNA, 18 bp, synthetic construct
  source 1..18: mol_type = other DNA
taataagtctcactcaag

SEQ ID NO: 19380 - DNA, 18 bp, synthetic construct
  source 1..18: mol_type = other DNA
taataatgctctctatag

SEQ ID NO: 19381 - DNA, 18 bp, synthetic construct
  source 1..18: mol_type = other DNA
taatacaactcccaaaag

SEQ ID NO: 19382 - DNA, 18 bp, synthetic construct
  source 1..18: mol_type = other DNA
taatacaactctttctag

SEQ ID NO: 19383 - DNA, 18 bp, synthetic construct
  source 1..18: mol_type = other DNA
taatacaagttactagag

SEQ ID NO: 19384 - DNA, 18 bp, synthetic construct
  source 1..18: mol_type = other DNA
taatacaatacactttag

SEQ ID NO: 19385 - DNA, 18 bp, synthetic construct
  source 1..18: mol_type = other DNA
taatacgacaatctatcg

SEQ ID NO: 19386 - DNA, 18 bp, synthetic construct
  source 1..18: mol_type = other DNA
taatacgactcaggctcg

SEQ ID NO: 19387 - DNA, 18 bp, synthetic construct
  source 1..18: mol_type = other DNA
taatacgacttatcagag

SEQ ID NO: 19388 - DNA, 18 bp, synthetic construct
  source 1..18: mol_type = other DNA
taatacgatacacgaaag

SEQ ID NO: 19389 - DNA, 18 bp, synthetic construct
  source 1..18: mol_type = other DNA
taatacgcttaattatag

SEQ ID NO: 19390 - DNA, 18 bp, synthetic construct
  source 1..18: mol_type = other DNA
taatacttctgaatatag

SEQ ID NO: 19391 - DNA, 18 bp, synthetic construct
  source 1..18: mol_type = other DNA
taatattactcaataaag

SEQ ID NO: 19392 - DNA, 18 bp, synthetic construct
  source 1..18: mol_type = other DNA
taatattagtctctatag

SEQ ID NO: 19393 - DNA, 18 bp, synthetic construct
  source 1..18: mol_type = other DNA
taatcagtctcactgtag

SEQ ID NO: 19394 - DNA, 18 bp, synthetic construct
  source 1..18: mol_type = other DNA
taatccgactctttttag

SEQ ID NO: 19395 - DNA, 18 bp, synthetic construct
  source 1..18: mol_type = other DNA
taatccgatacactgtag

SEQ ID NO: 19396 - DNA, 18 bp, synthetic construct
  source 1..18: mol_type = other DNA
taatcctaatcactatcg

SEQ ID NO: 19397 - DNA, 18 bp, synthetic construct
  source 1..18: mol_type = other DNA
taatgccacactctatag

SEQ ID NO: 19398 - DNA, 18 bp, synthetic construct
  source 1..18: mol_type = other DNA
taatgcgactccttatcg

SEQ ID NO: 19399 - DNA, 18 bp, synthetic construct
  source 1..18: mol_type = other DNA
tagtatcactcactagag

SEQ ID NO: 19400 - DNA, 18 bp, synthetic construct
  source 1..18: mol_type = other DNA
tataaagattcactatag

SEQ ID NO: 19401 - DNA, 18 bp, synthetic construct
  source 1..18: mol_type = other DNA
tataacaactcactttag

SEQ ID NO: 19402 - DNA, 18 bp, synthetic construct
  source 1..18: mol_type = other DNA
tataacgactaactaaag

SEQ ID NO: 19403 - DNA, 18 bp, synthetic construct
  source 1..18: mol_type = other DNA
tatcaagactcacaatag

SEQ ID NO: 19404 - DNA, 18 bp, synthetic construct
  source 1..18: mol_type = other DNA
tatcacgactcccaatag

SEQ ID NO: 19405 - DNA, 18 bp, synthetic construct
  source 1..18: mol_type = other DNA
tatcacgacttaccatag

SEQ ID NO: 19406 - DNA, 18 bp, synthetic construct
  source 1..18: mol_type = other DNA
tattacacctcactatcg

SEQ ID NO: 19407 - DNA, 18 bp, synthetic construct
  source 1..18: mol_type = other DNA
tattacgacacactctcg

SEQ ID NO: 19408 - DNA, 18 bp, synthetic construct
  source 1..18: mol_type = other DNA
tattattacttactatag

SEQ ID NO: 19409 - DNA, 18 bp, synthetic construct
  source 1..18: mol_type = other DNA
tattcagactcactaaag

SEQ ID NO: 19410 - DNA, 18 bp, synthetic construct
  source 1..18: mol_type = other DNA
tattccgtctcactaaag

SEQ ID NO: 19411 - DNA, 18 bp, synthetic construct
  source 1..18: mol_type = other DNA
tattgcgacacactgtag

SEQ ID NO: 19412 - DNA, 18 bp, synthetic construct
  source 1..18: mol_type = other DNA
tcatacttcttactatag

SEQ ID NO: 19413 - DNA, 18 bp, synthetic construct
  source 1..18: mol_type = other DNA
tcataggactcaccacag

SEQ ID NO: 19414 - DNA, 18 bp, synthetic construct
  source 1..18: mol_type = other DNA
tgtcacgactcattatag

SEQ ID NO: 19415 - DNA, 18 bp, synthetic construct
  source 1..18: mol_type = other DNA
tgttacgattcacaatag

SEQ ID NO: 19416 - DNA, 18 bp, synthetic construct
  source 1..18: mol_type = other DNA
ttataccactaactttag

SEQ ID NO: 19417 - DNA, 18 bp, synthetic construct
  source 1..18: mol_type = other DNA
ttataccactcactagcg

SEQ ID NO: 19418 - DNA, 18 bp, synthetic construct
  source 1..18: mol_type = other DNA
ttataccagtctctatag

SEQ ID NO: 19419 - DNA, 18 bp, synthetic construct
  source 1..18: mol_type = other DNA
ttatacgacacagcatag

SEQ ID NO: 19420 - DNA, 18 bp, synthetic construct
  source 1..18: mol_type = other DNA
ttatacgactaacaaaag

SEQ ID NO: 19421 - DNA, 18 bp, synthetic construct
  source 1..18: mol_type = other DNA
ttatagaactcactaaag

SEQ ID NO: 19422 - DNA, 18 bp, synthetic construct
  source 1..18: mol_type = other DNA
ttatccatctcactatag

SEQ ID NO: 19423 - DNA, 18 bp, synthetic construct
  source 1..18: mol_type = other DNA
ttatccgcctcactagag

SEQ ID NO: 19424 - DNA, 18 bp, synthetic construct
  source 1..18: mol_type = other DNA
ttctacgattcacaatag

SEQ ID NO: 19425 - DNA, 18 bp, synthetic construct
  source 1..18: mol_type = other DNA
ttgtaagcctcactatag

SEQ ID NO: 19426 - DNA, 18 bp, synthetic construct
  source 1..18: mol_type = other DNA
ttgtacgacttcctatag

SEQ ID NO: 19427 - DNA, 18 bp, synthetic construct
  source 1..18: mol_type = other DNA
ttttacgaccaactatag

SEQ ID NO: 19428 - DNA, 18 bp, synthetic construct
  source 1..18: mol_type = other DNA
ttttactactcactttag

SEQ ID NO: 19429 - DNA, 18 bp, synthetic construct
  source 1..18: mol_type = other DNA
aaattcgactctctgtag

SEQ ID NO: 19430 - DNA, 18 bp, synthetic construct
  source 1..18: mol_type = other DNA
aagttcgactcacaatag

SEQ ID NO: 19431 - DNA, 18 bp, synthetic construct
  source 1..18: mol_type = other DNA
taaatcgactaactacag

SEQ ID NO: 19432 - DNA, 18 bp, synthetic construct
  source 1..18: mol_type = other DNA
taatacaattcgctatcg

SEQ ID NO: 19433 - DNA, 18 bp, synthetic construct
  source 1..18: mol_type = other DNA
taattcgtctcaccatcg

SEQ ID NO: 19434 - DNA, 18 bp, synthetic construct
  source 1..18: mol_type = other DNA
tatttagactcactgtag

SEQ ID NO: 19435 - DNA, 18 bp, synthetic construct
  source 1..18: mol_type = other DNA
tgaagcgactcactattg

SEQ ID NO: 19436 - DNA, 18 bp, synthetic construct
  source 1..18: mol_type = other DNA
ttatacgactctctcttg

SEQ ID NO: 19437 - DNA, 18 bp, synthetic construct
  source 1..18: mol_type = other DNA
ttatactacgcactattg

SEQ ID NO: 19438 - DNA, 18 bp, synthetic construct
  source 1..18: mol_type = other DNA
aaatacaactgactttag

SEQ ID NO: 19439 - DNA, 18 bp, synthetic construct
  source 1..18: mol_type = other DNA
aattacgaattactatag

SEQ ID NO: 19440 - DNA, 18 bp, synthetic construct
  source 1..18: mol_type = other DNA
acatacgaatcactttag

SEQ ID NO: 19441 - DNA, 18 bp, synthetic construct
  source 1..18: mol_type = other DNA
caatccgtctcactttag

SEQ ID NO: 19442 - DNA, 18 bp, synthetic construct
  source 1..18: mol_type = other DNA
taaaagaactcactaaag

SEQ ID NO: 19443 - DNA, 18 bp, synthetic construct
  source 1..18: mol_type = other DNA
taacacgactgacattag

SEQ ID NO: 19444 - DNA, 18 bp, synthetic construct
  source 1..18: mol_type = other DNA
taacacgatacacgatag

SEQ ID NO: 19445 - DNA, 18 bp, synthetic construct
  source 1..18: mol_type = other DNA
taacacgattcattttag

SEQ ID NO: 19446 - DNA, 18 bp, synthetic construct
  source 1..18: mol_type = other DNA
taatacgaccctcgaaag

SEQ ID NO: 19447 - DNA, 18 bp, synthetic construct
  source 1..18: mol_type = other DNA
tattacctctcaatatag

SEQ ID NO: 19448 - DNA, 18 bp, synthetic construct
  source 1..18: mol_type = other DNA
tattacgcatcactacag

SEQ ID NO: 19449 - DNA, 18 bp, synthetic construct
  source 1..18: mol_type = other DNA
tggtacgaatcactttag

SEQ ID NO: 19450 - DNA, 18 bp, synthetic construct
  source 1..18: mol_type = other DNA
ttaaatgactcaccatag

SEQ ID NO: 19451 - DNA, 18 bp, synthetic construct
  source 1..18: mol_type = other DNA
ttataccacttactatcg

SEQ ID NO: 19452 - DNA, 18 bp, synthetic construct
  source 1..18: mol_type = other DNA
ttatacgtcttaatatag

SEQ ID NO: 19453 - DNA, 18 bp, synthetic construct
  source 1..18: mol_type = other DNA
ttgaacgactcacaatag

SEQ ID NO: 19454 - DNA, 18 bp, synthetic construct
  source 1..18: mol_type = other DNA
aaaatcgactcacaatag

SEQ ID NO: 19455 - DNA, 18 bp, synthetic construct
  source 1..18: mol_type = other DNA
taattcgattccctatgg

SEQ ID NO: 19456 - DNA, 18 bp, synthetic construct
  source 1..18: mol_type = other DNA
tattaaaactcgctatag

SEQ ID NO: 19457 - DNA, 18 bp, synthetic construct
  source 1..18: mol_type = other DNA
atatacgattccctatag

SEQ ID NO: 19458 - DNA, 18 bp, synthetic construct
  source 1..18: mol_type = other DNA
taaaacgaatctctttag

SEQ ID NO: 19459 - DNA, 18 bp, synthetic construct
  source 1..18: mol_type = other DNA
ttttacaacacactatag

SEQ ID NO: 19460 - DNA, 18 bp, synthetic construct
  source 1..18: mol_type = other DNA
ttattcgactcacttttg

SEQ ID NO: 19461 - DNA, 18 bp, synthetic construct
  source 1..18: mol_type = other DNA
taattcgtctcaccaaag

SEQ ID NO: 19462 - DNA, 18 bp, synthetic construct
  source 1..18: mol_type = other DNA
taaatcgtctcgctatag

SEQ ID NO: 19463 - DNA, 18 bp, synthetic construct
  source 1..18: mol_type = other DNA
taatacgacgcgctactg

SEQ ID NO: 19464 - DNA, 18 bp, synthetic construct
  source 1..18: mol_type = other DNA
taatacgactagcttttg

SEQ ID NO: 19465 - DNA, 18 bp, synthetic construct
  source 1..18: mol_type = other DNA
taatactactagctattg

SEQ ID NO: 19466 - DNA, 18 bp, synthetic construct
  source 1..18: mol_type = other DNA
taattcgactcaataatg

SEQ ID NO: 19467 - DNA, 18 bp, synthetic construct
  source 1..18: mol_type = other DNA
taattcgactcactgctg

SEQ ID NO: 19468 - DNA, 18 bp, synthetic construct
  source 1..18: mol_type = other DNA
taattcgactcggtttag

SEQ ID NO: 19469 - DNA, 18 bp, synthetic construct
  source 1..18: mol_type = other DNA
taattcgactctctactg

SEQ ID NO: 19470 - DNA, 18 bp, synthetic construct
  source 1..18: mol_type = other DNA
taattcggcgcactattg

SEQ ID NO: 19471 - DNA, 18 bp, synthetic construct
  source 1..18: mol_type = other DNA
taattctacccactattg

SEQ ID NO: 19472 - DNA, 18 bp, synthetic construct
  source 1..18: mol_type = other DNA
taatttgactcgcaatag

SEQ ID NO: 19473 - DNA, 18 bp, synthetic construct
  source 1..18: mol_type = other DNA
tagtacaactcgctattg

SEQ ID NO: 19474 - DNA, 18 bp, synthetic construct
  source 1..18: mol_type = other DNA
tattacgactcgctatta

SEQ ID NO: 19475 - DNA, 18 bp, synthetic construct
  source 1..18: mol_type = other DNA
tatttagactcgctatag

SEQ ID NO: 19476 - DNA, 18 bp, synthetic construct
  source 1..18: mol_type = other DNA
tatttcgactcacgattg

SEQ ID NO: 19477 - DNA, 18 bp, synthetic construct
  source 1..18: mol_type = other DNA
aaacacgactcaatattg

SEQ ID NO: 19478 - DNA, 18 bp, synthetic construct
  source 1..18: mol_type = other DNA
aaacacgactcgctttag

SEQ ID NO: 19479 - DNA, 18 bp, synthetic construct
  source 1..18: mol_type = other DNA
aaagtcgactcaccatag

SEQ ID NO: 19480 - DNA, 18 bp, synthetic construct
  source 1..18: mol_type = other DNA
aaatacgacacactcttg

SEQ ID NO: 19481 - DNA, 18 bp, synthetic construct
  source 1..18: mol_type = other DNA
aaatacgacccgcaatag

SEQ ID NO: 19482 - DNA, 18 bp, synthetic construct
  source 1..18: mol_type = other DNA
aaatacgactcgataaag

SEQ ID NO: 19483 - DNA, 18 bp, synthetic construct
  source 1..18: mol_type = other DNA
aaatacgactcgccctag

SEQ ID NO: 19484 - DNA, 18 bp, synthetic construct
  source 1..18: mol_type = other DNA
aaatgcgaatcactattg

SEQ ID NO: 19485 - DNA, 18 bp, synthetic construct
  source 1..18: mol_type = other DNA
aaattagactcactagag

SEQ ID NO: 19486 - DNA, 18 bp, synthetic construct
  source 1..18: mol_type = other DNA
aactacgactcacttttg

SEQ ID NO: 19487 - DNA, 18 bp, synthetic construct
  source 1..18: mol_type = other DNA
aacttcgacttactatag

SEQ ID NO: 19488 - DNA, 18 bp, synthetic construct
  source 1..18: mol_type = other DNA
aagtacgcctcactattg

SEQ ID NO: 19489 - DNA, 18 bp, synthetic construct
  source 1..18: mol_type = other DNA
aattacgacgcgctatag

SEQ ID NO: 19490 - DNA, 18 bp, synthetic construct
  source 1..18: mol_type = other DNA
aattacgactcgctttag

SEQ ID NO: 19491 - DNA, 18 bp, synthetic construct
  source 1..18: mol_type = other DNA
acagacgactcactattg

SEQ ID NO: 19492 - DNA, 18 bp, synthetic construct
  source 1..18: mol_type = other DNA
acatacgcctcgctatag

SEQ ID NO: 19493 - DNA, 18 bp, synthetic construct
  source 1..18: mol_type = other DNA
atatacgactcgccatag

SEQ ID NO: 19494 - DNA, 18 bp, synthetic construct
  source 1..18: mol_type = other DNA
atatccgactcactattg

SEQ ID NO: 19495 - DNA, 18 bp, synthetic construct
  source 1..18: mol_type = other DNA
caaatcgactcactatgg

SEQ ID NO: 19496 - DNA, 18 bp, synthetic construct
  source 1..18: mol_type = other DNA
caagacgacttactattg

SEQ ID NO: 19497 - DNA, 18 bp, synthetic construct
  source 1..18: mol_type = other DNA
caatacgactctccattg

SEQ ID NO: 19498 - DNA, 18 bp, synthetic construct
  source 1..18: mol_type = other DNA
caatagaactcactattg

SEQ ID NO: 19499 - DNA, 18 bp, synthetic construct
  source 1..18: mol_type = other DNA
caatctgactcactattg

SEQ ID NO: 19500 - DNA, 18 bp, synthetic construct
  source 1..18: mol_type = other DNA
caattcgactctctatgg

SEQ ID NO: 19501 - DNA, 18 bp, synthetic construct
  source 1..18: mol_type = other DNA
caattcgacttaccatag

SEQ ID NO: 19502 - DNA, 18 bp, synthetic construct
  source 1..18: mol_type = other DNA
caattctactcaccatag

SEQ ID NO: 19503 - DNA, 18 bp, synthetic construct
  source 1..18: mol_type = other DNA
cacttccactcactatag

SEQ ID NO: 19504 - DNA, 18 bp, synthetic construct
  source 1..18: mol_type = other DNA
ccaaacgactcactattg

SEQ ID NO: 19505 - DNA, 18 bp, synthetic construct
  source 1..18: mol_type = other DNA
ccatactactcactattg

SEQ ID NO: 19506 - DNA, 18 bp, synthetic construct
  source 1..18: mol_type = other DNA
ccattcgactcacaatag

SEQ ID NO: 19507 - DNA, 18 bp, synthetic construct
  source 1..18: mol_type = other DNA
cctttcgactcactatag

SEQ ID NO: 19508 - DNA, 18 bp, synthetic construct
  source 1..18: mol_type = other DNA
gaatacaactctctattg

SEQ ID NO: 19509 - DNA, 18 bp, synthetic construct
  source 1..18: mol_type = other DNA
gaatacgactcagtaatg

SEQ ID NO: 19510 - DNA, 18 bp, synthetic construct
  source 1..18: mol_type = other DNA
gaatacgtctcacttttg

SEQ ID NO: 19511 - DNA, 18 bp, synthetic construct
  source 1..18: mol_type = other DNA
gaatacgtctgactattg

SEQ ID NO: 19512 - DNA, 18 bp, synthetic construct
  source 1..18: mol_type = other DNA
gaattcgactcacaatcg

SEQ ID NO: 19513 - DNA, 18 bp, synthetic construct
  source 1..18: mol_type = other DNA
gaattcgagtcactttag

SEQ ID NO: 19514 - DNA, 18 bp, synthetic construct
  source 1..18: mol_type = other DNA
ggatacaactcactattg

SEQ ID NO: 19515 - DNA, 18 bp, synthetic construct
  source 1..18: mol_type = other DNA
gtattcgactcaccatag

SEQ ID NO: 19516 - DNA, 18 bp, synthetic construct
  source 1..18: mol_type = other DNA
taaaaccactcagtattg

SEQ ID NO: 19517 - DNA, 18 bp, synthetic construct
  source 1..18: mol_type = other DNA
taaaaccactcattattg

SEQ ID NO: 19518 - DNA, 18 bp, synthetic construct
  source 1..18: mol_type = other DNA
taaaacgaatcgctatcg

SEQ ID NO: 19519 - DNA, 18 bp, synthetic construct
  source 1..18: mol_type = other DNA
taaatcgaatcactacag

SEQ ID NO: 19520 - DNA, 18 bp, synthetic construct
  source 1..18: mol_type = other DNA
taaatcgcctctctatag

SEQ ID NO: 19521 - DNA, 18 bp, synthetic construct
  source 1..18: mol_type = other DNA
taaatgtactcactatag

SEQ ID NO: 19522 - DNA, 18 bp, synthetic construct
  source 1..18: mol_type = other DNA
taacaagactcgcaatag

SEQ ID NO: 19523 - DNA, 18 bp, synthetic construct
  source 1..18: mol_type = other DNA
taacacgactcacttatg

SEQ ID NO: 19524 - DNA, 18 bp, synthetic construct
  source 1..18: mol_type = other DNA
taacactactcgcaatag

SEQ ID NO: 19525 - DNA, 18 bp, synthetic construct
  source 1..18: mol_type = other DNA
taactagactcaccatag

SEQ ID NO: 19526 - DNA, 18 bp, synthetic construct
  source 1..18: mol_type = other DNA
taactccacccactatag

SEQ ID NO: 19527 - DNA, 18 bp, synthetic construct
  source 1..18: mol_type = other DNA
taactcgactcaatatgg

SEQ ID NO: 19528 - DNA, 18 bp, synthetic construct
  source 1..18: mol_type = other DNA
taactcgactgacaatag

SEQ ID NO: 19529 - DNA, 18 bp, synthetic construct
  source 1..18: mol_type = other DNA
taacttgactcactatcg

SEQ ID NO: 19530 - DNA, 18 bp, synthetic construct
  source 1..18: mol_type = other DNA
taagacgactcgttttag

SEQ ID NO: 19531 - DNA, 18 bp, synthetic construct
  source 1..18: mol_type = other DNA
taagactcctcactattg

SEQ ID NO: 19532 - DNA, 18 bp, synthetic construct
  source 1..18: mol_type = other DNA
taataagagtcactaatg

SEQ ID NO: 19533 - DNA, 18 bp, synthetic construct
  source 1..18: mol_type = other DNA
taataagattcactactg

SEQ ID NO: 19534 - DNA, 18 bp, synthetic construct
  source 1..18: mol_type = other DNA
taataagcctaactattg

SEQ ID NO: 19535 - DNA, 18 bp, synthetic construct
  source 1..18: mol_type = other DNA
taataaggctagctatag

SEQ ID NO: 19536 - DNA, 18 bp, synthetic construct
  source 1..18: mol_type = other DNA
taatacaacacgctttag

SEQ ID NO: 19537 - DNA, 18 bp, synthetic construct
  source 1..18: mol_type = other DNA
taatacaactccatattg

SEQ ID NO: 19538 - DNA, 18 bp, synthetic construct
  source 1..18: mol_type = other DNA
taatacaactctctgttg

SEQ ID NO: 19539 - DNA, 18 bp, synthetic construct
  source 1..18: mol_type = other DNA
taataccacggactattg

SEQ ID NO: 19540 - DNA, 18 bp, synthetic construct
  source 1..18: mol_type = other DNA
taataccactcccttttg

SEQ ID NO: 19541 - DNA, 18 bp, synthetic construct
  source 1..18: mol_type = other DNA
taataccactttctattg

SEQ ID NO: 19542 - DNA, 18 bp, synthetic construct
  source 1..18: mol_type = other DNA
taatacctcgcgctatag

SEQ ID NO: 19543 - DNA, 18 bp, synthetic construct
  source 1..18: mol_type = other DNA
taatacgaataactgttg

SEQ ID NO: 19544 - DNA, 18 bp, synthetic construct
  source 1..18: mol_type = other DNA
taatacgaatcgcttaag

SEQ ID NO: 19545 - DNA, 18 bp, synthetic construct
  source 1..18: mol_type = other DNA
taatacgacacaatactg

SEQ ID NO: 19546 - DNA, 18 bp, synthetic construct
  source 1..18: mol_type = other DNA
taatacgacccgttaaag

SEQ ID NO: 19547 - DNA, 18 bp, synthetic construct
  source 1..18: mol_type = other DNA
taatacgacgcattactg

SEQ ID NO: 19548 - DNA, 18 bp, synthetic construct
  source 1..18: mol_type = other DNA
taatacgacggaccattg

SEQ ID NO: 19549 - DNA, 18 bp, synthetic construct
  source 1..18: mol_type = other DNA
taatacgactaactgatg

SEQ ID NO: 19550 - DNA, 18 bp, synthetic construct
  source 1..18: mol_type = other DNA
taatacgactaagtaatg

SEQ ID NO: 19551 - DNA, 18 bp, synthetic construct
  source 1..18: mol_type = other DNA
taatacgactagcactag

SEQ ID NO: 19552 - DNA, 18 bp, synthetic construct
  source 1..18: mol_type = other DNA
taatacgactagttttag

SEQ ID NO: 19553 - DNA, 18 bp, synthetic construct
  source 1..18: mol_type = other DNA
taatacgactatcgattg

SEQ ID NO: 19554 - DNA, 18 bp, synthetic construct
  source 1..18: mol_type = other DNA
taatacgactcgcataag

SEQ ID NO: 19555 - DNA, 18 bp, synthetic construct
  source 1..18: mol_type = other DNA
taatacgactcggactag

SEQ ID NO: 19556 - DNA, 18 bp, synthetic construct
  source 1..18: mol_type = other DNA
taatacgactctatgttg

SEQ ID NO: 19557 - DNA, 18 bp, synthetic construct
  source 1..18: mol_type = other DNA
taatacgactctttagtg

SEQ ID NO: 19558 - DNA, 18 bp, synthetic construct
  source 1..18: mol_type = other DNA
taatacgacttaatgttg

SEQ ID NO: 19559 - DNA, 18 bp, synthetic construct
  source 1..18: mol_type = other DNA
taatacgacttcatattg

SEQ ID NO: 19560 - DNA, 18 bp, synthetic construct
  source 1..18: mol_type = other DNA
taatacgagccattattg

SEQ ID NO: 19561 - DNA, 18 bp, synthetic construct
  source 1..18: mol_type = other DNA
taatacgagtaacttttg

SEQ ID NO: 19562 - DNA, 18 bp, synthetic construct
  source 1..18: mol_type = other DNA
taatacgagtcaattttg

SEQ ID NO: 19563 - DNA, 18 bp, synthetic construct
  source 1..18: mol_type = other DNA
taatacgagttacgattg

SEQ ID NO: 19564 - DNA, 18 bp, synthetic construct
  source 1..18: mol_type = other DNA
taatacgatacgttatag

SEQ ID NO: 19565 - DNA, 18 bp, synthetic construct
  source 1..18: mol_type = other DNA
taatacgattaagtattg

SEQ ID NO: 19566 - DNA, 18 bp, synthetic construct
  source 1..18: mol_type = other DNA
taatacgattcactgctg

SEQ ID NO: 19567 - DNA, 18 bp, synthetic construct
  source 1..18: mol_type = other DNA
taatacgcgtaactattg

SEQ ID NO: 19568 - DNA, 18 bp, synthetic construct
  source 1..18: mol_type = other DNA
taatacggcttacttttg

SEQ ID NO: 19569 - DNA, 18 bp, synthetic construct
  source 1..18: mol_type = other DNA
taatacggttaactattg

SEQ ID NO: 19570 - DNA, 18 bp, synthetic construct
  source 1..18: mol_type = other DNA
taatacggtttgctatag

SEQ ID NO: 19571 - DNA, 18 bp, synthetic construct
  source 1..18: mol_type = other DNA
taatacgtcccactgttg

SEQ ID NO: 19572 - DNA, 18 bp, synthetic construct
  source 1..18: mol_type = other DNA
taatacgtctcgccttag

SEQ ID NO: 19573 - DNA, 18 bp, synthetic construct
  source 1..18: mol_type = other DNA
taatacgtctcggtatgg

SEQ ID NO: 19574 - DNA, 18 bp, synthetic construct
  source 1..18: mol_type = other DNA
taatacgtgtcactgttg

SEQ ID NO: 19575 - DNA, 18 bp, synthetic construct
  source 1..18: mol_type = other DNA
taatactactcagtaatg

SEQ ID NO: 19576 - DNA, 18 bp, synthetic construct
  source 1..18: mol_type = other DNA
taatactactcgaaatag

SEQ ID NO: 19577 - DNA, 18 bp, synthetic construct
  source 1..18: mol_type = other DNA
taataggacgcattattg

SEQ ID NO: 19578 - DNA, 18 bp, synthetic construct
  source 1..18: mol_type = other DNA
taataggactaactcttg

SEQ ID NO: 19579 - DNA, 18 bp, synthetic construct
  source 1..18: mol_type = other DNA
taataggactcacatttg

SEQ ID NO: 19580 - DNA, 18 bp, synthetic construct
  source 1..18: mol_type = other DNA
taataggactgcctattg

SEQ ID NO: 19581 - DNA, 18 bp, synthetic construct
  source 1..18: mol_type = other DNA
taataggacttaatattg

SEQ ID NO: 19582 - DNA, 18 bp, synthetic construct
  source 1..18: mol_type = other DNA
taataggattccctattg

SEQ ID NO: 19583 - DNA, 18 bp, synthetic construct
  source 1..18: mol_type = other DNA
taatatgacacgcaatag

SEQ ID NO: 19584 - DNA, 18 bp, synthetic construct
  source 1..18: mol_type = other DNA
taatatgacccaatattg

SEQ ID NO: 19585 - DNA, 18 bp, synthetic construct
  source 1..18: mol_type = other DNA
taatatgactaaccattg

SEQ ID NO: 19586 - DNA, 18 bp, synthetic construct
  source 1..18: mol_type = other DNA
taatatgactcacacttg

SEQ ID NO: 19587 - DNA, 18 bp, synthetic construct
  source 1..18: mol_type = other DNA
taatatgactcacctttg

SEQ ID NO: 19588 - DNA, 18 bp, synthetic construct
  source 1..18: mol_type = other DNA
taatatgactctctagtg

SEQ ID NO: 19589 - DNA, 18 bp, synthetic construct
  source 1..18: mol_type = other DNA
taatccgacccattattg

SEQ ID NO: 19590 - DNA, 18 bp, synthetic construct
  source 1..18: mol_type = other DNA
taatccgtctgactattg

SEQ ID NO: 19591 - DNA, 18 bp, synthetic construct
  source 1..18: mol_type = other DNA
taatcctactccctattg

SEQ ID NO: 19592 - DNA, 18 bp, synthetic construct
  source 1..18: mol_type = other DNA
taatcctacttgctatag

SEQ ID NO: 19593 - DNA, 18 bp, synthetic construct
  source 1..18: mol_type = other DNA
taatgcgaatcactactg

SEQ ID NO: 19594 - DNA, 18 bp, synthetic construct
  source 1..18: mol_type = other DNA
taatgcgactaactaatg

SEQ ID NO: 19595 - DNA, 18 bp, synthetic construct
  source 1..18: mol_type = other DNA
taatgcgactagctaaag

SEQ ID NO: 19596 - DNA, 18 bp, synthetic construct
  source 1..18: mol_type = other DNA
taatgcgactcacttctg

SEQ ID NO: 19597 - DNA, 18 bp, synthetic construct
  source 1..18: mol_type = other DNA
taatgcgattcactactg

SEQ ID NO: 19598 - DNA, 18 bp, synthetic construct
  source 1..18: mol_type = other DNA
taatgcgtcttactattg

SEQ ID NO: 19599 - DNA, 18 bp, synthetic construct
  source 1..18: mol_type = other DNA
taatgcgtttcactattg

SEQ ID NO: 19600 - DNA, 18 bp, synthetic construct
  source 1..18: mol_type = other DNA
taatgtgacttactattg

SEQ ID NO: 19601 - DNA, 18 bp, synthetic construct
  source 1..18: mol_type = other DNA
taattacactctctatag

SEQ ID NO: 19602 - DNA, 18 bp, synthetic construct
  source 1..18: mol_type = other DNA
taattagactcccaatag

SEQ ID NO: 19603 - DNA, 18 bp, synthetic construct
  source 1..18: mol_type = other DNA
taattagactgactacag

SEQ ID NO: 19604 - DNA, 18 bp, synthetic construct
  source 1..18: mol_type = other DNA
taattagatccactatag

SEQ ID NO: 19605 - DNA, 18 bp, synthetic construct
  source 1..18: mol_type = other DNA
taattagcctcactatgg

SEQ ID NO: 19606 - DNA, 18 bp, synthetic construct
  source 1..18: mol_type = other DNA
taattcaaatcaccatag

SEQ ID NO: 19607 - DNA, 18 bp, synthetic construct
  source 1..18: mol_type = other DNA
taattcaactctctatgg

SEQ ID NO: 19608 - DNA, 18 bp, synthetic construct
  source 1..18: mol_type = other DNA
taattcaattaactatag

SEQ ID NO: 19609 - DNA, 18 bp, synthetic construct
  source 1..18: mol_type = other DNA
taattcaattcagtatag

SEQ ID NO: 19610 - DNA, 18 bp, synthetic construct
  source 1..18: mol_type = other DNA
taattccactaagtatag

SEQ ID NO: 19611 - DNA, 18 bp, synthetic construct
  source 1..18: mol_type = other DNA
taattcccctcactttag

SEQ ID NO: 19612 - DNA, 18 bp, synthetic construct
  source 1..18: mol_type = other DNA
taattcctctcaccatag

SEQ ID NO: 19613 - DNA, 18 bp, synthetic construct
  source 1..18: mol_type = other DNA
taattcgaatcaatgtag

SEQ ID NO: 19614 - DNA, 18 bp, synthetic construct
  source 1..18: mol_type = other DNA
taattcgacacaccgtag

SEQ ID NO: 19615 - DNA, 18 bp, synthetic construct
  source 1..18: mol_type = other DNA
taattcgacaccccatag

SEQ ID NO: 19616 - DNA, 18 bp, synthetic construct
  source 1..18: mol_type = other DNA
taattcgacgcaatttag

SEQ ID NO: 19617 - DNA, 18 bp, synthetic construct
  source 1..18: mol_type = other DNA
taattcgactaaccacag

SEQ ID NO: 19618 - DNA, 18 bp, synthetic construct
  source 1..18: mol_type = other DNA
taattcgactcaatacgg

SEQ ID NO: 19619 - DNA, 18 bp, synthetic construct
  source 1..18: mol_type = other DNA
taattcgactgattgtag

SEQ ID NO: 19620 - DNA, 18 bp, synthetic construct
  source 1..18: mol_type = other DNA
taattcgactgcctaaag

SEQ ID NO: 19621 - DNA, 18 bp, synthetic construct
  source 1..18: mol_type = other DNA
taattcgacttcatatag

SEQ ID NO: 19622 - DNA, 18 bp, synthetic construct
  source 1..18: mol_type = other DNA
taattcgagacactctag

SEQ ID NO: 19623 - DNA, 18 bp, synthetic construct
  source 1..18: mol_type = other DNA
taattcgattaactacag

SEQ ID NO: 19624 - DNA, 18 bp, synthetic construct
  source 1..18: mol_type = other DNA
taattcggcacactaaag

SEQ ID NO: 19625 - DNA, 18 bp, synthetic construct
  source 1..18: mol_type = other DNA
taattcggctccctctag

SEQ ID NO: 19626 - DNA, 18 bp, synthetic construct
  source 1..18: mol_type = other DNA
taattcggcttactgtag

SEQ ID NO: 19627 - DNA, 18 bp, synthetic construct
  source 1..18: mol_type = other DNA
taattctaatcactatcg

SEQ ID NO: 19628 - DNA, 18 bp, synthetic construct
  source 1..18: mol_type = other DNA
taattctactcactaccg

SEQ ID NO: 19629 - DNA, 18 bp, synthetic construct
  source 1..18: mol_type = other DNA
taattctacttactatgg

SEQ ID NO: 19630 - DNA, 18 bp, synthetic construct
  source 1..18: mol_type = other DNA
taattctccccactatag

SEQ ID NO: 19631 - DNA, 18 bp, synthetic construct
  source 1..18: mol_type = other DNA
taattggactaagtatag

SEQ ID NO: 19632 - DNA, 18 bp, synthetic construct
  source 1..18: mol_type = other DNA
taattggactcagtacag

SEQ ID NO: 19633 - DNA, 18 bp, synthetic construct
  source 1..18: mol_type = other DNA
taattggactctttatag

SEQ ID NO: 19634 - DNA, 18 bp, synthetic construct
  source 1..18: mol_type = other DNA
taattggccacactatag

SEQ ID NO: 19635 - DNA, 18 bp, synthetic construct
  source 1..18: mol_type = other DNA
taattggccccactatag

SEQ ID NO: 19636 - DNA, 18 bp, synthetic construct
  source 1..18: mol_type = other DNA
taattgggctctctatag

SEQ ID NO: 19637 - DNA, 18 bp, synthetic construct
  source 1..18: mol_type = other DNA
taatttaactctctatag

SEQ ID NO: 19638 - DNA, 18 bp, synthetic construct
  source 1..18: mol_type = other DNA
tacaacgacttgctatag

SEQ ID NO: 19639 - DNA, 18 bp, synthetic construct
  source 1..18: mol_type = other DNA
tactacgaatcaccattg

SEQ ID NO: 19640 - DNA, 18 bp, synthetic construct
  source 1..18: mol_type = other DNA
tactacgagtccctattg

SEQ ID NO: 19641 - DNA, 18 bp, synthetic construct
  source 1..18: mol_type = other DNA
tactactattcgctatag

SEQ ID NO: 19642 - DNA, 18 bp, synthetic construct
  source 1..18: mol_type = other DNA
tactgcaactcgctatag

SEQ ID NO: 19643 - DNA, 18 bp, synthetic construct
  source 1..18: mol_type = other DNA
tacttcaaatcactatag

SEQ ID NO: 19644 - DNA, 18 bp, synthetic construct
  source 1..18: mol_type = other DNA
tacttccactcactacag

SEQ ID NO: 19645 - DNA, 18 bp, synthetic construct
  source 1..18: mol_type = other DNA
tacttccactcactctag

SEQ ID NO: 19646 - DNA, 18 bp, synthetic construct
  source 1..18: mol_type = other DNA
tacttcgacccactacag

SEQ ID NO: 19647 - DNA, 18 bp, synthetic construct
  source 1..18: mol_type = other DNA
tacttcgaccgactatag

SEQ ID NO: 19648 - DNA, 18 bp, synthetic construct
  source 1..18: mol_type = other DNA
tacttcgactctatatag

SEQ ID NO: 19649 - DNA, 18 bp, synthetic construct
  source 1..18: mol_type = other DNA
tactttgactcaccatag

SEQ ID NO: 19650 - DNA, 18 bp, synthetic construct
  source 1..18: mol_type = other DNA
tagaacgactcaatattg

SEQ ID NO: 19651 - DNA, 18 bp, synthetic construct
  source 1..18: mol_type = other DNA
tagctcgactcactatgg

SEQ ID NO: 19652 - DNA, 18 bp, synthetic construct
  source 1..18: mol_type = other DNA
tagtacgaatcacaattg

SEQ ID NO: 19653 - DNA, 18 bp, synthetic construct
  source 1..18: mol_type = other DNA
tagtacgacaagctatag

SEQ ID NO: 19654 - DNA, 18 bp, synthetic construct
  source 1..18: mol_type = other DNA
tagtatgacttactattg

SEQ ID NO: 19655 - DNA, 18 bp, synthetic construct
  source 1..18: mol_type = other DNA
tagttatactcactatag

SEQ ID NO: 19656 - DNA, 18 bp, synthetic construct
  source 1..18: mol_type = other DNA
tagttccactcactaaag

SEQ ID NO: 19657 - DNA, 18 bp, synthetic construct
  source 1..18: mol_type = other DNA
tagttcgatccactatag

SEQ ID NO: 19658 - DNA, 18 bp, synthetic construct
  source 1..18: mol_type = other DNA
tagttcgtctcacaatag

SEQ ID NO: 19659 - DNA, 18 bp, synthetic construct
  source 1..18: mol_type = other DNA
tatctcgactcaccatag

SEQ ID NO: 19660 - DNA, 18 bp, synthetic construct
  source 1..18: mol_type = other DNA
tattacaactcactagtg

SEQ ID NO: 19661 - DNA, 18 bp, synthetic construct
  source 1..18: mol_type = other DNA
tattacacctcgctatag

SEQ ID NO: 19662 - DNA, 18 bp, synthetic construct
  source 1..18: mol_type = other DNA
tattacgacacagtattg

SEQ ID NO: 19663 - DNA, 18 bp, synthetic construct
  source 1..18: mol_type = other DNA
tattacgacacgctacag

SEQ ID NO: 19664 - DNA, 18 bp, synthetic construct
  source 1..18: mol_type = other DNA
tattacgactggcaatag

SEQ ID NO: 19665 - DNA, 18 bp, synthetic construct
  source 1..18: mol_type = other DNA
tattacgagccgctatag

SEQ ID NO: 19666 - DNA, 18 bp, synthetic construct
  source 1..18: mol_type = other DNA
tattacgagttgctatag

SEQ ID NO: 19667 - DNA, 18 bp, synthetic construct
  source 1..18: mol_type = other DNA
tattactactagctatag

SEQ ID NO: 19668 - DNA, 18 bp, synthetic construct
  source 1..18: mol_type = other DNA
tattactagtcactattg

SEQ ID NO: 19669 - DNA, 18 bp, synthetic construct
  source 1..18: mol_type = other DNA
tattaggacccgctatag

SEQ ID NO: 19670 - DNA, 18 bp, synthetic construct
  source 1..18: mol_type = other DNA
tattatgacgcactattg

SEQ ID NO: 19671 - DNA, 18 bp, synthetic construct
  source 1..18: mol_type = other DNA
tattatgactcgctatcg

SEQ ID NO: 19672 - DNA, 18 bp, synthetic construct
  source 1..18: mol_type = other DNA
tattatgactcgctatgg

SEQ ID NO: 19673 - DNA, 18 bp, synthetic construct
  source 1..18: mol_type = other DNA
tattgcgactcgatatag

SEQ ID NO: 19674 - DNA, 18 bp, synthetic construct
  source 1..18: mol_type = other DNA
tatttcgacgaactatag

SEQ ID NO: 19675 - DNA, 18 bp, synthetic construct
  source 1..18: mol_type = other DNA
tatttcggctcacaatag

SEQ ID NO: 19676 - DNA, 18 bp, synthetic construct
  source 1..18: mol_type = other DNA
tatttggcctcactatag

SEQ ID NO: 19677 - DNA, 18 bp, synthetic construct
  source 1..18: mol_type = other DNA
tcacatgactcgctatag

SEQ ID NO: 19678 - DNA, 18 bp, synthetic construct
  source 1..18: mol_type = other DNA
tcatacgacttaatattg

SEQ ID NO: 19679 - DNA, 18 bp, synthetic construct
  source 1..18: mol_type = other DNA
tcatacgacttaccattg

SEQ ID NO: 19680 - DNA, 18 bp, synthetic construct
  source 1..18: mol_type = other DNA
tcatacgtctcattattg

SEQ ID NO: 19681 - DNA, 18 bp, synthetic construct
  source 1..18: mol_type = other DNA
tcatacgtctcgctatgg

SEQ ID NO: 19682 - DNA, 18 bp, synthetic construct
  source 1..18: mol_type = other DNA
tcatactactcgctttag

SEQ ID NO: 19683 - DNA, 18 bp, synthetic construct
  source 1..18: mol_type = other DNA
tcatatgactcgctgtag

SEQ ID NO: 19684 - DNA, 18 bp, synthetic construct
  source 1..18: mol_type = other DNA
tcatccgtctcactattg

SEQ ID NO: 19685 - DNA, 18 bp, synthetic construct
  source 1..18: mol_type = other DNA
tcattcgcctcactatgg

SEQ ID NO: 19686 - DNA, 18 bp, synthetic construct
  source 1..18: mol_type = other DNA
tcattcgcctctctatag

SEQ ID NO: 19687 - DNA, 18 bp, synthetic construct
  source 1..18: mol_type = other DNA
tcctacgactctctattg

SEQ ID NO: 19688 - DNA, 18 bp, synthetic construct
  source 1..18: mol_type = other DNA
tcttacgactcgctatgg

SEQ ID NO: 19689 - DNA, 18 bp, synthetic construct
  source 1..18: mol_type = other DNA
tgatacgcctaactattg

SEQ ID NO: 19690 - DNA, 18 bp, synthetic construct
  source 1..18: mol_type = other DNA
tgatatgactcagtattg

SEQ ID NO: 19691 - DNA, 18 bp, synthetic construct
  source 1..18: mol_type = other DNA
tgatccgactctctattg

SEQ ID NO: 19692 - DNA, 18 bp, synthetic construct
  source 1..18: mol_type = other DNA
tgattcaactcattatag

SEQ ID NO: 19693 - DNA, 18 bp, synthetic construct
  source 1..18: mol_type = other DNA
tgattcgacaaactatag

SEQ ID NO: 19694 - DNA, 18 bp, synthetic construct
  source 1..18: mol_type = other DNA
tgcttccactcactatag

SEQ ID NO: 19695 - DNA, 18 bp, synthetic construct
  source 1..18: mol_type = other DNA
tgcttcgattcactatag

SEQ ID NO: 19696 - DNA, 18 bp, synthetic construct
  source 1..18: mol_type = other DNA
tgttacgactcactcttg

SEQ ID NO: 19697 - DNA, 18 bp, synthetic construct
  source 1..18: mol_type = other DNA
tgttacgacttactattg

SEQ ID NO: 19698 - DNA, 18 bp, synthetic construct
  source 1..18: mol_type = other DNA
tgttacgattcgctatag

SEQ ID NO: 19699 - DNA, 18 bp, synthetic construct
  source 1..18: mol_type = other DNA
ttacacgactcagtattg

SEQ ID NO: 19700 - DNA, 18 bp, synthetic construct
  source 1..18: mol_type = other DNA
ttataagactcgcaatag

SEQ ID NO: 19701 - DNA, 18 bp, synthetic construct
  source 1..18: mol_type = other DNA
ttatacgacacagtattg

SEQ ID NO: 19702 - DNA, 18 bp, synthetic construct
  source 1..18: mol_type = other DNA
ttatacgacacgatatag

SEQ ID NO: 19703 - DNA, 18 bp, synthetic construct
  source 1..18: mol_type = other DNA
ttatacgacccactcttg

SEQ ID NO: 19704 - DNA, 18 bp, synthetic construct
  source 1..18: mol_type = other DNA
ttatacgactagctttag

SEQ ID NO: 19705 - DNA, 18 bp, synthetic construct
  source 1..18: mol_type = other DNA
ttatacgactcgccctag

SEQ ID NO: 19706 - DNA, 18 bp, synthetic construct
  source 1..18: mol_type = other DNA
ttatacgacttgccatag

SEQ ID NO: 19707 - DNA, 18 bp, synthetic construct
  source 1..18: mol_type = other DNA
ttatacgcctcgctacag

SEQ ID NO: 19708 - DNA, 18 bp, synthetic construct
  source 1..18: mol_type = other DNA
ttatacggcacgctatag

SEQ ID NO: 19709 - DNA, 18 bp, synthetic construct
  source 1..18: mol_type = other DNA
ttatacgtgtcgctatag

SEQ ID NO: 19710 - DNA, 18 bp, synthetic construct
  source 1..18: mol_type = other DNA
ttatactactccctattg

SEQ ID NO: 19711 - DNA, 18 bp, synthetic construct
  source 1..18: mol_type = other DNA
ttatataactcgctatag

SEQ ID NO: 19712 - DNA, 18 bp, synthetic construct
  source 1..18: mol_type = other DNA
ttatcagactcgctatag

SEQ ID NO: 19713 - DNA, 18 bp, synthetic construct
  source 1..18: mol_type = other DNA
ttatgctactcactattg

SEQ ID NO: 19714 - DNA, 18 bp, synthetic construct
  source 1..18: mol_type = other DNA
ttattccactcaatatag

SEQ ID NO: 19715 - DNA, 18 bp, synthetic construct
  source 1..18: mol_type = other DNA
ttattcgacgcactatcg

SEQ ID NO: 19716 - DNA, 18 bp, synthetic construct
  source 1..18: mol_type = other DNA
ttattcgacgcactatgg

SEQ ID NO: 19717 - DNA, 18 bp, synthetic construct
  source 1..18: mol_type = other DNA
ttattcgactaaccatag

SEQ ID NO: 19718 - DNA, 18 bp, synthetic construct
  source 1..18: mol_type = other DNA
ttattcgactcactaacg

SEQ ID NO: 19719 - DNA, 18 bp, synthetic construct
  source 1..18: mol_type = other DNA
ttattcggcccactatag

SEQ ID NO: 19720 - DNA, 18 bp, synthetic construct
  source 1..18: mol_type = other DNA
ttattggactaactatag

SEQ ID NO: 19721 - DNA, 18 bp, synthetic construct
  source 1..18: mol_type = other DNA
ttatttgactgactatag

SEQ ID NO: 19722 - DNA, 18 bp, synthetic construct
  source 1..18: mol_type = other DNA
ttgtacgactcacgattg

SEQ ID NO: 19723 - DNA, 18 bp, synthetic construct
  source 1..18: mol_type = other DNA
ttgttcgactcaccatag

SEQ ID NO: 19724 - DNA, 18 bp, synthetic construct
  source 1..18: mol_type = other DNA
ttttacgactcgttatag

SEQ ID NO: 19725 - DNA, 18 bp, synthetic construct
  source 1..18: mol_type = other DNA
aaaaacgactaaatatag

SEQ ID NO: 19726 - DNA, 18 bp, synthetic construct
  source 1..18: mol_type = other DNA
aaaaacgactccttatag

SEQ ID NO: 19727 - DNA, 18 bp, synthetic construct
  source 1..18: mol_type = other DNA
aaaaacgattcagtatag

SEQ ID NO: 19728 - DNA, 18 bp, synthetic construct
  source 1..18: mol_type = other DNA
aaaaacgtctccctatag

SEQ ID NO: 19729 - DNA, 18 bp, synthetic construct
  source 1..18: mol_type = other DNA
aaacacaactcacaatag

SEQ ID NO: 19730 - DNA, 18 bp, synthetic construct
  source 1..18: mol_type = other DNA
aaacacaactcactagag

SEQ ID NO: 19731 - DNA, 18 bp, synthetic construct
  source 1..18: mol_type = other DNA
aaacacgaattactatag

SEQ ID NO: 19732 - DNA, 18 bp, synthetic construct
  source 1..18: mol_type = other DNA
aaacacgactccctgtag

SEQ ID NO: 19733 - DNA, 18 bp, synthetic construct
  source 1..18: mol_type = other DNA
aaacacgactgacaatag

SEQ ID NO: 19734 - DNA, 18 bp, synthetic construct
  source 1..18: mol_type = other DNA
aaagacaactcactaaag

SEQ ID NO: 19735 - DNA, 18 bp, synthetic construct
  source 1..18: mol_type = other DNA
aaagacgatttactatag

SEQ ID NO: 19736 - DNA, 18 bp, synthetic construct
  source 1..18: mol_type = other DNA
aaataagacttaccatag

SEQ ID NO: 19737 - DNA, 18 bp, synthetic construct
  source 1..18: mol_type = other DNA
aaatacaacccaccatag

SEQ ID NO: 19738 - DNA, 18 bp, synthetic construct
  source 1..18: mol_type = other DNA
aaatacaactaactctag

SEQ ID NO: 19739 - DNA, 18 bp, synthetic construct
  source 1..18: mol_type = other DNA
aaatacaactgactgtag

SEQ ID NO: 19740 - DNA, 18 bp, synthetic construct
  source 1..18: mol_type = other DNA
aaataccaatcacaatag

SEQ ID NO: 19741 - DNA, 18 bp, synthetic construct
  source 1..18: mol_type = other DNA
aaataccacttactatgg

SEQ ID NO: 19742 - DNA, 18 bp, synthetic construct
  source 1..18: mol_type = other DNA
aaataccacttactctag

SEQ ID NO: 19743 - DNA, 18 bp, synthetic construct
  source 1..18: mol_type = other DNA
aaatacgaaaaactatag

SEQ ID NO: 19744 - DNA, 18 bp, synthetic construct
  source 1..18: mol_type = other DNA
aaatacgaaacactctag

SEQ ID NO: 19745 - DNA, 18 bp, synthetic construct
  source 1..18: mol_type = other DNA
aaatacgaattactaaag

SEQ ID NO: 19746 - DNA, 18 bp, synthetic construct
  source 1..18: mol_type = other DNA
aaatacgacacactgtgg

SEQ ID NO: 19747 - DNA, 18 bp, synthetic construct
  source 1..18: mol_type = other DNA
aaatacgacccacgttag

SEQ ID NO: 19748 - DNA, 18 bp, synthetic construct
  source 1..18: mol_type = other DNA
aaatacgacttactgaag

SEQ ID NO: 19749 - DNA, 18 bp, synthetic construct
  source 1..18: mol_type = other DNA
aaatacgacttagtacag

SEQ ID NO: 19750 - DNA, 18 bp, synthetic construct
  source 1..18: mol_type = other DNA
aaatacgagtttctatag

SEQ ID NO: 19751 - DNA, 18 bp, synthetic construct
  source 1..18: mol_type = other DNA
aaatacgccacactaaag

SEQ ID NO: 19752 - DNA, 18 bp, synthetic construct
  source 1..18: mol_type = other DNA
aaatacgcctcaatatcg

SEQ ID NO: 19753 - DNA, 18 bp, synthetic construct
  source 1..18: mol_type = other DNA
aaatacggcgcacaatag

SEQ ID NO: 19754 - DNA, 18 bp, synthetic construct
  source 1..18: mol_type = other DNA
aaatacggctcaataaag

SEQ ID NO: 19755 - DNA, 18 bp, synthetic construct
  source 1..18: mol_type = other DNA
aaatacgtcccacaatag

SEQ ID NO: 19756 - DNA, 18 bp, synthetic construct
  source 1..18: mol_type = other DNA
aaatactacttactgtag

SEQ ID NO: 19757 - DNA, 18 bp, synthetic construct
  source 1..18: mol_type = other DNA
aaataggcctaactatag

SEQ ID NO: 19758 - DNA, 18 bp, synthetic construct
  source 1..18: mol_type = other DNA
aaatatgatgcactatag

SEQ ID NO: 19759 - DNA, 18 bp, synthetic construct
  source 1..18: mol_type = other DNA
aaatgcgattcactatcg

SEQ ID NO: 19760 - DNA, 18 bp, synthetic construct
  source 1..18: mol_type = other DNA
aactacaactcacaatag

SEQ ID NO: 19761 - DNA, 18 bp, synthetic construct
  source 1..18: mol_type = other DNA
aattaccactgactatag

SEQ ID NO: 19762 - DNA, 18 bp, synthetic construct
  source 1..18: mol_type = other DNA
aattacgacgaactatag

SEQ ID NO: 19763 - DNA, 18 bp, synthetic construct
  source 1..18: mol_type = other DNA
acaaacgactcactaaag

SEQ ID NO: 19764 - DNA, 18 bp, synthetic construct
  source 1..18: mol_type = other DNA
acatacgactcaatttag

SEQ ID NO: 19765 - DNA, 18 bp, synthetic construct
  source 1..18: mol_type = other DNA
acatatgactcacaatag

SEQ ID NO: 19766 - DNA, 18 bp, synthetic construct
  source 1..18: mol_type = other DNA
acatccgactcattatag

SEQ ID NO: 19767 - DNA, 18 bp, synthetic construct
  source 1..18: mol_type = other DNA
agatacgactcacactag

SEQ ID NO: 19768 - DNA, 18 bp, synthetic construct
  source 1..18: mol_type = other DNA
agatacggctcaatatag

SEQ ID NO: 19769 - DNA, 18 bp, synthetic construct
  source 1..18: mol_type = other DNA
agatacggctcattatag

SEQ ID NO: 19770 - DNA, 18 bp, synthetic construct
  source 1..18: mol_type = other DNA
agatacgtctgactatag

SEQ ID NO: 19771 - DNA, 18 bp, synthetic construct
  source 1..18: mol_type = other DNA
atatataactcactatag

SEQ ID NO: 19772 - DNA, 18 bp, synthetic construct
  source 1..18: mol_type = other DNA
atatccgactcactctag

SEQ ID NO: 19773 - DNA, 18 bp, synthetic construct
  source 1..18: mol_type = other DNA
atatccgactcagtatag

SEQ ID NO: 19774 - DNA, 18 bp, synthetic construct
  source 1..18: mol_type = other DNA
atatgcgactcactaaag

SEQ ID NO: 19775 - DNA, 18 bp, synthetic construct
  source 1..18: mol_type = other DNA
atatgcgacttactatag

SEQ ID NO: 19776 - DNA, 18 bp, synthetic construct
  source 1..18: mol_type = other DNA
caaaacgactcatcatag

SEQ ID NO: 19777 - DNA, 18 bp, synthetic construct
  source 1..18: mol_type = other DNA
caaaacgagtaactatag

SEQ ID NO: 19778 - DNA, 18 bp, synthetic construct
  source 1..18: mol_type = other DNA
caaaacgtctcattatag

SEQ ID NO: 19779 - DNA, 18 bp, synthetic construct
  source 1..18: mol_type = other DNA
caaaatgactcactaaag

SEQ ID NO: 19780 - DNA, 18 bp, synthetic construct
  source 1..18: mol_type = other DNA
caacacctctcactatag

SEQ ID NO: 19781 - DNA, 18 bp, synthetic construct
  source 1..18: mol_type = other DNA
caacacgaatctctatag

SEQ ID NO: 19782 - DNA, 18 bp, synthetic construct
  source 1..18: mol_type = other DNA
caacacgattcaatatag

SEQ ID NO: 19783 - DNA, 18 bp, synthetic construct
  source 1..18: mol_type = other DNA
caataagacactctatag

SEQ ID NO: 19784 - DNA, 18 bp, synthetic construct
  source 1..18: mol_type = other DNA
caataagactaagtatag

SEQ ID NO: 19785 - DNA, 18 bp, synthetic construct
  source 1..18: mol_type = other DNA
caataccaatctctatag

SEQ ID NO: 19786 - DNA, 18 bp, synthetic construct
  source 1..18: mol_type = other DNA
caataccacacattatag

SEQ ID NO: 19787 - DNA, 18 bp, synthetic construct
  source 1..18: mol_type = other DNA
caatacgaatatctatag

SEQ ID NO: 19788 - DNA, 18 bp, synthetic construct
  source 1..18: mol_type = other DNA
caatacgacacaatctag

SEQ ID NO: 19789 - DNA, 18 bp, synthetic construct
  source 1..18: mol_type = other DNA
caatacgatatactatag

SEQ ID NO: 19790 - DNA, 18 bp, synthetic construct
  source 1..18: mol_type = other DNA
caatacgatttactagag

SEQ ID NO: 19791 - DNA, 18 bp, synthetic construct
  source 1..18: mol_type = other DNA
caatacgcaacactatag

SEQ ID NO: 19792 - DNA, 18 bp, synthetic construct
  source 1..18: mol_type = other DNA
caatacggttccctatag

SEQ ID NO: 19793 - DNA, 18 bp, synthetic construct
  source 1..18: mol_type = other DNA
caatacgttttactatag

SEQ ID NO: 19794 - DNA, 18 bp, synthetic construct
  source 1..18: mol_type = other DNA
caatactacttactaaag

SEQ ID NO: 19795 - DNA, 18 bp, synthetic construct
  source 1..18: mol_type = other DNA
caatagaacccactatag

SEQ ID NO: 19796 - DNA, 18 bp, synthetic construct
  source 1..18: mol_type = other DNA
caataggactcaccttag

SEQ ID NO: 19797 - DNA, 18 bp, synthetic construct
  source 1..18: mol_type = other DNA
caataggactttctatag

SEQ ID NO: 19798 - DNA, 18 bp, synthetic construct
  source 1..18: mol_type = other DNA
caataggtcacactatag

SEQ ID NO: 19799 - DNA, 18 bp, synthetic construct
  source 1..18: mol_type = other DNA
caataggtctcattatag

SEQ ID NO: 19800 - DNA, 18 bp, synthetic construct
  source 1..18: mol_type = other DNA
caatatgacccactacag

SEQ ID NO: 19801 - DNA, 18 bp, synthetic construct
  source 1..18: mol_type = other DNA
caatatgactcacttgag

SEQ ID NO: 19802 - DNA, 18 bp, synthetic construct
  source 1..18: mol_type = other DNA
caatcagaatcactatag

SEQ ID NO: 19803 - DNA, 18 bp, synthetic construct
  source 1..18: mol_type = other DNA
caatcatactcactatag

SEQ ID NO: 19804 - DNA, 18 bp, synthetic construct
  source 1..18: mol_type = other DNA
caatccaactctctatag

SEQ ID NO: 19805 - DNA, 18 bp, synthetic construct
  source 1..18: mol_type = other DNA
caatcccactcactttag

SEQ ID NO: 19806 - DNA, 18 bp, synthetic construct
  source 1..18: mol_type = other DNA
caatccgaatcactgtag

SEQ ID NO: 19807 - DNA, 18 bp, synthetic construct
  source 1..18: mol_type = other DNA
caatccgactctctaaag

SEQ ID NO: 19808 - DNA, 18 bp, synthetic construct
  source 1..18: mol_type = other DNA
cactaggactcactttag

SEQ ID NO: 19809 - DNA, 18 bp, synthetic construct
  source 1..18: mol_type = other DNA
cagtaagactcaccatag

SEQ ID NO: 19810 - DNA, 18 bp, synthetic construct
  source 1..18: mol_type = other DNA
cagtacgccacactatag

SEQ ID NO: 19811 - DNA, 18 bp, synthetic construct
  source 1..18: mol_type = other DNA
cattacgactctctatcg

SEQ ID NO: 19812 - DNA, 18 bp, synthetic construct
  source 1..18: mol_type = other DNA
ccacacgactcactgtag

SEQ ID NO: 19813 - DNA, 18 bp, synthetic construct
  source 1..18: mol_type = other DNA
cgaaaccactcactatag

SEQ ID NO: 19814 - DNA, 18 bp, synthetic construct
  source 1..18: mol_type = other DNA
cgagacgacacactatag

SEQ ID NO: 19815 - DNA, 18 bp, synthetic construct
  source 1..18: mol_type = other DNA
cgatacgactcaatgtag

SEQ ID NO: 19816 - DNA, 18 bp, synthetic construct
  source 1..18: mol_type = other DNA
ctatacgacttacgatag

SEQ ID NO: 19817 - DNA, 18 bp, synthetic construct
  source 1..18: mol_type = other DNA
ctatacgattcactaaag

SEQ ID NO: 19818 - DNA, 18 bp, synthetic construct
  source 1..18: mol_type = other DNA
ctatacgtctgactatag

SEQ ID NO: 19819 - DNA, 18 bp, synthetic construct
  source 1..18: mol_type = other DNA
ctttaagactcactatag

SEQ ID NO: 19820 - DNA, 18 bp, synthetic construct
  source 1..18: mol_type = other DNA
gaaaacgacttactaaag

SEQ ID NO: 19821 - DNA, 18 bp, synthetic construct
  source 1..18: mol_type = other DNA
gaacacgtttcactatag

SEQ ID NO: 19822 - DNA, 18 bp, synthetic construct
  source 1..18: mol_type = other DNA
gaatacaaatcacaatag

SEQ ID NO: 19823 - DNA, 18 bp, synthetic construct
  source 1..18: mol_type = other DNA
gaatacaacccactgtag

SEQ ID NO: 19824 - DNA, 18 bp, synthetic construct
  source 1..18: mol_type = other DNA
gaatacaactcataatag

SEQ ID NO: 19825 - DNA, 18 bp, synthetic construct
  source 1..18: mol_type = other DNA
gaatccgaatcaccatag

SEQ ID NO: 19826 - DNA, 18 bp, synthetic construct
  source 1..18: mol_type = other DNA
gactaggactcaccatag

SEQ ID NO: 19827 - DNA, 18 bp, synthetic construct
  source 1..18: mol_type = other DNA
gagtaagactcactatcg

SEQ ID NO: 19828 - DNA, 18 bp, synthetic construct
  source 1..18: mol_type = other DNA
gattaccactcactacag

SEQ ID NO: 19829 - DNA, 18 bp, synthetic construct
  source 1..18: mol_type = other DNA
gattatgactaactatag

SEQ ID NO: 19830 - DNA, 18 bp, synthetic construct
  source 1..18: mol_type = other DNA
gcatacgagtcactatcg

SEQ ID NO: 19831 - DNA, 18 bp, synthetic construct
  source 1..18: mol_type = other DNA
ggatatgactcactacag

SEQ ID NO: 19832 - DNA, 18 bp, synthetic construct
  source 1..18: mol_type = other DNA
gtatacgactctctctag

SEQ ID NO: 19833 - DNA, 18 bp, synthetic construct
  source 1..18: mol_type = other DNA
gtatacgacttattatag

SEQ ID NO: 19834 - DNA, 18 bp, synthetic construct
  source 1..18: mol_type = other DNA
gtatacgtcttactatag

SEQ ID NO: 19835 - DNA, 18 bp, synthetic construct
  source 1..18: mol_type = other DNA
gtatgcgtctcactatag

SEQ ID NO: 19836 - DNA, 18 bp, synthetic construct
  source 1..18: mol_type = other DNA
gtttaggactcactatag

SEQ ID NO: 19837 - DNA, 18 bp, synthetic construct
  source 1..18: mol_type = other DNA
taaaaagaatctctatag

SEQ ID NO: 19838 - DNA, 18 bp, synthetic construct
  source 1..18: mol_type = other DNA
taaaaagacacactttag

SEQ ID NO: 19839 - DNA, 18 bp, synthetic construct
  source 1..18: mol_type = other DNA
taaaaaggcttactatag

SEQ ID NO: 19840 - DNA, 18 bp, synthetic construct
  source 1..18: mol_type = other DNA
taaaacatctcactagag

SEQ ID NO: 19841 - DNA, 18 bp, synthetic construct
  source 1..18: mol_type = other DNA
taaaacctctctctatag

SEQ ID NO: 19842 - DNA, 18 bp, synthetic construct
  source 1..18: mol_type = other DNA
taaaacgaatcaatatgg

SEQ ID NO: 19843 - DNA, 18 bp, synthetic construct
  source 1..18: mol_type = other DNA
taaaacgacacaatatcg

SEQ ID NO: 19844 - DNA, 18 bp, synthetic construct
  source 1..18: mol_type = other DNA
taaaacgacacacaagag

SEQ ID NO: 19845 - DNA, 18 bp, synthetic construct
  source 1..18: mol_type = other DNA
taaaacgaccctctatgg

SEQ ID NO: 19846 - DNA, 18 bp, synthetic construct
  source 1..18: mol_type = other DNA
taaaacgactcacatcag

SEQ ID NO: 19847 - DNA, 18 bp, synthetic construct
  source 1..18: mol_type = other DNA
taaaacgactcaccttcg

SEQ ID NO: 19848 - DNA, 18 bp, synthetic construct
  source 1..18: mol_type = other DNA
taaaacgactcagtgaag

SEQ ID NO: 19849 - DNA, 18 bp, synthetic construct
  source 1..18: mol_type = other DNA
taaaacgactccaaatag

SEQ ID NO: 19850 - DNA, 18 bp, synthetic construct
  source 1..18: mol_type = other DNA
taaaacgagtaagtatag

SEQ ID NO: 19851 - DNA, 18 bp, synthetic construct
  source 1..18: mol_type = other DNA
taaaacgattcacaaaag

SEQ ID NO: 19852 - DNA, 18 bp, synthetic construct
  source 1..18: mol_type = other DNA
taaaacgattcatcatag

SEQ ID NO: 19853 - DNA, 18 bp, synthetic construct
  source 1..18: mol_type = other DNA
taaaacgccgcattatag

SEQ ID NO: 19854 - DNA, 18 bp, synthetic construct
  source 1..18: mol_type = other DNA
taaaacgcctcaatttag

SEQ ID NO: 19855 - DNA, 18 bp, synthetic construct
  source 1..18: mol_type = other DNA
taaaacgtctcaccaaag

SEQ ID NO: 19856 - DNA, 18 bp, synthetic construct
  source 1..18: mol_type = other DNA
taaaacgtctcactctcg

SEQ ID NO: 19857 - DNA, 18 bp, synthetic construct
  source 1..18: mol_type = other DNA
taaaacgtctcactgcag

SEQ ID NO: 19858 - DNA, 18 bp, synthetic construct
  source 1..18: mol_type = other DNA
taaaacgtctccctatcg

SEQ ID NO: 19859 - DNA, 18 bp, synthetic construct
  source 1..18: mol_type = other DNA
taaaactacctactatag

SEQ ID NO: 19860 - DNA, 18 bp, synthetic construct
  source 1..18: mol_type = other DNA
taaaactactcagtctag

SEQ ID NO: 19861 - DNA, 18 bp, synthetic construct
  source 1..18: mol_type = other DNA
taaaactcctctctatag

SEQ ID NO: 19862 - DNA, 18 bp, synthetic construct
  source 1..18: mol_type = other DNA
taaaagaactcactatcg

SEQ ID NO: 19863 - DNA, 18 bp, synthetic construct
  source 1..18: mol_type = other DNA
taaaccgacatactatag

SEQ ID NO: 19864 - DNA, 18 bp, synthetic construct
  source 1..18: mol_type = other DNA
taaaccgactatctatag

SEQ ID NO: 19865 - DNA, 18 bp, synthetic construct
  source 1..18: mol_type = other DNA
taaaccgactcactaccg

SEQ ID NO: 19866 - DNA, 18 bp, synthetic construct
  source 1..18: mol_type = other DNA
taaacctattcactatag

SEQ ID NO: 19867 - DNA, 18 bp, synthetic construct
  source 1..18: mol_type = other DNA
taaacggactcactctag

SEQ ID NO: 19868 - DNA, 18 bp, synthetic construct
  source 1..18: mol_type = other DNA
taaagatactcactatag

SEQ ID NO: 19869 - DNA, 18 bp, synthetic construct
  source 1..18: mol_type = other DNA
taaagcgactacctatag

SEQ ID NO: 19870 - DNA, 18 bp, synthetic construct
  source 1..18: mol_type = other DNA
taaagcgattcattatag

SEQ ID NO: 19871 - DNA, 18 bp, synthetic construct
  source 1..18: mol_type = other DNA
taaagcggctcactgtag

SEQ ID NO: 19872 - DNA, 18 bp, synthetic construct
  source 1..18: mol_type = other DNA
taacaacactcaatatag

SEQ ID NO: 19873 - DNA, 18 bp, synthetic construct
  source 1..18: mol_type = other DNA
taacaacactcacaatag

SEQ ID NO: 19874 - DNA, 18 bp, synthetic construct
  source 1..18: mol_type = other DNA
taacaagaatcagtatag

SEQ ID NO: 19875 - DNA, 18 bp, synthetic construct
  source 1..18: mol_type = other DNA
taacaagactcattatgg

SEQ ID NO: 19876 - DNA, 18 bp, synthetic construct
  source 1..18: mol_type = other DNA
taacaagactctatatag

SEQ ID NO: 19877 - DNA, 18 bp, synthetic construct
  source 1..18: mol_type = other DNA
taacaagacttactttag

SEQ ID NO: 19878 - DNA, 18 bp, synthetic construct
  source 1..18: mol_type = other DNA
taacaagattctctatag

SEQ ID NO: 19879 - DNA, 18 bp, synthetic construct
  source 1..18: mol_type = other DNA
taacaatactaactatag

SEQ ID NO: 19880 - DNA, 18 bp, synthetic construct
  source 1..18: mol_type = other DNA
taacaatactcactacag

SEQ ID NO: 19881 - DNA, 18 bp, synthetic construct
  source 1..18: mol_type = other DNA
taacacaattcattatag

SEQ ID NO: 19882 - DNA, 18 bp, synthetic construct
  source 1..18: mol_type = other DNA
taacaccacagactatag

SEQ ID NO: 19883 - DNA, 18 bp, synthetic construct
  source 1..18: mol_type = other DNA
taacaccactcaataaag

SEQ ID NO: 19884 - DNA, 18 bp, synthetic construct
  source 1..18: mol_type = other DNA
taacacgaacctctatag

SEQ ID NO: 19885 - DNA, 18 bp, synthetic construct
  source 1..18: mol_type = other DNA
taacacgacacaatttag

SEQ ID NO: 19886 - DNA, 18 bp, synthetic construct
  source 1..18: mol_type = other DNA
taacacgacagacaatag

SEQ ID NO: 19887 - DNA, 18 bp, synthetic construct
  source 1..18: mol_type = other DNA
taacacgacccaccgtag

SEQ ID NO: 19888 - DNA, 18 bp, synthetic construct
  source 1..18: mol_type = other DNA
taacacgactcagtcgag

SEQ ID NO: 19889 - DNA, 18 bp, synthetic construct
  source 1..18: mol_type = other DNA
taacacgactctccacag

SEQ ID NO: 19890 - DNA, 18 bp, synthetic construct
  source 1..18: mol_type = other DNA
taacacgagttacgatag

SEQ ID NO: 19891 - DNA, 18 bp, synthetic construct
  source 1..18: mol_type = other DNA
taacacgattcacttaag

SEQ ID NO: 19892 - DNA, 18 bp, synthetic construct
  source 1..18: mol_type = other DNA
taacacgattccctaaag

SEQ ID NO: 19893 - DNA, 18 bp, synthetic construct
  source 1..18: mol_type = other DNA
taacacgattccctacag

SEQ ID NO: 19894 - DNA, 18 bp, synthetic construct
  source 1..18: mol_type = other DNA
taacacgcctcactaagg

SEQ ID NO: 19895 - DNA, 18 bp, synthetic construct
  source 1..18: mol_type = other DNA
taacacgcctcactctgg

SEQ ID NO: 19896 - DNA, 18 bp, synthetic construct
  source 1..18: mol_type = other DNA
taacacgcttcaccatag

SEQ ID NO: 19897 - DNA, 18 bp, synthetic construct
  source 1..18: mol_type = other DNA
taacacggcacactacag

SEQ ID NO: 19898 - DNA, 18 bp, synthetic construct
  source 1..18: mol_type = other DNA
taacacggcacactttag

SEQ ID NO: 19899 - DNA, 18 bp, synthetic construct
  source 1..18: mol_type = other DNA
taacacgtctaacgatag

SEQ ID NO: 19900 - DNA, 18 bp, synthetic construct
  source 1..18: mol_type = other DNA
taacacgtctcattagag

SEQ ID NO: 19901 - DNA, 18 bp, synthetic construct
  source 1..18: mol_type = other DNA
taacactactaactgtag

SEQ ID NO: 19902 - DNA, 18 bp, synthetic construct
  source 1..18: mol_type = other DNA
taacactactctctaaag

SEQ ID NO: 19903 - DNA, 18 bp, synthetic construct
  source 1..18: mol_type = other DNA
taacactactctctatcg

SEQ ID NO: 19904 - DNA, 18 bp, synthetic construct
  source 1..18: mol_type = other DNA
taacaggactcacaaaag

SEQ ID NO: 19905 - DNA, 18 bp, synthetic construct
  source 1..18: mol_type = other DNA
taacaggactcactttcg

SEQ ID NO: 19906 - DNA, 18 bp, synthetic construct
  source 1..18: mol_type = other DNA
taacatgactctctaaag

SEQ ID NO: 19907 - DNA, 18 bp, synthetic construct
  source 1..18: mol_type = other DNA
taacatgcctctctatag

SEQ ID NO: 19908 - DNA, 18 bp, synthetic construct
  source 1..18: mol_type = other DNA
taacccgactcactgtgg

SEQ ID NO: 19909 - DNA, 18 bp, synthetic construct
  source 1..18: mol_type = other DNA
taacgcggctcactctag

SEQ ID NO: 19910 - DNA, 18 bp, synthetic construct
  source 1..18: mol_type = other DNA
taagaagactctatatag

SEQ ID NO: 19911 - DNA, 18 bp, synthetic construct
  source 1..18: mol_type = other DNA
taagaataatcactatag

SEQ ID NO: 19912 - DNA, 18 bp, synthetic construct
  source 1..18: mol_type = other DNA
taagacaactctccatag

SEQ ID NO: 19913 - DNA, 18 bp, synthetic construct
  source 1..18: mol_type = other DNA
taagacaattctctatag

SEQ ID NO: 19914 - DNA, 18 bp, synthetic construct
  source 1..18: mol_type = other DNA
taagacgacaaattatag

SEQ ID NO: 19915 - DNA, 18 bp, synthetic construct
  source 1..18: mol_type = other DNA
taagacgacccattaaag

SEQ ID NO: 19916 - DNA, 18 bp, synthetic construct
  source 1..18: mol_type = other DNA
taagacgacgcacaaaag

SEQ ID NO: 19917 - DNA, 18 bp, synthetic construct
  source 1..18: mol_type = other DNA
taagacgactcataacag

SEQ ID NO: 19918 - DNA, 18 bp, synthetic construct
  source 1..18: mol_type = other DNA
taagacgacttaatttag

SEQ ID NO: 19919 - DNA, 18 bp, synthetic construct
  source 1..18: mol_type = other DNA
taagactactgtctatag

SEQ ID NO: 19920 - DNA, 18 bp, synthetic construct
  source 1..18: mol_type = other DNA
taagacttctcaatatag

SEQ ID NO: 19921 - DNA, 18 bp, synthetic construct
  source 1..18: mol_type = other DNA
taaggagacttactatag

SEQ ID NO: 19922 - DNA, 18 bp, synthetic construct
  source 1..18: mol_type = other DNA
taaggctacacactatag

SEQ ID NO: 19923 - DNA, 18 bp, synthetic construct
  source 1..18: mol_type = other DNA
taataaaactcaatacag

SEQ ID NO: 19924 - DNA, 18 bp, synthetic construct
  source 1..18: mol_type = other DNA
taataaaactcactccag

SEQ ID NO: 19925 - DNA, 18 bp, synthetic construct
  source 1..18: mol_type = other DNA
taataaaactctctatcg

SEQ ID NO: 19926 - DNA, 18 bp, synthetic construct
  source 1..18: mol_type = other DNA
taataaaattcaatatag

SEQ ID NO: 19927 - DNA, 18 bp, synthetic construct
  source 1..18: mol_type = other DNA
taataacactcacattag

SEQ ID NO: 19928 - DNA, 18 bp, synthetic construct
  source 1..18: mol_type = other DNA
taataacactcagaatag

SEQ ID NO: 19929 - DNA, 18 bp, synthetic construct
  source 1..18: mol_type = other DNA
taataagaatctctgtag

SEQ ID NO: 19930 - DNA, 18 bp, synthetic construct
  source 1..18: mol_type = other DNA
taataagacgcccaatag

SEQ ID NO: 19931 - DNA, 18 bp, synthetic construct
  source 1..18: mol_type = other DNA
taataagactatctgtag

SEQ ID NO: 19932 - DNA, 18 bp, synthetic construct
  source 1..18: mol_type = other DNA
taataagactcagttcag

SEQ ID NO: 19933 - DNA, 18 bp, synthetic construct
  source 1..18: mol_type = other DNA
taataagacttcctatgg

SEQ ID NO: 19934 - DNA, 18 bp, synthetic construct
  source 1..18: mol_type = other DNA
taataagagtcacaaaag

SEQ ID NO: 19935 - DNA, 18 bp, synthetic construct
  source 1..18: mol_type = other DNA
taataagattaactacag

SEQ ID NO: 19936 - DNA, 18 bp, synthetic construct
  source 1..18: mol_type = other DNA
taataagattttctatag

SEQ ID NO: 19937 - DNA, 18 bp, synthetic construct
  source 1..18: mol_type = other DNA
taataagcatcaatatag

SEQ ID NO: 19938 - DNA, 18 bp, synthetic construct
  source 1..18: mol_type = other DNA
taataagccacactatcg

SEQ ID NO: 19939 - DNA, 18 bp, synthetic construct
  source 1..18: mol_type = other DNA
taataagccgccctatag

SEQ ID NO: 19940 - DNA, 18 bp, synthetic construct
  source 1..18: mol_type = other DNA
taataagcctcaatatcg

SEQ ID NO: 19941 - DNA, 18 bp, synthetic construct
  source 1..18: mol_type = other DNA
taataaggcacactatcg

SEQ ID NO: 19942 - DNA, 18 bp, synthetic construct
  source 1..18: mol_type = other DNA
taataaggctcaccatcg

SEQ ID NO: 19943 - DNA, 18 bp, synthetic construct
  source 1..18: mol_type = other DNA
taataaggctcactgtcg

SEQ ID NO: 19944 - DNA, 18 bp, synthetic construct
  source 1..18: mol_type = other DNA
taataaggctgaccatag

SEQ ID NO: 19945 - DNA, 18 bp, synthetic construct
  source 1..18: mol_type = other DNA
taataagtatcactatcg

SEQ ID NO: 19946 - DNA, 18 bp, synthetic construct
  source 1..18: mol_type = other DNA
taataagtctcaccatcg

SEQ ID NO: 19947 - DNA, 18 bp, synthetic construct
  source 1..18: mol_type = other DNA
taataagtctctctctag

SEQ ID NO: 19948 - DNA, 18 bp, synthetic construct
  source 1..18: mol_type = other DNA
taataagtctgtctatag

SEQ ID NO: 19949 - DNA, 18 bp, synthetic construct
  source 1..18: mol_type = other DNA
taatacaaaacactctag

SEQ ID NO: 19950 - DNA, 18 bp, synthetic construct
  source 1..18: mol_type = other DNA
taatacaacaccctttag

SEQ ID NO: 19951 - DNA, 18 bp, synthetic construct
  source 1..18: mol_type = other DNA
taatacaacctacaatag

SEQ ID NO: 19952 - DNA, 18 bp, synthetic construct
  source 1..18: mol_type = other DNA
taatacaactaactaacg

SEQ ID NO: 19953 - DNA, 18 bp, synthetic construct
  source 1..18: mol_type = other DNA
taatacaactcaacttag

SEQ ID NO: 19954 - DNA, 18 bp, synthetic construct
  source 1..18: mol_type = other DNA
taatacaactcactcagg

SEQ ID NO: 19955 - DNA, 18 bp, synthetic construct
  source 1..18: mol_type = other DNA
taatacaactctatacag

SEQ ID NO: 19956 - DNA, 18 bp, synthetic construct
  source 1..18: mol_type = other DNA
taatacaactctctgtcg

SEQ ID NO: 19957 - DNA, 18 bp, synthetic construct
  source 1..18: mol_type = other DNA
taatacaactcttcatag

SEQ ID NO: 19958 - DNA, 18 bp, synthetic construct
  source 1..18: mol_type = other DNA
taatacaagtaactatgg

SEQ ID NO: 19959 - DNA, 18 bp, synthetic construct
  source 1..18: mol_type = other DNA
taatacagatcactatcg

SEQ ID NO: 19960 - DNA, 18 bp, synthetic construct
  source 1..18: mol_type = other DNA
taatacatgtctctatag

SEQ ID NO: 19961 - DNA, 18 bp, synthetic construct
  source 1..18: mol_type = other DNA
taataccaataactacag

SEQ ID NO: 19962 - DNA, 18 bp, synthetic construct
  source 1..18: mol_type = other DNA
taataccaatcacttaag

SEQ ID NO: 19963 - DNA, 18 bp, synthetic construct
  source 1..18: mol_type = other DNA
taataccacaaactctag

SEQ ID NO: 19964 - DNA, 18 bp, synthetic construct
  source 1..18: mol_type = other DNA
taataccacacacaatcg

SEQ ID NO: 19965 - DNA, 18 bp, synthetic construct
  source 1..18: mol_type = other DNA
taataccaccctcaatag

SEQ ID NO: 19966 - DNA, 18 bp, synthetic construct
  source 1..18: mol_type = other DNA
taataccaggcaccatag

SEQ ID NO: 19967 - DNA, 18 bp, synthetic construct
  source 1..18: mol_type = other DNA
taataccatttactaaag

SEQ ID NO: 19968 - DNA, 18 bp, synthetic construct
  source 1..18: mol_type = other DNA
taatacccatcactatcg

SEQ ID NO: 19969 - DNA, 18 bp, synthetic construct
  source 1..18: mol_type = other DNA
taataccgctcacattag

SEQ ID NO: 19970 - DNA, 18 bp, synthetic construct
  source 1..18: mol_type = other DNA
taatacctccccctatag

SEQ ID NO: 19971 - DNA, 18 bp, synthetic construct
  source 1..18: mol_type = other DNA
taatacgaaaaactatgg

SEQ ID NO: 19972 - DNA, 18 bp, synthetic construct
  source 1..18: mol_type = other DNA
taatacgaaggcctatag

SEQ ID NO: 19973 - DNA, 18 bp, synthetic construct
  source 1..18: mol_type = other DNA
taatacgaataacaatcg

SEQ ID NO: 19974 - DNA, 18 bp, synthetic construct
  source 1..18: mol_type = other DNA
taatacgaataactccag

SEQ ID NO: 19975 - DNA, 18 bp, synthetic construct
  source 1..18: mol_type = other DNA
taatacgaatacctttag

SEQ ID NO: 19976 - DNA, 18 bp, synthetic construct
  source 1..18: mol_type = other DNA
taatacgacaaacaatgg

SEQ ID NO: 19977 - DNA, 18 bp, synthetic construct
  source 1..18: mol_type = other DNA
taatacgacaaactaagg

SEQ ID NO: 19978 - DNA, 18 bp, synthetic construct
  source 1..18: mol_type = other DNA
taatacgacaaactacgg

SEQ ID NO: 19979 - DNA, 18 bp, synthetic construct
  source 1..18: mol_type = other DNA
taatacgacaaactctgg

SEQ ID NO: 19980 - DNA, 18 bp, synthetic construct
  source 1..18: mol_type = other DNA
taatacgacaaattgtag

SEQ ID NO: 19981 - DNA, 18 bp, synthetic construct
  source 1..18: mol_type = other DNA
taatacgacacaaactag

SEQ ID NO: 19982 - DNA, 18 bp, synthetic construct
  source 1..18: mol_type = other DNA
taatacgacacactcgcg

SEQ ID NO: 19983 - DNA, 18 bp, synthetic construct
  source 1..18: mol_type = other DNA
taatacgacacactttgc

SEQ ID NO: 19984 - DNA, 18 bp, synthetic construct
  source 1..18: mol_type = other DNA
taatacgacccaccaagg

SEQ ID NO: 19985 - DNA, 18 bp, synthetic construct
  source 1..18: mol_type = other DNA
taatacgacccacttagg

SEQ ID NO: 19986 - DNA, 18 bp, synthetic construct
  source 1..18: mol_type = other DNA
taatacgacccatcaaag

SEQ ID NO: 19987 - DNA, 18 bp, synthetic construct
  source 1..18: mol_type = other DNA
taatacgaccctcactag

SEQ ID NO: 19988 - DNA, 18 bp, synthetic construct
  source 1..18: mol_type = other DNA
taatacgacctaatttag

SEQ ID NO: 19989 - DNA, 18 bp, synthetic construct
  source 1..18: mol_type = other DNA
taatacgacctatcatag

SEQ ID NO: 19990 - DNA, 18 bp, synthetic construct
  source 1..18: mol_type = other DNA
taatacgacgaattgtag

SEQ ID NO: 19991 - DNA, 18 bp, synthetic construct
  source 1..18: mol_type = other DNA
taatacgactaaatatca

SEQ ID NO: 19992 - DNA, 18 bp, synthetic construct
  source 1..18: mol_type = other DNA
taatacgactaaatccag

SEQ ID NO: 19993 - DNA, 18 bp, synthetic construct
  source 1..18: mol_type = other DNA
taatacgactaaccttgg

SEQ ID NO: 19994 - DNA, 18 bp, synthetic construct
  source 1..18: mol_type = other DNA
taatacgactctcatcag

SEQ ID NO: 19995 - DNA, 18 bp, synthetic construct
  source 1..18: mol_type = other DNA
taatacgactctctcacg

SEQ ID NO: 19996 - DNA, 18 bp, synthetic construct
  source 1..18: mol_type = other DNA
taatacgactgtcattag

SEQ ID NO: 19997 - DNA, 18 bp, synthetic construct
  source 1..18: mol_type = other DNA
taatacgacttacctcag

SEQ ID NO: 19998 - DNA, 18 bp, synthetic construct
  source 1..18: mol_type = other DNA
taatacgacttagagtag

SEQ ID NO: 19999 - DNA, 18 bp, synthetic construct
  source 1..18: mol_type = other DNA
taatacgacttataaaag

SEQ ID NO: 20000 - DNA, 18 bp, synthetic construct
  source 1..18: mol_type = other DNA
taatacgagacattatgg

SEQ ID NO: 20001 - DNA, 18 bp, synthetic construct
  source 1..18: mol_type = other DNA
taatacgagtcaaactag

SEQ ID NO: 20002 - DNA, 18 bp, synthetic construct
  source 1..18: mol_type = other DNA
taatacgagtctctgtgg

SEQ ID NO: 20003 - DNA, 18 bp, synthetic construct
  source 1..18: mol_type = other DNA
taatacgatacactgaag

SEQ ID NO: 20004 - DNA, 18 bp, synthetic construct
  source 1..18: mol_type = other DNA
taatacgatgcacaaaag

SEQ ID NO: 20005 - DNA, 18 bp, synthetic construct
  source 1..18: mol_type = other DNA
taatacgatgcaccttag

SEQ ID NO: 20006 - DNA, 18 bp, synthetic construct
  source 1..18: mol_type = other DNA
taatacgattaacaataa

SEQ ID NO: 20007 - DNA, 18 bp, synthetic construct
  source 1..18: mol_type = other DNA
taatacgattaaccataa

SEQ ID NO: 20008 - DNA, 18 bp, synthetic construct
  source 1..18: mol_type = other DNA
taatacgattaattatgg

SEQ ID NO: 20009 - DNA, 18 bp, synthetic construct
  source 1..18: mol_type = other DNA
taatacgattcacaaggg

SEQ ID NO: 20010 - DNA, 18 bp, synthetic construct
  source 1..18: mol_type = other DNA
taatacgattcacctcag

SEQ ID NO: 20011 - DNA, 18 bp, synthetic construct
  source 1..18: mol_type = other DNA
taatacgattcatcctag

SEQ ID NO: 20012 - DNA, 18 bp, synthetic construct
  source 1..18: mol_type = other DNA
taatacgattcattttcg

SEQ ID NO: 20013 - DNA, 18 bp, synthetic construct
  source 1..18: mol_type = other DNA
taatacgattctctgaag

SEQ ID NO: 20014 - DNA, 18 bp, synthetic construct
  source 1..18: mol_type = other DNA
taatacgattgattagag

SEQ ID NO: 20015 - DNA, 18 bp, synthetic construct
  source 1..18: mol_type = other DNA
taatacgccgcaccttag

SEQ ID NO: 20016 - DNA, 18 bp, synthetic construct
  source 1..18: mol_type = other DNA
taatacgcctaacagtag

SEQ ID NO: 20017 - DNA, 18 bp, synthetic construct
  source 1..18: mol_type = other DNA
taatacgcctcactcacg

SEQ ID NO: 20018 - DNA, 18 bp, synthetic construct
  source 1..18: mol_type = other DNA
taatacgccttattaaag

SEQ ID NO: 20019 - DNA, 18 bp, synthetic construct
  source 1..18: mol_type = other DNA
taatacggcacattacag

SEQ ID NO: 20020 - DNA, 18 bp, synthetic construct
  source 1..18: mol_type = other DNA
taatacggcagtctatag

SEQ ID NO: 20021 - DNA, 18 bp, synthetic construct
  source 1..18: mol_type = other DNA
taatacggttatctatag

SEQ ID NO: 20022 - DNA, 18 bp, synthetic construct
  source 1..18: mol_type = other DNA
taatacggttccctaaag

SEQ ID NO: 20023 - DNA, 18 bp, synthetic construct
  source 1..18: mol_type = other DNA
taatacgtatccctctag

SEQ ID NO: 20024 - DNA, 18 bp, synthetic construct
  source 1..18: mol_type = other DNA
taatacgtatccctgtag

SEQ ID NO: 20025 - DNA, 18 bp, synthetic construct
  source 1..18: mol_type = other DNA
taatacgtcaaacgatag

SEQ ID NO: 20026 - DNA, 18 bp, synthetic construct
  source 1..18: mol_type = other DNA
taatacgtccctatatag

SEQ ID NO: 20027 - DNA, 18 bp, synthetic construct
  source 1..18: mol_type = other DNA
taatacgtccctcaatag

SEQ ID NO: 20028 - DNA, 18 bp, synthetic construct
  source 1..18: mol_type = other DNA
taatacgtcgcaccttag

SEQ ID NO: 20029 - DNA, 18 bp, synthetic construct
  source 1..18: mol_type = other DNA
taatacgtctaactaagg

SEQ ID NO: 20030 - DNA, 18 bp, synthetic construct
  source 1..18: mol_type = other DNA
taatacgtctcagtccag

SEQ ID NO: 20031 - DNA, 18 bp, synthetic construct
  source 1..18: mol_type = other DNA
taatacgtctctctaagg

SEQ ID NO: 20032 - DNA, 18 bp, synthetic construct
  source 1..18: mol_type = other DNA
taatacgtgttaatatag

SEQ ID NO: 20033 - DNA, 18 bp, synthetic construct
  source 1..18: mol_type = other DNA
taatactaatcaatctag

SEQ ID NO: 20034 - DNA, 18 bp, synthetic construct
  source 1..18: mol_type = other DNA
taatactacagactttag

SEQ ID NO: 20035 - DNA, 18 bp, synthetic construct
  source 1..18: mol_type = other DNA
taatactactctcgacag

SEQ ID NO: 20036 - DNA, 18 bp, synthetic construct
  source 1..18: mol_type = other DNA
taatactactgcctaaag

SEQ ID NO: 20037 - DNA, 18 bp, synthetic construct
  source 1..18: mol_type = other DNA
taatactacttcatatag

SEQ ID NO: 20038 - DNA, 18 bp, synthetic construct
  source 1..18: mol_type = other DNA
taatactatccattatag

SEQ ID NO: 20039 - DNA, 18 bp, synthetic construct
  source 1..18: mol_type = other DNA
taatactattcactttcg

SEQ ID NO: 20040 - DNA, 18 bp, synthetic construct
  source 1..18: mol_type = other DNA
taatactatttagtatag

SEQ ID NO: 20041 - DNA, 18 bp, synthetic construct
  source 1..18: mol_type = other DNA
taatactcatcactaaag

SEQ ID NO: 20042 - DNA, 18 bp, synthetic construct
  source 1..18: mol_type = other DNA
taatactcctcacaatcg

SEQ ID NO: 20043 - DNA, 18 bp, synthetic construct
  source 1..18: mol_type = other DNA
taatactgcacactacag

SEQ ID NO: 20044 - DNA, 18 bp, synthetic construct
  source 1..18: mol_type = other DNA
taatactgctctctaaag

SEQ ID NO: 20045 - DNA, 18 bp, synthetic construct
  source 1..18: mol_type = other DNA
taatacttcgtactatag

SEQ ID NO: 20046 - DNA, 18 bp, synthetic construct
  source 1..18: mol_type = other DNA
taatacttctcccaatag

SEQ ID NO: 20047 - DNA, 18 bp, synthetic construct
  source 1..18: mol_type = other DNA
taatacttcttactaaag

SEQ ID NO: 20048 - DNA, 18 bp, synthetic construct
  source 1..18: mol_type = other DNA
taatacttgtcacaatag

SEQ ID NO: 20049 - DNA, 18 bp, synthetic construct
  source 1..18: mol_type = other DNA
taatagaactcacagtag

SEQ ID NO: 20050 - DNA, 18 bp, synthetic construct
  source 1..18: mol_type = other DNA
taatagaactcacttcag

SEQ ID NO: 20051 - DNA, 18 bp, synthetic construct
  source 1..18: mol_type = other DNA
taatagcactcagtttag

SEQ ID NO: 20052 - DNA, 18 bp, synthetic construct
  source 1..18: mol_type = other DNA
taataggaatcaatatcg

SEQ ID NO: 20053 - DNA, 18 bp, synthetic construct
  source 1..18: mol_type = other DNA
taataggactcaacttag

SEQ ID NO: 20054 - DNA, 18 bp, synthetic construct
  source 1..18: mol_type = other DNA
taataggccccactatgg

SEQ ID NO: 20055 - DNA, 18 bp, synthetic construct
  source 1..18: mol_type = other DNA
taataggcttcacaatag

SEQ ID NO: 20056 - DNA, 18 bp, synthetic construct
  source 1..18: mol_type = other DNA
taatagggatcactaaag

SEQ ID NO: 20057 - DNA, 18 bp, synthetic construct
  source 1..18: mol_type = other DNA
taatagggctaaatatag

SEQ ID NO: 20058 - DNA, 18 bp, synthetic construct
  source 1..18: mol_type = other DNA
taataggtctcattacag

SEQ ID NO: 20059 - DNA, 18 bp, synthetic construct
  source 1..18: mol_type = other DNA
taataggtctctctacag

SEQ ID NO: 20060 - DNA, 18 bp, synthetic construct
  source 1..18: mol_type = other DNA
taatagtattcactaaag

SEQ ID NO: 20061 - DNA, 18 bp, synthetic construct
  source 1..18: mol_type = other DNA
taatagtgctcattatag

SEQ ID NO: 20062 - DNA, 18 bp, synthetic construct
  source 1..18: mol_type = other DNA
taatataacacactgtag

SEQ ID NO: 20063 - DNA, 18 bp, synthetic construct
  source 1..18: mol_type = other DNA
taatataacccactaaag

SEQ ID NO: 20064 - DNA, 18 bp, synthetic construct
  source 1..18: mol_type = other DNA
taatatcactaactaaag

SEQ ID NO: 20065 - DNA, 18 bp, synthetic construct
  source 1..18: mol_type = other DNA
taatatgaataactagag

SEQ ID NO: 20066 - DNA, 18 bp, synthetic construct
  source 1..18: mol_type = other DNA
taatatgaatcaccaaag

SEQ ID NO: 20067 - DNA, 18 bp, synthetic construct
  source 1..18: mol_type = other DNA
taatatgacaaacgatag

SEQ ID NO: 20068 - DNA, 18 bp, synthetic construct
  source 1..18: mol_type = other DNA
taatatgacgcataatag

SEQ ID NO: 20069 - DNA, 18 bp, synthetic construct
  source 1..18: mol_type = other DNA
taatatgacgttctatag

SEQ ID NO: 20070 - DNA, 18 bp, synthetic construct
  source 1..18: mol_type = other DNA
taatatgactctatacag

SEQ ID NO: 20071 - DNA, 18 bp, synthetic construct
  source 1..18: mol_type = other DNA
taatatgaggctctatag

SEQ ID NO: 20072 - DNA, 18 bp, synthetic construct
  source 1..18: mol_type = other DNA
taatatgattaagtatag

SEQ ID NO: 20073 - DNA, 18 bp, synthetic construct
  source 1..18: mol_type = other DNA
taatatgcttcactatac

SEQ ID NO: 20074 - DNA, 18 bp, synthetic construct
  source 1..18: mol_type = other DNA
taatatgtatcactatcg

SEQ ID NO: 20075 - DNA, 18 bp, synthetic construct
  source 1..18: mol_type = other DNA
taatatgtctaactacag

SEQ ID NO: 20076 - DNA, 18 bp, synthetic construct
  source 1..18: mol_type = other DNA
taatatgtctcaccgtag

SEQ ID NO: 20077 - DNA, 18 bp, synthetic construct
  source 1..18: mol_type = other DNA
taatattacccaccatag

SEQ ID NO: 20078 - DNA, 18 bp, synthetic construct
  source 1..18: mol_type = other DNA
taatattactcaccatgg

SEQ ID NO: 20079 - DNA, 18 bp, synthetic construct
  source 1..18: mol_type = other DNA
taatattactcacttgag

SEQ ID NO: 20080 - DNA, 18 bp, synthetic construct
  source 1..18: mol_type = other DNA
taatcacactcactaaag

SEQ ID NO: 20081 - DNA, 18 bp, synthetic construct
  source 1..18: mol_type = other DNA
taatcagaataactatag

SEQ ID NO: 20082 - DNA, 18 bp, synthetic construct
  source 1..18: mol_type = other DNA
taatcagtttcactatag

SEQ ID NO: 20083 - DNA, 18 bp, synthetic construct
  source 1..18: mol_type = other DNA
taatccaaatgactatag

SEQ ID NO: 20084 - DNA, 18 bp, synthetic construct
  source 1..18: mol_type = other DNA
taatccaacttactagag

SEQ ID NO: 20085 - DNA, 18 bp, synthetic construct
  source 1..18: mol_type = other DNA
taatcccactacctatag

SEQ ID NO: 20086 - DNA, 18 bp, synthetic construct
  source 1..18: mol_type = other DNA
taatcccactgactatcg

SEQ ID NO: 20087 - DNA, 18 bp, synthetic construct
  source 1..18: mol_type = other DNA
taatcccatttactatag

SEQ ID NO: 20088 - DNA, 18 bp, synthetic construct
  source 1..18: mol_type = other DNA
taatcccgcacactatag

SEQ ID NO: 20089 - DNA, 18 bp, synthetic construct
  source 1..18: mol_type = other DNA
taatccgaatcaataaag

SEQ ID NO: 20090 - DNA, 18 bp, synthetic construct
  source 1..18: mol_type = other DNA
taatccgacacaatatcg

SEQ ID NO: 20091 - DNA, 18 bp, synthetic construct
  source 1..18: mol_type = other DNA
taatccgacactctgtag

SEQ ID NO: 20092 - DNA, 18 bp, synthetic construct
  source 1..18: mol_type = other DNA
taatccgaggcactaaag

SEQ ID NO: 20093 - DNA, 18 bp, synthetic construct
  source 1..18: mol_type = other DNA
taatccgattcccaatag

SEQ ID NO: 20094 - DNA, 18 bp, synthetic construct
  source 1..18: mol_type = other DNA
taatccgcctgagtatag

SEQ ID NO: 20095 - DNA, 18 bp, synthetic construct
  source 1..18: mol_type = other DNA
taatccgtctcacaatcg

SEQ ID NO: 20096 - DNA, 18 bp, synthetic construct
  source 1..18: mol_type = other DNA
taatcctacacacgatag

SEQ ID NO: 20097 - DNA, 18 bp, synthetic construct
  source 1..18: mol_type = other DNA
taatcgtactcaccatag

SEQ ID NO: 20098 - DNA, 18 bp, synthetic construct
  source 1..18: mol_type = other DNA
taatctcactcactctag

SEQ ID NO: 20099 - DNA, 18 bp, synthetic construct
  source 1..18: mol_type = other DNA
taatctgactcaatttag

SEQ ID NO: 20100 - DNA, 18 bp, synthetic construct
  source 1..18: mol_type = other DNA
taatctgactcagcatag

SEQ ID NO: 20101 - DNA, 18 bp, synthetic construct
  source 1..18: mol_type = other DNA
taatctgattcactctag

SEQ ID NO: 20102 - DNA, 18 bp, synthetic construct
  source 1..18: mol_type = other DNA
taatgaaactcactaaag

SEQ ID NO: 20103 - DNA, 18 bp, synthetic construct
  source 1..18: mol_type = other DNA
taatgaacctcactatag

SEQ ID NO: 20104 - DNA, 18 bp, synthetic construct
  source 1..18: mol_type = other DNA
taatgagaaccactatag

SEQ ID NO: 20105 - DNA, 18 bp, synthetic construct
  source 1..18: mol_type = other DNA
taatgagacacactatgg

SEQ ID NO: 20106 - DNA, 18 bp, synthetic construct
  source 1..18: mol_type = other DNA
taatgagtctcactacag

SEQ ID NO: 20107 - DNA, 18 bp, synthetic construct
  source 1..18: mol_type = other DNA
taatgatactcactatcg

SEQ ID NO: 20108 - DNA, 18 bp, synthetic construct
  source 1..18: mol_type = other DNA
taatgcaacatactatag

SEQ ID NO: 20109 - DNA, 18 bp, synthetic construct
  source 1..18: mol_type = other DNA
taatgcaacccacaatag

SEQ ID NO: 20110 - DNA, 18 bp, synthetic construct
  source 1..18: mol_type = other DNA
taatgcaacttattatag

SEQ ID NO: 20111 - DNA, 18 bp, synthetic construct
  source 1..18: mol_type = other DNA
taatgcgaatcacaacag

SEQ ID NO: 20112 - DNA, 18 bp, synthetic construct
  source 1..18: mol_type = other DNA
taatgcgactaacaagag

SEQ ID NO: 20113 - DNA, 18 bp, synthetic construct
  source 1..18: mol_type = other DNA
taatgcgactaactaccg

SEQ ID NO: 20114 - DNA, 18 bp, synthetic construct
  source 1..18: mol_type = other DNA
taatgcgactcatgttag

SEQ ID NO: 20115 - DNA, 18 bp, synthetic construct
  source 1..18: mol_type = other DNA
taatgcgacttaaaatag

SEQ ID NO: 20116 - DNA, 18 bp, synthetic construct
  source 1..18: mol_type = other DNA
taatgcgattcactacgg

SEQ ID NO: 20117 - DNA, 18 bp, synthetic construct
  source 1..18: mol_type = other DNA
taatgcgccgcacgatag

SEQ ID NO: 20118 - DNA, 18 bp, synthetic construct
  source 1..18: mol_type = other DNA
taatgcgccgcagtatag

SEQ ID NO: 20119 - DNA, 18 bp, synthetic construct
  source 1..18: mol_type = other DNA
taatgggaccaactatag

SEQ ID NO: 20120 - DNA, 18 bp, synthetic construct
  source 1..18: mol_type = other DNA
tacaacgactcacgaaag

SEQ ID NO: 20121 - DNA, 18 bp, synthetic construct
  source 1..18: mol_type = other DNA
tacaacgactcacgctag

SEQ ID NO: 20122 - DNA, 18 bp, synthetic construct
  source 1..18: mol_type = other DNA
taccacgacatactatag

SEQ ID NO: 20123 - DNA, 18 bp, synthetic construct
  source 1..18: mol_type = other DNA
taccatgactcacaatag

SEQ ID NO: 20124 - DNA, 18 bp, synthetic construct
  source 1..18: mol_type = other DNA
tacggcgactccctatag

SEQ ID NO: 20125 - DNA, 18 bp, synthetic construct
  source 1..18: mol_type = other DNA
tactaagactcataatag

SEQ ID NO: 20126 - DNA, 18 bp, synthetic construct
  source 1..18: mol_type = other DNA
tactacatctaactatag

SEQ ID NO: 20127 - DNA, 18 bp, synthetic construct
  source 1..18: mol_type = other DNA
tactaccactcactttgg

SEQ ID NO: 20128 - DNA, 18 bp, synthetic construct
  source 1..18: mol_type = other DNA
tactacgaatgactaaag

SEQ ID NO: 20129 - DNA, 18 bp, synthetic construct
  source 1..18: mol_type = other DNA
tactacgacgtaatatag

SEQ ID NO: 20130 - DNA, 18 bp, synthetic construct
  source 1..18: mol_type = other DNA
tactacgactcaatcaag

SEQ ID NO: 20131 - DNA, 18 bp, synthetic construct
  source 1..18: mol_type = other DNA
tactacgattcactccag

SEQ ID NO: 20132 - DNA, 18 bp, synthetic construct
  source 1..18: mol_type = other DNA
tactacgccggactatag

SEQ ID NO: 20133 - DNA, 18 bp, synthetic construct
  source 1..18: mol_type = other DNA
tactacgcttgactatag

SEQ ID NO: 20134 - DNA, 18 bp, synthetic construct
  source 1..18: mol_type = other DNA
tactacgtcacattatag

SEQ ID NO: 20135 - DNA, 18 bp, synthetic construct
  source 1..18: mol_type = other DNA
tactactactcactgaag

SEQ ID NO: 20136 - DNA, 18 bp, synthetic construct
  source 1..18: mol_type = other DNA
tactactacttagtatag

SEQ ID NO: 20137 - DNA, 18 bp, synthetic construct
  source 1..18: mol_type = other DNA
tactactagtccctatag

SEQ ID NO: 20138 - DNA, 18 bp, synthetic construct
  source 1..18: mol_type = other DNA
tactaggactctttatag

SEQ ID NO: 20139 - DNA, 18 bp, synthetic construct
  source 1..18: mol_type = other DNA
tactatgactcagtttag

SEQ ID NO: 20140 - DNA, 18 bp, synthetic construct
  source 1..18: mol_type = other DNA
tactatgactgcctatag

SEQ ID NO: 20141 - DNA, 18 bp, synthetic construct
  source 1..18: mol_type = other DNA
tactatggctcactttag

SEQ ID NO: 20142 - DNA, 18 bp, synthetic construct
  source 1..18: mol_type = other DNA
tactatgtctcacaatag

SEQ ID NO: 20143 - DNA, 18 bp, synthetic construct
  source 1..18: mol_type = other DNA
tactccaactctctatag

SEQ ID NO: 20144 - DNA, 18 bp, synthetic construct
  source 1..18: mol_type = other DNA
tactgcgactcactaacg

SEQ ID NO: 20145 - DNA, 18 bp, synthetic construct
  source 1..18: mol_type = other DNA
tactgctacttactatag

SEQ ID NO: 20146 - DNA, 18 bp, synthetic construct
  source 1..18: mol_type = other DNA
tagcaccactcaatatag

SEQ ID NO: 20147 - DNA, 18 bp, synthetic construct
  source 1..18: mol_type = other DNA
tagcacgacgcactaaag

SEQ ID NO: 20148 - DNA, 18 bp, synthetic construct
  source 1..18: mol_type = other DNA
tagcacggctcaccatag

SEQ ID NO: 20149 - DNA, 18 bp, synthetic construct
  source 1..18: mol_type = other DNA
taggacgactcactcaag

SEQ ID NO: 20150 - DNA, 18 bp, synthetic construct
  source 1..18: mol_type = other DNA
taggacgattcactttag

SEQ ID NO: 20151 - DNA, 18 bp, synthetic construct
  source 1..18: mol_type = other DNA
tagtaagactcattaaag

SEQ ID NO: 20152 - DNA, 18 bp, synthetic construct
  source 1..18: mol_type = other DNA
tagtaagattcactttag

SEQ ID NO: 20153 - DNA, 18 bp, synthetic construct
  source 1..18: mol_type = other DNA
tagtacaacacaatatag

SEQ ID NO: 20154 - DNA, 18 bp, synthetic construct
  source 1..18: mol_type = other DNA
tagtacaactgaatatag

SEQ ID NO: 20155 - DNA, 18 bp, synthetic construct
  source 1..18: mol_type = other DNA
tagtacatctcaatatag

SEQ ID NO: 20156 - DNA, 18 bp, synthetic construct
  source 1..18: mol_type = other DNA
tagtaccacccactaaag

SEQ ID NO: 20157 - DNA, 18 bp, synthetic construct
  source 1..18: mol_type = other DNA
tagtacgaagccctatag

SEQ ID NO: 20158 - DNA, 18 bp, synthetic construct
  source 1..18: mol_type = other DNA
tagtacgacacaccaaag

SEQ ID NO: 20159 - DNA, 18 bp, synthetic construct
  source 1..18: mol_type = other DNA
tagtacgacacagtatcg

SEQ ID NO: 20160 - DNA, 18 bp, synthetic construct
  source 1..18: mol_type = other DNA
tagtacgacccacaaaag

SEQ ID NO: 20161 - DNA, 18 bp, synthetic construct
  source 1..18: mol_type = other DNA
tagtacgacctaatatag

SEQ ID NO: 20162 - DNA, 18 bp, synthetic construct
  source 1..18: mol_type = other DNA
tagtacgactaagtacag

SEQ ID NO: 20163 - DNA, 18 bp, synthetic construct
  source 1..18: mol_type = other DNA
tagtacgactaattacag

SEQ ID NO: 20164 - DNA, 18 bp, synthetic construct
  source 1..18: mol_type = other DNA
tagtacgactcactgagg

SEQ ID NO: 20165 - DNA, 18 bp, synthetic construct
  source 1..18: mol_type = other DNA
tagtacgactcccttcag

SEQ ID NO: 20166 - DNA, 18 bp, synthetic construct
  source 1..18: mol_type = other DNA
tagtacgatacactctag

SEQ ID NO: 20167 - DNA, 18 bp, synthetic construct
  source 1..18: mol_type = other DNA
tagtacgatacattatag

SEQ ID NO: 20168 - DNA, 18 bp, synthetic construct
  source 1..18: mol_type = other DNA
tagtacgatttagtatag

SEQ ID NO: 20169 - DNA, 18 bp, synthetic construct
  source 1..18: mol_type = other DNA
tagtacgtgtcactttag

SEQ ID NO: 20170 - DNA, 18 bp, synthetic construct
  source 1..18: mol_type = other DNA
tagtacttctcactatcg

SEQ ID NO: 20171 - DNA, 18 bp, synthetic construct
  source 1..18: mol_type = other DNA
tagtataactcaatatag

SEQ ID NO: 20172 - DNA, 18 bp, synthetic construct
  source 1..18: mol_type = other DNA
tagtatgactcagaatag

SEQ ID NO: 20173 - DNA, 18 bp, synthetic construct
  source 1..18: mol_type = other DNA
tagtattactcacaatag

SEQ ID NO: 20174 - DNA, 18 bp, synthetic construct
  source 1..18: mol_type = other DNA
tagtgtgactctctatag

SEQ ID NO: 20175 - DNA, 18 bp, synthetic construct
  source 1..18: mol_type = other DNA
tataaccactcaccatag

SEQ ID NO: 20176 - DNA, 18 bp, synthetic construct
  source 1..18: mol_type = other DNA
tatagcgtctcactatag

SEQ ID NO: 20177 - DNA, 18 bp, synthetic construct
  source 1..18: mol_type = other DNA
tatcacaactcactaaag

SEQ ID NO: 20178 - DNA, 18 bp, synthetic construct
  source 1..18: mol_type = other DNA
tatcacgagtcactgtag

SEQ ID NO: 20179 - DNA, 18 bp, synthetic construct
  source 1..18: mol_type = other DNA
tatcacgcatcactatag

SEQ ID NO: 20180 - DNA, 18 bp, synthetic construct
  source 1..18: mol_type = other DNA
tatcatgactcaccatag

SEQ ID NO: 20181 - DNA, 18 bp, synthetic construct
  source 1..18: mol_type = other DNA
tatgaaaactcactatag

SEQ ID NO: 20182 - DNA, 18 bp, synthetic construct
  source 1..18: mol_type = other DNA
tatgaagactctctatag

SEQ ID NO: 20183 - DNA, 18 bp, synthetic construct
  source 1..18: mol_type = other DNA
tatgacgactcactgaag

SEQ ID NO: 20184 - DNA, 18 bp, synthetic construct
  source 1..18: mol_type = other DNA
tatgatgactaactatag

SEQ ID NO: 20185 - DNA, 18 bp, synthetic construct
  source 1..18: mol_type = other DNA
tattaagactcacagtag

SEQ ID NO: 20186 - DNA, 18 bp, synthetic construct
  source 1..18: mol_type = other DNA
tattaagactcattacag

SEQ ID NO: 20187 - DNA, 18 bp, synthetic construct
  source 1..18: mol_type = other DNA
tattacaactcactttgg

SEQ ID NO: 20188 - DNA, 18 bp, synthetic construct
  source 1..18: mol_type = other DNA
tattacaactcattacag

SEQ ID NO: 20189 - DNA, 18 bp, synthetic construct
  source 1..18: mol_type = other DNA
tattaccaaccactatag

SEQ ID NO: 20190 - DNA, 18 bp, synthetic construct
  source 1..18: mol_type = other DNA
tattaccaatcactagag

SEQ ID NO: 20191 - DNA, 18 bp, synthetic construct
  source 1..18: mol_type = other DNA
tattaccactaactacag

SEQ ID NO: 20192 - DNA, 18 bp, synthetic construct
  source 1..18: mol_type = other DNA
tattaccactctccatag

SEQ ID NO: 20193 - DNA, 18 bp, synthetic construct
  source 1..18: mol_type = other DNA
tattaccattcactagag

SEQ ID NO: 20194 - DNA, 18 bp, synthetic construct
  source 1..18: mol_type = other DNA
tattacgaaccaatatag

SEQ ID NO: 20195 - DNA, 18 bp, synthetic construct
  source 1..18: mol_type = other DNA
tattacgaacgactatag

SEQ ID NO: 20196 - DNA, 18 bp, synthetic construct
  source 1..18: mol_type = other DNA
tattacgacccacttcag

SEQ ID NO: 20197 - DNA, 18 bp, synthetic construct
  source 1..18: mol_type = other DNA
tattacgactgtctacag

SEQ ID NO: 20198 - DNA, 18 bp, synthetic construct
  source 1..18: mol_type = other DNA
tattacgacttacgctag

SEQ ID NO: 20199 - DNA, 18 bp, synthetic construct
  source 1..18: mol_type = other DNA
tattacgacttcctctag

SEQ ID NO: 20200 - DNA, 18 bp, synthetic construct
  source 1..18: mol_type = other DNA
tattacgagagactatag

SEQ ID NO: 20201 - DNA, 18 bp, synthetic construct
  source 1..18: mol_type = other DNA
tattacgatgcactttag

SEQ ID NO: 20202 - DNA, 18 bp, synthetic construct
  source 1..18: mol_type = other DNA
tattacgattaagtatag

SEQ ID NO: 20203 - DNA, 18 bp, synthetic construct
  source 1..18: mol_type = other DNA
tattacgatttcctatag

SEQ ID NO: 20204 - DNA, 18 bp, synthetic construct
  source 1..18: mol_type = other DNA
tattacgccacacgatag

SEQ ID NO: 20205 - DNA, 18 bp, synthetic construct
  source 1..18: mol_type = other DNA
tattacgcctcaccaaag

SEQ ID NO: 20206 - DNA, 18 bp, synthetic construct
  source 1..18: mol_type = other DNA
tattacgcctcccaatag

SEQ ID NO: 20207 - DNA, 18 bp, synthetic construct
  source 1..18: mol_type = other DNA
tattacgtcccattatag

SEQ ID NO: 20208 - DNA, 18 bp, synthetic construct
  source 1..18: mol_type = other DNA
tattacgtctcaagatag

SEQ ID NO: 20209 - DNA, 18 bp, synthetic construct
  source 1..18: mol_type = other DNA
tattactactgactttag

SEQ ID NO: 20210 - DNA, 18 bp, synthetic construct
  source 1..18: mol_type = other DNA
tattactgctcactatcg

SEQ ID NO: 20211 - DNA, 18 bp, synthetic construct
  source 1..18: mol_type = other DNA
tattagcactcaatatag

SEQ ID NO: 20212 - DNA, 18 bp, synthetic construct
  source 1..18: mol_type = other DNA
tattagcagtcactatag

SEQ ID NO: 20213 - DNA, 18 bp, synthetic construct
  source 1..18: mol_type = other DNA
tattaggactcataatag

SEQ ID NO: 20214 - DNA, 18 bp, synthetic construct
  source 1..18: mol_type = other DNA
tattaggcctcactgtag

SEQ ID NO: 20215 - DNA, 18 bp, synthetic construct
  source 1..18: mol_type = other DNA
tattattactcaatatag

SEQ ID NO: 20216 - DNA, 18 bp, synthetic construct
  source 1..18: mol_type = other DNA
tattcggactcactagag

SEQ ID NO: 20217 - DNA, 18 bp, synthetic construct
  source 1..18: mol_type = other DNA
tattgcgacacactaaag

SEQ ID NO: 20218 - DNA, 18 bp, synthetic construct
  source 1..18: mol_type = other DNA
tattgcgactcaatatgg

SEQ ID NO: 20219 - DNA, 18 bp, synthetic construct
  source 1..18: mol_type = other DNA
tattgcgactgactaaag

SEQ ID NO: 20220 - DNA, 18 bp, synthetic construct
  source 1..18: mol_type = other DNA
tattgcgagtcactacag

SEQ ID NO: 20221 - DNA, 18 bp, synthetic construct
  source 1..18: mol_type = other DNA
tattgcggctgactatag

SEQ ID NO: 20222 - DNA, 18 bp, synthetic construct
  source 1..18: mol_type = other DNA
tattgctactaactatag

SEQ ID NO: 20223 - DNA, 18 bp, synthetic construct
  source 1..18: mol_type = other DNA
tcaaaagactaactatag

SEQ ID NO: 20224 - DNA, 18 bp, synthetic construct
  source 1..18: mol_type = other DNA
tcaaacggctcactttag

SEQ ID NO: 20225 - DNA, 18 bp, synthetic construct
  source 1..18: mol_type = other DNA
tcaaactattcactatag

SEQ ID NO: 20226 - DNA, 18 bp, synthetic construct
  source 1..18: mol_type = other DNA
tcaaataactcactatag

SEQ ID NO: 20227 - DNA, 18 bp, synthetic construct
  source 1..18: mol_type = other DNA
tcagacgattcacaatag

SEQ ID NO: 20228 - DNA, 18 bp, synthetic construct
  source 1..18: mol_type = other DNA
tcataagattctctatag

SEQ ID NO: 20229 - DNA, 18 bp, synthetic construct
  source 1..18: mol_type = other DNA
tcataagcctctctatag

SEQ ID NO: 20230 - DNA, 18 bp, synthetic construct
  source 1..18: mol_type = other DNA
tcataagtctaactatag

SEQ ID NO: 20231 - DNA, 18 bp, synthetic construct
  source 1..18: mol_type = other DNA
tcataatacgcactatag

SEQ ID NO: 20232 - DNA, 18 bp, synthetic construct
  source 1..18: mol_type = other DNA
tcatacgattcaatctag

SEQ ID NO: 20233 - DNA, 18 bp, synthetic construct
  source 1..18: mol_type = other DNA
tcatacgattgactttag

SEQ ID NO: 20234 - DNA, 18 bp, synthetic construct
  source 1..18: mol_type = other DNA
tcatacgatttactatcg

SEQ ID NO: 20235 - DNA, 18 bp, synthetic construct
  source 1..18: mol_type = other DNA
tcatacgcatcagtatag

SEQ ID NO: 20236 - DNA, 18 bp, synthetic construct
  source 1..18: mol_type = other DNA
tcatacgccactctatag

SEQ ID NO: 20237 - DNA, 18 bp, synthetic construct
  source 1..18: mol_type = other DNA
tcatacggctcacagtag

SEQ ID NO: 20238 - DNA, 18 bp, synthetic construct
  source 1..18: mol_type = other DNA
tcatacgtcacactatgg

SEQ ID NO: 20239 - DNA, 18 bp, synthetic construct
  source 1..18: mol_type = other DNA
tcatactactaaatatag

SEQ ID NO: 20240 - DNA, 18 bp, synthetic construct
  source 1..18: mol_type = other DNA
tcatactattcactttag

SEQ ID NO: 20241 - DNA, 18 bp, synthetic construct
  source 1..18: mol_type = other DNA
tcatagaactctctatag

SEQ ID NO: 20242 - DNA, 18 bp, synthetic construct
  source 1..18: mol_type = other DNA
tcatataactctctatag

SEQ ID NO: 20243 - DNA, 18 bp, synthetic construct
  source 1..18: mol_type = other DNA
tcatatcactcactaaag

SEQ ID NO: 20244 - DNA, 18 bp, synthetic construct
  source 1..18: mol_type = other DNA
tcatatgactccctttag

SEQ ID NO: 20245 - DNA, 18 bp, synthetic construct
  source 1..18: mol_type = other DNA
tcatatgattcacaatag

SEQ ID NO: 20246 - DNA, 18 bp, synthetic construct
  source 1..18: mol_type = other DNA
tcatccgacacactctag

SEQ ID NO: 20247 - DNA, 18 bp, synthetic construct
  source 1..18: mol_type = other DNA
tcatgcgaatcactgtag

SEQ ID NO: 20248 - DNA, 18 bp, synthetic construct
  source 1..18: mol_type = other DNA
tcctaagactgactatag

SEQ ID NO: 20249 - DNA, 18 bp, synthetic construct
  source 1..18: mol_type = other DNA
tcctacgaatcacaatag

SEQ ID NO: 20250 - DNA, 18 bp, synthetic construct
  source 1..18: mol_type = other DNA
tcctacgactcacttaag

SEQ ID NO: 20251 - DNA, 18 bp, synthetic construct
  source 1..18: mol_type = other DNA
tcctacgactcataatag

SEQ ID NO: 20252 - DNA, 18 bp, synthetic construct
  source 1..18: mol_type = other DNA
tcctacgtctcaatatag

SEQ ID NO: 20253 - DNA, 18 bp, synthetic construct
  source 1..18: mol_type = other DNA
tcgtatgactaactatag

SEQ ID NO: 20254 - DNA, 18 bp, synthetic construct
  source 1..18: mol_type = other DNA
tcttacaactaactatag

SEQ ID NO: 20255 - DNA, 18 bp, synthetic construct
  source 1..18: mol_type = other DNA
tcttacaactcactgtag

SEQ ID NO: 20256 - DNA, 18 bp, synthetic construct
  source 1..18: mol_type = other DNA
tcttacgactcaatatcg

SEQ ID NO: 20257 - DNA, 18 bp, synthetic construct
  source 1..18: mol_type = other DNA
tcttacgactcacttgag

SEQ ID NO: 20258 - DNA, 18 bp, synthetic construct
  source 1..18: mol_type = other DNA
tcttacgcctgactatag

SEQ ID NO: 20259 - DNA, 18 bp, synthetic construct
  source 1..18: mol_type = other DNA
tgaaacaactcactacag

SEQ ID NO: 20260 - DNA, 18 bp, synthetic construct
  source 1..18: mol_type = other DNA
tgaaacgactcactgcag

SEQ ID NO: 20261 - DNA, 18 bp, synthetic construct
  source 1..18: mol_type = other DNA
tgaaacgactcagtttag

SEQ ID NO: 20262 - DNA, 18 bp, synthetic construct
  source 1..18: mol_type = other DNA
tgagaccacacactatag

SEQ ID NO: 20263 - DNA, 18 bp, synthetic construct
  source 1..18: mol_type = other DNA
tgagacgacaaactatag

SEQ ID NO: 20264 - DNA, 18 bp, synthetic construct
  source 1..18: mol_type = other DNA
tgagacgattcactaaag

SEQ ID NO: 20265 - DNA, 18 bp, synthetic construct
  source 1..18: mol_type = other DNA
tgataagactctctatgg

SEQ ID NO: 20266 - DNA, 18 bp, synthetic construct
  source 1..18: mol_type = other DNA
tgatacaactctctgtag

SEQ ID NO: 20267 - DNA, 18 bp, synthetic construct
  source 1..18: mol_type = other DNA
tgatacaatccactatag

SEQ ID NO: 20268 - DNA, 18 bp, synthetic construct
  source 1..18: mol_type = other DNA
tgataccactcaatgtag

SEQ ID NO: 20269 - DNA, 18 bp, synthetic construct
  source 1..18: mol_type = other DNA
tgatacgaattattatag

SEQ ID NO: 20270 - DNA, 18 bp, synthetic construct
  source 1..18: mol_type = other DNA
tgatacgacacaaaatag

SEQ ID NO: 20271 - DNA, 18 bp, synthetic construct
  source 1..18: mol_type = other DNA
tgatacgacacacaaaag

SEQ ID NO: 20272 - DNA, 18 bp, synthetic construct
  source 1..18: mol_type = other DNA
tgatacgacacaccctag

SEQ ID NO: 20273 - DNA, 18 bp, synthetic construct
  source 1..18: mol_type = other DNA
tgatacgactaagtctag

SEQ ID NO: 20274 - DNA, 18 bp, synthetic construct
  source 1..18: mol_type = other DNA
tgatacgactctatacag

SEQ ID NO: 20275 - DNA, 18 bp, synthetic construct
  source 1..18: mol_type = other DNA
tgatacgactctttatgg

SEQ ID NO: 20276 - DNA, 18 bp, synthetic construct
  source 1..18: mol_type = other DNA
tgatacgagtcagaatag

SEQ ID NO: 20277 - DNA, 18 bp, synthetic construct
  source 1..18: mol_type = other DNA
tgatacgattctcgatag

SEQ ID NO: 20278 - DNA, 18 bp, synthetic construct
  source 1..18: mol_type = other DNA
tgatacgcctgaatatag

SEQ ID NO: 20279 - DNA, 18 bp, synthetic construct
  source 1..18: mol_type = other DNA
tgatacggctcattatcg

SEQ ID NO: 20280 - DNA, 18 bp, synthetic construct
  source 1..18: mol_type = other DNA
tgatacgtcgctctatag

SEQ ID NO: 20281 - DNA, 18 bp, synthetic construct
  source 1..18: mol_type = other DNA
tgatacgtctcactgtgg

SEQ ID NO: 20282 - DNA, 18 bp, synthetic construct
  source 1..18: mol_type = other DNA
tgatacgtctctctgtag

SEQ ID NO: 20283 - DNA, 18 bp, synthetic construct
  source 1..18: mol_type = other DNA
tgatacgttccactatag

SEQ ID NO: 20284 - DNA, 18 bp, synthetic construct
  source 1..18: mol_type = other DNA
tgatactactaactacag

SEQ ID NO: 20285 - DNA, 18 bp, synthetic construct
  source 1..18: mol_type = other DNA
tgataggagtcaatatag

SEQ ID NO: 20286 - DNA, 18 bp, synthetic construct
  source 1..18: mol_type = other DNA
tgatagtacacactatag

SEQ ID NO: 20287 - DNA, 18 bp, synthetic construct
  source 1..18: mol_type = other DNA
tgatatgacaccctatag

SEQ ID NO: 20288 - DNA, 18 bp, synthetic construct
  source 1..18: mol_type = other DNA
tgatatgactcacaatgg

SEQ ID NO: 20289 - DNA, 18 bp, synthetic construct
  source 1..18: mol_type = other DNA
tgatatgtctcactaaag

SEQ ID NO: 20290 - DNA, 18 bp, synthetic construct
  source 1..18: mol_type = other DNA
tgatatgtctcactgtag

SEQ ID NO: 20291 - DNA, 18 bp, synthetic construct
  source 1..18: mol_type = other DNA
tgatgcgactcacttaag

SEQ ID NO: 20292 - DNA, 18 bp, synthetic construct
  source 1..18: mol_type = other DNA
tggtacgactccgtatag

SEQ ID NO: 20293 - DNA, 18 bp, synthetic construct
  source 1..18: mol_type = other DNA
tggtacgtctcactttag

SEQ ID NO: 20294 - DNA, 18 bp, synthetic construct
  source 1..18: mol_type = other DNA
tgttaagactcactacag

SEQ ID NO: 20295 - DNA, 18 bp, synthetic construct
  source 1..18: mol_type = other DNA
tgttacgactcattaaag

SEQ ID NO: 20296 - DNA, 18 bp, synthetic construct
  source 1..18: mol_type = other DNA
tgttacggctcacaatag

SEQ ID NO: 20297 - DNA, 18 bp, synthetic construct
  source 1..18: mol_type = other DNA
tgttaggactcacaatag

SEQ ID NO: 20298 - DNA, 18 bp, synthetic construct
  source 1..18: mol_type = other DNA
ttaaacgactaaccatag

SEQ ID NO: 20299 - DNA, 18 bp, synthetic construct
  source 1..18: mol_type = other DNA
ttaaacggatcactatag

SEQ ID NO: 20300 - DNA, 18 bp, synthetic construct
  source 1..18: mol_type = other DNA
ttaagctactcactatag

SEQ ID NO: 20301 - DNA, 18 bp, synthetic construct
  source 1..18: mol_type = other DNA
ttacacgacacactatgg

SEQ ID NO: 20302 - DNA, 18 bp, synthetic construct
  source 1..18: mol_type = other DNA
ttacacgactcaccaaag

SEQ ID NO: 20303 - DNA, 18 bp, synthetic construct
  source 1..18: mol_type = other DNA
ttacacggcacactatag

SEQ ID NO: 20304 - DNA, 18 bp, synthetic construct
  source 1..18: mol_type = other DNA
ttacactactcactacag

SEQ ID NO: 20305 - DNA, 18 bp, synthetic construct
  source 1..18: mol_type = other DNA
ttacccgactcactagag

SEQ ID NO: 20306 - DNA, 18 bp, synthetic construct
  source 1..18: mol_type = other DNA
ttagacaactgactatag

SEQ ID NO: 20307 - DNA, 18 bp, synthetic construct
  source 1..18: mol_type = other DNA
ttagacgattcactacag

SEQ ID NO: 20308 - DNA, 18 bp, synthetic construct
  source 1..18: mol_type = other DNA
ttagacgtatcactatag

SEQ ID NO: 20309 - DNA, 18 bp, synthetic construct
  source 1..18: mol_type = other DNA
ttataagcctcactatgg

SEQ ID NO: 20310 - DNA, 18 bp, synthetic construct
  source 1..18: mol_type = other DNA
ttataatactcactacag

SEQ ID NO: 20311 - DNA, 18 bp, synthetic construct
  source 1..18: mol_type = other DNA
ttataatactcactgtag

SEQ ID NO: 20312 - DNA, 18 bp, synthetic construct
  source 1..18: mol_type = other DNA
ttatacaactcaccgtag

SEQ ID NO: 20313 - DNA, 18 bp, synthetic construct
  source 1..18: mol_type = other DNA
ttatacaactcattgtag

SEQ ID NO: 20314 - DNA, 18 bp, synthetic construct
  source 1..18: mol_type = other DNA
ttatacagctcactatgg

SEQ ID NO: 20315 - DNA, 18 bp, synthetic construct
  source 1..18: mol_type = other DNA
ttataccacacactgtag

SEQ ID NO: 20316 - DNA, 18 bp, synthetic construct
  source 1..18: mol_type = other DNA
ttatacgaatcacagtag

SEQ ID NO: 20317 - DNA, 18 bp, synthetic construct
  source 1..18: mol_type = other DNA
ttatacgaatcattacag

SEQ ID NO: 20318 - DNA, 18 bp, synthetic construct
  source 1..18: mol_type = other DNA
ttatacgacagacaatag

SEQ ID NO: 20319 - DNA, 18 bp, synthetic construct
  source 1..18: mol_type = other DNA
ttatacgacagactctag

SEQ ID NO: 20320 - DNA, 18 bp, synthetic construct
  source 1..18: mol_type = other DNA
ttatacgactatcaatag

SEQ ID NO: 20321 - DNA, 18 bp, synthetic construct
  source 1..18: mol_type = other DNA
ttatacgactcagactag

SEQ ID NO: 20322 - DNA, 18 bp, synthetic construct
  source 1..18: mol_type = other DNA
ttatacgactctccagag

SEQ ID NO: 20323 - DNA, 18 bp, synthetic construct
  source 1..18: mol_type = other DNA
ttatacgactgacagtag

SEQ ID NO: 20324 - DNA, 18 bp, synthetic construct
  source 1..18: mol_type = other DNA
ttatacgacttactgtaa

SEQ ID NO: 20325 - DNA, 18 bp, synthetic construct
  source 1..18: mol_type = other DNA
ttatacgacttcttatag

SEQ ID NO: 20326 - DNA, 18 bp, synthetic construct
  source 1..18: mol_type = other DNA
ttatacgagctactatag

SEQ ID NO: 20327 - DNA, 18 bp, synthetic construct
  source 1..18: mol_type = other DNA
ttatacgaggcagtatag

SEQ ID NO: 20328 - DNA, 18 bp, synthetic construct
  source 1..18: mol_type = other DNA
ttatacgagtcaatatgg

SEQ ID NO: 20329 - DNA, 18 bp, synthetic construct
  source 1..18: mol_type = other DNA
ttatacgagtcactttgg

SEQ ID NO: 20330 - DNA, 18 bp, synthetic construct
  source 1..18: mol_type = other DNA
ttatacgattcaagatag

SEQ ID NO: 20331 - DNA, 18 bp, synthetic construct
  source 1..18: mol_type = other DNA
ttatacggcaccctatag

SEQ ID NO: 20332 - DNA, 18 bp, synthetic construct
  source 1..18: mol_type = other DNA
ttatacggttcattatag

SEQ ID NO: 20333 - DNA, 18 bp, synthetic construct
  source 1..18: mol_type = other DNA
ttatacgtatcactctag

SEQ ID NO: 20334 - DNA, 18 bp, synthetic construct
  source 1..18: mol_type = other DNA
ttatacgtcacactatgg

SEQ ID NO: 20335 - DNA, 18 bp, synthetic construct
  source 1..18: mol_type = other DNA
ttatactacacacgatag

SEQ ID NO: 20336 - DNA, 18 bp, synthetic construct
  source 1..18: mol_type = other DNA
ttatactacccactacag

SEQ ID NO: 20337 - DNA, 18 bp, synthetic construct
  source 1..18: mol_type = other DNA
ttatactacttcctatag

SEQ ID NO: 20338 - DNA, 18 bp, synthetic construct
  source 1..18: mol_type = other DNA
ttatagcagtcactatag

SEQ ID NO: 20339 - DNA, 18 bp, synthetic construct
  source 1..18: mol_type = other DNA
ttatagtactaactatag

SEQ ID NO: 20340 - DNA, 18 bp, synthetic construct
  source 1..18: mol_type = other DNA
ttatagtactcactatcg

SEQ ID NO: 20341 - DNA, 18 bp, synthetic construct
  source 1..18: mol_type = other DNA
ttatatgacccaatatag

SEQ ID NO: 20342 - DNA, 18 bp, synthetic construct
  source 1..18: mol_type = other DNA
ttatatgacgctctatag

SEQ ID NO: 20343 - DNA, 18 bp, synthetic construct
  source 1..18: mol_type = other DNA
ttatatgactcactttcg

SEQ ID NO: 20344 - DNA, 18 bp, synthetic construct
  source 1..18: mol_type = other DNA
ttatatgactgactacag

SEQ ID NO: 20345 - DNA, 18 bp, synthetic construct
  source 1..18: mol_type = other DNA
ttatattactcacgatag

SEQ ID NO: 20346 - DNA, 18 bp, synthetic construct
  source 1..18: mol_type = other DNA
ttatcagactcattatag

SEQ ID NO: 20347 - DNA, 18 bp, synthetic construct
  source 1..18: mol_type = other DNA
ttatcagactctctatag

SEQ ID NO: 20348 - DNA, 18 bp, synthetic construct
  source 1..18: mol_type = other DNA
ttatcccacttactatag

SEQ ID NO: 20349 - DNA, 18 bp, synthetic construct
  source 1..18: mol_type = other DNA
ttatccgactcaagatag

SEQ ID NO: 20350 - DNA, 18 bp, synthetic construct
  source 1..18: mol_type = other DNA
ttatctgaatcactatag

SEQ ID NO: 20351 - DNA, 18 bp, synthetic construct
  source 1..18: mol_type = other DNA
ttatgcaactcaatatag

SEQ ID NO: 20352 - DNA, 18 bp, synthetic construct
  source 1..18: mol_type = other DNA
ttatgcgactctctctag

SEQ ID NO: 20353 - DNA, 18 bp, synthetic construct
  source 1..18: mol_type = other DNA
ttctacacctcactatag

SEQ ID NO: 20354 - DNA, 18 bp, synthetic construct
  source 1..18: mol_type = other DNA
ttctactacccactatag

SEQ ID NO: 20355 - DNA, 18 bp, synthetic construct
  source 1..18: mol_type = other DNA
ttctgccactcactatag

SEQ ID NO: 20356 - DNA, 18 bp, synthetic construct
  source 1..18: mol_type = other DNA
ttgcacgacacactatag

SEQ ID NO: 20357 - DNA, 18 bp, synthetic construct
  source 1..18: mol_type = other DNA
ttgtacgattcactacag

SEQ ID NO: 20358 - DNA, 18 bp, synthetic construct
  source 1..18: mol_type = other DNA
ttgtacgtctcaccatag

SEQ ID NO: 20359 - DNA, 18 bp, synthetic construct
  source 1..18: mol_type = other DNA
ttgtactactcactatcg

SEQ ID NO: 20360 - DNA, 18 bp, synthetic construct
  source 1..18: mol_type = other DNA
tttaacgactcactagag

SEQ ID NO: 20361 - DNA, 18 bp, synthetic construct
  source 1..18: mol_type = other DNA
ttttaaaactcactatag

SEQ ID NO: 20362 - DNA, 18 bp, synthetic construct
  source 1..18: mol_type = other DNA
ttttatgactcactacag

SEQ ID NO: 20363 - DNA, 18 bp, synthetic construct
  source 1..18: mol_type = other DNA
ttttattactcactatag

SEQ ID NO: 20364 - DNA, 18 bp, synthetic construct
  source 1..18: mol_type = other DNA
ttttctgactcactatag

SEQ ID NO: 20365 - DNA, 18 bp, synthetic construct
  source 1..18: mol_type = other DNA
ttttgcgactcattatag

SEQ ID NO: 20366 - DNA, 18 bp, synthetic construct
  source 1..18: mol_type = other DNA
taaaacgtctcgctattg

SEQ ID NO: 20367 - DNA, 18 bp, synthetic construct
  source 1..18: mol_type = other DNA
taaatagaatcactatag

SEQ ID NO: 20368 - DNA, 18 bp, synthetic construct
  source 1..18: mol_type = other DNA
taataagcatcactattg

SEQ ID NO: 20369 - DNA, 18 bp, synthetic construct
  source 1..18: mol_type = other DNA
taatacgattcactgatg

SEQ ID NO: 20370 - DNA, 18 bp, synthetic construct
  source 1..18: mol_type = other DNA
taatgcgtctctctattg

SEQ ID NO: 20371 - DNA, 18 bp, synthetic construct
  source 1..18: mol_type = other DNA
taattaaactcaccatag

SEQ ID NO: 20372 - DNA, 18 bp, synthetic construct
  source 1..18: mol_type = other DNA
taattcaactctcgatag

SEQ ID NO: 20373 - DNA, 18 bp, synthetic construct
  source 1..18: mol_type = other DNA
taatttgactcattaaag

SEQ ID NO: 20374 - DNA, 18 bp, synthetic construct
  source 1..18: mol_type = other DNA
tatatcgagtcactatag

SEQ ID NO: 20375 - DNA, 18 bp, synthetic construct
  source 1..18: mol_type = other DNA
tcattcgactctctacag

SEQ ID NO: 20376 - DNA, 18 bp, synthetic construct
  source 1..18: mol_type = other DNA
tcgttcgactcactgtag

SEQ ID NO: 20377 - DNA, 18 bp, synthetic construct
  source 1..18: mol_type = other DNA
tgataccactcactaatg

SEQ ID NO: 20378 - DNA, 18 bp, synthetic construct
  source 1..18: mol_type = other DNA
tgattcaactcactctag

SEQ ID NO: 20379 - DNA, 18 bp, synthetic construct
  source 1..18: mol_type = other DNA
taaaacaactaaccatag

SEQ ID NO: 20380 - DNA, 18 bp, synthetic construct
  source 1..18: mol_type = other DNA
taataagactctttgtag

SEQ ID NO: 20381 - DNA, 18 bp, synthetic construct
  source 1..18: mol_type = other DNA
taataggaaactctatag

SEQ ID NO: 20382 - DNA, 18 bp, synthetic construct
  source 1..18: mol_type = other DNA
taatatgattcacaatgg

SEQ ID NO: 20383 - DNA, 18 bp, synthetic construct
  source 1..18: mol_type = other DNA
taatatggctcaataaag

SEQ ID NO: 20384 - DNA, 18 bp, synthetic construct
  source 1..18: mol_type = other DNA
tacaacgactcactaacg

SEQ ID NO: 20385 - DNA, 18 bp, synthetic construct
  source 1..18: mol_type = other DNA
tacaacgtctcaccatag

SEQ ID NO: 20386 - DNA, 18 bp, synthetic construct
  source 1..18: mol_type = other DNA
tattaccactcacaaaag

SEQ ID NO: 20387 - DNA, 18 bp, synthetic construct
  source 1..18: mol_type = other DNA
tattacggctcacttaag

SEQ ID NO: 20388 - DNA, 18 bp, synthetic construct
  source 1..18: mol_type = other DNA
tattatgactaaccatag

SEQ ID NO: 20389 - DNA, 18 bp, synthetic construct
  source 1..18: mol_type = other DNA
tattgcgtctaactatag

SEQ ID NO: 20390 - DNA, 18 bp, synthetic construct
  source 1..18: mol_type = other DNA
tcatatgacacactttag

SEQ ID NO: 20391 - DNA, 18 bp, synthetic construct
  source 1..18: mol_type = other DNA
ttataagcctaactatag

SEQ ID NO: 20392 - DNA, 18 bp, synthetic construct
  source 1..18: mol_type = other DNA
ttatacgaaacaatatag

SEQ ID NO: 20393 - DNA, 18 bp, synthetic construct
  source 1..18: mol_type = other DNA
ttatacgactgacttcag

SEQ ID NO: 20394 - DNA, 18 bp, synthetic construct
  source 1..18: mol_type = other DNA
ttatacgatttactaaag

SEQ ID NO: 20395 - DNA, 18 bp, synthetic construct
  source 1..18: mol_type = other DNA
ttatacgtatcactttag

SEQ ID NO: 20396 - DNA, 18 bp, synthetic construct
  source 1..18: mol_type = other DNA
ttgtgcgactcacgatag

SEQ ID NO: 20397 - DNA, 18 bp, synthetic construct
  source 1..18: mol_type = other DNA
ttaaacgtatcactatag

SEQ ID NO: 20398 - DNA, 18 bp, synthetic construct
  source 1..18: mol_type = other DNA
atatacgactcactactg

SEQ ID NO: 20399 - DNA, 18 bp, synthetic construct
  source 1..18: mol_type = other DNA
tatttcgacttactaaag

SEQ ID NO: 20400 - DNA, 18 bp, synthetic construct
  source 1..18: mol_type = other DNA
taatatgattcacttaag

SEQ ID NO: 20401 - DNA, 18 bp, synthetic construct
  source 1..18: mol_type = other DNA
tattacgcctcactcaag

SEQ ID NO: 20402 - DNA, 18 bp, synthetic construct
  source 1..18: mol_type = other DNA
tttcacaactcactatag

SEQ ID NO: 20403 - DNA, 18 bp, synthetic construct
  source 1..18: mol_type = other DNA
ctattcgactcactttag

SEQ ID NO: 20404 - DNA, 18 bp, synthetic construct
  source 1..18: mol_type = other DNA
taatacaactcacacttg

SEQ ID NO: 20405 - DNA, 18 bp, synthetic construct
  source 1..18: mol_type = other DNA
taattcaactctccatag

SEQ ID NO: 20406 - DNA, 18 bp, synthetic construct
  source 1..18: mol_type = other DNA
tattacgactgattattg

SEQ ID NO: 20407 - DNA, 18 bp, synthetic construct
  source 1..18: mol_type = other DNA
aattgcgactcactttag

SEQ ID NO: 20408 - DNA, 18 bp, synthetic construct
  source 1..18: mol_type = other DNA
tcattcgtctcactattg

SEQ ID NO: 20409 - DNA, 18 bp, synthetic construct
  source 1..18: mol_type = other DNA
aaatacgtctcactaatg

SEQ ID NO: 20410 - DNA, 18 bp, synthetic construct
  source 1..18: mol_type = other DNA
taaaccgtctcactattg

SEQ ID NO: 20411 - DNA, 18 bp, synthetic construct
  source 1..18: mol_type = other DNA
taactcgatacactatag

SEQ ID NO: 20412 - DNA, 18 bp, synthetic construct
  source 1..18: mol_type = other DNA
taatacgtctaaccattg

SEQ ID NO: 20413 - DNA, 18 bp, synthetic construct
  source 1..18: mol_type = other DNA
taattagactcagtaaag

SEQ ID NO: 20414 - DNA, 18 bp, synthetic construct
  source 1..18: mol_type = other DNA
taattcgagacactgtag

SEQ ID NO: 20415 - DNA, 18 bp, synthetic construct
  source 1..18: mol_type = other DNA
taattcgtttcactatcg

SEQ ID NO: 20416 - DNA, 18 bp, synthetic construct
  source 1..18: mol_type = other DNA
taattctactcaccgtag

SEQ ID NO: 20417 - DNA, 18 bp, synthetic construct
  source 1..18: mol_type = other DNA
tacttcgactcacgttag

SEQ ID NO: 20418 - DNA, 18 bp, synthetic construct
  source 1..18: mol_type = other DNA
tgattcgtcacactatag

SEQ ID NO: 20419 - DNA, 18 bp, synthetic construct
  source 1..18: mol_type = other DNA
tgttttgactcactatag

SEQ ID NO: 20420 - DNA, 18 bp, synthetic construct
  source 1..18: mol_type = other DNA
ttatacgactcatttttg

SEQ ID NO: 20421 - DNA, 18 bp, synthetic construct
  source 1..18: mol_type = other DNA
aaatactactatctatag

SEQ ID NO: 20422 - DNA, 18 bp, synthetic construct
  source 1..18: mol_type = other DNA
aattacgactctctatgg

SEQ ID NO: 20423 - DNA, 18 bp, synthetic construct
  source 1..18: mol_type = other DNA
taataagtctcacaaaag

SEQ ID NO: 20424 - DNA, 18 bp, synthetic construct
  source 1..18: mol_type = other DNA
taatacaactctataaag

SEQ ID NO: 20425 - DNA, 18 bp, synthetic construct
  source 1..18: mol_type = other DNA
taatacgactcaatcccg

SEQ ID NO: 20426 - DNA, 18 bp, synthetic construct
  source 1..18: mol_type = other DNA
taatacgattctctcaag

SEQ ID NO: 20427 - DNA, 18 bp, synthetic construct
  source 1..18: mol_type = other DNA
taatacgtcacaccagag

SEQ ID NO: 20428 - DNA, 18 bp, synthetic construct
  source 1..18: mol_type = other DNA
taatacgtcttcctgtag

SEQ ID NO: 20429 - DNA, 18 bp, synthetic construct
  source 1..18: mol_type = other DNA
tagtagaactcactaaag

SEQ ID NO: 20430 - DNA, 18 bp, synthetic construct
  source 1..18: mol_type = other DNA
tattacgaatccctctag

SEQ ID NO: 20431 - DNA, 18 bp, synthetic construct
  source 1..18: mol_type = other DNA
tattacgaccctctttag

SEQ ID NO: 20432 - DNA, 18 bp, synthetic construct
  source 1..18: mol_type = other DNA
tattactatttactatag

SEQ ID NO: 20433 - DNA, 18 bp, synthetic construct
  source 1..18: mol_type = other DNA
tcatacttctcactttag

SEQ ID NO: 20434 - DNA, 18 bp, synthetic construct
  source 1..18: mol_type = other DNA
ttatacgacacaataaag

SEQ ID NO: 20435 - DNA, 18 bp, synthetic construct
  source 1..18: mol_type = other DNA
ttatgagtctcactatag

SEQ ID NO: 20436 - DNA, 18 bp, synthetic construct
  source 1..18: mol_type = other DNA
tttttggactcactatag

SEQ ID NO: 20437 - DNA, 18 bp, synthetic construct
  source 1..18: mol_type = other DNA
ttataagtctcactattg

SEQ ID NO: 20438 - DNA, 18 bp, synthetic construct
  source 1..18: mol_type = other DNA
aaattagactcactattg

SEQ ID NO: 20439 - DNA, 18 bp, synthetic construct
  source 1..18: mol_type = other DNA
taattcggctcactaatg

SEQ ID NO: 20440 - DNA, 18 bp, synthetic construct
  source 1..18: mol_type = other DNA
tagtacgactcgctagtg

SEQ ID NO: 20441 - DNA, 18 bp, synthetic construct
  source 1..18: mol_type = other DNA
tattacgaatcgctattg

SEQ ID NO: 20442 - DNA, 18 bp, synthetic construct
  source 1..18: mol_type = other DNA
tcattcgactcgctacag

SEQ ID NO: 20443 - DNA, 18 bp, synthetic construct
  source 1..18: mol_type = other DNA
ttattcgactcgcaatag

SEQ ID NO: 20444 - DNA, 18 bp, synthetic construct
  source 1..18: mol_type = other DNA
aaaatcgactccctatag

SEQ ID NO: 20445 - DNA, 18 bp, synthetic construct
  source 1..18: mol_type = other DNA
aaatacgacttaatattg

SEQ ID NO: 20446 - DNA, 18 bp, synthetic construct
  source 1..18: mol_type = other DNA
aaattccactcagtatag

SEQ ID NO: 20447 - DNA, 18 bp, synthetic construct
  source 1..18: mol_type = other DNA
aaattcgactctctctag

SEQ ID NO: 20448 - DNA, 18 bp, synthetic construct
  source 1..18: mol_type = other DNA
aataacgactcactattg

SEQ ID NO: 20449 - DNA, 18 bp, synthetic construct
  source 1..18: mol_type = other DNA
aatttcgactcacgatag

SEQ ID NO: 20450 - DNA, 18 bp, synthetic construct
  source 1..18: mol_type = other DNA
gatttcgactcattatag

SEQ ID NO: 20451 - DNA, 18 bp, synthetic construct
  source 1..18: mol_type = other DNA
taaaacgactctctagtg

SEQ ID NO: 20452 - DNA, 18 bp, synthetic construct
  source 1..18: mol_type = other DNA
taaatcgactcattctag

SEQ ID NO: 20453 - DNA, 18 bp, synthetic construct
  source 1..18: mol_type = other DNA
taatacaactcaccatta

SEQ ID NO: 20454 - DNA, 18 bp, synthetic construct
  source 1..18: mol_type = other DNA
taatacgaatacctattg

SEQ ID NO: 20455 - DNA, 18 bp, synthetic construct
  source 1..18: mol_type = other DNA
taatacgacaagccatag

SEQ ID NO: 20456 - DNA, 18 bp, synthetic construct
  source 1..18: mol_type = other DNA
taatacgacttattaatg

SEQ ID NO: 20457 - DNA, 18 bp, synthetic construct
  source 1..18: mol_type = other DNA
taatacgagtaattattg

SEQ ID NO: 20458 - DNA, 18 bp, synthetic construct
  source 1..18: mol_type = other DNA
taatactactcccaattg

SEQ ID NO: 20459 - DNA, 18 bp, synthetic construct
  source 1..18: mol_type = other DNA
taatactatccactattg

SEQ ID NO: 20460 - DNA, 18 bp, synthetic construct
  source 1..18: mol_type = other DNA
taatacttctcgcaatag

SEQ ID NO: 20461 - DNA, 18 bp, synthetic construct
  source 1..18: mol_type = other DNA
taatatgcctcacttttg

SEQ ID NO: 20462 - DNA, 18 bp, synthetic construct
  source 1..18: mol_type = other DNA
taatgcgactaaccattg

SEQ ID NO: 20463 - DNA, 18 bp, synthetic construct
  source 1..18: mol_type = other DNA
taattagactctgtatag

SEQ ID NO: 20464 - DNA, 18 bp, synthetic construct
  source 1..18: mol_type = other DNA
taattcgactcacatcag

SEQ ID NO: 20465 - DNA, 18 bp, synthetic construct
  source 1..18: mol_type = other DNA
taattcgattctcgatag

SEQ ID NO: 20466 - DNA, 18 bp, synthetic construct
  source 1..18: mol_type = other DNA
taattctacagactatag

SEQ ID NO: 20467 - DNA, 18 bp, synthetic construct
  source 1..18: mol_type = other DNA
taattggagacactatag

SEQ ID NO: 20468 - DNA, 18 bp, synthetic construct
  source 1..18: mol_type = other DNA
taatttcactcactaaag

SEQ ID NO: 20469 - DNA, 18 bp, synthetic construct
  source 1..18: mol_type = other DNA
tattacgactcactcatg

SEQ ID NO: 20470 - DNA, 18 bp, synthetic construct
  source 1..18: mol_type = other DNA
tatttcgactaactagag

SEQ ID NO: 20471 - DNA, 18 bp, synthetic construct
  source 1..18: mol_type = other DNA
tcatacgactcgctaccg

SEQ ID NO: 20472 - DNA, 18 bp, synthetic construct
  source 1..18: mol_type = other DNA
tgataccactcacaattg

SEQ ID NO: 20473 - DNA, 18 bp, synthetic construct
  source 1..18: mol_type = other DNA
tggtactactcactattg

SEQ ID NO: 20474 - DNA, 18 bp, synthetic construct
  source 1..18: mol_type = other DNA
ttataagaatcactattg

SEQ ID NO: 20475 - DNA, 18 bp, synthetic construct
  source 1..18: mol_type = other DNA
ttatacgactagatatag

SEQ ID NO: 20476 - DNA, 18 bp, synthetic construct
  source 1..18: mol_type = other DNA
ttatatgactcgctgtag

SEQ ID NO: 20477 - DNA, 18 bp, synthetic construct
  source 1..18: mol_type = other DNA
ttatgcaactcgctatag

SEQ ID NO: 20478 - DNA, 18 bp, synthetic construct
  source 1..18: mol_type = other DNA
ttattcgactcactaggg

SEQ ID NO: 20479 - DNA, 18 bp, synthetic construct
  source 1..18: mol_type = other DNA
ttattcgactcattacag

SEQ ID NO: 20480 - DNA, 18 bp, synthetic construct
  source 1..18: mol_type = other DNA
aaataagaatcactatgg

SEQ ID NO: 20481 - DNA, 18 bp, synthetic construct
  source 1..18: mol_type = other DNA
aaatacaactcactcaag

SEQ ID NO: 20482 - DNA, 18 bp, synthetic construct
  source 1..18: mol_type = other DNA
aaatacgactctctttcg

SEQ ID NO: 20483 - DNA, 18 bp, synthetic construct
  source 1..18: mol_type = other DNA
aaatacgtcgcactaaag

SEQ ID NO: 20484 - DNA, 18 bp, synthetic construct
  source 1..18: mol_type = other DNA
aagtacgactcacactag

SEQ ID NO: 20485 - DNA, 18 bp, synthetic construct
  source 1..18: mol_type = other DNA
acatacaactccctatag

SEQ ID NO: 20486 - DNA, 18 bp, synthetic construct
  source 1..18: mol_type = other DNA
acctacgactcactataa

SEQ ID NO: 20487 - DNA, 18 bp, synthetic construct
  source 1..18: mol_type = other DNA
atagacggctcactatag

SEQ ID NO: 20488 - DNA, 18 bp, synthetic construct
  source 1..18: mol_type = other DNA
atatacgactccttatag

SEQ ID NO: 20489 - DNA, 18 bp, synthetic construct
  source 1..18: mol_type = other DNA
caatacgacaaacaatag

SEQ ID NO: 20490 - DNA, 18 bp, synthetic construct
  source 1..18: mol_type = other DNA
caatactactcacattag

SEQ ID NO: 20491 - DNA, 18 bp, synthetic construct
  source 1..18: mol_type = other DNA
ctatacgactctctaaag

SEQ ID NO: 20492 - DNA, 18 bp, synthetic construct
  source 1..18: mol_type = other DNA
ctatatgacacactatag

SEQ ID NO: 20493 - DNA, 18 bp, synthetic construct
  source 1..18: mol_type = other DNA
gaatacgactcaatgaag

SEQ ID NO: 20494 - DNA, 18 bp, synthetic construct
  source 1..18: mol_type = other DNA
gactacaactcactttag

SEQ ID NO: 20495 - DNA, 18 bp, synthetic construct
  source 1..18: mol_type = other DNA
gtaaacgactcactaaag

SEQ ID NO: 20496 - DNA, 18 bp, synthetic construct
  source 1..18: mol_type = other DNA
taaaaagactaattatag

SEQ ID NO: 20497 - DNA, 18 bp, synthetic construct
  source 1..18: mol_type = other DNA
taaaacaactcaatacag

SEQ ID NO: 20498 - DNA, 18 bp, synthetic construct
  source 1..18: mol_type = other DNA
taaaacgatacattatag

SEQ ID NO: 20499 - DNA, 18 bp, synthetic construct
  source 1..18: mol_type = other DNA
taaaatgcttcactatag

SEQ ID NO: 20500 - DNA, 18 bp, synthetic construct
  source 1..18: mol_type = other DNA
taaagcgacacattatag

SEQ ID NO: 20501 - DNA, 18 bp, synthetic construct
  source 1..18: mol_type = other DNA
taacatgactctttatag

SEQ ID NO: 20502 - DNA, 18 bp, synthetic construct
  source 1..18: mol_type = other DNA
taagactattcactacag

SEQ ID NO: 20503 - DNA, 18 bp, synthetic construct
  source 1..18: mol_type = other DNA
taataacattcactttag

SEQ ID NO: 20504 - DNA, 18 bp, synthetic construct
  source 1..18: mol_type = other DNA
taataagacaatctatag

SEQ ID NO: 20505 - DNA, 18 bp, synthetic construct
  source 1..18: mol_type = other DNA
taataagacacactgaag

SEQ ID NO: 20506 - DNA, 18 bp, synthetic construct
  source 1..18: mol_type = other DNA
taataagagtcactcaag

SEQ ID NO: 20507 - DNA, 18 bp, synthetic construct
  source 1..18: mol_type = other DNA
taataagattctctatgg

SEQ ID NO: 20508 - DNA, 18 bp, synthetic construct
  source 1..18: mol_type = other DNA
taatacatcttattatag

SEQ ID NO: 20509 - DNA, 18 bp, synthetic construct
  source 1..18: mol_type = other DNA
taatacgaatcaatagcg

SEQ ID NO: 20510 - DNA, 18 bp, synthetic construct
  source 1..18: mol_type = other DNA
taatacgaatcaccgaag

SEQ ID NO: 20511 - DNA, 18 bp, synthetic construct
  source 1..18: mol_type = other DNA
taatacgacaatctatgg

SEQ ID NO: 20512 - DNA, 18 bp, synthetic construct
  source 1..18: mol_type = other DNA
taatacgactcatggaag

SEQ ID NO: 20513 - DNA, 18 bp, synthetic construct
  source 1..18: mol_type = other DNA
taatacgactccgttaag

SEQ ID NO: 20514 - DNA, 18 bp, synthetic construct
  source 1..18: mol_type = other DNA
taatacgatacacagtag

SEQ ID NO: 20515 - DNA, 18 bp, synthetic construct
  source 1..18: mol_type = other DNA
taatacgccccaaaatag

SEQ ID NO: 20516 - DNA, 18 bp, synthetic construct
  source 1..18: mol_type = other DNA
taatacgcctatctgtag

SEQ ID NO: 20517 - DNA, 18 bp, synthetic construct
  source 1..18: mol_type = other DNA
taatacgtctaactcaag

SEQ ID NO: 20518 - DNA, 18 bp, synthetic construct
  source 1..18: mol_type = other DNA
taatacgtctctctaccg

SEQ ID NO: 20519 - DNA, 18 bp, synthetic construct
  source 1..18: mol_type = other DNA
taatacgtctctctggag

SEQ ID NO: 20520 - DNA, 18 bp, synthetic construct
  source 1..18: mol_type = other DNA
taatactacctactctag

SEQ ID NO: 20521 - DNA, 18 bp, synthetic construct
  source 1..18: mol_type = other DNA
taatatgactcataaaag

SEQ ID NO: 20522 - DNA, 18 bp, synthetic construct
  source 1..18: mol_type = other DNA
taatatgatttaccatag

SEQ ID NO: 20523 - DNA, 18 bp, synthetic construct
  source 1..18: mol_type = other DNA
taatattactcacaaaag

SEQ ID NO: 20524 - DNA, 18 bp, synthetic construct
  source 1..18: mol_type = other DNA
taatcagaatcactttag

SEQ ID NO: 20525 - DNA, 18 bp, synthetic construct
  source 1..18: mol_type = other DNA
taatccgtctcacactag

SEQ ID NO: 20526 - DNA, 18 bp, synthetic construct
  source 1..18: mol_type = other DNA
taatgcgcctgaatatag

SEQ ID NO: 20527 - DNA, 18 bp, synthetic construct
  source 1..18: mol_type = other DNA
tacaacgtctaactatag

SEQ ID NO: 20528 - DNA, 18 bp, synthetic construct
  source 1..18: mol_type = other DNA
tactacaacactctatag

SEQ ID NO: 20529 - DNA, 18 bp, synthetic construct
  source 1..18: mol_type = other DNA
tactgcgacccacaatag

SEQ ID NO: 20530 - DNA, 18 bp, synthetic construct
  source 1..18: mol_type = other DNA
tactgcgactcaaaatag

SEQ ID NO: 20531 - DNA, 18 bp, synthetic construct
  source 1..18: mol_type = other DNA
tagtccttctcactatag

SEQ ID NO: 20532 - DNA, 18 bp, synthetic construct
  source 1..18: mol_type = other DNA
tataaagacttactatag

SEQ ID NO: 20533 - DNA, 18 bp, synthetic construct
  source 1..18: mol_type = other DNA
tatcacgtctaactatag

SEQ ID NO: 20534 - DNA, 18 bp, synthetic construct
  source 1..18: mol_type = other DNA
tatcactactcactttag

SEQ ID NO: 20535 - DNA, 18 bp, synthetic construct
  source 1..18: mol_type = other DNA
tatgacacctcactatag

SEQ ID NO: 20536 - DNA, 18 bp, synthetic construct
  source 1..18: mol_type = other DNA
tattacgtctcaatatcg

SEQ ID NO: 20537 - DNA, 18 bp, synthetic construct
  source 1..18: mol_type = other DNA
tattgtgactcattatag

SEQ ID NO: 20538 - DNA, 18 bp, synthetic construct
  source 1..18: mol_type = other DNA
tcaaactacacactatag

SEQ ID NO: 20539 - DNA, 18 bp, synthetic construct
  source 1..18: mol_type = other DNA
tcatacgactaacttcag

SEQ ID NO: 20540 - DNA, 18 bp, synthetic construct
  source 1..18: mol_type = other DNA
tcatatgactcattaaag

SEQ ID NO: 20541 - DNA, 18 bp, synthetic construct
  source 1..18: mol_type = other DNA
tgaaacgactcagaatag

SEQ ID NO: 20542 - DNA, 18 bp, synthetic construct
  source 1..18: mol_type = other DNA
ttaaacaactcactacag

SEQ ID NO: 20543 - DNA, 18 bp, synthetic construct
  source 1..18: mol_type = other DNA
ttaaacgcctcactttag

SEQ ID NO: 20544 - DNA, 18 bp, synthetic construct
  source 1..18: mol_type = other DNA
ttacacgactctctctag

SEQ ID NO: 20545 - DNA, 18 bp, synthetic construct
  source 1..18: mol_type = other DNA
ttataagactctccatag

SEQ ID NO: 20546 - DNA, 18 bp, synthetic construct
  source 1..18: mol_type = other DNA
ttatacaactctcgatag

SEQ ID NO: 20547 - DNA, 18 bp, synthetic construct
  source 1..18: mol_type = other DNA
ttataccactcaccctag

SEQ ID NO: 20548 - DNA, 18 bp, synthetic construct
  source 1..18: mol_type = other DNA
ttatacgactatctatgg

SEQ ID NO: 20549 - DNA, 18 bp, synthetic construct
  source 1..18: mol_type = other DNA
ttatacgatacaatatag

SEQ ID NO: 20550 - DNA, 18 bp, synthetic construct
  source 1..18: mol_type = other DNA
ttatacgtcccactacag

SEQ ID NO: 20551 - DNA, 18 bp, synthetic construct
  source 1..18: mol_type = other DNA
ttatacgtcgcactaaag

SEQ ID NO: 20552 - DNA, 18 bp, synthetic construct
  source 1..18: mol_type = other DNA
ttatacgtctccctaaag

SEQ ID NO: 20553 - DNA, 18 bp, synthetic construct
  source 1..18: mol_type = other DNA
ttatactaattactatag

SEQ ID NO: 20554 - DNA, 18 bp, synthetic construct
  source 1..18: mol_type = other DNA
ttatataactcaatatag

SEQ ID NO: 20555 - DNA, 18 bp, synthetic construct
  source 1..18: mol_type = other DNA
ttatatgactaaccatag

SEQ ID NO: 20556 - DNA, 18 bp, synthetic construct
  source 1..18: mol_type = other DNA
ttatattactcactctag

SEQ ID NO: 20557 - DNA, 18 bp, synthetic construct
  source 1..18: mol_type = other DNA
ttctacaactcactttag

SEQ ID NO: 20558 - DNA, 18 bp, synthetic construct
  source 1..18: mol_type = other DNA
ttttacgtctcactatcg

SEQ ID NO: 20559 - DNA, 18 bp, synthetic construct
  source 1..18: mol_type = other DNA
ttatatgcatcactatag

SEQ ID NO: 20560 - DNA, 18 bp, synthetic construct
  source 1..18: mol_type = other DNA
taaaacgtcacactaaag

SEQ ID NO: 20561 - DNA, 18 bp, synthetic construct
  source 1..18: mol_type = other DNA
taaatcgatacactatag

SEQ ID NO: 20562 - DNA, 18 bp, synthetic construct
  source 1..18: mol_type = other DNA
tactacgtctcactgttg

SEQ ID NO: 20563 - DNA, 18 bp, synthetic construct
  source 1..18: mol_type = other DNA
tactatgactctctattg

SEQ ID NO: 20564 - DNA, 18 bp, synthetic construct
  source 1..18: mol_type = other DNA
tcaatctactcactatag

SEQ ID NO: 20565 - DNA, 18 bp, synthetic construct
  source 1..18: mol_type = other DNA
ttattcgacacactagag

SEQ ID NO: 20566 - DNA, 18 bp, synthetic construct
  source 1..18: mol_type = other DNA
taaaacgactgacttcag

SEQ ID NO: 20567 - DNA, 18 bp, synthetic construct
  source 1..18: mol_type = other DNA
taaaacgtcacattatag

SEQ ID NO: 20568 - DNA, 18 bp, synthetic construct
  source 1..18: mol_type = other DNA
taataaaattcacaatag

SEQ ID NO: 20569 - DNA, 18 bp, synthetic construct
  source 1..18: mol_type = other DNA
taataatactcacttaag

SEQ ID NO: 20570 - DNA, 18 bp, synthetic construct
  source 1..18: mol_type = other DNA
taatacgattacctaaag

SEQ ID NO: 20571 - DNA, 18 bp, synthetic construct
  source 1..18: mol_type = other DNA
taatacgccttataatag

SEQ ID NO: 20572 - DNA, 18 bp, synthetic construct
  source 1..18: mol_type = other DNA
taatacgtcactctatcg

SEQ ID NO: 20573 - DNA, 18 bp, synthetic construct
  source 1..18: mol_type = other DNA
taatccgacacacttaag

SEQ ID NO: 20574 - DNA, 18 bp, synthetic construct
  source 1..18: mol_type = other DNA
tagtacgactctcgaaag

SEQ ID NO: 20575 - DNA, 18 bp, synthetic construct
  source 1..18: mol_type = other DNA
tattacaaccctctatag

SEQ ID NO: 20576 - DNA, 18 bp, synthetic construct
  source 1..18: mol_type = other DNA
tattacgtcacactacag

SEQ ID NO: 20577 - DNA, 18 bp, synthetic construct
  source 1..18: mol_type = other DNA
tattactagtctctatag

SEQ ID NO: 20578 - DNA, 18 bp, synthetic construct
  source 1..18: mol_type = other DNA
ttatacgactctttatgg

SEQ ID NO: 20579 - DNA, 18 bp, synthetic construct
  source 1..18: mol_type = other DNA
ttatccgactcacttaag

SEQ ID NO: 20580 - DNA, 18 bp, synthetic construct
  source 1..18: mol_type = other DNA
aaattagactcactaaag

SEQ ID NO: 20581 - DNA, 18 bp, synthetic construct
  source 1..18: mol_type = other DNA
taataccattgactattg

SEQ ID NO: 20582 - DNA, 18 bp, synthetic construct
  source 1..18: mol_type = other DNA
taatatgactttctattg

SEQ ID NO: 20583 - DNA, 18 bp, synthetic construct
  source 1..18: mol_type = other DNA
taattcgcctcacattag

SEQ ID NO: 20584 - DNA, 18 bp, synthetic construct
  source 1..18: mol_type = other DNA
aatcacgtctcactatag

SEQ ID NO: 20585 - DNA, 18 bp, synthetic construct
  source 1..18: mol_type = other DNA
tatttcgactcactgttg

SEQ ID NO: 20586 - DNA, 18 bp, synthetic construct
  source 1..18: mol_type = other DNA
atacactactcactatag

SEQ ID NO: 20587 - DNA, 18 bp, synthetic construct
  source 1..18: mol_type = other DNA
taatgcttctcacaatag

SEQ ID NO: 20588 - DNA, 18 bp, synthetic construct
  source 1..18: mol_type = other DNA
tataacaactctctatag

SEQ ID NO: 20589 - DNA, 18 bp, synthetic construct
  source 1..18: mol_type = other DNA
tgattcgactcacttaag

SEQ ID NO: 20590 - DNA, 18 bp, synthetic construct
  source 1..18: mol_type = other DNA
tattaaaacttactatag

SEQ ID NO: 20591 - DNA, 18 bp, synthetic construct
  source 1..18: mol_type = other DNA
taattcgtctctctatcg

SEQ ID NO: 20592 - DNA, 18 bp, synthetic construct
  source 1..18: mol_type = other DNA
aaatacaactcgctattg

SEQ ID NO: 20593 - DNA, 18 bp, synthetic construct
  source 1..18: mol_type = other DNA
aaattcgactcactagtg

SEQ ID NO: 20594 - DNA, 18 bp, synthetic construct
  source 1..18: mol_type = other DNA
caattcgaatcgctatag

SEQ ID NO: 20595 - DNA, 18 bp, synthetic construct
  source 1..18: mol_type = other DNA
caattcgtctcactattg

SEQ ID NO: 20596 - DNA, 18 bp, synthetic construct
  source 1..18: mol_type = other DNA
taaaacgactagctattg

SEQ ID NO: 20597 - DNA, 18 bp, synthetic construct
  source 1..18: mol_type = other DNA
taactcgaatcgctatag

SEQ ID NO: 20598 - DNA, 18 bp, synthetic construct
  source 1..18: mol_type = other DNA
taatacaactcgctcttg

SEQ ID NO: 20599 - DNA, 18 bp, synthetic construct
  source 1..18: mol_type = other DNA
taataccactcgttattg

SEQ ID NO: 20600 - DNA, 18 bp, synthetic construct
  source 1..18: mol_type = other DNA
taatacggctcgcaattg

SEQ ID NO: 20601 - DNA, 18 bp, synthetic construct
  source 1..18: mol_type = other DNA
taatatgacttgctattg

SEQ ID NO: 20602 - DNA, 18 bp, synthetic construct
  source 1..18: mol_type = other DNA
taattcatctcgctatag

SEQ ID NO: 20603 - DNA, 18 bp, synthetic construct
  source 1..18: mol_type = other DNA
taattccactcactactg

SEQ ID NO: 20604 - DNA, 18 bp, synthetic construct
  source 1..18: mol_type = other DNA
taattcgaatcaccattg

SEQ ID NO: 20605 - DNA, 18 bp, synthetic construct
  source 1..18: mol_type = other DNA
taattcgactaactaatg

SEQ ID NO: 20606 - DNA, 18 bp, synthetic construct
  source 1..18: mol_type = other DNA
taattcgactcacaactg

SEQ ID NO: 20607 - DNA, 18 bp, synthetic construct
  source 1..18: mol_type = other DNA
taattcgactcacatttg

SEQ ID NO: 20608 - DNA, 18 bp, synthetic construct
  source 1..18: mol_type = other DNA
taattcgactccatattg

SEQ ID NO: 20609 - DNA, 18 bp, synthetic construct
  source 1..18: mol_type = other DNA
taattcgacttgatatag

SEQ ID NO: 20610 - DNA, 18 bp, synthetic construct
  source 1..18: mol_type = other DNA
taattcgattcaccattg

SEQ ID NO: 20611 - DNA, 18 bp, synthetic construct
  source 1..18: mol_type = other DNA
taattcgtatcgctatag

SEQ ID NO: 20612 - DNA, 18 bp, synthetic construct
  source 1..18: mol_type = other DNA
taattcgtttcgctatag

SEQ ID NO: 20613 - DNA, 18 bp, synthetic construct
  source 1..18: mol_type = other DNA
tactaagactcgctattg

SEQ ID NO: 20614 - DNA, 18 bp, synthetic construct
  source 1..18: mol_type = other DNA
tacttcgcctcactattg

SEQ ID NO: 20615 - DNA, 18 bp, synthetic construct
  source 1..18: mol_type = other DNA
tagttcgacccgctatag

SEQ ID NO: 20616 - DNA, 18 bp, synthetic construct
  source 1..18: mol_type = other DNA
tagttcggctcactattg

SEQ ID NO: 20617 - DNA, 18 bp, synthetic construct
  source 1..18: mol_type = other DNA
ttactcgactcgctatag

SEQ ID NO: 20618 - DNA, 18 bp, synthetic construct
  source 1..18: mol_type = other DNA
aaaaacgactcacgattg

SEQ ID NO: 20619 - DNA, 18 bp, synthetic construct
  source 1..18: mol_type = other DNA
aaatacgacacgcgatag

SEQ ID NO: 20620 - DNA, 18 bp, synthetic construct
  source 1..18: mol_type = other DNA
aaatacgacccaccattg

SEQ ID NO: 20621 - DNA, 18 bp, synthetic construct
  source 1..18: mol_type = other DNA
aaatacgactcgcgttag

SEQ ID NO: 20622 - DNA, 18 bp, synthetic construct
  source 1..18: mol_type = other DNA
aaataggactcgctatcg

SEQ ID NO: 20623 - DNA, 18 bp, synthetic construct
  source 1..18: mol_type = other DNA
aaattcgactaaatatag

SEQ ID NO: 20624 - DNA, 18 bp, synthetic construct
  source 1..18: mol_type = other DNA
aaattcgactcaatacag

SEQ ID NO: 20625 - DNA, 18 bp, synthetic construct
  source 1..18: mol_type = other DNA
aaattcgactcagtatcg

SEQ ID NO: 20626 - DNA, 18 bp, synthetic construct
  source 1..18: mol_type = other DNA
aaattcgactcattctag

SEQ ID NO: 20627 - DNA, 18 bp, synthetic construct
  source 1..18: mol_type = other DNA
aaattcgactgactagag

SEQ ID NO: 20628 - DNA, 18 bp, synthetic construct
  source 1..18: mol_type = other DNA
aaattcgattcactatcg

SEQ ID NO: 20629 - DNA, 18 bp, synthetic construct
  source 1..18: mol_type = other DNA
aaattcgtctcacgatag

SEQ ID NO: 20630 - DNA, 18 bp, synthetic construct
  source 1..18: mol_type = other DNA
aattacgacgcactattg

SEQ ID NO: 20631 - DNA, 18 bp, synthetic construct
  source 1..18: mol_type = other DNA
acatacgacccactattg

SEQ ID NO: 20632 - DNA, 18 bp, synthetic construct
  source 1..18: mol_type = other DNA
acatacgactcattattg

SEQ ID NO: 20633 - DNA, 18 bp, synthetic construct
  source 1..18: mol_type = other DNA
agatacgactccctattg

SEQ ID NO: 20634 - DNA, 18 bp, synthetic construct
  source 1..18: mol_type = other DNA
caatacaattcactattg

SEQ ID NO: 20635 - DNA, 18 bp, synthetic construct
  source 1..18: mol_type = other DNA
caatactactcaccattg

SEQ ID NO: 20636 - DNA, 18 bp, synthetic construct
  source 1..18: mol_type = other DNA
caataggagtcactattg

SEQ ID NO: 20637 - DNA, 18 bp, synthetic construct
  source 1..18: mol_type = other DNA
caatatgtctcgctatag

SEQ ID NO: 20638 - DNA, 18 bp, synthetic construct
  source 1..18: mol_type = other DNA
caattagactcactatcg

SEQ ID NO: 20639 - DNA, 18 bp, synthetic construct
  source 1..18: mol_type = other DNA
caattcgacacactagag

SEQ ID NO: 20640 - DNA, 18 bp, synthetic construct
  source 1..18: mol_type = other DNA
caattcgaccgactatag

SEQ ID NO: 20641 - DNA, 18 bp, synthetic construct
  source 1..18: mol_type = other DNA
caattcgactaactatcg

SEQ ID NO: 20642 - DNA, 18 bp, synthetic construct
  source 1..18: mol_type = other DNA
caattcgactcaatgtag

SEQ ID NO: 20643 - DNA, 18 bp, synthetic construct
  source 1..18: mol_type = other DNA
caattcgactcactaccg

SEQ ID NO: 20644 - DNA, 18 bp, synthetic construct
  source 1..18: mol_type = other DNA
catttccactcactatag

SEQ ID NO: 20645 - DNA, 18 bp, synthetic construct
  source 1..18: mol_type = other DNA
ctatacgactcaccattg

SEQ ID NO: 20646 - DNA, 18 bp, synthetic construct
  source 1..18: mol_type = other DNA
ctatacgacttgctatag

SEQ ID NO: 20647 - DNA, 18 bp, synthetic construct
  source 1..18: mol_type = other DNA
gaaatcgactcagtatag

SEQ ID NO: 20648 - DNA, 18 bp, synthetic construct
  source 1..18: mol_type = other DNA
gaattccactcacaatag

SEQ ID NO: 20649 - DNA, 18 bp, synthetic construct
  source 1..18: mol_type = other DNA
gaattcgtctcactgtag

SEQ ID NO: 20650 - DNA, 18 bp, synthetic construct
  source 1..18: mol_type = other DNA
gaattggactcacgatag

SEQ ID NO: 20651 - DNA, 18 bp, synthetic construct
  source 1..18: mol_type = other DNA
taaaaagattcactattg

SEQ ID NO: 20652 - DNA, 18 bp, synthetic construct
  source 1..18: mol_type = other DNA
taaaacgaatcgatatag

SEQ ID NO: 20653 - DNA, 18 bp, synthetic construct
  source 1..18: mol_type = other DNA
taaaacgattcactaatg

SEQ ID NO: 20654 - DNA, 18 bp, synthetic construct
  source 1..18: mol_type = other DNA
taaaacggctcactactg

SEQ ID NO: 20655 - DNA, 18 bp, synthetic construct
  source 1..18: mol_type = other DNA
taaaacggcttgctatag

SEQ ID NO: 20656 - DNA, 18 bp, synthetic construct
  source 1..18: mol_type = other DNA
taaaacgtctcgctttag

SEQ ID NO: 20657 - DNA, 18 bp, synthetic construct
  source 1..18: mol_type = other DNA
taaaactactcgctgtag

SEQ ID NO: 20658 - DNA, 18 bp, synthetic construct
  source 1..18: mol_type = other DNA
taaaaggactccctattg

SEQ ID NO: 20659 - DNA, 18 bp, synthetic construct
  source 1..18: mol_type = other DNA
taaaccgcctcactattg

SEQ ID NO: 20660 - DNA, 18 bp, synthetic construct
  source 1..18: mol_type = other DNA
taaatcgaaacactatag

SEQ ID NO: 20661 - DNA, 18 bp, synthetic construct
  source 1..18: mol_type = other DNA
taaatcgacttactctag

SEQ ID NO: 20662 - DNA, 18 bp, synthetic construct
  source 1..18: mol_type = other DNA
taacacaactgactattg

SEQ ID NO: 20663 - DNA, 18 bp, synthetic construct
  source 1..18: mol_type = other DNA
taacacgactcaacattg

SEQ ID NO: 20664 - DNA, 18 bp, synthetic construct
  source 1..18: mol_type = other DNA
taacacgactctccattg

SEQ ID NO: 20665 - DNA, 18 bp, synthetic construct
  source 1..18: mol_type = other DNA
taacacgtctcgctatcg

SEQ ID NO: 20666 - DNA, 18 bp, synthetic construct
  source 1..18: mol_type = other DNA
taacactactcacaattg

SEQ ID NO: 20667 - DNA, 18 bp, synthetic construct
  source 1..18: mol_type = other DNA
taactcgacacaatatag

SEQ ID NO: 20668 - DNA, 18 bp, synthetic construct
  source 1..18: mol_type = other DNA
taactcgactaactagag

SEQ ID NO: 20669 - DNA, 18 bp, synthetic construct
  source 1..18: mol_type = other DNA
taactcgattcaccatag

SEQ ID NO: 20670 - DNA, 18 bp, synthetic construct
  source 1..18: mol_type = other DNA
taagacgactaggtatag

SEQ ID NO: 20671 - DNA, 18 bp, synthetic construct
  source 1..18: mol_type = other DNA
taagtcaactcactaaag

SEQ ID NO: 20672 - DNA, 18 bp, synthetic construct
  source 1..18: mol_type = other DNA
taagtctactcactatcg

SEQ ID NO: 20673 - DNA, 18 bp, synthetic construct
  source 1..18: mol_type = other DNA
taagttgactcacaatag

SEQ ID NO: 20674 - DNA, 18 bp, synthetic construct
  source 1..18: mol_type = other DNA
taataagaatcactgttg

SEQ ID NO: 20675 - DNA, 18 bp, synthetic construct
  source 1..18: mol_type = other DNA
taataagacaaactattg

SEQ ID NO: 20676 - DNA, 18 bp, synthetic construct
  source 1..18: mol_type = other DNA
taataagactcattgttg

SEQ ID NO: 20677 - DNA, 18 bp, synthetic construct
  source 1..18: mol_type = other DNA
taataagactcgcaacag

SEQ ID NO: 20678 - DNA, 18 bp, synthetic construct
  source 1..18: mol_type = other DNA
taataagactcgttgtag

SEQ ID NO: 20679 - DNA, 18 bp, synthetic construct
  source 1..18: mol_type = other DNA
taataagcctcgctatcg

SEQ ID NO: 20680 - DNA, 18 bp, synthetic construct
  source 1..18: mol_type = other DNA
taataaggctcacgattg

SEQ ID NO: 20681 - DNA, 18 bp, synthetic construct
  source 1..18: mol_type = other DNA
taatacaacacactagtg

SEQ ID NO: 20682 - DNA, 18 bp, synthetic construct
  source 1..18: mol_type = other DNA
taatacaactcaggattg

SEQ ID NO: 20683 - DNA, 18 bp, synthetic construct
  source 1..18: mol_type = other DNA
taatacaactcgcattag

SEQ ID NO: 20684 - DNA, 18 bp, synthetic construct
  source 1..18: mol_type = other DNA
taatacaagccactattg

SEQ ID NO: 20685 - DNA, 18 bp, synthetic construct
  source 1..18: mol_type = other DNA
taatacatctcgctttag

SEQ ID NO: 20686 - DNA, 18 bp, synthetic construct
  source 1..18: mol_type = other DNA
taatacctctcgatatag

SEQ ID NO: 20687 - DNA, 18 bp, synthetic construct
  source 1..18: mol_type = other DNA
taatacgaatctctagtg

SEQ ID NO: 20688 - DNA, 18 bp, synthetic construct
  source 1..18: mol_type = other DNA
taatacgaattacttttg

SEQ ID NO: 20689 - DNA, 18 bp, synthetic construct
  source 1..18: mol_type = other DNA
taatacgaattgctgtag

SEQ ID NO: 20690 - DNA, 18 bp, synthetic construct
  source 1..18: mol_type = other DNA
taatacgacacgttaaag

SEQ ID NO: 20691 - DNA, 18 bp, synthetic construct
  source 1..18: mol_type = other DNA
taatacgacccacaaatg

SEQ ID NO: 20692 - DNA, 18 bp, synthetic construct
  source 1..18: mol_type = other DNA
taatacgaccgactcttg

SEQ ID NO: 20693 - DNA, 18 bp, synthetic construct
  source 1..18: mol_type = other DNA
taatacgacgtaccattg

SEQ ID NO: 20694 - DNA, 18 bp, synthetic construct
  source 1..18: mol_type = other DNA
taatacgactcaactttg

SEQ ID NO: 20695 - DNA, 18 bp, synthetic construct
  source 1..18: mol_type = other DNA
taatacgactctatatta

SEQ ID NO: 20696 - DNA, 18 bp, synthetic construct
  source 1..18: mol_type = other DNA
taatacgactctcaagtg

SEQ ID NO: 20697 - DNA, 18 bp, synthetic construct
  source 1..18: mol_type = other DNA
taatacgactgtctagtg

SEQ ID NO: 20698 - DNA, 18 bp, synthetic construct
  source 1..18: mol_type = other DNA
taatacgactttctatta

SEQ ID NO: 20699 - DNA, 18 bp, synthetic construct
  source 1..18: mol_type = other DNA
taatacgagtcggtttag

SEQ ID NO: 20700 - DNA, 18 bp, synthetic construct
  source 1..18: mol_type = other DNA
taatacgagttcctattg

SEQ ID NO: 20701 - DNA, 18 bp, synthetic construct
  source 1..18: mol_type = other DNA
taatacgatacgctatcg

SEQ ID NO: 20702 - DNA, 18 bp, synthetic construct
  source 1..18: mol_type = other DNA
taatacggcccacaattg

SEQ ID NO: 20703 - DNA, 18 bp, synthetic construct
  source 1..18: mol_type = other DNA
taatacggtacactattg

SEQ ID NO: 20704 - DNA, 18 bp, synthetic construct
  source 1..18: mol_type = other DNA
taatacgtatcactgttg

SEQ ID NO: 20705 - DNA, 18 bp, synthetic construct
  source 1..18: mol_type = other DNA
taatacgtcaggctatag

SEQ ID NO: 20706 - DNA, 18 bp, synthetic construct
  source 1..18: mol_type = other DNA
taatactacccacaattg

SEQ ID NO: 20707 - DNA, 18 bp, synthetic construct
  source 1..18: mol_type = other DNA
taatactactccttattg

SEQ ID NO: 20708 - DNA, 18 bp, synthetic construct
  source 1..18: mol_type = other DNA
taatactactcgataaag

SEQ ID NO: 20709 - DNA, 18 bp, synthetic construct
  source 1..18: mol_type = other DNA
taatagaactctctattg

SEQ ID NO: 20710 - DNA, 18 bp, synthetic construct
  source 1..18: mol_type = other DNA
taataggacttattattg

SEQ ID NO: 20711 - DNA, 18 bp, synthetic construct
  source 1..18: mol_type = other DNA
taataggatttactattg

SEQ ID NO: 20712 - DNA, 18 bp, synthetic construct
  source 1..18: mol_type = other DNA
taataggcctcactaatg

SEQ ID NO: 20713 - DNA, 18 bp, synthetic construct
  source 1..18: mol_type = other DNA
taatagggctcactgttg

SEQ ID NO: 20714 - DNA, 18 bp, synthetic construct
  source 1..18: mol_type = other DNA
taataggtctcacaattg

SEQ ID NO: 20715 - DNA, 18 bp, synthetic construct
  source 1..18: mol_type = other DNA
taatatgactcaatatta

SEQ ID NO: 20716 - DNA, 18 bp, synthetic construct
  source 1..18: mol_type = other DNA
taatatgactcataattg

SEQ ID NO: 20717 - DNA, 18 bp, synthetic construct
  source 1..18: mol_type = other DNA
taatatgacttgcaatag

SEQ ID NO: 20718 - DNA, 18 bp, synthetic construct
  source 1..18: mol_type = other DNA
taatatgacttgcgatag

SEQ ID NO: 20719 - DNA, 18 bp, synthetic construct
  source 1..18: mol_type = other DNA
taatatgagtcacttttg

SEQ ID NO: 20720 - DNA, 18 bp, synthetic construct
  source 1..18: mol_type = other DNA
taatatgattcgctaaag

SEQ ID NO: 20721 - DNA, 18 bp, synthetic construct
  source 1..18: mol_type = other DNA
taatattactcactgttg

SEQ ID NO: 20722 - DNA, 18 bp, synthetic construct
  source 1..18: mol_type = other DNA
taatcaggctcactattg

SEQ ID NO: 20723 - DNA, 18 bp, synthetic construct
  source 1..18: mol_type = other DNA
taatccgtctagctatag

SEQ ID NO: 20724 - DNA, 18 bp, synthetic construct
  source 1..18: mol_type = other DNA
taatgcgactcccttttg

SEQ ID NO: 20725 - DNA, 18 bp, synthetic construct
  source 1..18: mol_type = other DNA
taatggcactcactattg

SEQ ID NO: 20726 - DNA, 18 bp, synthetic construct
  source 1..18: mol_type = other DNA
taattaaactaactatag

SEQ ID NO: 20727 - DNA, 18 bp, synthetic construct
  source 1..18: mol_type = other DNA
taattcaactcaatctag

SEQ ID NO: 20728 - DNA, 18 bp, synthetic construct
  source 1..18: mol_type = other DNA
taattcaactcaccatcg

SEQ ID NO: 20729 - DNA, 18 bp, synthetic construct
  source 1..18: mol_type = other DNA
taattcaactcactgaag

SEQ ID NO: 20730 - DNA, 18 bp, synthetic construct
  source 1..18: mol_type = other DNA
taattcaacttcctatag

SEQ ID NO: 20731 - DNA, 18 bp, synthetic construct
  source 1..18: mol_type = other DNA
taattcagctcacaatag

SEQ ID NO: 20732 - DNA, 18 bp, synthetic construct
  source 1..18: mol_type = other DNA
taattcagctcaccatag

SEQ ID NO: 20733 - DNA, 18 bp, synthetic construct
  source 1..18: mol_type = other DNA
taattccactaattatag

SEQ ID NO: 20734 - DNA, 18 bp, synthetic construct
  source 1..18: mol_type = other DNA
taattccaggcactatag

SEQ ID NO: 20735 - DNA, 18 bp, synthetic construct
  source 1..18: mol_type = other DNA
taattcgaagccctatag

SEQ ID NO: 20736 - DNA, 18 bp, synthetic construct
  source 1..18: mol_type = other DNA
taattcgaatctgtatag

SEQ ID NO: 20737 - DNA, 18 bp, synthetic construct
  source 1..18: mol_type = other DNA
taattcgacaaactatcg

SEQ ID NO: 20738 - DNA, 18 bp, synthetic construct
  source 1..18: mol_type = other DNA
taattcgacacacaagag

SEQ ID NO: 20739 - DNA, 18 bp, synthetic construct
  source 1..18: mol_type = other DNA
taattcgacacacttcag

SEQ ID NO: 20740 - DNA, 18 bp, synthetic construct
  source 1..18: mol_type = other DNA
taattcgacactctgtag

SEQ ID NO: 20741 - DNA, 18 bp, synthetic construct
  source 1..18: mol_type = other DNA
taattcgactaaatgtag

SEQ ID NO: 20742 - DNA, 18 bp, synthetic construct
  source 1..18: mol_type = other DNA
taattcgactacctaaag

SEQ ID NO: 20743 - DNA, 18 bp, synthetic construct
  source 1..18: mol_type = other DNA
taattcgactcactgacg

SEQ ID NO: 20744 - DNA, 18 bp, synthetic construct
  source 1..18: mol_type = other DNA
taattcgactcagaatcg

SEQ ID NO: 20745 - DNA, 18 bp, synthetic construct
  source 1..18: mol_type = other DNA
taattcgactctcaatgg

SEQ ID NO: 20746 - DNA, 18 bp, synthetic construct
  source 1..18: mol_type = other DNA
taattcgactctgtttag

SEQ ID NO: 20747 - DNA, 18 bp, synthetic construct
  source 1..18: mol_type = other DNA
taattcgagtcattttag

SEQ ID NO: 20748 - DNA, 18 bp, synthetic construct
  source 1..18: mol_type = other DNA
taattcgagttactttag

SEQ ID NO: 20749 - DNA, 18 bp, synthetic construct
  source 1..18: mol_type = other DNA
taattcgcatcactttag

SEQ ID NO: 20750 - DNA, 18 bp, synthetic construct
  source 1..18: mol_type = other DNA
taattcgccacactgtag

SEQ ID NO: 20751 - DNA, 18 bp, synthetic construct
  source 1..18: mol_type = other DNA
taattcgccgctctatag

SEQ ID NO: 20752 - DNA, 18 bp, synthetic construct
  source 1..18: mol_type = other DNA
taattcggcctactatag

SEQ ID NO: 20753 - DNA, 18 bp, synthetic construct
  source 1..18: mol_type = other DNA
taattcgtcgcactacag

SEQ ID NO: 20754 - DNA, 18 bp, synthetic construct
  source 1..18: mol_type = other DNA
taattcgtctcaatacag

SEQ ID NO: 20755 - DNA, 18 bp, synthetic construct
  source 1..18: mol_type = other DNA
taattcgtctcaatagag

SEQ ID NO: 20756 - DNA, 18 bp, synthetic construct
  source 1..18: mol_type = other DNA
taattcgtctcactctcg

SEQ ID NO: 20757 - DNA, 18 bp, synthetic construct
  source 1..18: mol_type = other DNA
taattcgtctcacttgag

SEQ ID NO: 20758 - DNA, 18 bp, synthetic construct
  source 1..18: mol_type = other DNA
taattcgtctcagcatag

SEQ ID NO: 20759 - DNA, 18 bp, synthetic construct
  source 1..18: mol_type = other DNA
taattcgtcttactctag

SEQ ID NO: 20760 - DNA, 18 bp, synthetic construct
  source 1..18: mol_type = other DNA
taattcgtttccctatag

SEQ ID NO: 20761 - DNA, 18 bp, synthetic construct
  source 1..18: mol_type = other DNA
taattctactcaccctag

SEQ ID NO: 20762 - DNA, 18 bp, synthetic construct
  source 1..18: mol_type = other DNA
taattctactcacggtag

SEQ ID NO: 20763 - DNA, 18 bp, synthetic construct
  source 1..18: mol_type = other DNA
taattctactcactgcag

SEQ ID NO: 20764 - DNA, 18 bp, synthetic construct
  source 1..18: mol_type = other DNA
taattctactcacttaag

SEQ ID NO: 20765 - DNA, 18 bp, synthetic construct
  source 1..18: mol_type = other DNA
taattctagtcactttag

SEQ ID NO: 20766 - DNA, 18 bp, synthetic construct
  source 1..18: mol_type = other DNA
taattctcctcactaaag

SEQ ID NO: 20767 - DNA, 18 bp, synthetic construct
  source 1..18: mol_type = other DNA
taattcttctcactagag

SEQ ID NO: 20768 - DNA, 18 bp, synthetic construct
  source 1..18: mol_type = other DNA
taattgaactctctatag

SEQ ID NO: 20769 - DNA, 18 bp, synthetic construct
  source 1..18: mol_type = other DNA
taattgcactaactatag

SEQ ID NO: 20770 - DNA, 18 bp, synthetic construct
  source 1..18: mol_type = other DNA
taattggactctccatag

SEQ ID NO: 20771 - DNA, 18 bp, synthetic construct
  source 1..18: mol_type = other DNA
taattgtactcactctag

SEQ ID NO: 20772 - DNA, 18 bp, synthetic construct
  source 1..18: mol_type = other DNA
taatttgacttactatgg

SEQ ID NO: 20773 - DNA, 18 bp, synthetic construct
  source 1..18: mol_type = other DNA
tactacgacacaatattg

SEQ ID NO: 20774 - DNA, 18 bp, synthetic construct
  source 1..18: mol_type = other DNA
tactacgactcagcattg

SEQ ID NO: 20775 - DNA, 18 bp, synthetic construct
  source 1..18: mol_type = other DNA
tactacgactccccattg

SEQ ID NO: 20776 - DNA, 18 bp, synthetic construct
  source 1..18: mol_type = other DNA
tactacgtctgactattg

SEQ ID NO: 20777 - DNA, 18 bp, synthetic construct
  source 1..18: mol_type = other DNA
tactaggactcactcttg

SEQ ID NO: 20778 - DNA, 18 bp, synthetic construct
  source 1..18: mol_type = other DNA
tactatgactcacttttg

SEQ ID NO: 20779 - DNA, 18 bp, synthetic construct
  source 1..18: mol_type = other DNA
tactccgactctctattg

SEQ ID NO: 20780 - DNA, 18 bp, synthetic construct
  source 1..18: mol_type = other DNA
tacttcgaatcactacag

SEQ ID NO: 20781 - DNA, 18 bp, synthetic construct
  source 1..18: mol_type = other DNA
tacttcgaatcactatgg

SEQ ID NO: 20782 - DNA, 18 bp, synthetic construct
  source 1..18: mol_type = other DNA
tacttcgactcaaaatag

SEQ ID NO: 20783 - DNA, 18 bp, synthetic construct
  source 1..18: mol_type = other DNA
tacttcgcctcactatgg

SEQ ID NO: 20784 - DNA, 18 bp, synthetic construct
  source 1..18: mol_type = other DNA
tactttgactccctatag

SEQ ID NO: 20785 - DNA, 18 bp, synthetic construct
  source 1..18: mol_type = other DNA
tagatcgactcattatag

SEQ ID NO: 20786 - DNA, 18 bp, synthetic construct
  source 1..18: mol_type = other DNA
tagtacaactcgttatag

SEQ ID NO: 20787 - DNA, 18 bp, synthetic construct
  source 1..18: mol_type = other DNA
tagtacgactcaacattg

SEQ ID NO: 20788 - DNA, 18 bp, synthetic construct
  source 1..18: mol_type = other DNA
tagttccactctctatag

SEQ ID NO: 20789 - DNA, 18 bp, synthetic construct
  source 1..18: mol_type = other DNA
tagttcgcctcattatag

SEQ ID NO: 20790 - DNA, 18 bp, synthetic construct
  source 1..18: mol_type = other DNA
tagttctactccctatag

SEQ ID NO: 20791 - DNA, 18 bp, synthetic construct
  source 1..18: mol_type = other DNA
tatcacgacacactattg

SEQ ID NO: 20792 - DNA, 18 bp, synthetic construct
  source 1..18: mol_type = other DNA
tattacaactcagtattg

SEQ ID NO: 20793 - DNA, 18 bp, synthetic construct
  source 1..18: mol_type = other DNA
tattacgacacactgttg

SEQ ID NO: 20794 - DNA, 18 bp, synthetic construct
  source 1..18: mol_type = other DNA
tattacgacacgctgtag

SEQ ID NO: 20795 - DNA, 18 bp, synthetic construct
  source 1..18: mol_type = other DNA
tattacgacttgttatag

SEQ ID NO: 20796 - DNA, 18 bp, synthetic construct
  source 1..18: mol_type = other DNA
tattaggacccactattg

SEQ ID NO: 20797 - DNA, 18 bp, synthetic construct
  source 1..18: mol_type = other DNA
tatttcaactgactatag

SEQ ID NO: 20798 - DNA, 18 bp, synthetic construct
  source 1..18: mol_type = other DNA
tatttcgactacctatag

SEQ ID NO: 20799 - DNA, 18 bp, synthetic construct
  source 1..18: mol_type = other DNA
tatttcgactcacgacag

SEQ ID NO: 20800 - DNA, 18 bp, synthetic construct
  source 1..18: mol_type = other DNA
tatttcgacttacgatag

SEQ ID NO: 20801 - DNA, 18 bp, synthetic construct
  source 1..18: mol_type = other DNA
tcactcaactcactatag

SEQ ID NO: 20802 - DNA, 18 bp, synthetic construct
  source 1..18: mol_type = other DNA
tcataccactcactagtg

SEQ ID NO: 20803 - DNA, 18 bp, synthetic construct
  source 1..18: mol_type = other DNA
tcatacgtctcgctaaag

SEQ ID NO: 20804 - DNA, 18 bp, synthetic construct
  source 1..18: mol_type = other DNA
tcatactactggctatag

SEQ ID NO: 20805 - DNA, 18 bp, synthetic construct
  source 1..18: mol_type = other DNA
tcataggaatcactattg

SEQ ID NO: 20806 - DNA, 18 bp, synthetic construct
  source 1..18: mol_type = other DNA
tcatatgactcggtatag

SEQ ID NO: 20807 - DNA, 18 bp, synthetic construct
  source 1..18: mol_type = other DNA
tcattcaaatcactatag

SEQ ID NO: 20808 - DNA, 18 bp, synthetic construct
  source 1..18: mol_type = other DNA
tcattcaagtcactatag

SEQ ID NO: 20809 - DNA, 18 bp, synthetic construct
  source 1..18: mol_type = other DNA
tcattctactcactacag

SEQ ID NO: 20810 - DNA, 18 bp, synthetic construct
  source 1..18: mol_type = other DNA
tcttacgacgcactattg

SEQ ID NO: 20811 - DNA, 18 bp, synthetic construct
  source 1..18: mol_type = other DNA
tgaatggactcactatag

SEQ ID NO: 20812 - DNA, 18 bp, synthetic construct
  source 1..18: mol_type = other DNA
tgacacgactcgctctag

SEQ ID NO: 20813 - DNA, 18 bp, synthetic construct
  source 1..18: mol_type = other DNA
tgatacgaatcgctttag

SEQ ID NO: 20814 - DNA, 18 bp, synthetic construct
  source 1..18: mol_type = other DNA
tgatacgactcacctttg

SEQ ID NO: 20815 - DNA, 18 bp, synthetic construct
  source 1..18: mol_type = other DNA
tgatacgattcagtattg

SEQ ID NO: 20816 - DNA, 18 bp, synthetic construct
  source 1..18: mol_type = other DNA
tgatgctactcgctatag

SEQ ID NO: 20817 - DNA, 18 bp, synthetic construct
  source 1..18: mol_type = other DNA
tgattcgatttactatag

SEQ ID NO: 20818 - DNA, 18 bp, synthetic construct
  source 1..18: mol_type = other DNA
tgttacgacccgctatag

SEQ ID NO: 20819 - DNA, 18 bp, synthetic construct
  source 1..18: mol_type = other DNA
ttaaacgactcactgttg

SEQ ID NO: 20820 - DNA, 18 bp, synthetic construct
  source 1..18: mol_type = other DNA
ttataccactcgctaaag

SEQ ID NO: 20821 - DNA, 18 bp, synthetic construct
  source 1..18: mol_type = other DNA
ttatacgactgactactg

SEQ ID NO: 20822 - DNA, 18 bp, synthetic construct
  source 1..18: mol_type = other DNA
ttatactactagctatag

SEQ ID NO: 20823 - DNA, 18 bp, synthetic construct
  source 1..18: mol_type = other DNA
ttattcgtctcactatcg

SEQ ID NO: 20824 - DNA, 18 bp, synthetic construct
  source 1..18: mol_type = other DNA
ttggacgactcgctatag

SEQ ID NO: 20825 - DNA, 18 bp, synthetic construct
  source 1..18: mol_type = other DNA
aaaaacgactctctttag

SEQ ID NO: 20826 - DNA, 18 bp, synthetic construct
  source 1..18: mol_type = other DNA
aaaaacgattcaccatag

SEQ ID NO: 20827 - DNA, 18 bp, synthetic construct
  source 1..18: mol_type = other DNA
aaaaacggctccctatag

SEQ ID NO: 20828 - DNA, 18 bp, synthetic construct
  source 1..18: mol_type = other DNA
aaaagcgactcaatatag

SEQ ID NO: 20829 - DNA, 18 bp, synthetic construct
  source 1..18: mol_type = other DNA
aaacacaactcactctag

SEQ ID NO: 20830 - DNA, 18 bp, synthetic construct
  source 1..18: mol_type = other DNA
aaacacgactcacttaag

SEQ ID NO: 20831 - DNA, 18 bp, synthetic construct
  source 1..18: mol_type = other DNA
aaataacactcactgtag

SEQ ID NO: 20832 - DNA, 18 bp, synthetic construct
  source 1..18: mol_type = other DNA
aaataagactcataatag

SEQ ID NO: 20833 - DNA, 18 bp, synthetic construct
  source 1..18: mol_type = other DNA
aaatacaactcacaaaag

SEQ ID NO: 20834 - DNA, 18 bp, synthetic construct
  source 1..18: mol_type = other DNA
aaatacaattcactttag

SEQ ID NO: 20835 - DNA, 18 bp, synthetic construct
  source 1..18: mol_type = other DNA
aaataccactcatgatag

SEQ ID NO: 20836 - DNA, 18 bp, synthetic construct
  source 1..18: mol_type = other DNA
aaatacgaatcacactag

SEQ ID NO: 20837 - DNA, 18 bp, synthetic construct
  source 1..18: mol_type = other DNA
aaatacgaatcagtctag

SEQ ID NO: 20838 - DNA, 18 bp, synthetic construct
  source 1..18: mol_type = other DNA
aaatacgaattaatatag

SEQ ID NO: 20839 - DNA, 18 bp, synthetic construct
  source 1..18: mol_type = other DNA
aaatacgacacattatgg

SEQ ID NO: 20840 - DNA, 18 bp, synthetic construct
  source 1..18: mol_type = other DNA
aaatacgacctactacag

SEQ ID NO: 20841 - DNA, 18 bp, synthetic construct
  source 1..18: mol_type = other DNA
aaatacgacgcaatatcg

SEQ ID NO: 20842 - DNA, 18 bp, synthetic construct
  source 1..18: mol_type = other DNA
aaatacgactaaccagag

SEQ ID NO: 20843 - DNA, 18 bp, synthetic construct
  source 1..18: mol_type = other DNA
aaatacgactcaatttcg

SEQ ID NO: 20844 - DNA, 18 bp, synthetic construct
  source 1..18: mol_type = other DNA
aaatacgactgacattag

SEQ ID NO: 20845 - DNA, 18 bp, synthetic construct
  source 1..18: mol_type = other DNA
aaatacgacttatcatag

SEQ ID NO: 20846 - DNA, 18 bp, synthetic construct
  source 1..18: mol_type = other DNA
aaatacgagttactttag

SEQ ID NO: 20847 - DNA, 18 bp, synthetic construct
  source 1..18: mol_type = other DNA
aaatacgattcaccaaag

SEQ ID NO: 20848 - DNA, 18 bp, synthetic construct
  source 1..18: mol_type = other DNA
aaatacggctcattacag

SEQ ID NO: 20849 - DNA, 18 bp, synthetic construct
  source 1..18: mol_type = other DNA
aaatacggctgactttag

SEQ ID NO: 20850 - DNA, 18 bp, synthetic construct
  source 1..18: mol_type = other DNA
aaatacggctgagtatag

SEQ ID NO: 20851 - DNA, 18 bp, synthetic construct
  source 1..18: mol_type = other DNA
aaatacgtaacactatag

SEQ ID NO: 20852 - DNA, 18 bp, synthetic construct
  source 1..18: mol_type = other DNA
aaatactactaactgtag

SEQ ID NO: 20853 - DNA, 18 bp, synthetic construct
  source 1..18: mol_type = other DNA
aaatactactccctatcg

SEQ ID NO: 20854 - DNA, 18 bp, synthetic construct
  source 1..18: mol_type = other DNA
aaatactacttactctag

SEQ ID NO: 20855 - DNA, 18 bp, synthetic construct
  source 1..18: mol_type = other DNA
aaataggacacagtatag

SEQ ID NO: 20856 - DNA, 18 bp, synthetic construct
  source 1..18: mol_type = other DNA
aaatatgaaacactatag

SEQ ID NO: 20857 - DNA, 18 bp, synthetic construct
  source 1..18: mol_type = other DNA
aaatatgactcaacatag

SEQ ID NO: 20858 - DNA, 18 bp, synthetic construct
  source 1..18: mol_type = other DNA
aaatatgactccctatcg

SEQ ID NO: 20859 - DNA, 18 bp, synthetic construct
  source 1..18: mol_type = other DNA
aaatatgactctttatag

SEQ ID NO: 20860 - DNA, 18 bp, synthetic construct
  source 1..18: mol_type = other DNA
aaatatgactgcctatag

SEQ ID NO: 20861 - DNA, 18 bp, synthetic construct
  source 1..18: mol_type = other DNA
aaatattactcactgtag

SEQ ID NO: 20862 - DNA, 18 bp, synthetic construct
  source 1..18: mol_type = other DNA
aaatattacttactatag

SEQ ID NO: 20863 - DNA, 18 bp, synthetic construct
  source 1..18: mol_type = other DNA
aaatccgactcacactag

SEQ ID NO: 20864 - DNA, 18 bp, synthetic construct
  source 1..18: mol_type = other DNA
aaatgagactcactatgg

SEQ ID NO: 20865 - DNA, 18 bp, synthetic construct
  source 1..18: mol_type = other DNA
aaatgagtctcactatag

SEQ ID NO: 20866 - DNA, 18 bp, synthetic construct
  source 1..18: mol_type = other DNA
aaatgcgactcacattag

SEQ ID NO: 20867 - DNA, 18 bp, synthetic construct
  source 1..18: mol_type = other DNA
aaatgcgcctcacaatag

SEQ ID NO: 20868 - DNA, 18 bp, synthetic construct
  source 1..18: mol_type = other DNA
aaatgtgacccactatag

SEQ ID NO: 20869 - DNA, 18 bp, synthetic construct
  source 1..18: mol_type = other DNA
aactacgacccactttag

SEQ ID NO: 20870 - DNA, 18 bp, synthetic construct
  source 1..18: mol_type = other DNA
aactacgactcaaaatag

SEQ ID NO: 20871 - DNA, 18 bp, synthetic construct
  source 1..18: mol_type = other DNA
aactacgactcaccttag

SEQ ID NO: 20872 - DNA, 18 bp, synthetic construct
  source 1..18: mol_type = other DNA
aactacgccttactatag

SEQ ID NO: 20873 - DNA, 18 bp, synthetic construct
  source 1..18: mol_type = other DNA
aactccgacttactatag

SEQ ID NO: 20874 - DNA, 18 bp, synthetic construct
  source 1..18: mol_type = other DNA
aagaacgactcactctag

SEQ ID NO: 20875 - DNA, 18 bp, synthetic construct
  source 1..18: mol_type = other DNA
aagcacgactcaatatag

SEQ ID NO: 20876 - DNA, 18 bp, synthetic construct
  source 1..18: mol_type = other DNA
aagtacgacgcactttag

SEQ ID NO: 20877 - DNA, 18 bp, synthetic construct
  source 1..18: mol_type = other DNA
aagtactactccctatag

SEQ ID NO: 20878 - DNA, 18 bp, synthetic construct
  source 1..18: mol_type = other DNA
aagtatgactaactatag

SEQ ID NO: 20879 - DNA, 18 bp, synthetic construct
  source 1..18: mol_type = other DNA
aattacgacacactatcg

SEQ ID NO: 20880 - DNA, 18 bp, synthetic construct
  source 1..18: mol_type = other DNA
aattacgacctactatag

SEQ ID NO: 20881 - DNA, 18 bp, synthetic construct
  source 1..18: mol_type = other DNA
aattacgacttactacag

SEQ ID NO: 20882 - DNA, 18 bp, synthetic construct
  source 1..18: mol_type = other DNA
aattacgagtcactagag

SEQ ID NO: 20883 - DNA, 18 bp, synthetic construct
  source 1..18: mol_type = other DNA
aattacgtctcactagag

SEQ ID NO: 20884 - DNA, 18 bp, synthetic construct
  source 1..18: mol_type = other DNA
aattgcgacacactatag

SEQ ID NO: 20885 - DNA, 18 bp, synthetic construct
  source 1..18: mol_type = other DNA
acataagactctctatag

SEQ ID NO: 20886 - DNA, 18 bp, synthetic construct
  source 1..18: mol_type = other DNA
acataccactccctatag

SEQ ID NO: 20887 - DNA, 18 bp, synthetic construct
  source 1..18: mol_type = other DNA
acatacgaatcactgtag

SEQ ID NO: 20888 - DNA, 18 bp, synthetic construct
  source 1..18: mol_type = other DNA
acatacgccttactatag

SEQ ID NO: 20889 - DNA, 18 bp, synthetic construct
  source 1..18: mol_type = other DNA
acatacttctcactatag

SEQ ID NO: 20890 - DNA, 18 bp, synthetic construct
  source 1..18: mol_type = other DNA
acataggacttactatag

SEQ ID NO: 20891 - DNA, 18 bp, synthetic construct
  source 1..18: mol_type = other DNA
acgtacgactctctatag

SEQ ID NO: 20892 - DNA, 18 bp, synthetic construct
  source 1..18: mol_type = other DNA
agaaacgactcacaatag

SEQ ID NO: 20893 - DNA, 18 bp, synthetic construct
  source 1..18: mol_type = other DNA
agatacaactctctatag

SEQ ID NO: 20894 - DNA, 18 bp, synthetic construct
  source 1..18: mol_type = other DNA
agatacgagtcaatatag

SEQ ID NO: 20895 - DNA, 18 bp, synthetic construct
  source 1..18: mol_type = other DNA
agatacgtctcactatcg

SEQ ID NO: 20896 - DNA, 18 bp, synthetic construct
  source 1..18: mol_type = other DNA
agatactactctctatag

SEQ ID NO: 20897 - DNA, 18 bp, synthetic construct
  source 1..18: mol_type = other DNA
atataccacttactatag

SEQ ID NO: 20898 - DNA, 18 bp, synthetic construct
  source 1..18: mol_type = other DNA
atatacgactcaccctag

SEQ ID NO: 20899 - DNA, 18 bp, synthetic construct
  source 1..18: mol_type = other DNA
atatacgagacactatag

SEQ ID NO: 20900 - DNA, 18 bp, synthetic construct
  source 1..18: mol_type = other DNA
atatacgagtcattatag

SEQ ID NO: 20901 - DNA, 18 bp, synthetic construct
  source 1..18: mol_type = other DNA
atatactactcacgatag

SEQ ID NO: 20902 - DNA, 18 bp, synthetic construct
  source 1..18: mol_type = other DNA
atatatgactcacaatag

SEQ ID NO: 20903 - DNA, 18 bp, synthetic construct
  source 1..18: mol_type = other DNA
atatgcgactcactagag

SEQ ID NO: 20904 - DNA, 18 bp, synthetic construct
  source 1..18: mol_type = other DNA
atgtaggactcactatag

SEQ ID NO: 20905 - DNA, 18 bp, synthetic construct
  source 1..18: mol_type = other DNA
caaaaagtctcactatag

SEQ ID NO: 20906 - DNA, 18 bp, synthetic construct
  source 1..18: mol_type = other DNA
caaaacgaatcactacag

SEQ ID NO: 20907 - DNA, 18 bp, synthetic construct
  source 1..18: mol_type = other DNA
caaaacgactaactaaag

SEQ ID NO: 20908 - DNA, 18 bp, synthetic construct
  source 1..18: mol_type = other DNA
caataagactctcaatag

SEQ ID NO: 20909 - DNA, 18 bp, synthetic construct
  source 1..18: mol_type = other DNA
caataagacttcctatag

SEQ ID NO: 20910 - DNA, 18 bp, synthetic construct
  source 1..18: mol_type = other DNA
caataagtctcaccatag

SEQ ID NO: 20911 - DNA, 18 bp, synthetic construct
  source 1..18: mol_type = other DNA
caatacaaaacactatag

SEQ ID NO: 20912 - DNA, 18 bp, synthetic construct
  source 1..18: mol_type = other DNA
caatacaactcaatgtag

SEQ ID NO: 20913 - DNA, 18 bp, synthetic construct
  source 1..18: mol_type = other DNA
caatacaattcactagag

SEQ ID NO: 20914 - DNA, 18 bp, synthetic construct
  source 1..18: mol_type = other DNA
caatacgaatccctaaag

SEQ ID NO: 20915 - DNA, 18 bp, synthetic construct
  source 1..18: mol_type = other DNA
caatacgactcacctaag

SEQ ID NO: 20916 - DNA, 18 bp, synthetic construct
  source 1..18: mol_type = other DNA
caatacgcctcaatagag

SEQ ID NO: 20917 - DNA, 18 bp, synthetic construct
  source 1..18: mol_type = other DNA
caatacggcacactagag

SEQ ID NO: 20918 - DNA, 18 bp, synthetic construct
  source 1..18: mol_type = other DNA
caatacggctctttatag

SEQ ID NO: 20919 - DNA, 18 bp, synthetic construct
  source 1..18: mol_type = other DNA
caatacgtctcattaaag

SEQ ID NO: 20920 - DNA, 18 bp, synthetic construct
  source 1..18: mol_type = other DNA
caatacgtcttacgatag

SEQ ID NO: 20921 - DNA, 18 bp, synthetic construct
  source 1..18: mol_type = other DNA
caataggacacaatatag

SEQ ID NO: 20922 - DNA, 18 bp, synthetic construct
  source 1..18: mol_type = other DNA
caataggacatactatag

SEQ ID NO: 20923 - DNA, 18 bp, synthetic construct
  source 1..18: mol_type = other DNA
caatagggctcactttag

SEQ ID NO: 20924 - DNA, 18 bp, synthetic construct
  source 1..18: mol_type = other DNA
caatatcactcattatag

SEQ ID NO: 20925 - DNA, 18 bp, synthetic construct
  source 1..18: mol_type = other DNA
caatatgtctcaatatag

SEQ ID NO: 20926 - DNA, 18 bp, synthetic construct
  source 1..18: mol_type = other DNA
caatcagactcactttag

SEQ ID NO: 20927 - DNA, 18 bp, synthetic construct
  source 1..18: mol_type = other DNA
caatgcaacacactatag

SEQ ID NO: 20928 - DNA, 18 bp, synthetic construct
  source 1..18: mol_type = other DNA
caatgcgacctactatag

SEQ ID NO: 20929 - DNA, 18 bp, synthetic construct
  source 1..18: mol_type = other DNA
caatgggactcactgtag

SEQ ID NO: 20930 - DNA, 18 bp, synthetic construct
  source 1..18: mol_type = other DNA
cactacgacacaatatag

SEQ ID NO: 20931 - DNA, 18 bp, synthetic construct
  source 1..18: mol_type = other DNA
cagcacgacgcactatag

SEQ ID NO: 20932 - DNA, 18 bp, synthetic construct
  source 1..18: mol_type = other DNA
cattacgactcaaaatag

SEQ ID NO: 20933 - DNA, 18 bp, synthetic construct
  source 1..18: mol_type = other DNA
cattacgactcattgtag

SEQ ID NO: 20934 - DNA, 18 bp, synthetic construct
  source 1..18: mol_type = other DNA
cattactactcactatcg

SEQ ID NO: 20935 - DNA, 18 bp, synthetic construct
  source 1..18: mol_type = other DNA
ccatacgaataactatag

SEQ ID NO: 20936 - DNA, 18 bp, synthetic construct
  source 1..18: mol_type = other DNA
ccatacgactcatgatag

SEQ ID NO: 20937 - DNA, 18 bp, synthetic construct
  source 1..18: mol_type = other DNA
ccttacgactcactctag

SEQ ID NO: 20938 - DNA, 18 bp, synthetic construct
  source 1..18: mol_type = other DNA
cgatacgactcaataaag

SEQ ID NO: 20939 - DNA, 18 bp, synthetic construct
  source 1..18: mol_type = other DNA
ctatacaactcacaatag

SEQ ID NO: 20940 - DNA, 18 bp, synthetic construct
  source 1..18: mol_type = other DNA
ctatacgactcaaaatag

SEQ ID NO: 20941 - DNA, 18 bp, synthetic construct
  source 1..18: mol_type = other DNA
ctatacgattccctatag

SEQ ID NO: 20942 - DNA, 18 bp, synthetic construct
  source 1..18: mol_type = other DNA
ctatacggctcactacag

SEQ ID NO: 20943 - DNA, 18 bp, synthetic construct
  source 1..18: mol_type = other DNA
ctatgcgactcagtatag

SEQ ID NO: 20944 - DNA, 18 bp, synthetic construct
  source 1..18: mol_type = other DNA
gaaaacgacacactatcg

SEQ ID NO: 20945 - DNA, 18 bp, synthetic construct
  source 1..18: mol_type = other DNA
gaaaactactcactaaag

SEQ ID NO: 20946 - DNA, 18 bp, synthetic construct
  source 1..18: mol_type = other DNA
gaataagtctcactatgg

SEQ ID NO: 20947 - DNA, 18 bp, synthetic construct
  source 1..18: mol_type = other DNA
gaatacgaatcattttag

SEQ ID NO: 20948 - DNA, 18 bp, synthetic construct
  source 1..18: mol_type = other DNA
gaatacgactcacacaag

SEQ ID NO: 20949 - DNA, 18 bp, synthetic construct
  source 1..18: mol_type = other DNA
gaatacgtctaactctag

SEQ ID NO: 20950 - DNA, 18 bp, synthetic construct
  source 1..18: mol_type = other DNA
gaatacgtcttactttag

SEQ ID NO: 20951 - DNA, 18 bp, synthetic construct
  source 1..18: mol_type = other DNA
gaatacgtcttattatag

SEQ ID NO: 20952 - DNA, 18 bp, synthetic construct
  source 1..18: mol_type = other DNA
gaatccgagtcacgatag

SEQ ID NO: 20953 - DNA, 18 bp, synthetic construct
  source 1..18: mol_type = other DNA
gagtacgagtgactatag

SEQ ID NO: 20954 - DNA, 18 bp, synthetic construct
  source 1..18: mol_type = other DNA
gattaccactcactttag

SEQ ID NO: 20955 - DNA, 18 bp, synthetic construct
  source 1..18: mol_type = other DNA
gattacgaatcactgtag

SEQ ID NO: 20956 - DNA, 18 bp, synthetic construct
  source 1..18: mol_type = other DNA
gattacgactaactctag

SEQ ID NO: 20957 - DNA, 18 bp, synthetic construct
  source 1..18: mol_type = other DNA
gattacgattcacaatag

SEQ ID NO: 20958 - DNA, 18 bp, synthetic construct
  source 1..18: mol_type = other DNA
gattacgattcactctag

SEQ ID NO: 20959 - DNA, 18 bp, synthetic construct
  source 1..18: mol_type = other DNA
gcatacgacacaatatag

SEQ ID NO: 20960 - DNA, 18 bp, synthetic construct
  source 1..18: mol_type = other DNA
gcatacgactctctttag

SEQ ID NO: 20961 - DNA, 18 bp, synthetic construct
  source 1..18: mol_type = other DNA
gcatacgacttaccatag

SEQ ID NO: 20962 - DNA, 18 bp, synthetic construct
  source 1..18: mol_type = other DNA
ggataaggctcactatag

SEQ ID NO: 20963 - DNA, 18 bp, synthetic construct
  source 1..18: mol_type = other DNA
ggataggacttactatag

SEQ ID NO: 20964 - DNA, 18 bp, synthetic construct
  source 1..18: mol_type = other DNA
gtaaacgactaactatag

SEQ ID NO: 20965 - DNA, 18 bp, synthetic construct
  source 1..18: mol_type = other DNA
gttaacgactcactatag

SEQ ID NO: 20966 - DNA, 18 bp, synthetic construct
  source 1..18: mol_type = other DNA
taaaaagtctccctatag

SEQ ID NO: 20967 - DNA, 18 bp, synthetic construct
  source 1..18: mol_type = other DNA
taaaacaactgacaatag

SEQ ID NO: 20968 - DNA, 18 bp, synthetic construct
  source 1..18: mol_type = other DNA
taaaaccacacaatatag

SEQ ID NO: 20969 - DNA, 18 bp, synthetic construct
  source 1..18: mol_type = other DNA
taaaaccactcagtttag

SEQ ID NO: 20970 - DNA, 18 bp, synthetic construct
  source 1..18: mol_type = other DNA
taaaacgaatcaccagag

SEQ ID NO: 20971 - DNA, 18 bp, synthetic construct
  source 1..18: mol_type = other DNA
taaaacgaatctttatag

SEQ ID NO: 20972 - DNA, 18 bp, synthetic construct
  source 1..18: mol_type = other DNA
taaaacgactcagttcag

SEQ ID NO: 20973 - DNA, 18 bp, synthetic construct
  source 1..18: mol_type = other DNA
taaaacgactcccactag

SEQ ID NO: 20974 - DNA, 18 bp, synthetic construct
  source 1..18: mol_type = other DNA
taaaacgactccctgtcg

SEQ ID NO: 20975 - DNA, 18 bp, synthetic construct
  source 1..18: mol_type = other DNA
taaaacgacttaatagag

SEQ ID NO: 20976 - DNA, 18 bp, synthetic construct
  source 1..18: mol_type = other DNA
taaaacgagttactatcg

SEQ ID NO: 20977 - DNA, 18 bp, synthetic construct
  source 1..18: mol_type = other DNA
taaaacgattcactttgg

SEQ ID NO: 20978 - DNA, 18 bp, synthetic construct
  source 1..18: mol_type = other DNA
taaaacgatttacaatag

SEQ ID NO: 20979 - DNA, 18 bp, synthetic construct
  source 1..18: mol_type = other DNA
taaaacgcctcagcatag

SEQ ID NO: 20980 - DNA, 18 bp, synthetic construct
  source 1..18: mol_type = other DNA
taaaacgccttaccatag

SEQ ID NO: 20981 - DNA, 18 bp, synthetic construct
  source 1..18: mol_type = other DNA
taaaacggctcacaatcg

SEQ ID NO: 20982 - DNA, 18 bp, synthetic construct
  source 1..18: mol_type = other DNA
taaaacggctcacactag

SEQ ID NO: 20983 - DNA, 18 bp, synthetic construct
  source 1..18: mol_type = other DNA
taaaacggctcattatgg

SEQ ID NO: 20984 - DNA, 18 bp, synthetic construct
  source 1..18: mol_type = other DNA
taaaacggttcattatag

SEQ ID NO: 20985 - DNA, 18 bp, synthetic construct
  source 1..18: mol_type = other DNA
taaaacgtctctctatcg

SEQ ID NO: 20986 - DNA, 18 bp, synthetic construct
  source 1..18: mol_type = other DNA
taaaactagttactatag

SEQ ID NO: 20987 - DNA, 18 bp, synthetic construct
  source 1..18: mol_type = other DNA
taaaactgctcactaaag

SEQ ID NO: 20988 - DNA, 18 bp, synthetic construct
  source 1..18: mol_type = other DNA
taaaacttctcactatgg

SEQ ID NO: 20989 - DNA, 18 bp, synthetic construct
  source 1..18: mol_type = other DNA
taaaaggactaattatag

SEQ ID NO: 20990 - DNA, 18 bp, synthetic construct
  source 1..18: mol_type = other DNA
taaaaggacttcctatag

SEQ ID NO: 20991 - DNA, 18 bp, synthetic construct
  source 1..18: mol_type = other DNA
taaaatatctcactatag

SEQ ID NO: 20992 - DNA, 18 bp, synthetic construct
  source 1..18: mol_type = other DNA
taaaatgactaactttag

SEQ ID NO: 20993 - DNA, 18 bp, synthetic construct
  source 1..18: mol_type = other DNA
taaaatgactgactttag

SEQ ID NO: 20994 - DNA, 18 bp, synthetic construct
  source 1..18: mol_type = other DNA
taaaatggcccactatag

SEQ ID NO: 20995 - DNA, 18 bp, synthetic construct
  source 1..18: mol_type = other DNA
taaacaggctcactatag

SEQ ID NO: 20996 - DNA, 18 bp, synthetic construct
  source 1..18: mol_type = other DNA
taaaccacctcactatag

SEQ ID NO: 20997 - DNA, 18 bp, synthetic construct
  source 1..18: mol_type = other DNA
taaaccgtctcattatag

SEQ ID NO: 20998 - DNA, 18 bp, synthetic construct
  source 1..18: mol_type = other DNA
taaacctacgcactatag

SEQ ID NO: 20999 - DNA, 18 bp, synthetic construct
  source 1..18: mol_type = other DNA
taaagagactcaatatag

SEQ ID NO: 21000 - DNA, 18 bp, synthetic construct
  source 1..18: mol_type = other DNA
taaagcgacaaactatag

SEQ ID NO: 21001 - DNA, 18 bp, synthetic construct
  source 1..18: mol_type = other DNA
taacaagacacaatatag

SEQ ID NO: 21002 - DNA, 18 bp, synthetic construct
  source 1..18: mol_type = other DNA
taacaagcctcactatcg

SEQ ID NO: 21003 - DNA, 18 bp, synthetic construct
  source 1..18: mol_type = other DNA
taacaccacacacaatag

SEQ ID NO: 21004 - DNA, 18 bp, synthetic construct
  source 1..18: mol_type = other DNA
taacacgacgcaccctag

SEQ ID NO: 21005 - DNA, 18 bp, synthetic construct
  source 1..18: mol_type = other DNA
taacacgactcaacaaag

SEQ ID NO: 21006 - DNA, 18 bp, synthetic construct
  source 1..18: mol_type = other DNA
taacacgactctttaaag

SEQ ID NO: 21007 - DNA, 18 bp, synthetic construct
  source 1..18: mol_type = other DNA
taacacgactgattttag

SEQ ID NO: 21008 - DNA, 18 bp, synthetic construct
  source 1..18: mol_type = other DNA
taacacgccgctctatag

SEQ ID NO: 21009 - DNA, 18 bp, synthetic construct
  source 1..18: mol_type = other DNA
taacacgcctcacaaaag

SEQ ID NO: 21010 - DNA, 18 bp, synthetic construct
  source 1..18: mol_type = other DNA
taacacgtctctatatag

SEQ ID NO: 21011 - DNA, 18 bp, synthetic construct
  source 1..18: mol_type = other DNA
taacactactgaccatag

SEQ ID NO: 21012 - DNA, 18 bp, synthetic construct
  source 1..18: mol_type = other DNA
taacaggaatccctatag

SEQ ID NO: 21013 - DNA, 18 bp, synthetic construct
  source 1..18: mol_type = other DNA
taacatgaatcactacag

SEQ ID NO: 21014 - DNA, 18 bp, synthetic construct
  source 1..18: mol_type = other DNA
taacatgaccaactatag

SEQ ID NO: 21015 - DNA, 18 bp, synthetic construct
  source 1..18: mol_type = other DNA
taaccagattcactatag

SEQ ID NO: 21016 - DNA, 18 bp, synthetic construct
  source 1..18: mol_type = other DNA
taacccgacctactatag

SEQ ID NO: 21017 - DNA, 18 bp, synthetic construct
  source 1..18: mol_type = other DNA
taacccgacgcactctag

SEQ ID NO: 21018 - DNA, 18 bp, synthetic construct
  source 1..18: mol_type = other DNA
taacccgactaactaaag

SEQ ID NO: 21019 - DNA, 18 bp, synthetic construct
  source 1..18: mol_type = other DNA
taacccgactcattttag

SEQ ID NO: 21020 - DNA, 18 bp, synthetic construct
  source 1..18: mol_type = other DNA
taacctgactcactatcg

SEQ ID NO: 21021 - DNA, 18 bp, synthetic construct
  source 1..18: mol_type = other DNA
taacctgactcattatag

SEQ ID NO: 21022 - DNA, 18 bp, synthetic construct
  source 1..18: mol_type = other DNA
taacgcgactctctaaag

SEQ ID NO: 21023 - DNA, 18 bp, synthetic construct
  source 1..18: mol_type = other DNA
taagaagactcacttaag

SEQ ID NO: 21024 - DNA, 18 bp, synthetic construct
  source 1..18: mol_type = other DNA
taagaagattcactatcg

SEQ ID NO: 21025 - DNA, 18 bp, synthetic construct
  source 1..18: mol_type = other DNA
taagacgaatgaatatag

SEQ ID NO: 21026 - DNA, 18 bp, synthetic construct
  source 1..18: mol_type = other DNA
taagacgacacattagag

SEQ ID NO: 21027 - DNA, 18 bp, synthetic construct
  source 1..18: mol_type = other DNA
taagacgaccctgtatag

SEQ ID NO: 21028 - DNA, 18 bp, synthetic construct
  source 1..18: mol_type = other DNA
taagacgactccttaaag

SEQ ID NO: 21029 - DNA, 18 bp, synthetic construct
  source 1..18: mol_type = other DNA
taagacgactctcaatcg

SEQ ID NO: 21030 - DNA, 18 bp, synthetic construct
  source 1..18: mol_type = other DNA
taagacgcctctctatcg

SEQ ID NO: 21031 - DNA, 18 bp, synthetic construct
  source 1..18: mol_type = other DNA
taagactagtcacgatag

SEQ ID NO: 21032 - DNA, 18 bp, synthetic construct
  source 1..18: mol_type = other DNA
taagatgaatctctatag

SEQ ID NO: 21033 - DNA, 18 bp, synthetic construct
  source 1..18: mol_type = other DNA
taagatgacacaatatag

SEQ ID NO: 21034 - DNA, 18 bp, synthetic construct
  source 1..18: mol_type = other DNA
taagccgacttattatag

SEQ ID NO: 21035 - DNA, 18 bp, synthetic construct
  source 1..18: mol_type = other DNA
taaggcgactcattttag

SEQ ID NO: 21036 - DNA, 18 bp, synthetic construct
  source 1..18: mol_type = other DNA
taaggctacccactatag

SEQ ID NO: 21037 - DNA, 18 bp, synthetic construct
  source 1..18: mol_type = other DNA
taataaaactatctatag

SEQ ID NO: 21038 - DNA, 18 bp, synthetic construct
  source 1..18: mol_type = other DNA
taataaacctcactctag

SEQ ID NO: 21039 - DNA, 18 bp, synthetic construct
  source 1..18: mol_type = other DNA
taataagactcacccaag

SEQ ID NO: 21040 - DNA, 18 bp, synthetic construct
  source 1..18: mol_type = other DNA
taataagactccctacgg

SEQ ID NO: 21041 - DNA, 18 bp, synthetic construct
  source 1..18: mol_type = other DNA
taataagacttacttcag

SEQ ID NO: 21042 - DNA, 18 bp, synthetic construct
  source 1..18: mol_type = other DNA
taataagacttcatatag

SEQ ID NO: 21043 - DNA, 18 bp, synthetic construct
  source 1..18: mol_type = other DNA
taataagagtcacaatcg

SEQ ID NO: 21044 - DNA, 18 bp, synthetic construct
  source 1..18: mol_type = other DNA
taataagcctaactgtag

SEQ ID NO: 21045 - DNA, 18 bp, synthetic construct
  source 1..18: mol_type = other DNA
taataaggatcacaatag

SEQ ID NO: 21046 - DNA, 18 bp, synthetic construct
  source 1..18: mol_type = other DNA
taataagtctaaatatag

SEQ ID NO: 21047 - DNA, 18 bp, synthetic construct
  source 1..18: mol_type = other DNA
taataagtctcattacag

SEQ ID NO: 21048 - DNA, 18 bp, synthetic construct
  source 1..18: mol_type = other DNA
taataatactcacttcag

SEQ ID NO: 21049 - DNA, 18 bp, synthetic construct
  source 1..18: mol_type = other DNA
taataatacttacaatag

SEQ ID NO: 21050 - DNA, 18 bp, synthetic construct
  source 1..18: mol_type = other DNA
taatacaaagcactaaag

SEQ ID NO: 21051 - DNA, 18 bp, synthetic construct
  source 1..18: mol_type = other DNA
taatacaaatccctgtag

SEQ ID NO: 21052 - DNA, 18 bp, synthetic construct
  source 1..18: mol_type = other DNA
taatacaacaccctaaag

SEQ ID NO: 21053 - DNA, 18 bp, synthetic construct
  source 1..18: mol_type = other DNA
taatacaactcaccttcg

SEQ ID NO: 21054 - DNA, 18 bp, synthetic construct
  source 1..18: mol_type = other DNA
taatacaactctcaagag

SEQ ID NO: 21055 - DNA, 18 bp, synthetic construct
  source 1..18: mol_type = other DNA
taatacaacttactaacg

SEQ ID NO: 21056 - DNA, 18 bp, synthetic construct
  source 1..18: mol_type = other DNA
taatacaactttgtatag

SEQ ID NO: 21057 - DNA, 18 bp, synthetic construct
  source 1..18: mol_type = other DNA
taatacaagttaccatag

SEQ ID NO: 21058 - DNA, 18 bp, synthetic construct
  source 1..18: mol_type = other DNA
taatacaattcactaacg

SEQ ID NO: 21059 - DNA, 18 bp, synthetic construct
  source 1..18: mol_type = other DNA
taatacacctcataatag

SEQ ID NO: 21060 - DNA, 18 bp, synthetic construct
  source 1..18: mol_type = other DNA
taatacagcacactctag

SEQ ID NO: 21061 - DNA, 18 bp, synthetic construct
  source 1..18: mol_type = other DNA
taatacatccaactatag

SEQ ID NO: 21062 - DNA, 18 bp, synthetic construct
  source 1..18: mol_type = other DNA
taatacatctctctatcg

SEQ ID NO: 21063 - DNA, 18 bp, synthetic construct
  source 1..18: mol_type = other DNA
taatacatctctctgtag

SEQ ID NO: 21064 - DNA, 18 bp, synthetic construct
  source 1..18: mol_type = other DNA
taatacatctgactaaag

SEQ ID NO: 21065 - DNA, 18 bp, synthetic construct
  source 1..18: mol_type = other DNA
taatacatcttagtatag

SEQ ID NO: 21066 - DNA, 18 bp, synthetic construct
  source 1..18: mol_type = other DNA
taataccaaacaccatag

SEQ ID NO: 21067 - DNA, 18 bp, synthetic construct
  source 1..18: mol_type = other DNA
taataccactaattctag

SEQ ID NO: 21068 - DNA, 18 bp, synthetic construct
  source 1..18: mol_type = other DNA
taataccactctacatag

SEQ ID NO: 21069 - DNA, 18 bp, synthetic construct
  source 1..18: mol_type = other DNA
taataccactgagcatag

SEQ ID NO: 21070 - DNA, 18 bp, synthetic construct
  source 1..18: mol_type = other DNA
taatacccctccctttag

SEQ ID NO: 21071 - DNA, 18 bp, synthetic construct
  source 1..18: mol_type = other DNA
taataccgctctccatag

SEQ ID NO: 21072 - DNA, 18 bp, synthetic construct
  source 1..18: mol_type = other DNA
taatacctctcacggtag

SEQ ID NO: 21073 - DNA, 18 bp, synthetic construct
  source 1..18: mol_type = other DNA
taatacctcttactgtag

SEQ ID NO: 21074 - DNA, 18 bp, synthetic construct
  source 1..18: mol_type = other DNA
taatacgaataattctag

SEQ ID NO: 21075 - DNA, 18 bp, synthetic construct
  source 1..18: mol_type = other DNA
taatacgaatcaatcaag

SEQ ID NO: 21076 - DNA, 18 bp, synthetic construct
  source 1..18: mol_type = other DNA
taatacgaatcaattcag

SEQ ID NO: 21077 - DNA, 18 bp, synthetic construct
  source 1..18: mol_type = other DNA
taatacgaatcacgttcg

SEQ ID NO: 21078 - DNA, 18 bp, synthetic construct
  source 1..18: mol_type = other DNA
taatacgaatcagtttgg

SEQ ID NO: 21079 - DNA, 18 bp, synthetic construct
  source 1..18: mol_type = other DNA
taatacgaatcccgacag

SEQ ID NO: 21080 - DNA, 18 bp, synthetic construct
  source 1..18: mol_type = other DNA
taatacgaatctatacag

SEQ ID NO: 21081 - DNA, 18 bp, synthetic construct
  source 1..18: mol_type = other DNA
taatacgaatgtctatcg

SEQ ID NO: 21082 - DNA, 18 bp, synthetic construct
  source 1..18: mol_type = other DNA
taatacgacacagaatgg

SEQ ID NO: 21083 - DNA, 18 bp, synthetic construct
  source 1..18: mol_type = other DNA
taatacgacactttatgg

SEQ ID NO: 21084 - DNA, 18 bp, synthetic construct
  source 1..18: mol_type = other DNA
taatacgacatattagag

SEQ ID NO: 21085 - DNA, 18 bp, synthetic construct
  source 1..18: mol_type = other DNA
taatacgaccaattttag

SEQ ID NO: 21086 - DNA, 18 bp, synthetic construct
  source 1..18: mol_type = other DNA
taatacgactatatataa

SEQ ID NO: 21087 - DNA, 18 bp, synthetic construct
  source 1..18: mol_type = other DNA
taatacgactatatctag

SEQ ID NO: 21088 - DNA, 18 bp, synthetic construct
  source 1..18: mol_type = other DNA
taatacgactatccacag

SEQ ID NO: 21089 - DNA, 18 bp, synthetic construct
  source 1..18: mol_type = other DNA
taatacgactcacagagg

SEQ ID NO: 21090 - DNA, 18 bp, synthetic construct
  source 1..18: mol_type = other DNA
taatacgactcaggtaag

SEQ ID NO: 21091 - DNA, 18 bp, synthetic construct
  source 1..18: mol_type = other DNA
taatacgactcattcacg

SEQ ID NO: 21092 - DNA, 18 bp, synthetic construct
  source 1..18: mol_type = other DNA
taatacgactccccaacg

SEQ ID NO: 21093 - DNA, 18 bp, synthetic construct
  source 1..18: mol_type = other DNA
taatacgactcttcaaag

SEQ ID NO: 21094 - DNA, 18 bp, synthetic construct
  source 1..18: mol_type = other DNA
taatacgactgataaaag

SEQ ID NO: 21095 - DNA, 18 bp, synthetic construct
  source 1..18: mol_type = other DNA
taatacgacttagttgag

SEQ ID NO: 21096 - DNA, 18 bp, synthetic construct
  source 1..18: mol_type = other DNA
taatacgacttagtttcg

SEQ ID NO: 21097 - DNA, 18 bp, synthetic construct
  source 1..18: mol_type = other DNA
taatacgagacactcaag

SEQ ID NO: 21098 - DNA, 18 bp, synthetic construct
  source 1..18: mol_type = other DNA
taatacgagtaaatatgg

SEQ ID NO: 21099 - DNA, 18 bp, synthetic construct
  source 1..18: mol_type = other DNA
taatacgagtaatcatag

SEQ ID NO: 21100 - DNA, 18 bp, synthetic construct
  source 1..18: mol_type = other DNA
taatacgatacaataaag

SEQ ID NO: 21101 - DNA, 18 bp, synthetic construct
  source 1..18: mol_type = other DNA
taatacgatccactaagg

SEQ ID NO: 21102 - DNA, 18 bp, synthetic construct
  source 1..18: mol_type = other DNA
taatacgatgctccatag

SEQ ID NO: 21103 - DNA, 18 bp, synthetic construct
  source 1..18: mol_type = other DNA
taatacgatttaatatgg

SEQ ID NO: 21104 - DNA, 18 bp, synthetic construct
  source 1..18: mol_type = other DNA
taatacgcatcactaacg

SEQ ID NO: 21105 - DNA, 18 bp, synthetic construct
  source 1..18: mol_type = other DNA
taatacgccgaactttag

SEQ ID NO: 21106 - DNA, 18 bp, synthetic construct
  source 1..18: mol_type = other DNA
taatacgcctccccaaag

SEQ ID NO: 21107 - DNA, 18 bp, synthetic construct
  source 1..18: mol_type = other DNA
taatacgcttcactcaag

SEQ ID NO: 21108 - DNA, 18 bp, synthetic construct
  source 1..18: mol_type = other DNA
taatacggcagactaaag

SEQ ID NO: 21109 - DNA, 18 bp, synthetic construct
  source 1..18: mol_type = other DNA
taatacggcgcacttaag

SEQ ID NO: 21110 - DNA, 18 bp, synthetic construct
  source 1..18: mol_type = other DNA
taatacggctctatagag

SEQ ID NO: 21111 - DNA, 18 bp, synthetic construct
  source 1..18: mol_type = other DNA
taatacggctctcaagag

SEQ ID NO: 21112 - DNA, 18 bp, synthetic construct
  source 1..18: mol_type = other DNA
taatacggctctctgaag

SEQ ID NO: 21113 - DNA, 18 bp, synthetic construct
  source 1..18: mol_type = other DNA
taatacggctctctgcag

SEQ ID NO: 21114 - DNA, 18 bp, synthetic construct
  source 1..18: mol_type = other DNA
taatacgtaccagtatag

SEQ ID NO: 21115 - DNA, 18 bp, synthetic construct
  source 1..18: mol_type = other DNA
taatacgtatccctttag

SEQ ID NO: 21116 - DNA, 18 bp, synthetic construct
  source 1..18: mol_type = other DNA
taatacgtcccacaacag

SEQ ID NO: 21117 - DNA, 18 bp, synthetic construct
  source 1..18: mol_type = other DNA
taatacgtcgatctatag

SEQ ID NO: 21118 - DNA, 18 bp, synthetic construct
  source 1..18: mol_type = other DNA
taatacgtctcaccaccg

SEQ ID NO: 21119 - DNA, 18 bp, synthetic construct
  source 1..18: mol_type = other DNA
taatacgtctccgcatag

SEQ ID NO: 21120 - DNA, 18 bp, synthetic construct
  source 1..18: mol_type = other DNA
taatacgtgtccccatag

SEQ ID NO: 21121 - DNA, 18 bp, synthetic construct
  source 1..18: mol_type = other DNA
taatacgttacattatag

SEQ ID NO: 21122 - DNA, 18 bp, synthetic construct
  source 1..18: mol_type = other DNA
taatacgtttcacaatcg

SEQ ID NO: 21123 - DNA, 18 bp, synthetic construct
  source 1..18: mol_type = other DNA
taatacgtttcactaggg

SEQ ID NO: 21124 - DNA, 18 bp, synthetic construct
  source 1..18: mol_type = other DNA
taatactaataactatcg

SEQ ID NO: 21125 - DNA, 18 bp, synthetic construct
  source 1..18: mol_type = other DNA
taatactacccaatacag

SEQ ID NO: 21126 - DNA, 18 bp, synthetic construct
  source 1..18: mol_type = other DNA
taatactacccactcaag

SEQ ID NO: 21127 - DNA, 18 bp, synthetic construct
  source 1..18: mol_type = other DNA
taatactactcattttcg

SEQ ID NO: 21128 - DNA, 18 bp, synthetic construct
  source 1..18: mol_type = other DNA
taatactacttaatttag

SEQ ID NO: 21129 - DNA, 18 bp, synthetic construct
  source 1..18: mol_type = other DNA
taatactagccacaatag

SEQ ID NO: 21130 - DNA, 18 bp, synthetic construct
  source 1..18: mol_type = other DNA
taatactagtccctaaag

SEQ ID NO: 21131 - DNA, 18 bp, synthetic construct
  source 1..18: mol_type = other DNA
taatactagtgaatatag

SEQ ID NO: 21132 - DNA, 18 bp, synthetic construct
  source 1..18: mol_type = other DNA
taatactatcccctatag

SEQ ID NO: 21133 - DNA, 18 bp, synthetic construct
  source 1..18: mol_type = other DNA
taatactattctctagag

SEQ ID NO: 21134 - DNA, 18 bp, synthetic construct
  source 1..18: mol_type = other DNA
taatactcctcagtttag

SEQ ID NO: 21135 - DNA, 18 bp, synthetic construct
  source 1..18: mol_type = other DNA
taatactcctctcgatag

SEQ ID NO: 21136 - DNA, 18 bp, synthetic construct
  source 1..18: mol_type = other DNA
taatactcctctctaaag

SEQ ID NO: 21137 - DNA, 18 bp, synthetic construct
  source 1..18: mol_type = other DNA
taatactcgtcaccatag

SEQ ID NO: 21138 - DNA, 18 bp, synthetic construct
  source 1..18: mol_type = other DNA
taatactgcactctatag

SEQ ID NO: 21139 - DNA, 18 bp, synthetic construct
  source 1..18: mol_type = other DNA
taatacttcccactgtag

SEQ ID NO: 21140 - DNA, 18 bp, synthetic construct
  source 1..18: mol_type = other DNA
taatagaacttactatcg

SEQ ID NO: 21141 - DNA, 18 bp, synthetic construct
  source 1..18: mol_type = other DNA
taatagaacttactgtag

SEQ ID NO: 21142 - DNA, 18 bp, synthetic construct
  source 1..18: mol_type = other DNA
taataggaatcaatacag

SEQ ID NO: 21143 - DNA, 18 bp, synthetic construct
  source 1..18: mol_type = other DNA
taataggaatcaatctag

SEQ ID NO: 21144 - DNA, 18 bp, synthetic construct
  source 1..18: mol_type = other DNA
taataggaatcagtctag

SEQ ID NO: 21145 - DNA, 18 bp, synthetic construct
  source 1..18: mol_type = other DNA
taataggactcaccaacg

SEQ ID NO: 21146 - DNA, 18 bp, synthetic construct
  source 1..18: mol_type = other DNA
taataggattaactaaag

SEQ ID NO: 21147 - DNA, 18 bp, synthetic construct
  source 1..18: mol_type = other DNA
taataggcctctctgtag

SEQ ID NO: 21148 - DNA, 18 bp, synthetic construct
  source 1..18: mol_type = other DNA
taataggtcacactacag

SEQ ID NO: 21149 - DNA, 18 bp, synthetic construct
  source 1..18: mol_type = other DNA
taataggtctctccatag

SEQ ID NO: 21150 - DNA, 18 bp, synthetic construct
  source 1..18: mol_type = other DNA
taataggtctctctatgg

SEQ ID NO: 21151 - DNA, 18 bp, synthetic construct
  source 1..18: mol_type = other DNA
taatataactaactatcg

SEQ ID NO: 21152 - DNA, 18 bp, synthetic construct
  source 1..18: mol_type = other DNA
taatataactaactctag

SEQ ID NO: 21153 - DNA, 18 bp, synthetic construct
  source 1..18: mol_type = other DNA
taatataactccttatag

SEQ ID NO: 21154 - DNA, 18 bp, synthetic construct
  source 1..18: mol_type = other DNA
taatatatctaactatag

SEQ ID NO: 21155 - DNA, 18 bp, synthetic construct
  source 1..18: mol_type = other DNA
taatatcacactctatag

SEQ ID NO: 21156 - DNA, 18 bp, synthetic construct
  source 1..18: mol_type = other DNA
taatatcatacactatag

SEQ ID NO: 21157 - DNA, 18 bp, synthetic construct
  source 1..18: mol_type = other DNA
taatatgaaatactatag

SEQ ID NO: 21158 - DNA, 18 bp, synthetic construct
  source 1..18: mol_type = other DNA
taatatgaataactaaag

SEQ ID NO: 21159 - DNA, 18 bp, synthetic construct
  source 1..18: mol_type = other DNA
taatatgaataattatag

SEQ ID NO: 21160 - DNA, 18 bp, synthetic construct
  source 1..18: mol_type = other DNA
taatatgaatgactatgg

SEQ ID NO: 21161 - DNA, 18 bp, synthetic construct
  source 1..18: mol_type = other DNA
taatatgacagacaatag

SEQ ID NO: 21162 - DNA, 18 bp, synthetic construct
  source 1..18: mol_type = other DNA
taatatgactcataacag

SEQ ID NO: 21163 - DNA, 18 bp, synthetic construct
  source 1..18: mol_type = other DNA
taatatgactccctaagg

SEQ ID NO: 21164 - DNA, 18 bp, synthetic construct
  source 1..18: mol_type = other DNA
taatatgactctataaag

SEQ ID NO: 21165 - DNA, 18 bp, synthetic construct
  source 1..18: mol_type = other DNA
taatatgactgatgatag

SEQ ID NO: 21166 - DNA, 18 bp, synthetic construct
  source 1..18: mol_type = other DNA
taatatgagtaactctag

SEQ ID NO: 21167 - DNA, 18 bp, synthetic construct
  source 1..18: mol_type = other DNA
taatatgatccactatgg

SEQ ID NO: 21168 - DNA, 18 bp, synthetic construct
  source 1..18: mol_type = other DNA
taatatgcctgattatag

SEQ ID NO: 21169 - DNA, 18 bp, synthetic construct
  source 1..18: mol_type = other DNA
taatatgcgtcaatatag

SEQ ID NO: 21170 - DNA, 18 bp, synthetic construct
  source 1..18: mol_type = other DNA
taatatggatcacaatag

SEQ ID NO: 21171 - DNA, 18 bp, synthetic construct
  source 1..18: mol_type = other DNA
taatatgtctccctctag

SEQ ID NO: 21172 - DNA, 18 bp, synthetic construct
  source 1..18: mol_type = other DNA
taatatgtttcactctag

SEQ ID NO: 21173 - DNA, 18 bp, synthetic construct
  source 1..18: mol_type = other DNA
taatattaatcactttag

SEQ ID NO: 21174 - DNA, 18 bp, synthetic construct
  source 1..18: mol_type = other DNA
taatattactcactgtcg

SEQ ID NO: 21175 - DNA, 18 bp, synthetic construct
  source 1..18: mol_type = other DNA
taatattactctttatag

SEQ ID NO: 21176 - DNA, 18 bp, synthetic construct
  source 1..18: mol_type = other DNA
taatattgctcactttag

SEQ ID NO: 21177 - DNA, 18 bp, synthetic construct
  source 1..18: mol_type = other DNA
taatatttctcactacag

SEQ ID NO: 21178 - DNA, 18 bp, synthetic construct
  source 1..18: mol_type = other DNA
taatcagactcacagtag

SEQ ID NO: 21179 - DNA, 18 bp, synthetic construct
  source 1..18: mol_type = other DNA
taatccaatgcactatag

SEQ ID NO: 21180 - DNA, 18 bp, synthetic construct
  source 1..18: mol_type = other DNA
taatccatctaactatag

SEQ ID NO: 21181 - DNA, 18 bp, synthetic construct
  source 1..18: mol_type = other DNA
taatcccactcacaacag

SEQ ID NO: 21182 - DNA, 18 bp, synthetic construct
  source 1..18: mol_type = other DNA
taatcccactcacattag

SEQ ID NO: 21183 - DNA, 18 bp, synthetic construct
  source 1..18: mol_type = other DNA
taatcccacttactacag

SEQ ID NO: 21184 - DNA, 18 bp, synthetic construct
  source 1..18: mol_type = other DNA
taatccgaatcattaaag

SEQ ID NO: 21185 - DNA, 18 bp, synthetic construct
  source 1..18: mol_type = other DNA
taatccgacactctacag

SEQ ID NO: 21186 - DNA, 18 bp, synthetic construct
  source 1..18: mol_type = other DNA
taatccgacccacaacag

SEQ ID NO: 21187 - DNA, 18 bp, synthetic construct
  source 1..18: mol_type = other DNA
taatccgactaactttgg

SEQ ID NO: 21188 - DNA, 18 bp, synthetic construct
  source 1..18: mol_type = other DNA
taatccgacttaataaag

SEQ ID NO: 21189 - DNA, 18 bp, synthetic construct
  source 1..18: mol_type = other DNA
taatccgacttacaaaag

SEQ ID NO: 21190 - DNA, 18 bp, synthetic construct
  source 1..18: mol_type = other DNA
taatccgatccactctag

SEQ ID NO: 21191 - DNA, 18 bp, synthetic construct
  source 1..18: mol_type = other DNA
taatccgattcacaatcg

SEQ ID NO: 21192 - DNA, 18 bp, synthetic construct
  source 1..18: mol_type = other DNA
taatccggctcacttgag

SEQ ID NO: 21193 - DNA, 18 bp, synthetic construct
  source 1..18: mol_type = other DNA
taatccgtcacattatag

SEQ ID NO: 21194 - DNA, 18 bp, synthetic construct
  source 1..18: mol_type = other DNA
taatccgtctcactaagg

SEQ ID NO: 21195 - DNA, 18 bp, synthetic construct
  source 1..18: mol_type = other DNA
taatccgtctcattacag

SEQ ID NO: 21196 - DNA, 18 bp, synthetic construct
  source 1..18: mol_type = other DNA
taatccgtctccctttag

SEQ ID NO: 21197 - DNA, 18 bp, synthetic construct
  source 1..18: mol_type = other DNA
taatccgtcttaatatag

SEQ ID NO: 21198 - DNA, 18 bp, synthetic construct
  source 1..18: mol_type = other DNA
taatcctactcacaatgg

SEQ ID NO: 21199 - DNA, 18 bp, synthetic construct
  source 1..18: mol_type = other DNA
taatcctccacactatag

SEQ ID NO: 21200 - DNA, 18 bp, synthetic construct
  source 1..18: mol_type = other DNA
taatcgatctcactatag

SEQ ID NO: 21201 - DNA, 18 bp, synthetic construct
  source 1..18: mol_type = other DNA
taatcggactctctgtag

SEQ ID NO: 21202 - DNA, 18 bp, synthetic construct
  source 1..18: mol_type = other DNA
taatctgaatcactttag

SEQ ID NO: 21203 - DNA, 18 bp, synthetic construct
  source 1..18: mol_type = other DNA
taatgagccttactatag

SEQ ID NO: 21204 - DNA, 18 bp, synthetic construct
  source 1..18: mol_type = other DNA
taatgagtgtcactatag

SEQ ID NO: 21205 - DNA, 18 bp, synthetic construct
  source 1..18: mol_type = other DNA
taatgcaaatcaccatag

SEQ ID NO: 21206 - DNA, 18 bp, synthetic construct
  source 1..18: mol_type = other DNA
taatgcaactcaatatgg

SEQ ID NO: 21207 - DNA, 18 bp, synthetic construct
  source 1..18: mol_type = other DNA
taatgcaactcacaagag

SEQ ID NO: 21208 - DNA, 18 bp, synthetic construct
  source 1..18: mol_type = other DNA
taatgcgaatctctgtag

SEQ ID NO: 21209 - DNA, 18 bp, synthetic construct
  source 1..18: mol_type = other DNA
taatgcgacacacttgag

SEQ ID NO: 21210 - DNA, 18 bp, synthetic construct
  source 1..18: mol_type = other DNA
taatgcgacacagtttag

SEQ ID NO: 21211 - DNA, 18 bp, synthetic construct
  source 1..18: mol_type = other DNA
taatgcgactcaccaacg

SEQ ID NO: 21212 - DNA, 18 bp, synthetic construct
  source 1..18: mol_type = other DNA
taatgcgactcagaataa

SEQ ID NO: 21213 - DNA, 18 bp, synthetic construct
  source 1..18: mol_type = other DNA
taatgcgactcagtcaag

SEQ ID NO: 21214 - DNA, 18 bp, synthetic construct
  source 1..18: mol_type = other DNA
taatgcgactcagttaag

SEQ ID NO: 21215 - DNA, 18 bp, synthetic construct
  source 1..18: mol_type = other DNA
taatgcgactctcttgag

SEQ ID NO: 21216 - DNA, 18 bp, synthetic construct
  source 1..18: mol_type = other DNA
taatgcgacttactaacg

SEQ ID NO: 21217 - DNA, 18 bp, synthetic construct
  source 1..18: mol_type = other DNA
taatgcgacttacttaag

SEQ ID NO: 21218 - DNA, 18 bp, synthetic construct
  source 1..18: mol_type = other DNA
taatgcgattcaataaag

SEQ ID NO: 21219 - DNA, 18 bp, synthetic construct
  source 1..18: mol_type = other DNA
taatgcgattcacattag

SEQ ID NO: 21220 - DNA, 18 bp, synthetic construct
  source 1..18: mol_type = other DNA
taatgcgcctcaatttag

SEQ ID NO: 21221 - DNA, 18 bp, synthetic construct
  source 1..18: mol_type = other DNA
taatgcggttcactttag

SEQ ID NO: 21222 - DNA, 18 bp, synthetic construct
  source 1..18: mol_type = other DNA
taatgcgtcacacgatag

SEQ ID NO: 21223 - DNA, 18 bp, synthetic construct
  source 1..18: mol_type = other DNA
taatgcgtcaccctatag

SEQ ID NO: 21224 - DNA, 18 bp, synthetic construct
  source 1..18: mol_type = other DNA
taatgcgtctcacactag

SEQ ID NO: 21225 - DNA, 18 bp, synthetic construct
  source 1..18: mol_type = other DNA
taatgcgtctccctaaag

SEQ ID NO: 21226 - DNA, 18 bp, synthetic construct
  source 1..18: mol_type = other DNA
taatgctactaaccatag

SEQ ID NO: 21227 - DNA, 18 bp, synthetic construct
  source 1..18: mol_type = other DNA
taatgctactcaccatgg

SEQ ID NO: 21228 - DNA, 18 bp, synthetic construct
  source 1..18: mol_type = other DNA
taatgctactcactaccg

SEQ ID NO: 21229 - DNA, 18 bp, synthetic construct
  source 1..18: mol_type = other DNA
taatgtgaataactatag

SEQ ID NO: 21230 - DNA, 18 bp, synthetic construct
  source 1..18: mol_type = other DNA
taatgtgtctcactatcg

SEQ ID NO: 21231 - DNA, 18 bp, synthetic construct
  source 1..18: mol_type = other DNA
tacaacaacccactatag

SEQ ID NO: 21232 - DNA, 18 bp, synthetic construct
  source 1..18: mol_type = other DNA
tacaacgtgtcactatag

SEQ ID NO: 21233 - DNA, 18 bp, synthetic construct
  source 1..18: mol_type = other DNA
tacaagtactcactatag

SEQ ID NO: 21234 - DNA, 18 bp, synthetic construct
  source 1..18: mol_type = other DNA
tacaccgactcaatatag

SEQ ID NO: 21235 - DNA, 18 bp, synthetic construct
  source 1..18: mol_type = other DNA
taccacgattcactaaag

SEQ ID NO: 21236 - DNA, 18 bp, synthetic construct
  source 1..18: mol_type = other DNA
taccactaatcactatag

SEQ ID NO: 21237 - DNA, 18 bp, synthetic construct
  source 1..18: mol_type = other DNA
tacgacaactcactttag

SEQ ID NO: 21238 - DNA, 18 bp, synthetic construct
  source 1..18: mol_type = other DNA
tactaaaacacactatag

SEQ ID NO: 21239 - DNA, 18 bp, synthetic construct
  source 1..18: mol_type = other DNA
tactacgaacccctatag

SEQ ID NO: 21240 - DNA, 18 bp, synthetic construct
  source 1..18: mol_type = other DNA
tactacgacacaataaag

SEQ ID NO: 21241 - DNA, 18 bp, synthetic construct
  source 1..18: mol_type = other DNA
tactacgacacacttcag

SEQ ID NO: 21242 - DNA, 18 bp, synthetic construct
  source 1..18: mol_type = other DNA
tactacgacgatctatag

SEQ ID NO: 21243 - DNA, 18 bp, synthetic construct
  source 1..18: mol_type = other DNA
tactacgactcatcttag

SEQ ID NO: 21244 - DNA, 18 bp, synthetic construct
  source 1..18: mol_type = other DNA
tactacgactctctaacg

SEQ ID NO: 21245 - DNA, 18 bp, synthetic construct
  source 1..18: mol_type = other DNA
tactacgactgacaatcg

SEQ ID NO: 21246 - DNA, 18 bp, synthetic construct
  source 1..18: mol_type = other DNA
tactacgacttacttaag

SEQ ID NO: 21247 - DNA, 18 bp, synthetic construct
  source 1..18: mol_type = other DNA
tactacgcatcacaatag

SEQ ID NO: 21248 - DNA, 18 bp, synthetic construct
  source 1..18: mol_type = other DNA
tactacgccttactttag

SEQ ID NO: 21249 - DNA, 18 bp, synthetic construct
  source 1..18: mol_type = other DNA
tactacggctctccatag

SEQ ID NO: 21250 - DNA, 18 bp, synthetic construct
  source 1..18: mol_type = other DNA
tactacggctgtctatag

SEQ ID NO: 21251 - DNA, 18 bp, synthetic construct
  source 1..18: mol_type = other DNA
tactacggcttactatgg

SEQ ID NO: 21252 - DNA, 18 bp, synthetic construct
  source 1..18: mol_type = other DNA
tactacgtcgcacaatag

SEQ ID NO: 21253 - DNA, 18 bp, synthetic construct
  source 1..18: mol_type = other DNA
tactacgtctcacactag

SEQ ID NO: 21254 - DNA, 18 bp, synthetic construct
  source 1..18: mol_type = other DNA
tactacgtctccctctag

SEQ ID NO: 21255 - DNA, 18 bp, synthetic construct
  source 1..18: mol_type = other DNA
tactacgttttactatag

SEQ ID NO: 21256 - DNA, 18 bp, synthetic construct
  source 1..18: mol_type = other DNA
tactactacaaactatag

SEQ ID NO: 21257 - DNA, 18 bp, synthetic construct
  source 1..18: mol_type = other DNA
tactactacactctatag

SEQ ID NO: 21258 - DNA, 18 bp, synthetic construct
  source 1..18: mol_type = other DNA
tactactcttcactatag

SEQ ID NO: 21259 - DNA, 18 bp, synthetic construct
  source 1..18: mol_type = other DNA
tactatgacactctatag

SEQ ID NO: 21260 - DNA, 18 bp, synthetic construct
  source 1..18: mol_type = other DNA
tactatgactcagaatag

SEQ ID NO: 21261 - DNA, 18 bp, synthetic construct
  source 1..18: mol_type = other DNA
tactatgtcttactatag

SEQ ID NO: 21262 - DNA, 18 bp, synthetic construct
  source 1..18: mol_type = other DNA
tagaactactcactatgg

SEQ ID NO: 21263 - DNA, 18 bp, synthetic construct
  source 1..18: mol_type = other DNA
tagaaggactgactatag

SEQ ID NO: 21264 - DNA, 18 bp, synthetic construct
  source 1..18: mol_type = other DNA
tagcacgactaaccatag

SEQ ID NO: 21265 - DNA, 18 bp, synthetic construct
  source 1..18: mol_type = other DNA
tagcacgactcacttcag

SEQ ID NO: 21266 - DNA, 18 bp, synthetic construct
  source 1..18: mol_type = other DNA
tagcacgactttctatag

SEQ ID NO: 21267 - DNA, 18 bp, synthetic construct
  source 1..18: mol_type = other DNA
tagtaagaatcaccatag

SEQ ID NO: 21268 - DNA, 18 bp, synthetic construct
  source 1..18: mol_type = other DNA
tagtaagactcaccatcg

SEQ ID NO: 21269 - DNA, 18 bp, synthetic construct
  source 1..18: mol_type = other DNA
tagtaagactctccatag

SEQ ID NO: 21270 - DNA, 18 bp, synthetic construct
  source 1..18: mol_type = other DNA
tagtaagactctctgtag

SEQ ID NO: 21271 - DNA, 18 bp, synthetic construct
  source 1..18: mol_type = other DNA
tagtacaactgtctatag

SEQ ID NO: 21272 - DNA, 18 bp, synthetic construct
  source 1..18: mol_type = other DNA
tagtacgacttactttgg

SEQ ID NO: 21273 - DNA, 18 bp, synthetic construct
  source 1..18: mol_type = other DNA
tagtacgacttattaaag

SEQ ID NO: 21274 - DNA, 18 bp, synthetic construct
  source 1..18: mol_type = other DNA
tagtacgagttacaatag

SEQ ID NO: 21275 - DNA, 18 bp, synthetic construct
  source 1..18: mol_type = other DNA
tagtacgcctcaccatgg

SEQ ID NO: 21276 - DNA, 18 bp, synthetic construct
  source 1..18: mol_type = other DNA
tagtactcctcactaaag

SEQ ID NO: 21277 - DNA, 18 bp, synthetic construct
  source 1..18: mol_type = other DNA
tagtacttctgactatag

SEQ ID NO: 21278 - DNA, 18 bp, synthetic construct
  source 1..18: mol_type = other DNA
tagtacttttcactatag

SEQ ID NO: 21279 - DNA, 18 bp, synthetic construct
  source 1..18: mol_type = other DNA
tagtattactcactaaag

SEQ ID NO: 21280 - DNA, 18 bp, synthetic construct
  source 1..18: mol_type = other DNA
tagtccaattcactatag

SEQ ID NO: 21281 - DNA, 18 bp, synthetic construct
  source 1..18: mol_type = other DNA
tagtcccactcactttag

SEQ ID NO: 21282 - DNA, 18 bp, synthetic construct
  source 1..18: mol_type = other DNA
tagtccgacactctatag

SEQ ID NO: 21283 - DNA, 18 bp, synthetic construct
  source 1..18: mol_type = other DNA
tagtccgaggcactatag

SEQ ID NO: 21284 - DNA, 18 bp, synthetic construct
  source 1..18: mol_type = other DNA
tagtgcgattctctatag

SEQ ID NO: 21285 - DNA, 18 bp, synthetic construct
  source 1..18: mol_type = other DNA
tataaagactcactacag

SEQ ID NO: 21286 - DNA, 18 bp, synthetic construct
  source 1..18: mol_type = other DNA
tataacgacgcactaaag

SEQ ID NO: 21287 - DNA, 18 bp, synthetic construct
  source 1..18: mol_type = other DNA
tataacgcctcacaatag

SEQ ID NO: 21288 - DNA, 18 bp, synthetic construct
  source 1..18: mol_type = other DNA
tataacgtctcactacag

SEQ ID NO: 21289 - DNA, 18 bp, synthetic construct
  source 1..18: mol_type = other DNA
tataacgtgtcactatag

SEQ ID NO: 21290 - DNA, 18 bp, synthetic construct
  source 1..18: mol_type = other DNA
tataactactaactatag

SEQ ID NO: 21291 - DNA, 18 bp, synthetic construct
  source 1..18: mol_type = other DNA
tataactactcacgatag

SEQ ID NO: 21292 - DNA, 18 bp, synthetic construct
  source 1..18: mol_type = other DNA
tataaggactcactatcg

SEQ ID NO: 21293 - DNA, 18 bp, synthetic construct
  source 1..18: mol_type = other DNA
tatcaagactcactgtag

SEQ ID NO: 21294 - DNA, 18 bp, synthetic construct
  source 1..18: mol_type = other DNA
tatcacgaatcattatag

SEQ ID NO: 21295 - DNA, 18 bp, synthetic construct
  source 1..18: mol_type = other DNA
tatcacgacaaactatag

SEQ ID NO: 21296 - DNA, 18 bp, synthetic construct
  source 1..18: mol_type = other DNA
tatcacgactacctatag

SEQ ID NO: 21297 - DNA, 18 bp, synthetic construct
  source 1..18: mol_type = other DNA
tatcacgactccccatag

SEQ ID NO: 21298 - DNA, 18 bp, synthetic construct
  source 1..18: mol_type = other DNA
tatcacgactgactaaag

SEQ ID NO: 21299 - DNA, 18 bp, synthetic construct
  source 1..18: mol_type = other DNA
tatcccgtctcactatag

SEQ ID NO: 21300 - DNA, 18 bp, synthetic construct
  source 1..18: mol_type = other DNA
tattaagactaaatatag

SEQ ID NO: 21301 - DNA, 18 bp, synthetic construct
  source 1..18: mol_type = other DNA
tattaagactcaatatgg

SEQ ID NO: 21302 - DNA, 18 bp, synthetic construct
  source 1..18: mol_type = other DNA
tattaagactcagcatag

SEQ ID NO: 21303 - DNA, 18 bp, synthetic construct
  source 1..18: mol_type = other DNA
tattaagactcagtgtag

SEQ ID NO: 21304 - DNA, 18 bp, synthetic construct
  source 1..18: mol_type = other DNA
tattaagcgtcactatag

SEQ ID NO: 21305 - DNA, 18 bp, synthetic construct
  source 1..18: mol_type = other DNA
tattacaacccaccatag

SEQ ID NO: 21306 - DNA, 18 bp, synthetic construct
  source 1..18: mol_type = other DNA
tattacaacccactacag

SEQ ID NO: 21307 - DNA, 18 bp, synthetic construct
  source 1..18: mol_type = other DNA
tattaccactcacattag

SEQ ID NO: 21308 - DNA, 18 bp, synthetic construct
  source 1..18: mol_type = other DNA
tattaccactccccatag

SEQ ID NO: 21309 - DNA, 18 bp, synthetic construct
  source 1..18: mol_type = other DNA
tattaccatccactatag

SEQ ID NO: 21310 - DNA, 18 bp, synthetic construct
  source 1..18: mol_type = other DNA
tattaccattcaccatag

SEQ ID NO: 21311 - DNA, 18 bp, synthetic construct
  source 1..18: mol_type = other DNA
tattacgaatcattatgg

SEQ ID NO: 21312 - DNA, 18 bp, synthetic construct
  source 1..18: mol_type = other DNA
tattacgaatgattatag

SEQ ID NO: 21313 - DNA, 18 bp, synthetic construct
  source 1..18: mol_type = other DNA
tattacgacacacagtag

SEQ ID NO: 21314 - DNA, 18 bp, synthetic construct
  source 1..18: mol_type = other DNA
tattacgacacactagcg

SEQ ID NO: 21315 - DNA, 18 bp, synthetic construct
  source 1..18: mol_type = other DNA
tattacgacacacttcag

SEQ ID NO: 21316 - DNA, 18 bp, synthetic construct
  source 1..18: mol_type = other DNA
tattacgacccaatgtag

SEQ ID NO: 21317 - DNA, 18 bp, synthetic construct
  source 1..18: mol_type = other DNA
tattacgacctattatag

SEQ ID NO: 21318 - DNA, 18 bp, synthetic construct
  source 1..18: mol_type = other DNA
tattacgacgcataatag

SEQ ID NO: 21319 - DNA, 18 bp, synthetic construct
  source 1..18: mol_type = other DNA
tattacgactaacactag

SEQ ID NO: 21320 - DNA, 18 bp, synthetic construct
  source 1..18: mol_type = other DNA
tattacgactcactgacg

SEQ ID NO: 21321 - DNA, 18 bp, synthetic construct
  source 1..18: mol_type = other DNA
tattacgactcatcatgg

SEQ ID NO: 21322 - DNA, 18 bp, synthetic construct
  source 1..18: mol_type = other DNA
tattacgactccctcgag

SEQ ID NO: 21323 - DNA, 18 bp, synthetic construct
  source 1..18: mol_type = other DNA
tattacgactctgcatag

SEQ ID NO: 21324 - DNA, 18 bp, synthetic construct
  source 1..18: mol_type = other DNA
tattacgattctctatcg

SEQ ID NO: 21325 - DNA, 18 bp, synthetic construct
  source 1..18: mol_type = other DNA
tattacgccttcctatag

SEQ ID NO: 21326 - DNA, 18 bp, synthetic construct
  source 1..18: mol_type = other DNA
tattacgcttcaatatag

SEQ ID NO: 21327 - DNA, 18 bp, synthetic construct
  source 1..18: mol_type = other DNA
tattacgcttcacaatag

SEQ ID NO: 21328 - DNA, 18 bp, synthetic construct
  source 1..18: mol_type = other DNA
tattacggctctctttag

SEQ ID NO: 21329 - DNA, 18 bp, synthetic construct
  source 1..18: mol_type = other DNA
tattacggctgattatag

SEQ ID NO: 21330 - DNA, 18 bp, synthetic construct
  source 1..18: mol_type = other DNA
tattacgtcccacaatag

SEQ ID NO: 21331 - DNA, 18 bp, synthetic construct
  source 1..18: mol_type = other DNA
tattacgtgtcactacag

SEQ ID NO: 21332 - DNA, 18 bp, synthetic construct
  source 1..18: mol_type = other DNA
tattacttatcactatag

SEQ ID NO: 21333 - DNA, 18 bp, synthetic construct
  source 1..18: mol_type = other DNA
tattagatctcactatag

SEQ ID NO: 21334 - DNA, 18 bp, synthetic construct
  source 1..18: mol_type = other DNA
tattaggagtcactttag

SEQ ID NO: 21335 - DNA, 18 bp, synthetic construct
  source 1..18: mol_type = other DNA
tattaggatttactatag

SEQ ID NO: 21336 - DNA, 18 bp, synthetic construct
  source 1..18: mol_type = other DNA
tattaggcctcaatatag

SEQ ID NO: 21337 - DNA, 18 bp, synthetic construct
  source 1..18: mol_type = other DNA
tattagtactcattatag

SEQ ID NO: 21338 - DNA, 18 bp, synthetic construct
  source 1..18: mol_type = other DNA
tattattaatcactatag

SEQ ID NO: 21339 - DNA, 18 bp, synthetic construct
  source 1..18: mol_type = other DNA
tattcagactcactagag

SEQ ID NO: 21340 - DNA, 18 bp, synthetic construct
  source 1..18: mol_type = other DNA
tattcatactcactatag

SEQ ID NO: 21341 - DNA, 18 bp, synthetic construct
  source 1..18: mol_type = other DNA
tattccgactaacaatag

SEQ ID NO: 21342 - DNA, 18 bp, synthetic construct
  source 1..18: mol_type = other DNA
tattccgactctgtatag

SEQ ID NO: 21343 - DNA, 18 bp, synthetic construct
  source 1..18: mol_type = other DNA
tattgcgacacactacag

SEQ ID NO: 21344 - DNA, 18 bp, synthetic construct
  source 1..18: mol_type = other DNA
tattgcgtgtcactatag

SEQ ID NO: 21345 - DNA, 18 bp, synthetic construct
  source 1..18: mol_type = other DNA
tattgggactctctatag

SEQ ID NO: 21346 - DNA, 18 bp, synthetic construct
  source 1..18: mol_type = other DNA
tcaaacgtctaactatag

SEQ ID NO: 21347 - DNA, 18 bp, synthetic construct
  source 1..18: mol_type = other DNA
tcacacgactctctatgg

SEQ ID NO: 21348 - DNA, 18 bp, synthetic construct
  source 1..18: mol_type = other DNA
tcacacgattctctatag

SEQ ID NO: 21349 - DNA, 18 bp, synthetic construct
  source 1..18: mol_type = other DNA
tcacacgtctcactttag

SEQ ID NO: 21350 - DNA, 18 bp, synthetic construct
  source 1..18: mol_type = other DNA
tcacactactcactgtag

SEQ ID NO: 21351 - DNA, 18 bp, synthetic construct
  source 1..18: mol_type = other DNA
tcagaagattcactatag

SEQ ID NO: 21352 - DNA, 18 bp, synthetic construct
  source 1..18: mol_type = other DNA
tcagaagtctcactatag

SEQ ID NO: 21353 - DNA, 18 bp, synthetic construct
  source 1..18: mol_type = other DNA
tcagacgacacattatag

SEQ ID NO: 21354 - DNA, 18 bp, synthetic construct
  source 1..18: mol_type = other DNA
tcagatgactgactatag

SEQ ID NO: 21355 - DNA, 18 bp, synthetic construct
  source 1..18: mol_type = other DNA
tcataagacacactaaag

SEQ ID NO: 21356 - DNA, 18 bp, synthetic construct
  source 1..18: mol_type = other DNA
tcataagagtcactctag

SEQ ID NO: 21357 - DNA, 18 bp, synthetic construct
  source 1..18: mol_type = other DNA
tcatacaacccagtatag

SEQ ID NO: 21358 - DNA, 18 bp, synthetic construct
  source 1..18: mol_type = other DNA
tcatacgacacacattag

SEQ ID NO: 21359 - DNA, 18 bp, synthetic construct
  source 1..18: mol_type = other DNA
tcatacgacataatatag

SEQ ID NO: 21360 - DNA, 18 bp, synthetic construct
  source 1..18: mol_type = other DNA
tcatacgacatattatag

SEQ ID NO: 21361 - DNA, 18 bp, synthetic construct
  source 1..18: mol_type = other DNA
tcatacgaccctatatag

SEQ ID NO: 21362 - DNA, 18 bp, synthetic construct
  source 1..18: mol_type = other DNA
tcatacgactaacttaag

SEQ ID NO: 21363 - DNA, 18 bp, synthetic construct
  source 1..18: mol_type = other DNA
tcatacgactacctttag

SEQ ID NO: 21364 - DNA, 18 bp, synthetic construct
  source 1..18: mol_type = other DNA
tcatacgactctctcgag

SEQ ID NO: 21365 - DNA, 18 bp, synthetic construct
  source 1..18: mol_type = other DNA
tcatacgagaaactatag

SEQ ID NO: 21366 - DNA, 18 bp, synthetic construct
  source 1..18: mol_type = other DNA
tcatacgatttactatgg

SEQ ID NO: 21367 - DNA, 18 bp, synthetic construct
  source 1..18: mol_type = other DNA
tcatacgcatcactatgg

SEQ ID NO: 21368 - DNA, 18 bp, synthetic construct
  source 1..18: mol_type = other DNA
tcatacgccgtactatag

SEQ ID NO: 21369 - DNA, 18 bp, synthetic construct
  source 1..18: mol_type = other DNA
tcatacgcctcagtttag

SEQ ID NO: 21370 - DNA, 18 bp, synthetic construct
  source 1..18: mol_type = other DNA
tcatacgccttactctag

SEQ ID NO: 21371 - DNA, 18 bp, synthetic construct
  source 1..18: mol_type = other DNA
tcatacgtcttactgtag

SEQ ID NO: 21372 - DNA, 18 bp, synthetic construct
  source 1..18: mol_type = other DNA
tcataggactcagtacag

SEQ ID NO: 21373 - DNA, 18 bp, synthetic construct
  source 1..18: mol_type = other DNA
tcataggcctcactatgg

SEQ ID NO: 21374 - DNA, 18 bp, synthetic construct
  source 1..18: mol_type = other DNA
tcatatgacacactatcg

SEQ ID NO: 21375 - DNA, 18 bp, synthetic construct
  source 1..18: mol_type = other DNA
tcatcagactcactttag

SEQ ID NO: 21376 - DNA, 18 bp, synthetic construct
  source 1..18: mol_type = other DNA
tcatccgcctcactatgg

SEQ ID NO: 21377 - DNA, 18 bp, synthetic construct
  source 1..18: mol_type = other DNA
tcatgcgacacactttag

SEQ ID NO: 21378 - DNA, 18 bp, synthetic construct
  source 1..18: mol_type = other DNA
tcctacgacactctatag

SEQ ID NO: 21379 - DNA, 18 bp, synthetic construct
  source 1..18: mol_type = other DNA
tcctacgactgtctatag

SEQ ID NO: 21380 - DNA, 18 bp, synthetic construct
  source 1..18: mol_type = other DNA
tcctacgtctcagtatag

SEQ ID NO: 21381 - DNA, 18 bp, synthetic construct
  source 1..18: mol_type = other DNA
tcctacttctcactatag

SEQ ID NO: 21382 - DNA, 18 bp, synthetic construct
  source 1..18: mol_type = other DNA
tcgtaagactaactatag

SEQ ID NO: 21383 - DNA, 18 bp, synthetic construct
  source 1..18: mol_type = other DNA
tcttacgactcactccag

SEQ ID NO: 21384 - DNA, 18 bp, synthetic construct
  source 1..18: mol_type = other DNA
tcttacgactcattaaag

SEQ ID NO: 21385 - DNA, 18 bp, synthetic construct
  source 1..18: mol_type = other DNA
tcttacgacttactgtag

SEQ ID NO: 21386 - DNA, 18 bp, synthetic construct
  source 1..18: mol_type = other DNA
tcttacgagtaactatag

SEQ ID NO: 21387 - DNA, 18 bp, synthetic construct
  source 1..18: mol_type = other DNA
tcttacgattcagtatag

SEQ ID NO: 21388 - DNA, 18 bp, synthetic construct
  source 1..18: mol_type = other DNA
tcttacgtctcactaaag

SEQ ID NO: 21389 - DNA, 18 bp, synthetic construct
  source 1..18: mol_type = other DNA
tgaaacgactcaccatgg

SEQ ID NO: 21390 - DNA, 18 bp, synthetic construct
  source 1..18: mol_type = other DNA
tgacacgacttaccatag

SEQ ID NO: 21391 - DNA, 18 bp, synthetic construct
  source 1..18: mol_type = other DNA
tgacccgactaactatag

SEQ ID NO: 21392 - DNA, 18 bp, synthetic construct
  source 1..18: mol_type = other DNA
tgagacgtctcactatcg

SEQ ID NO: 21393 - DNA, 18 bp, synthetic construct
  source 1..18: mol_type = other DNA
tgataagactcacaatgg

SEQ ID NO: 21394 - DNA, 18 bp, synthetic construct
  source 1..18: mol_type = other DNA
tgataccactcactccag

SEQ ID NO: 21395 - DNA, 18 bp, synthetic construct
  source 1..18: mol_type = other DNA
tgatacgacaaactaaag

SEQ ID NO: 21396 - DNA, 18 bp, synthetic construct
  source 1..18: mol_type = other DNA
tgatacgacacaccttag

SEQ ID NO: 21397 - DNA, 18 bp, synthetic construct
  source 1..18: mol_type = other DNA
tgatacgactcaccctcg

SEQ ID NO: 21398 - DNA, 18 bp, synthetic construct
  source 1..18: mol_type = other DNA
tgatacgactcccagtag

SEQ ID NO: 21399 - DNA, 18 bp, synthetic construct
  source 1..18: mol_type = other DNA
tgatacgtctaactacag

SEQ ID NO: 21400 - DNA, 18 bp, synthetic construct
  source 1..18: mol_type = other DNA
tgatacgtctcactacgg

SEQ ID NO: 21401 - DNA, 18 bp, synthetic construct
  source 1..18: mol_type = other DNA
tgatactacactctatag

SEQ ID NO: 21402 - DNA, 18 bp, synthetic construct
  source 1..18: mol_type = other DNA
tgatactactcattttag

SEQ ID NO: 21403 - DNA, 18 bp, synthetic construct
  source 1..18: mol_type = other DNA
tgatagttctcactatag

SEQ ID NO: 21404 - DNA, 18 bp, synthetic construct
  source 1..18: mol_type = other DNA
tgatataacacactatag

SEQ ID NO: 21405 - DNA, 18 bp, synthetic construct
  source 1..18: mol_type = other DNA
tgatatgactgactaaag

SEQ ID NO: 21406 - DNA, 18 bp, synthetic construct
  source 1..18: mol_type = other DNA
tgatccgaatcactttag

SEQ ID NO: 21407 - DNA, 18 bp, synthetic construct
  source 1..18: mol_type = other DNA
tgatccgactctccatag

SEQ ID NO: 21408 - DNA, 18 bp, synthetic construct
  source 1..18: mol_type = other DNA
tgatgcgactcccaatag

SEQ ID NO: 21409 - DNA, 18 bp, synthetic construct
  source 1..18: mol_type = other DNA
tgccacgactcactagag

SEQ ID NO: 21410 - DNA, 18 bp, synthetic construct
  source 1..18: mol_type = other DNA
tggtacgactcagaatag

SEQ ID NO: 21411 - DNA, 18 bp, synthetic construct
  source 1..18: mol_type = other DNA
tggtacgactccctatcg

SEQ ID NO: 21412 - DNA, 18 bp, synthetic construct
  source 1..18: mol_type = other DNA
tgttacctctcactatag

SEQ ID NO: 21413 - DNA, 18 bp, synthetic construct
  source 1..18: mol_type = other DNA
tgttacgaatcagtatag

SEQ ID NO: 21414 - DNA, 18 bp, synthetic construct
  source 1..18: mol_type = other DNA
tgttacgacacactacag

SEQ ID NO: 21415 - DNA, 18 bp, synthetic construct
  source 1..18: mol_type = other DNA
ttaaaagactcagtatag

SEQ ID NO: 21416 - DNA, 18 bp, synthetic construct
  source 1..18: mol_type = other DNA
ttaaacgaattactatag

SEQ ID NO: 21417 - DNA, 18 bp, synthetic construct
  source 1..18: mol_type = other DNA
ttaaacgactcaccttag

SEQ ID NO: 21418 - DNA, 18 bp, synthetic construct
  source 1..18: mol_type = other DNA
ttacacaacttactatag

SEQ ID NO: 21419 - DNA, 18 bp, synthetic construct
  source 1..18: mol_type = other DNA
ttacacgactctcaatag

SEQ ID NO: 21420 - DNA, 18 bp, synthetic construct
  source 1..18: mol_type = other DNA
ttacacgattcactacag

SEQ ID NO: 21421 - DNA, 18 bp, synthetic construct
  source 1..18: mol_type = other DNA
ttacacgattcactagag

SEQ ID NO: 21422 - DNA, 18 bp, synthetic construct
  source 1..18: mol_type = other DNA
ttacacgtctctctatag

SEQ ID NO: 21423 - DNA, 18 bp, synthetic construct
  source 1..18: mol_type = other DNA
ttacgcgtctcactatag

SEQ ID NO: 21424 - DNA, 18 bp, synthetic construct
  source 1..18: mol_type = other DNA
ttagaagactaactatag

SEQ ID NO: 21425 - DNA, 18 bp, synthetic construct
  source 1..18: mol_type = other DNA
ttagacgtgtcactatag

SEQ ID NO: 21426 - DNA, 18 bp, synthetic construct
  source 1..18: mol_type = other DNA
ttataacacgcactatag

SEQ ID NO: 21427 - DNA, 18 bp, synthetic construct
  source 1..18: mol_type = other DNA
ttataagagtcactagag

SEQ ID NO: 21428 - DNA, 18 bp, synthetic construct
  source 1..18: mol_type = other DNA
ttatacaactctctatgg

SEQ ID NO: 21429 - DNA, 18 bp, synthetic construct
  source 1..18: mol_type = other DNA
ttataccattcaccatag

SEQ ID NO: 21430 - DNA, 18 bp, synthetic construct
  source 1..18: mol_type = other DNA
ttatacgacacaacatag

SEQ ID NO: 21431 - DNA, 18 bp, synthetic construct
  source 1..18: mol_type = other DNA
ttatacgacccaacatag

SEQ ID NO: 21432 - DNA, 18 bp, synthetic construct
  source 1..18: mol_type = other DNA
ttatacgactcaatcaag

SEQ ID NO: 21433 - DNA, 18 bp, synthetic construct
  source 1..18: mol_type = other DNA
ttatacgactcactacct

SEQ ID NO: 21434 - DNA, 18 bp, synthetic construct
  source 1..18: mol_type = other DNA
ttatacgactcataatcg

SEQ ID NO: 21435 - DNA, 18 bp, synthetic construct
  source 1..18: mol_type = other DNA
ttatacgactctgtaaag

SEQ ID NO: 21436 - DNA, 18 bp, synthetic construct
  source 1..18: mol_type = other DNA
ttatacgaggcactttag

SEQ ID NO: 21437 - DNA, 18 bp, synthetic construct
  source 1..18: mol_type = other DNA
ttatacgcctcactgcag

SEQ ID NO: 21438 - DNA, 18 bp, synthetic construct
  source 1..18: mol_type = other DNA
ttatacggcacacaatag

SEQ ID NO: 21439 - DNA, 18 bp, synthetic construct
  source 1..18: mol_type = other DNA
ttatacggttcactgtag

SEQ ID NO: 21440 - DNA, 18 bp, synthetic construct
  source 1..18: mol_type = other DNA
ttatacgtctcactctgg

SEQ ID NO: 21441 - DNA, 18 bp, synthetic construct
  source 1..18: mol_type = other DNA
ttatacgtctcattacag

SEQ ID NO: 21442 - DNA, 18 bp, synthetic construct
  source 1..18: mol_type = other DNA
ttatacgtctcattatcg

SEQ ID NO: 21443 - DNA, 18 bp, synthetic construct
  source 1..18: mol_type = other DNA
ttatactactcccgatag

SEQ ID NO: 21444 - DNA, 18 bp, synthetic construct
  source 1..18: mol_type = other DNA
ttatactactctcgatag

SEQ ID NO: 21445 - DNA, 18 bp, synthetic construct
  source 1..18: mol_type = other DNA
ttataggactaactacag

SEQ ID NO: 21446 - DNA, 18 bp, synthetic construct
  source 1..18: mol_type = other DNA
ttatatcactcaccatag

SEQ ID NO: 21447 - DNA, 18 bp, synthetic construct
  source 1..18: mol_type = other DNA
ttatccgacaaactatag

SEQ ID NO: 21448 - DNA, 18 bp, synthetic construct
  source 1..18: mol_type = other DNA
ttatctgactctctatag

SEQ ID NO: 21449 - DNA, 18 bp, synthetic construct
  source 1..18: mol_type = other DNA
ttatctgactgactatag

SEQ ID NO: 21450 - DNA, 18 bp, synthetic construct
  source 1..18: mol_type = other DNA
ttatgcaacttactatag

SEQ ID NO: 21451 - DNA, 18 bp, synthetic construct
  source 1..18: mol_type = other DNA
ttatgcgactcacattag

SEQ ID NO: 21452 - DNA, 18 bp, synthetic construct
  source 1..18: mol_type = other DNA
ttatgcgagtcaatatag

SEQ ID NO: 21453 - DNA, 18 bp, synthetic construct
  source 1..18: mol_type = other DNA
ttatgcgatccactatag

SEQ ID NO: 21454 - DNA, 18 bp, synthetic construct
  source 1..18: mol_type = other DNA
ttatgcgtctcaatatag

SEQ ID NO: 21455 - DNA, 18 bp, synthetic construct
  source 1..18: mol_type = other DNA
ttctaccactcactttag

SEQ ID NO: 21456 - DNA, 18 bp, synthetic construct
  source 1..18: mol_type = other DNA
ttctacgaatcactatgg

SEQ ID NO: 21457 - DNA, 18 bp, synthetic construct
  source 1..18: mol_type = other DNA
ttctacgacacactaaag

SEQ ID NO: 21458 - DNA, 18 bp, synthetic construct
  source 1..18: mol_type = other DNA
ttctacgactcaccaaag

SEQ ID NO: 21459 - DNA, 18 bp, synthetic construct
  source 1..18: mol_type = other DNA
ttctacgactcactaagg

SEQ ID NO: 21460 - DNA, 18 bp, synthetic construct
  source 1..18: mol_type = other DNA
ttctacgagtcactatcg

SEQ ID NO: 21461 - DNA, 18 bp, synthetic construct
  source 1..18: mol_type = other DNA
ttctattactcactatag

SEQ ID NO: 21462 - DNA, 18 bp, synthetic construct
  source 1..18: mol_type = other DNA
ttgaacgaatcactatag

SEQ ID NO: 21463 - DNA, 18 bp, synthetic construct
  source 1..18: mol_type = other DNA
ttgtacaagtcactatag

SEQ ID NO: 21464 - DNA, 18 bp, synthetic construct
  source 1..18: mol_type = other DNA
ttgtatgactcactttag

SEQ ID NO: 21465 - DNA, 18 bp, synthetic construct
  source 1..18: mol_type = other DNA
ttttacgactccccatag

SEQ ID NO: 21466 - DNA, 18 bp, synthetic construct
  source 1..18: mol_type = other DNA
ttttacgcctcactctag

SEQ ID NO: 21467 - DNA, 18 bp, synthetic construct
  source 1..18: mol_type = other DNA
ttttacgtctcactaaag

SEQ ID NO: 21468 - DNA, 18 bp, synthetic construct
  source 1..18: mol_type = other DNA
ttttaggaatcactatag

SEQ ID NO: 21469 - DNA, 18 bp, synthetic construct
  source 1..18: mol_type = other DNA
ttttccgactaactatag

SEQ ID NO: 21470 - DNA, 18 bp, synthetic construct
  source 1..18: mol_type = other DNA
tatatcaactcactatag

SEQ ID NO: 21471 - DNA, 18 bp, synthetic construct
  source 1..18: mol_type = other DNA
taatccgtctcacttaag

SEQ ID NO: 21472 - DNA, 18 bp, synthetic construct
  source 1..18: mol_type = other DNA
taacactacacacaatag

SEQ ID NO: 21473 - DNA, 18 bp, synthetic construct
  source 1..18: mol_type = other DNA
tattacgactcaatcaag

SEQ ID NO: 21474 - DNA, 18 bp, synthetic construct
  source 1..18: mol_type = other DNA
taattagtctcactattg

SEQ ID NO: 21475 - DNA, 18 bp, synthetic construct
  source 1..18: mol_type = other DNA
ttattcgactcactaatg

SEQ ID NO: 21476 - DNA, 18 bp, synthetic construct
  source 1..18: mol_type = other DNA
aaatacgcttcactattg

SEQ ID NO: 21477 - DNA, 18 bp, synthetic construct
  source 1..18: mol_type = other DNA
atattcgagtcactatag

SEQ ID NO: 21478 - DNA, 18 bp, synthetic construct
  source 1..18: mol_type = other DNA
taaaacgtctcagtattg

SEQ ID NO: 21479 - DNA, 18 bp, synthetic construct
  source 1..18: mol_type = other DNA
taacatgactctctattg

SEQ ID NO: 21480 - DNA, 18 bp, synthetic construct
  source 1..18: mol_type = other DNA
taattcaactcacagtag

SEQ ID NO: 21481 - DNA, 18 bp, synthetic construct
  source 1..18: mol_type = other DNA
taattcgaatcactaacg

SEQ ID NO: 21482 - DNA, 18 bp, synthetic construct
  source 1..18: mol_type = other DNA
taatttgactcacttgag

SEQ ID NO: 21483 - DNA, 18 bp, synthetic construct
  source 1..18: mol_type = other DNA
tctttcgactcactatcg

SEQ ID NO: 21484 - DNA, 18 bp, synthetic construct
  source 1..18: mol_type = other DNA
ttatacgactcaatcttg

SEQ ID NO: 21485 - DNA, 18 bp, synthetic construct
  source 1..18: mol_type = other DNA
aaataggactcacaaaag

SEQ ID NO: 21486 - DNA, 18 bp, synthetic construct
  source 1..18: mol_type = other DNA
atatacgtctcactagag

SEQ ID NO: 21487 - DNA, 18 bp, synthetic construct
  source 1..18: mol_type = other DNA
caatacgactctcaaaag

SEQ ID NO: 21488 - DNA, 18 bp, synthetic construct
  source 1..18: mol_type = other DNA
taagacgattctttatag

SEQ ID NO: 21489 - DNA, 18 bp, synthetic construct
  source 1..18: mol_type = other DNA
taatactatacacaatag

SEQ ID NO: 21490 - DNA, 18 bp, synthetic construct
  source 1..18: mol_type = other DNA
taatatgaatctctaaag

SEQ ID NO: 21491 - DNA, 18 bp, synthetic construct
  source 1..18: mol_type = other DNA
taatatgtctatctatag

SEQ ID NO: 21492 - DNA, 18 bp, synthetic construct
  source 1..18: mol_type = other DNA
tataacgcctcattatag

SEQ ID NO: 21493 - DNA, 18 bp, synthetic construct
  source 1..18: mol_type = other DNA
tatcacgaatcactttag

SEQ ID NO: 21494 - DNA, 18 bp, synthetic construct
  source 1..18: mol_type = other DNA
tattaaggctctctatag

SEQ ID NO: 21495 - DNA, 18 bp, synthetic construct
  source 1..18: mol_type = other DNA
tattaccacacacaatag

SEQ ID NO: 21496 - DNA, 18 bp, synthetic construct
  source 1..18: mol_type = other DNA
tcatatgaatctctatag

SEQ ID NO: 21497 - DNA, 18 bp, synthetic construct
  source 1..18: mol_type = other DNA
ttaaacgcctcactaaag

SEQ ID NO: 21498 - DNA, 18 bp, synthetic construct
  source 1..18: mol_type = other DNA
ttatccaactcattatag

SEQ ID NO: 21499 - DNA, 18 bp, synthetic construct
  source 1..18: mol_type = other DNA
ttatccgcctcactaaag

SEQ ID NO: 21500 - DNA, 18 bp, synthetic construct
  source 1..18: mol_type = other DNA
ttctaagacccactatag

SEQ ID NO: 21501 - DNA, 18 bp, synthetic construct
  source 1..18: mol_type = other DNA
taaaacgtttcactattg

SEQ ID NO: 21502 - DNA, 18 bp, synthetic construct
  source 1..18: mol_type = other DNA
ttaaatgactcactaaag

SEQ ID NO: 21503 - DNA, 18 bp, synthetic construct
  source 1..18: mol_type = other DNA
taattcgacacgctattg

SEQ ID NO: 21504 - DNA, 18 bp, synthetic construct
  source 1..18: mol_type = other DNA
taatccgattcgctattg

SEQ ID NO: 21505 - DNA, 18 bp, synthetic construct
  source 1..18: mol_type = other DNA
taattccacttgctatag

SEQ ID NO: 21506 - DNA, 18 bp, synthetic construct
  source 1..18: mol_type = other DNA
aaacacgattcactattg

SEQ ID NO: 21507 - DNA, 18 bp, synthetic construct
  source 1..18: mol_type = other DNA
aaataagactaactattg

SEQ ID NO: 21508 - DNA, 18 bp, synthetic construct
  source 1..18: mol_type = other DNA
aaatacgattcactcttg

SEQ ID NO: 21509 - DNA, 18 bp, synthetic construct
  source 1..18: mol_type = other DNA
aaattccactcactatgg

SEQ ID NO: 21510 - DNA, 18 bp, synthetic construct
  source 1..18: mol_type = other DNA
aaattcgactcactttgg

SEQ ID NO: 21511 - DNA, 18 bp, synthetic construct
  source 1..18: mol_type = other DNA
aacaacgactcactattg

SEQ ID NO: 21512 - DNA, 18 bp, synthetic construct
  source 1..18: mol_type = other DNA
caatgcgactcactaatg

SEQ ID NO: 21513 - DNA, 18 bp, synthetic construct
  source 1..18: mol_type = other DNA
taaaacgagtcacttttg

SEQ ID NO: 21514 - DNA, 18 bp, synthetic construct
  source 1..18: mol_type = other DNA
taaaccgactgactattg

SEQ ID NO: 21515 - DNA, 18 bp, synthetic construct
  source 1..18: mol_type = other DNA
taactcgattcacaatag

SEQ ID NO: 21516 - DNA, 18 bp, synthetic construct
  source 1..18: mol_type = other DNA
taagacaactcactaatg

SEQ ID NO: 21517 - DNA, 18 bp, synthetic construct
  source 1..18: mol_type = other DNA
taatacaactctctagtg

SEQ ID NO: 21518 - DNA, 18 bp, synthetic construct
  source 1..18: mol_type = other DNA
taatacgaccaactactg

SEQ ID NO: 21519 - DNA, 18 bp, synthetic construct
  source 1..18: mol_type = other DNA
taatacgcttcgctctag

SEQ ID NO: 21520 - DNA, 18 bp, synthetic construct
  source 1..18: mol_type = other DNA
taatacggttctctattg

SEQ ID NO: 21521 - DNA, 18 bp, synthetic construct
  source 1..18: mol_type = other DNA
taatgcgattcactaatg

SEQ ID NO: 21522 - DNA, 18 bp, synthetic construct
  source 1..18: mol_type = other DNA
taattagagttactatag

SEQ ID NO: 21523 - DNA, 18 bp, synthetic construct
  source 1..18: mol_type = other DNA
taattagtctccctatag

SEQ ID NO: 21524 - DNA, 18 bp, synthetic construct
  source 1..18: mol_type = other DNA
taattcaactcacaatcg

SEQ ID NO: 21525 - DNA, 18 bp, synthetic construct
  source 1..18: mol_type = other DNA
taattcacctcactaaag

SEQ ID NO: 21526 - DNA, 18 bp, synthetic construct
  source 1..18: mol_type = other DNA
taattccacacactacag

SEQ ID NO: 21527 - DNA, 18 bp, synthetic construct
  source 1..18: mol_type = other DNA
taattccactccctttag

SEQ ID NO: 21528 - DNA, 18 bp, synthetic construct
  source 1..18: mol_type = other DNA
taattcgaatcagtatcg

SEQ ID NO: 21529 - DNA, 18 bp, synthetic construct
  source 1..18: mol_type = other DNA
taattcgactcccaatgg

SEQ ID NO: 21530 - DNA, 18 bp, synthetic construct
  source 1..18: mol_type = other DNA
taattcgactgacttaag

SEQ ID NO: 21531 - DNA, 18 bp, synthetic construct
  source 1..18: mol_type = other DNA
taattcgagacactttag

SEQ ID NO: 21532 - DNA, 18 bp, synthetic construct
  source 1..18: mol_type = other DNA
taattcgcctcaccttag

SEQ ID NO: 21533 - DNA, 18 bp, synthetic construct
  source 1..18: mol_type = other DNA
taattcggctcactaacg

SEQ ID NO: 21534 - DNA, 18 bp, synthetic construct
  source 1..18: mol_type = other DNA
taattcgtctcactgaag

SEQ ID NO: 21535 - DNA, 18 bp, synthetic construct
  source 1..18: mol_type = other DNA
taattcgtctctctgtag

SEQ ID NO: 21536 - DNA, 18 bp, synthetic construct
  source 1..18: mol_type = other DNA
taattcgtttcattatag

SEQ ID NO: 21537 - DNA, 18 bp, synthetic construct
  source 1..18: mol_type = other DNA
taccacgactcacaattg

SEQ ID NO: 21538 - DNA, 18 bp, synthetic construct
  source 1..18: mol_type = other DNA
tattacaactcactcttg

SEQ ID NO: 21539 - DNA, 18 bp, synthetic construct
  source 1..18: mol_type = other DNA
tattacgacacgcaatag

SEQ ID NO: 21540 - DNA, 18 bp, synthetic construct
  source 1..18: mol_type = other DNA
tattacgacagactattg

SEQ ID NO: 21541 - DNA, 18 bp, synthetic construct
  source 1..18: mol_type = other DNA
tatttcgacgcattatag

SEQ ID NO: 21542 - DNA, 18 bp, synthetic construct
  source 1..18: mol_type = other DNA
tgccacgactcactattg

SEQ ID NO: 21543 - DNA, 18 bp, synthetic construct
  source 1..18: mol_type = other DNA
ttacaggactcgctatag

SEQ ID NO: 21544 - DNA, 18 bp, synthetic construct
  source 1..18: mol_type = other DNA
ttatactactcgatatag

SEQ ID NO: 21545 - DNA, 18 bp, synthetic construct
  source 1..18: mol_type = other DNA
aaaaacaactcaccatag

SEQ ID NO: 21546 - DNA, 18 bp, synthetic construct
  source 1..18: mol_type = other DNA
aaataccactcacttaag

SEQ ID NO: 21547 - DNA, 18 bp, synthetic construct
  source 1..18: mol_type = other DNA
aaatacgactcataacag

SEQ ID NO: 21548 - DNA, 18 bp, synthetic construct
  source 1..18: mol_type = other DNA
aaatacgtctaactttag

SEQ ID NO: 21549 - DNA, 18 bp, synthetic construct
  source 1..18: mol_type = other DNA
aattacggcacactatag

SEQ ID NO: 21550 - DNA, 18 bp, synthetic construct
  source 1..18: mol_type = other DNA
aattccgacacactatag

SEQ ID NO: 21551 - DNA, 18 bp, synthetic construct
  source 1..18: mol_type = other DNA
acacacgactcactaaag

SEQ ID NO: 21552 - DNA, 18 bp, synthetic construct
  source 1..18: mol_type = other DNA
agataccacacactatag

SEQ ID NO: 21553 - DNA, 18 bp, synthetic construct
  source 1..18: mol_type = other DNA
atataaaactcactatag

SEQ ID NO: 21554 - DNA, 18 bp, synthetic construct
  source 1..18: mol_type = other DNA
atatacgaccctctatag

SEQ ID NO: 21555 - DNA, 18 bp, synthetic construct
  source 1..18: mol_type = other DNA
atatacgacgcactttag

SEQ ID NO: 21556 - DNA, 18 bp, synthetic construct
  source 1..18: mol_type = other DNA
caataccagtgactatag

SEQ ID NO: 21557 - DNA, 18 bp, synthetic construct
  source 1..18: mol_type = other DNA
caatacgacatactttag

SEQ ID NO: 21558 - DNA, 18 bp, synthetic construct
  source 1..18: mol_type = other DNA
caatacgattccctttag

SEQ ID NO: 21559 - DNA, 18 bp, synthetic construct
  source 1..18: mol_type = other DNA
ctttacgactcactctag

SEQ ID NO: 21560 - DNA, 18 bp, synthetic construct
  source 1..18: mol_type = other DNA
gattacgtctcacaatag

SEQ ID NO: 21561 - DNA, 18 bp, synthetic construct
  source 1..18: mol_type = other DNA
gtatacaactcactttag

SEQ ID NO: 21562 - DNA, 18 bp, synthetic construct
  source 1..18: mol_type = other DNA
taaaaagacagactatag

SEQ ID NO: 21563 - DNA, 18 bp, synthetic construct
  source 1..18: mol_type = other DNA
taaaaccagtcactaaag

SEQ ID NO: 21564 - DNA, 18 bp, synthetic construct
  source 1..18: mol_type = other DNA
taaaacgactccctgaag

SEQ ID NO: 21565 - DNA, 18 bp, synthetic construct
  source 1..18: mol_type = other DNA
taaaacgagtaattatag

SEQ ID NO: 21566 - DNA, 18 bp, synthetic construct
  source 1..18: mol_type = other DNA
taaaactactcataatag

SEQ ID NO: 21567 - DNA, 18 bp, synthetic construct
  source 1..18: mol_type = other DNA
taacaagactcacaacag

SEQ ID NO: 21568 - DNA, 18 bp, synthetic construct
  source 1..18: mol_type = other DNA
taataaaactcattttag

SEQ ID NO: 21569 - DNA, 18 bp, synthetic construct
  source 1..18: mol_type = other DNA
taataatgctcattatag

SEQ ID NO: 21570 - DNA, 18 bp, synthetic construct
  source 1..18: mol_type = other DNA
taatacatataactatag

SEQ ID NO: 21571 - DNA, 18 bp, synthetic construct
  source 1..18: mol_type = other DNA
taatacgactcttactag

SEQ ID NO: 21572 - DNA, 18 bp, synthetic construct
  source 1..18: mol_type = other DNA
taatacgactcttcatcg

SEQ ID NO: 21573 - DNA, 18 bp, synthetic construct
  source 1..18: mol_type = other DNA
taatacgatactctatcg

SEQ ID NO: 21574 - DNA, 18 bp, synthetic construct
  source 1..18: mol_type = other DNA
taatacgattcctaatag

SEQ ID NO: 21575 - DNA, 18 bp, synthetic construct
  source 1..18: mol_type = other DNA
taatacgattgtcgatag

SEQ ID NO: 21576 - DNA, 18 bp, synthetic construct
  source 1..18: mol_type = other DNA
taatacgttaaactatag

SEQ ID NO: 21577 - DNA, 18 bp, synthetic construct
  source 1..18: mol_type = other DNA
taatacgtttcattttag

SEQ ID NO: 21578 - DNA, 18 bp, synthetic construct
  source 1..18: mol_type = other DNA
taatactacaccctttag

SEQ ID NO: 21579 - DNA, 18 bp, synthetic construct
  source 1..18: mol_type = other DNA
taatactcctcacaaaag

SEQ ID NO: 21580 - DNA, 18 bp, synthetic construct
  source 1..18: mol_type = other DNA
taatacttctcactttcg

SEQ ID NO: 21581 - DNA, 18 bp, synthetic construct
  source 1..18: mol_type = other DNA
taatatgattccctaaag

SEQ ID NO: 21582 - DNA, 18 bp, synthetic construct
  source 1..18: mol_type = other DNA
taatatgtctcacttcag

SEQ ID NO: 21583 - DNA, 18 bp, synthetic construct
  source 1..18: mol_type = other DNA
taatgcgattcacttaag

SEQ ID NO: 21584 - DNA, 18 bp, synthetic construct
  source 1..18: mol_type = other DNA
taatgcgcttcactttag

SEQ ID NO: 21585 - DNA, 18 bp, synthetic construct
  source 1..18: mol_type = other DNA
taatgcgtctccctttag

SEQ ID NO: 21586 - DNA, 18 bp, synthetic construct
  source 1..18: mol_type = other DNA
taatgcgtgtcattatag

SEQ ID NO: 21587 - DNA, 18 bp, synthetic construct
  source 1..18: mol_type = other DNA
tactacgactcagaaaag

SEQ ID NO: 21588 - DNA, 18 bp, synthetic construct
  source 1..18: mol_type = other DNA
tactacgattcaataaag

SEQ ID NO: 21589 - DNA, 18 bp, synthetic construct
  source 1..18: mol_type = other DNA
tagtacgtctcccaatag

SEQ ID NO: 21590 - DNA, 18 bp, synthetic construct
  source 1..18: mol_type = other DNA
tagtactactaattatag

SEQ ID NO: 21591 - DNA, 18 bp, synthetic construct
  source 1..18: mol_type = other DNA
tagtgctactccctatag

SEQ ID NO: 21592 - DNA, 18 bp, synthetic construct
  source 1..18: mol_type = other DNA
tataatgactcactacag

SEQ ID NO: 21593 - DNA, 18 bp, synthetic construct
  source 1..18: mol_type = other DNA
tatcaccactcattatag

SEQ ID NO: 21594 - DNA, 18 bp, synthetic construct
  source 1..18: mol_type = other DNA
tattaagactctcaatag

SEQ ID NO: 21595 - DNA, 18 bp, synthetic construct
  source 1..18: mol_type = other DNA
tattaccactcactggag

SEQ ID NO: 21596 - DNA, 18 bp, synthetic construct
  source 1..18: mol_type = other DNA
tattacgaaatactatag

SEQ ID NO: 21597 - DNA, 18 bp, synthetic construct
  source 1..18: mol_type = other DNA
tattacgactgtctttag

SEQ ID NO: 21598 - DNA, 18 bp, synthetic construct
  source 1..18: mol_type = other DNA
tattactatccactatag

SEQ ID NO: 21599 - DNA, 18 bp, synthetic construct
  source 1..18: mol_type = other DNA
tattatgacacacaatag

SEQ ID NO: 21600 - DNA, 18 bp, synthetic construct
  source 1..18: mol_type = other DNA
tcacgtgactcactatag

SEQ ID NO: 21601 - DNA, 18 bp, synthetic construct
  source 1..18: mol_type = other DNA
tcataagtctccctatag

SEQ ID NO: 21602 - DNA, 18 bp, synthetic construct
  source 1..18: mol_type = other DNA
tcatacgtcttactaaag

SEQ ID NO: 21603 - DNA, 18 bp, synthetic construct
  source 1..18: mol_type = other DNA
tcttacgtctctctatag

SEQ ID NO: 21604 - DNA, 18 bp, synthetic construct
  source 1..18: mol_type = other DNA
tcttgcgactcactatcg

SEQ ID NO: 21605 - DNA, 18 bp, synthetic construct
  source 1..18: mol_type = other DNA
tgatacatctcactatgg

SEQ ID NO: 21606 - DNA, 18 bp, synthetic construct
  source 1..18: mol_type = other DNA
tgatacgactcatcatgg

SEQ ID NO: 21607 - DNA, 18 bp, synthetic construct
  source 1..18: mol_type = other DNA
tgatcctactcacaatag

SEQ ID NO: 21608 - DNA, 18 bp, synthetic construct
  source 1..18: mol_type = other DNA
tgatgcaactcaatatag

SEQ ID NO: 21609 - DNA, 18 bp, synthetic construct
  source 1..18: mol_type = other DNA
tgttacgcctctctatag

SEQ ID NO: 21610 - DNA, 18 bp, synthetic construct
  source 1..18: mol_type = other DNA
ttaaacgactcaaaatag

SEQ ID NO: 21611 - DNA, 18 bp, synthetic construct
  source 1..18: mol_type = other DNA
ttaaacgactcaccctag

SEQ ID NO: 21612 - DNA, 18 bp, synthetic construct
  source 1..18: mol_type = other DNA
ttacacgcctcactatgg

SEQ ID NO: 21613 - DNA, 18 bp, synthetic construct
  source 1..18: mol_type = other DNA
ttataaggctcaccatag

SEQ ID NO: 21614 - DNA, 18 bp, synthetic construct
  source 1..18: mol_type = other DNA
ttatacgaatcacactag

SEQ ID NO: 21615 - DNA, 18 bp, synthetic construct
  source 1..18: mol_type = other DNA
ttatacgactgagtaaag

SEQ ID NO: 21616 - DNA, 18 bp, synthetic construct
  source 1..18: mol_type = other DNA
ttatacgtctcaccgtag

SEQ ID NO: 21617 - DNA, 18 bp, synthetic construct
  source 1..18: mol_type = other DNA
ttatactacaaactatag

SEQ ID NO: 21618 - DNA, 18 bp, synthetic construct
  source 1..18: mol_type = other DNA
ttatactcctcactttag

SEQ ID NO: 21619 - DNA, 18 bp, synthetic construct
  source 1..18: mol_type = other DNA
ttataggtctctctatag

SEQ ID NO: 21620 - DNA, 18 bp, synthetic construct
  source 1..18: mol_type = other DNA
ttatatgtgtcactatag

SEQ ID NO: 21621 - DNA, 18 bp, synthetic construct
  source 1..18: mol_type = other DNA
ttgtacgactcacaaaag

SEQ ID NO: 21622 - DNA, 18 bp, synthetic construct
  source 1..18: mol_type = other DNA
aaattcgtctcactattg

SEQ ID NO: 21623 - DNA, 18 bp, synthetic construct
  source 1..18: mol_type = other DNA
ttattcgactcacaatcg

SEQ ID NO: 21624 - DNA, 18 bp, synthetic construct
  source 1..18: mol_type = other DNA
tagttcgaatcgctatag

SEQ ID NO: 21625 - DNA, 18 bp, synthetic construct
  source 1..18: mol_type = other DNA
atatacgcctcactattg

SEQ ID NO: 21626 - DNA, 18 bp, synthetic construct
  source 1..18: mol_type = other DNA
caaatcgactcacaatag

SEQ ID NO: 21627 - DNA, 18 bp, synthetic construct
  source 1..18: mol_type = other DNA
taatgcgactctcttttg

SEQ ID NO: 21628 - DNA, 18 bp, synthetic construct
  source 1..18: mol_type = other DNA
taattcgactttctatcg

SEQ ID NO: 21629 - DNA, 18 bp, synthetic construct
  source 1..18: mol_type = other DNA
tatttcaactcactaaag

SEQ ID NO: 21630 - DNA, 18 bp, synthetic construct
  source 1..18: mol_type = other DNA
tatttcgcctcactttag

SEQ ID NO: 21631 - DNA, 18 bp, synthetic construct
  source 1..18: mol_type = other DNA
ttatatgactctctattg

SEQ ID NO: 21632 - DNA, 18 bp, synthetic construct
  source 1..18: mol_type = other DNA
ttattcgactctctacag

SEQ ID NO: 21633 - DNA, 18 bp, synthetic construct
  source 1..18: mol_type = other DNA
aaataagtcgcactatag

SEQ ID NO: 21634 - DNA, 18 bp, synthetic construct
  source 1..18: mol_type = other DNA
aaatacatctcactctag

SEQ ID NO: 21635 - DNA, 18 bp, synthetic construct
  source 1..18: mol_type = other DNA
aaatacgactgccaatag

SEQ ID NO: 21636 - DNA, 18 bp, synthetic construct
  source 1..18: mol_type = other DNA
acaaacgaatcactatag

SEQ ID NO: 21637 - DNA, 18 bp, synthetic construct
  source 1..18: mol_type = other DNA
caaaaagactcactttag

SEQ ID NO: 21638 - DNA, 18 bp, synthetic construct
  source 1..18: mol_type = other DNA
taaaacgactctatgtag

SEQ ID NO: 21639 - DNA, 18 bp, synthetic construct
  source 1..18: mol_type = other DNA
taagacttctctctatag

SEQ ID NO: 21640 - DNA, 18 bp, synthetic construct
  source 1..18: mol_type = other DNA
taataagaatttctatag

SEQ ID NO: 21641 - DNA, 18 bp, synthetic construct
  source 1..18: mol_type = other DNA
taatacaactcaaattag

SEQ ID NO: 21642 - DNA, 18 bp, synthetic construct
  source 1..18: mol_type = other DNA
taatacgtctctcaatcg

SEQ ID NO: 21643 - DNA, 18 bp, synthetic construct
  source 1..18: mol_type = other DNA
taatacgtctctctaacg

SEQ ID NO: 21644 - DNA, 18 bp, synthetic construct
  source 1..18: mol_type = other DNA
tattacgactcaaaaaag

SEQ ID NO: 21645 - DNA, 18 bp, synthetic construct
  source 1..18: mol_type = other DNA
tgatacgactaacaaaag

SEQ ID NO: 21646 - DNA, 18 bp, synthetic construct
  source 1..18: mol_type = other DNA
ttacacgactcaccacag

SEQ ID NO: 21647 - DNA, 18 bp, synthetic construct
  source 1..18: mol_type = other DNA
ttataccaatcacaatag

SEQ ID NO: 21648 - DNA, 18 bp, synthetic construct
  source 1..18: mol_type = other DNA
taattcgactctccattg

SEQ ID NO: 21649 - DNA, 18 bp, synthetic construct
  source 1..18: mol_type = other DNA
taaaaagactcaccattg

SEQ ID NO: 21650 - DNA, 18 bp, synthetic construct
  source 1..18: mol_type = other DNA
taaaacgtctcacttttg

SEQ ID NO: 21651 - DNA, 18 bp, synthetic construct
  source 1..18: mol_type = other DNA
taatacgtatcactaatg

SEQ ID NO: 21652 - DNA, 18 bp, synthetic construct
  source 1..18: mol_type = other DNA
tattactaatcactattg

SEQ ID NO: 21653 - DNA, 18 bp, synthetic construct
  source 1..18: mol_type = other DNA
tatttcgtcgcactatag

SEQ ID NO: 21654 - DNA, 18 bp, synthetic construct
  source 1..18: mol_type = other DNA
tcttacgacttactaaag

SEQ ID NO: 21655 - DNA, 18 bp, synthetic construct
  source 1..18: mol_type = other DNA
ttttacgactcacaatgg

SEQ ID NO: 21656 - DNA, 18 bp, synthetic construct
  source 1..18: mol_type = other DNA
taattagactcacttttg

SEQ ID NO: 21657 - DNA, 18 bp, synthetic construct
  source 1..18: mol_type = other DNA
taaatcgactcactttcg

SEQ ID NO: 21658 - DNA, 18 bp, synthetic construct
  source 1..18: mol_type = other DNA
taatacgtctcacaactg

SEQ ID NO: 21659 - DNA, 18 bp, synthetic construct
  source 1..18: mol_type = other DNA
tataacgactcactactg

SEQ ID NO: 21660 - DNA, 18 bp, synthetic construct
  source 1..18: mol_type = other DNA
ttatacgagtctctttag

SEQ ID NO: 21661 - DNA, 18 bp, synthetic construct
  source 1..18: mol_type = other DNA
ttttacaactaactatag

SEQ ID NO: 21662 - DNA, 18 bp, synthetic construct
  source 1..18: mol_type = other DNA
ttaatcgactcactattg

SEQ ID NO: 21663 - DNA, 18 bp, synthetic construct
  source 1..18: mol_type = other DNA
tataaagcctcactatag

SEQ ID NO: 21664 - DNA, 18 bp, synthetic construct
  source 1..18: mol_type = other DNA
tataacaactcactaaag

SEQ ID NO: 21665 - DNA, 18 bp, synthetic construct
  source 1..18: mol_type = other DNA
tatctcgtctcactatag

SEQ ID NO: 21666 - DNA, 18 bp, synthetic construct
  source 1..18: mol_type = other DNA
aaattcgactcaatattg

SEQ ID NO: 21667 - DNA, 18 bp, synthetic construct
  source 1..18: mol_type = other DNA
aaattcggctcactattg

SEQ ID NO: 21668 - DNA, 18 bp, synthetic construct
  source 1..18: mol_type = other DNA
gaatatgactcgctattg

SEQ ID NO: 21669 - DNA, 18 bp, synthetic construct
  source 1..18: mol_type = other DNA
gagttcgactcactattg

SEQ ID NO: 21670 - DNA, 18 bp, synthetic construct
  source 1..18: mol_type = other DNA
taaaacgaatcgctattg

SEQ ID NO: 21671 - DNA, 18 bp, synthetic construct
  source 1..18: mol_type = other DNA
taaaacgactcgcgattg

SEQ ID NO: 21672 - DNA, 18 bp, synthetic construct
  source 1..18: mol_type = other DNA
taatacgatttgctattg

SEQ ID NO: 21673 - DNA, 18 bp, synthetic construct
  source 1..18: mol_type = other DNA
taatacgtctcgctgttg

SEQ ID NO: 21674 - DNA, 18 bp, synthetic construct
  source 1..18: mol_type = other DNA
taatgcgactcgttattg

SEQ ID NO: 21675 - DNA, 18 bp, synthetic construct
  source 1..18: mol_type = other DNA
taatgctactcgctattg

SEQ ID NO: 21676 - DNA, 18 bp, synthetic construct
  source 1..18: mol_type = other DNA
taattccactcgttatag

SEQ ID NO: 21677 - DNA, 18 bp, synthetic construct
  source 1..18: mol_type = other DNA
taattcgacgtactattg

SEQ ID NO: 21678 - DNA, 18 bp, synthetic construct
  source 1..18: mol_type = other DNA
taattcgcctcacttttg

SEQ ID NO: 21679 - DNA, 18 bp, synthetic construct
  source 1..18: mol_type = other DNA
taattctcctcgctatag

SEQ ID NO: 21680 - DNA, 18 bp, synthetic construct
  source 1..18: mol_type = other DNA
taattggactagctatag

SEQ ID NO: 21681 - DNA, 18 bp, synthetic construct
  source 1..18: mol_type = other DNA
taatttgcctcactattg

SEQ ID NO: 21682 - DNA, 18 bp, synthetic construct
  source 1..18: mol_type = other DNA
tatttcggctcgctatag

SEQ ID NO: 21683 - DNA, 18 bp, synthetic construct
  source 1..18: mol_type = other DNA
tcatacgaatcgctattg

SEQ ID NO: 21684 - DNA, 18 bp, synthetic construct
  source 1..18: mol_type = other DNA
tgatacgactagctattg

SEQ ID NO: 21685 - DNA, 18 bp, synthetic construct
  source 1..18: mol_type = other DNA
aaataagactcaccattg

SEQ ID NO: 21686 - DNA, 18 bp, synthetic construct
  source 1..18: mol_type = other DNA
aaatacgacaagctatag

SEQ ID NO: 21687 - DNA, 18 bp, synthetic construct
  source 1..18: mol_type = other DNA
aaatacgacctactattg

SEQ ID NO: 21688 - DNA, 18 bp, synthetic construct
  source 1..18: mol_type = other DNA
aaatacgactgactaatg

SEQ ID NO: 21689 - DNA, 18 bp, synthetic construct
  source 1..18: mol_type = other DNA
aaataggactaactattg

SEQ ID NO: 21690 - DNA, 18 bp, synthetic construct
  source 1..18: mol_type = other DNA
aaatatgattcactattg

SEQ ID NO: 21691 - DNA, 18 bp, synthetic construct
  source 1..18: mol_type = other DNA
aaatccgtctcactattg

SEQ ID NO: 21692 - DNA, 18 bp, synthetic construct
  source 1..18: mol_type = other DNA
aaattccactcactctag

SEQ ID NO: 21693 - DNA, 18 bp, synthetic construct
  source 1..18: mol_type = other DNA
aaattccgctcactatag

SEQ ID NO: 21694 - DNA, 18 bp, synthetic construct
  source 1..18: mol_type = other DNA
aactacgactctctattg

SEQ ID NO: 21695 - DNA, 18 bp, synthetic construct
  source 1..18: mol_type = other DNA
aattacgacccactattg

SEQ ID NO: 21696 - DNA, 18 bp, synthetic construct
  source 1..18: mol_type = other DNA
aattacgtctcgctatag

SEQ ID NO: 21697 - DNA, 18 bp, synthetic construct
  source 1..18: mol_type = other DNA
acattcgactcactacag

SEQ ID NO: 21698 - DNA, 18 bp, synthetic construct
  source 1..18: mol_type = other DNA
acattcgactcattatag

SEQ ID NO: 21699 - DNA, 18 bp, synthetic construct
  source 1..18: mol_type = other DNA
agatacgaatcactattg

SEQ ID NO: 21700 - DNA, 18 bp, synthetic construct
  source 1..18: mol_type = other DNA
agatacgactcactcttg

SEQ ID NO: 21701 - DNA, 18 bp, synthetic construct
  source 1..18: mol_type = other DNA
caaaacgactcacaattg

SEQ ID NO: 21702 - DNA, 18 bp, synthetic construct
  source 1..18: mol_type = other DNA
caaaacgactcattattg

SEQ ID NO: 21703 - DNA, 18 bp, synthetic construct
  source 1..18: mol_type = other DNA
caacacgactcacaattg

SEQ ID NO: 21704 - DNA, 18 bp, synthetic construct
  source 1..18: mol_type = other DNA
caagaccactcactattg

SEQ ID NO: 21705 - DNA, 18 bp, synthetic construct
  source 1..18: mol_type = other DNA
caatacgacttactagtg

SEQ ID NO: 21706 - DNA, 18 bp, synthetic construct
  source 1..18: mol_type = other DNA
caatacgattcactgttg

SEQ ID NO: 21707 - DNA, 18 bp, synthetic construct
  source 1..18: mol_type = other DNA
caatacgtctcactactg

SEQ ID NO: 21708 - DNA, 18 bp, synthetic construct
  source 1..18: mol_type = other DNA
caattcgaatcactctag

SEQ ID NO: 21709 - DNA, 18 bp, synthetic construct
  source 1..18: mol_type = other DNA
ctatacgactcactatta

SEQ ID NO: 21710 - DNA, 18 bp, synthetic construct
  source 1..18: mol_type = other DNA
ctatacggctcactattg

SEQ ID NO: 21711 - DNA, 18 bp, synthetic construct
  source 1..18: mol_type = other DNA
ctctacgactcactattg

SEQ ID NO: 21712 - DNA, 18 bp, synthetic construct
  source 1..18: mol_type = other DNA
ctttacgactcactattg

SEQ ID NO: 21713 - DNA, 18 bp, synthetic construct
  source 1..18: mol_type = other DNA
gaaaacgtctcactattg

SEQ ID NO: 21714 - DNA, 18 bp, synthetic construct
  source 1..18: mol_type = other DNA
gaatacgtctcactcttg

SEQ ID NO: 21715 - DNA, 18 bp, synthetic construct
  source 1..18: mol_type = other DNA
gaatactactcgctttag

SEQ ID NO: 21716 - DNA, 18 bp, synthetic construct
  source 1..18: mol_type = other DNA
gaatgcgtctcgctatag

SEQ ID NO: 21717 - DNA, 18 bp, synthetic construct
  source 1..18: mol_type = other DNA
gaattcgactcacactag

SEQ ID NO: 21718 - DNA, 18 bp, synthetic construct
  source 1..18: mol_type = other DNA
gaattcgattcactttag

SEQ ID NO: 21719 - DNA, 18 bp, synthetic construct
  source 1..18: mol_type = other DNA
gattacgactcactcttg

SEQ ID NO: 21720 - DNA, 18 bp, synthetic construct
  source 1..18: mol_type = other DNA
gtatacgacttgctatag

SEQ ID NO: 21721 - DNA, 18 bp, synthetic construct
  source 1..18: mol_type = other DNA
taaaacgactccccattg

SEQ ID NO: 21722 - DNA, 18 bp, synthetic construct
  source 1..18: mol_type = other DNA
taaaacgactcgctaacg

SEQ ID NO: 21723 - DNA, 18 bp, synthetic construct
  source 1..18: mol_type = other DNA
taaaacgagccactattg

SEQ ID NO: 21724 - DNA, 18 bp, synthetic construct
  source 1..18: mol_type = other DNA
taaagcgacccactattg

SEQ ID NO: 21725 - DNA, 18 bp, synthetic construct
  source 1..18: mol_type = other DNA
taaatcgactcactaccg

SEQ ID NO: 21726 - DNA, 18 bp, synthetic construct
  source 1..18: mol_type = other DNA
taaatcgcctcacaatag

SEQ ID NO: 21727 - DNA, 18 bp, synthetic construct
  source 1..18: mol_type = other DNA
taaattgactcactaaag

SEQ ID NO: 21728 - DNA, 18 bp, synthetic construct
  source 1..18: mol_type = other DNA
taacacgacacgctatcg

SEQ ID NO: 21729 - DNA, 18 bp, synthetic construct
  source 1..18: mol_type = other DNA
taacacgacacgctgtag

SEQ ID NO: 21730 - DNA, 18 bp, synthetic construct
  source 1..18: mol_type = other DNA
taacacgacccattattg

SEQ ID NO: 21731 - DNA, 18 bp, synthetic construct
  source 1..18: mol_type = other DNA
taacaggactcattattg

SEQ ID NO: 21732 - DNA, 18 bp, synthetic construct
  source 1..18: mol_type = other DNA
taacatgcctcactattg

SEQ ID NO: 21733 - DNA, 18 bp, synthetic construct
  source 1..18: mol_type = other DNA
taacccgactctctattg

SEQ ID NO: 21734 - DNA, 18 bp, synthetic construct
  source 1..18: mol_type = other DNA
taactcgaccaactatag

SEQ ID NO: 21735 - DNA, 18 bp, synthetic construct
  source 1..18: mol_type = other DNA
taactcgactcaccttag

SEQ ID NO: 21736 - DNA, 18 bp, synthetic construct
  source 1..18: mol_type = other DNA
taagaccactctctattg

SEQ ID NO: 21737 - DNA, 18 bp, synthetic construct
  source 1..18: mol_type = other DNA
taagacgacccacttttg

SEQ ID NO: 21738 - DNA, 18 bp, synthetic construct
  source 1..18: mol_type = other DNA
taagagaactcactattg

SEQ ID NO: 21739 - DNA, 18 bp, synthetic construct
  source 1..18: mol_type = other DNA
taataagaatggctatag

SEQ ID NO: 21740 - DNA, 18 bp, synthetic construct
  source 1..18: mol_type = other DNA
taataagccacgctatag

SEQ ID NO: 21741 - DNA, 18 bp, synthetic construct
  source 1..18: mol_type = other DNA
taataagcctcactgttg

SEQ ID NO: 21742 - DNA, 18 bp, synthetic construct
  source 1..18: mol_type = other DNA
taatacaacacaccattg

SEQ ID NO: 21743 - DNA, 18 bp, synthetic construct
  source 1..18: mol_type = other DNA
taatacaactagatatag

SEQ ID NO: 21744 - DNA, 18 bp, synthetic construct
  source 1..18: mol_type = other DNA
taatacaactcagttttg

SEQ ID NO: 21745 - DNA, 18 bp, synthetic construct
  source 1..18: mol_type = other DNA
taatacaactcgttacag

SEQ ID NO: 21746 - DNA, 18 bp, synthetic construct
  source 1..18: mol_type = other DNA
taatacaattcgctatgg

SEQ ID NO: 21747 - DNA, 18 bp, synthetic construct
  source 1..18: mol_type = other DNA
taatacaattgactattg

SEQ ID NO: 21748 - DNA, 18 bp, synthetic construct
  source 1..18: mol_type = other DNA
taataccactcaatcttg

SEQ ID NO: 21749 - DNA, 18 bp, synthetic construct
  source 1..18: mol_type = other DNA
taataccactcacgactg

SEQ ID NO: 21750 - DNA, 18 bp, synthetic construct
  source 1..18: mol_type = other DNA
taatacgaatcaatactg

SEQ ID NO: 21751 - DNA, 18 bp, synthetic construct
  source 1..18: mol_type = other DNA
taatacgacacacagttg

SEQ ID NO: 21752 - DNA, 18 bp, synthetic construct
  source 1..18: mol_type = other DNA
taatacgacagattattg

SEQ ID NO: 21753 - DNA, 18 bp, synthetic construct
  source 1..18: mol_type = other DNA
taatacgacctgcgatag

SEQ ID NO: 21754 - DNA, 18 bp, synthetic construct
  source 1..18: mol_type = other DNA
taatacgactaaatagtg

SEQ ID NO: 21755 - DNA, 18 bp, synthetic construct
  source 1..18: mol_type = other DNA
taatacgactcagttatg

SEQ ID NO: 21756 - DNA, 18 bp, synthetic construct
  source 1..18: mol_type = other DNA
taatacgactccatactg

SEQ ID NO: 21757 - DNA, 18 bp, synthetic construct
  source 1..18: mol_type = other DNA
taatacgactctcctttg

SEQ ID NO: 21758 - DNA, 18 bp, synthetic construct
  source 1..18: mol_type = other DNA
taatacgacttgcaaaag

SEQ ID NO: 21759 - DNA, 18 bp, synthetic construct
  source 1..18: mol_type = other DNA
taatacgagtcccaattg

SEQ ID NO: 21760 - DNA, 18 bp, synthetic construct
  source 1..18: mol_type = other DNA
taatacgagtcgatagag

SEQ ID NO: 21761 - DNA, 18 bp, synthetic construct
  source 1..18: mol_type = other DNA
taatacgatccgcaatag

SEQ ID NO: 21762 - DNA, 18 bp, synthetic construct
  source 1..18: mol_type = other DNA
taatacgattctcgattg

SEQ ID NO: 21763 - DNA, 18 bp, synthetic construct
  source 1..18: mol_type = other DNA
taatacgcatcgctagag

SEQ ID NO: 21764 - DNA, 18 bp, synthetic construct
  source 1..18: mol_type = other DNA
taatacgccacactgttg

SEQ ID NO: 21765 - DNA, 18 bp, synthetic construct
  source 1..18: mol_type = other DNA
taatacgccccactagtg

SEQ ID NO: 21766 - DNA, 18 bp, synthetic construct
  source 1..18: mol_type = other DNA
taatacgcctaacgattg

SEQ ID NO: 21767 - DNA, 18 bp, synthetic construct
  source 1..18: mol_type = other DNA
taatacgcctccctaatg

SEQ ID NO: 21768 - DNA, 18 bp, synthetic construct
  source 1..18: mol_type = other DNA
taatacgcctcgcattag

SEQ ID NO: 21769 - DNA, 18 bp, synthetic construct
  source 1..18: mol_type = other DNA
taatacggatctctattg

SEQ ID NO: 21770 - DNA, 18 bp, synthetic construct
  source 1..18: mol_type = other DNA
taatacggcttactcttg

SEQ ID NO: 21771 - DNA, 18 bp, synthetic construct
  source 1..18: mol_type = other DNA
taatacgtctaactagtg

SEQ ID NO: 21772 - DNA, 18 bp, synthetic construct
  source 1..18: mol_type = other DNA
taatacgtctcattcttg

SEQ ID NO: 21773 - DNA, 18 bp, synthetic construct
  source 1..18: mol_type = other DNA
taatacgtcttggtatag

SEQ ID NO: 21774 - DNA, 18 bp, synthetic construct
  source 1..18: mol_type = other DNA
taatacgtgtcactactg

SEQ ID NO: 21775 - DNA, 18 bp, synthetic construct
  source 1..18: mol_type = other DNA
taatactacacactcttg

SEQ ID NO: 21776 - DNA, 18 bp, synthetic construct
  source 1..18: mol_type = other DNA
taatactactcaccactg

SEQ ID NO: 21777 - DNA, 18 bp, synthetic construct
  source 1..18: mol_type = other DNA
taatactactccctactg

SEQ ID NO: 21778 - DNA, 18 bp, synthetic construct
  source 1..18: mol_type = other DNA
taatactactggctgtag

SEQ ID NO: 21779 - DNA, 18 bp, synthetic construct
  source 1..18: mol_type = other DNA
taatagcactcacttttg

SEQ ID NO: 21780 - DNA, 18 bp, synthetic construct
  source 1..18: mol_type = other DNA
taataggaatcgccatag

SEQ ID NO: 21781 - DNA, 18 bp, synthetic construct
  source 1..18: mol_type = other DNA
taataggactctcaattg

SEQ ID NO: 21782 - DNA, 18 bp, synthetic construct
  source 1..18: mol_type = other DNA
taatagtactaactattg

SEQ ID NO: 21783 - DNA, 18 bp, synthetic construct
  source 1..18: mol_type = other DNA
taatatcactcgctaaag

SEQ ID NO: 21784 - DNA, 18 bp, synthetic construct
  source 1..18: mol_type = other DNA
taatattactcgatatag

SEQ ID NO: 21785 - DNA, 18 bp, synthetic construct
  source 1..18: mol_type = other DNA
taatcagactaactattg

SEQ ID NO: 21786 - DNA, 18 bp, synthetic construct
  source 1..18: mol_type = other DNA
taatccgacttactgttg

SEQ ID NO: 21787 - DNA, 18 bp, synthetic construct
  source 1..18: mol_type = other DNA
taatccgcctcacttttg

SEQ ID NO: 21788 - DNA, 18 bp, synthetic construct
  source 1..18: mol_type = other DNA
taatgccactcactgttg

SEQ ID NO: 21789 - DNA, 18 bp, synthetic construct
  source 1..18: mol_type = other DNA
taatgcgagtcactagtg

SEQ ID NO: 21790 - DNA, 18 bp, synthetic construct
  source 1..18: mol_type = other DNA
taatgcgtctcaccattg

SEQ ID NO: 21791 - DNA, 18 bp, synthetic construct
  source 1..18: mol_type = other DNA
taatgctactcgctacag

SEQ ID NO: 21792 - DNA, 18 bp, synthetic construct
  source 1..18: mol_type = other DNA
taatgctactgactattg

SEQ ID NO: 21793 - DNA, 18 bp, synthetic construct
  source 1..18: mol_type = other DNA
taattagaatcactacag

SEQ ID NO: 21794 - DNA, 18 bp, synthetic construct
  source 1..18: mol_type = other DNA
taattagacacactagag

SEQ ID NO: 21795 - DNA, 18 bp, synthetic construct
  source 1..18: mol_type = other DNA
taattagactcacaatgg

SEQ ID NO: 21796 - DNA, 18 bp, synthetic construct
  source 1..18: mol_type = other DNA
taattagactccatatag

SEQ ID NO: 21797 - DNA, 18 bp, synthetic construct
  source 1..18: mol_type = other DNA
taattagacttacgatag

SEQ ID NO: 21798 - DNA, 18 bp, synthetic construct
  source 1..18: mol_type = other DNA
taattagtctcactctag

SEQ ID NO: 21799 - DNA, 18 bp, synthetic construct
  source 1..18: mol_type = other DNA
taattcaacacagtatag

SEQ ID NO: 21800 - DNA, 18 bp, synthetic construct
  source 1..18: mol_type = other DNA
taattccactcacaacag

SEQ ID NO: 21801 - DNA, 18 bp, synthetic construct
  source 1..18: mol_type = other DNA
taattccactgattatag

SEQ ID NO: 21802 - DNA, 18 bp, synthetic construct
  source 1..18: mol_type = other DNA
taattcgaatcattatgg

SEQ ID NO: 21803 - DNA, 18 bp, synthetic construct
  source 1..18: mol_type = other DNA
taattcgacagactaaag

SEQ ID NO: 21804 - DNA, 18 bp, synthetic construct
  source 1..18: mol_type = other DNA
taattcgacatacaatag

SEQ ID NO: 21805 - DNA, 18 bp, synthetic construct
  source 1..18: mol_type = other DNA
taattcgactaacaatgg

SEQ ID NO: 21806 - DNA, 18 bp, synthetic construct
  source 1..18: mol_type = other DNA
taattcgactctaaatag

SEQ ID NO: 21807 - DNA, 18 bp, synthetic construct
  source 1..18: mol_type = other DNA
taattcgatgaactatag

SEQ ID NO: 21808 - DNA, 18 bp, synthetic construct
  source 1..18: mol_type = other DNA
taattcgcataactatag

SEQ ID NO: 21809 - DNA, 18 bp, synthetic construct
  source 1..18: mol_type = other DNA
taattcgccacactctag

SEQ ID NO: 21810 - DNA, 18 bp, synthetic construct
  source 1..18: mol_type = other DNA
taattcgtctgcctatag

SEQ ID NO: 21811 - DNA, 18 bp, synthetic construct
  source 1..18: mol_type = other DNA
taattctaatcactacag

SEQ ID NO: 21812 - DNA, 18 bp, synthetic construct
  source 1..18: mol_type = other DNA
taattctactcattttag

SEQ ID NO: 21813 - DNA, 18 bp, synthetic construct
  source 1..18: mol_type = other DNA
taattctactctccatag

SEQ ID NO: 21814 - DNA, 18 bp, synthetic construct
  source 1..18: mol_type = other DNA
taattctattcactatcg

SEQ ID NO: 21815 - DNA, 18 bp, synthetic construct
  source 1..18: mol_type = other DNA
taattggactcacttgag

SEQ ID NO: 21816 - DNA, 18 bp, synthetic construct
  source 1..18: mol_type = other DNA
taattggtctaactatag

SEQ ID NO: 21817 - DNA, 18 bp, synthetic construct
  source 1..18: mol_type = other DNA
taatttgactaaatatag

SEQ ID NO: 21818 - DNA, 18 bp, synthetic construct
  source 1..18: mol_type = other DNA
taatttgactcattacag

SEQ ID NO: 21819 - DNA, 18 bp, synthetic construct
  source 1..18: mol_type = other DNA
taatttgactctctatcg

SEQ ID NO: 21820 - DNA, 18 bp, synthetic construct
  source 1..18: mol_type = other DNA
taatttgactgattatag

SEQ ID NO: 21821 - DNA, 18 bp, synthetic construct
  source 1..18: mol_type = other DNA
taatttgattcactgtag

SEQ ID NO: 21822 - DNA, 18 bp, synthetic construct
  source 1..18: mol_type = other DNA
taatttgcctcaatatag

SEQ ID NO: 21823 - DNA, 18 bp, synthetic construct
  source 1..18: mol_type = other DNA
taattttactcactgtag

SEQ ID NO: 21824 - DNA, 18 bp, synthetic construct
  source 1..18: mol_type = other DNA
tacatcgactcaccatag

SEQ ID NO: 21825 - DNA, 18 bp, synthetic construct
  source 1..18: mol_type = other DNA
tactacgactagctaaag

SEQ ID NO: 21826 - DNA, 18 bp, synthetic construct
  source 1..18: mol_type = other DNA
tactacgactcaccaatg

SEQ ID NO: 21827 - DNA, 18 bp, synthetic construct
  source 1..18: mol_type = other DNA
tactacgactcgcaaaag

SEQ ID NO: 21828 - DNA, 18 bp, synthetic construct
  source 1..18: mol_type = other DNA
tactacgactcggaatag

SEQ ID NO: 21829 - DNA, 18 bp, synthetic construct
  source 1..18: mol_type = other DNA
tactacgtctcagtattg

SEQ ID NO: 21830 - DNA, 18 bp, synthetic construct
  source 1..18: mol_type = other DNA
tacttcgaatcattatag

SEQ ID NO: 21831 - DNA, 18 bp, synthetic construct
  source 1..18: mol_type = other DNA
tacttcgactaactatcg

SEQ ID NO: 21832 - DNA, 18 bp, synthetic construct
  source 1..18: mol_type = other DNA
tacttcgatacactatag

SEQ ID NO: 21833 - DNA, 18 bp, synthetic construct
  source 1..18: mol_type = other DNA
tacttggactcaatatag

SEQ ID NO: 21834 - DNA, 18 bp, synthetic construct
  source 1..18: mol_type = other DNA
tagtacgactaaatattg

SEQ ID NO: 21835 - DNA, 18 bp, synthetic construct
  source 1..18: mol_type = other DNA
tagtacgattctctattg

SEQ ID NO: 21836 - DNA, 18 bp, synthetic construct
  source 1..18: mol_type = other DNA
tagtaggactgactattg

SEQ ID NO: 21837 - DNA, 18 bp, synthetic construct
  source 1..18: mol_type = other DNA
tagttcgacgcacaatag

SEQ ID NO: 21838 - DNA, 18 bp, synthetic construct
  source 1..18: mol_type = other DNA
tatcaccactcactattg

SEQ ID NO: 21839 - DNA, 18 bp, synthetic construct
  source 1..18: mol_type = other DNA
tatgacgactcaccattg

SEQ ID NO: 21840 - DNA, 18 bp, synthetic construct
  source 1..18: mol_type = other DNA
tattacgactcaatcttg

SEQ ID NO: 21841 - DNA, 18 bp, synthetic construct
  source 1..18: mol_type = other DNA
tattacgattcagtattg

SEQ ID NO: 21842 - DNA, 18 bp, synthetic construct
  source 1..18: mol_type = other DNA
tattaggactcactactg

SEQ ID NO: 21843 - DNA, 18 bp, synthetic construct
  source 1..18: mol_type = other DNA
tatttagactcactctag

SEQ ID NO: 21844 - DNA, 18 bp, synthetic construct
  source 1..18: mol_type = other DNA
tatttagactctctatag

SEQ ID NO: 21845 - DNA, 18 bp, synthetic construct
  source 1..18: mol_type = other DNA
tatttcgactcagcatag

SEQ ID NO: 21846 - DNA, 18 bp, synthetic construct
  source 1..18: mol_type = other DNA
tatttcgactcattacag

SEQ ID NO: 21847 - DNA, 18 bp, synthetic construct
  source 1..18: mol_type = other DNA
tatttcgattcactctag

SEQ ID NO: 21848 - DNA, 18 bp, synthetic construct
  source 1..18: mol_type = other DNA
tatttcgattcattatag

SEQ ID NO: 21849 - DNA, 18 bp, synthetic construct
  source 1..18: mol_type = other DNA
tatttctacgcactatag

SEQ ID NO: 21850 - DNA, 18 bp, synthetic construct
  source 1..18: mol_type = other DNA
tatttctactcactatcg

SEQ ID NO: 21851 - DNA, 18 bp, synthetic construct
  source 1..18: mol_type = other DNA
tatttggactcacaatag

SEQ ID NO: 21852 - DNA, 18 bp, synthetic construct
  source 1..18: mol_type = other DNA
tatttgggctcactatag

SEQ ID NO: 21853 - DNA, 18 bp, synthetic construct
  source 1..18: mol_type = other DNA
tattttgattcactatag

SEQ ID NO: 21854 - DNA, 18 bp, synthetic construct
  source 1..18: mol_type = other DNA
tcacacaactcactattg

SEQ ID NO: 21855 - DNA, 18 bp, synthetic construct
  source 1..18: mol_type = other DNA
tcatacgactcactggtg

SEQ ID NO: 21856 - DNA, 18 bp, synthetic construct
  source 1..18: mol_type = other DNA
tcatacgactcataattg

SEQ ID NO: 21857 - DNA, 18 bp, synthetic construct
  source 1..18: mol_type = other DNA
tcatactacttactattg

SEQ ID NO: 21858 - DNA, 18 bp, synthetic construct
  source 1..18: mol_type = other DNA
tcatgcgactcacaattg

SEQ ID NO: 21859 - DNA, 18 bp, synthetic construct
  source 1..18: mol_type = other DNA
tcattagactcactgtag

SEQ ID NO: 21860 - DNA, 18 bp, synthetic construct
  source 1..18: mol_type = other DNA
tcattcgactctctaaag

SEQ ID NO: 21861 - DNA, 18 bp, synthetic construct
  source 1..18: mol_type = other DNA
tcattcgcctcattatag

SEQ ID NO: 21862 - DNA, 18 bp, synthetic construct
  source 1..18: mol_type = other DNA
tcatttgactctctatag

SEQ ID NO: 21863 - DNA, 18 bp, synthetic construct
  source 1..18: mol_type = other DNA
tcccacgactcactattg

SEQ ID NO: 21864 - DNA, 18 bp, synthetic construct
  source 1..18: mol_type = other DNA
tgaaacgacgcactattg

SEQ ID NO: 21865 - DNA, 18 bp, synthetic construct
  source 1..18: mol_type = other DNA
tgacacgacacactattg

SEQ ID NO: 21866 - DNA, 18 bp, synthetic construct
  source 1..18: mol_type = other DNA
tgataagactaactattg

SEQ ID NO: 21867 - DNA, 18 bp, synthetic construct
  source 1..18: mol_type = other DNA
tgatacctctcgctatag

SEQ ID NO: 21868 - DNA, 18 bp, synthetic construct
  source 1..18: mol_type = other DNA
tgatacgacacagtattg

SEQ ID NO: 21869 - DNA, 18 bp, synthetic construct
  source 1..18: mol_type = other DNA
tgatacgacacgcaatag

SEQ ID NO: 21870 - DNA, 18 bp, synthetic construct
  source 1..18: mol_type = other DNA
tgatacgacacgctacag

SEQ ID NO: 21871 - DNA, 18 bp, synthetic construct
  source 1..18: mol_type = other DNA
tgatacgacccacaattg

SEQ ID NO: 21872 - DNA, 18 bp, synthetic construct
  source 1..18: mol_type = other DNA
tgatacgacttacttttg

SEQ ID NO: 21873 - DNA, 18 bp, synthetic construct
  source 1..18: mol_type = other DNA
tgatacgtctcgctatcg

SEQ ID NO: 21874 - DNA, 18 bp, synthetic construct
  source 1..18: mol_type = other DNA
tgatatgactcacttttg

SEQ ID NO: 21875 - DNA, 18 bp, synthetic construct
  source 1..18: mol_type = other DNA
tgatatgacttactattg

SEQ ID NO: 21876 - DNA, 18 bp, synthetic construct
  source 1..18: mol_type = other DNA
tgatgcgactcactactg

SEQ ID NO: 21877 - DNA, 18 bp, synthetic construct
  source 1..18: mol_type = other DNA
tgattcgacccactaaag

SEQ ID NO: 21878 - DNA, 18 bp, synthetic construct
  source 1..18: mol_type = other DNA
tgattcgactcaataaag

SEQ ID NO: 21879 - DNA, 18 bp, synthetic construct
  source 1..18: mol_type = other DNA
tgattggactcactatcg

SEQ ID NO: 21880 - DNA, 18 bp, synthetic construct
  source 1..18: mol_type = other DNA
tgatttgacacactatag

SEQ ID NO: 21881 - DNA, 18 bp, synthetic construct
  source 1..18: mol_type = other DNA
tgtttcgagtcactatag

SEQ ID NO: 21882 - DNA, 18 bp, synthetic construct
  source 1..18: mol_type = other DNA
ttacacgactcactaatg

SEQ ID NO: 21883 - DNA, 18 bp, synthetic construct
  source 1..18: mol_type = other DNA
ttacacgactccctattg

SEQ ID NO: 21884 - DNA, 18 bp, synthetic construct
  source 1..18: mol_type = other DNA
ttacacgactcgcaatag

SEQ ID NO: 21885 - DNA, 18 bp, synthetic construct
  source 1..18: mol_type = other DNA
ttataagacgcactattg

SEQ ID NO: 21886 - DNA, 18 bp, synthetic construct
  source 1..18: mol_type = other DNA
ttataagactcaccattg

SEQ ID NO: 21887 - DNA, 18 bp, synthetic construct
  source 1..18: mol_type = other DNA
ttataagactcgctttag

SEQ ID NO: 21888 - DNA, 18 bp, synthetic construct
  source 1..18: mol_type = other DNA
ttataccactagctatag

SEQ ID NO: 21889 - DNA, 18 bp, synthetic construct
  source 1..18: mol_type = other DNA
ttataccactcgctacag

SEQ ID NO: 21890 - DNA, 18 bp, synthetic construct
  source 1..18: mol_type = other DNA
ttatacgactaactcttg

SEQ ID NO: 21891 - DNA, 18 bp, synthetic construct
  source 1..18: mol_type = other DNA
ttatacgactcagtcttg

SEQ ID NO: 21892 - DNA, 18 bp, synthetic construct
  source 1..18: mol_type = other DNA
ttatacgactcgctcaag

SEQ ID NO: 21893 - DNA, 18 bp, synthetic construct
  source 1..18: mol_type = other DNA
ttatacgattcgctatcg

SEQ ID NO: 21894 - DNA, 18 bp, synthetic construct
  source 1..18: mol_type = other DNA
ttatacgcttcgctatag

SEQ ID NO: 21895 - DNA, 18 bp, synthetic construct
  source 1..18: mol_type = other DNA
ttatacggatcgctatag

SEQ ID NO: 21896 - DNA, 18 bp, synthetic construct
  source 1..18: mol_type = other DNA
ttatacggctcacaattg

SEQ ID NO: 21897 - DNA, 18 bp, synthetic construct
  source 1..18: mol_type = other DNA
ttataggactcaatattg

SEQ ID NO: 21898 - DNA, 18 bp, synthetic construct
  source 1..18: mol_type = other DNA
ttatccgacttactattg

SEQ ID NO: 21899 - DNA, 18 bp, synthetic construct
  source 1..18: mol_type = other DNA
ttattcgactcacgaaag

SEQ ID NO: 21900 - DNA, 18 bp, synthetic construct
  source 1..18: mol_type = other DNA
ttattcgactcactctgg

SEQ ID NO: 21901 - DNA, 18 bp, synthetic construct
  source 1..18: mol_type = other DNA
ttattcgactcattgtag

SEQ ID NO: 21902 - DNA, 18 bp, synthetic construct
  source 1..18: mol_type = other DNA
ttattcgactctctagag

SEQ ID NO: 21903 - DNA, 18 bp, synthetic construct
  source 1..18: mol_type = other DNA
ttattcgagtcactatgg

SEQ ID NO: 21904 - DNA, 18 bp, synthetic construct
  source 1..18: mol_type = other DNA
ttattcgattcactctag

SEQ ID NO: 21905 - DNA, 18 bp, synthetic construct
  source 1..18: mol_type = other DNA
ttattcgcctcattatag

SEQ ID NO: 21906 - DNA, 18 bp, synthetic construct
  source 1..18: mol_type = other DNA
ttattcgtcgcactatag

SEQ ID NO: 21907 - DNA, 18 bp, synthetic construct
  source 1..18: mol_type = other DNA
tttttcgacttactatag

SEQ ID NO: 21908 - DNA, 18 bp, synthetic construct
  source 1..18: mol_type = other DNA
aaaaacgcctcactatgg

SEQ ID NO: 21909 - DNA, 18 bp, synthetic construct
  source 1..18: mol_type = other DNA
aaaaacgtctaactatag

SEQ ID NO: 21910 - DNA, 18 bp, synthetic construct
  source 1..18: mol_type = other DNA
aaaaacgtctcactagag

SEQ ID NO: 21911 - DNA, 18 bp, synthetic construct
  source 1..18: mol_type = other DNA
aaaaactattcactatag

SEQ ID NO: 21912 - DNA, 18 bp, synthetic construct
  source 1..18: mol_type = other DNA
aaacaagactcattatag

SEQ ID NO: 21913 - DNA, 18 bp, synthetic construct
  source 1..18: mol_type = other DNA
aaacacgtctcactgtag

SEQ ID NO: 21914 - DNA, 18 bp, synthetic construct
  source 1..18: mol_type = other DNA
aaacacgtctcattatag

SEQ ID NO: 21915 - DNA, 18 bp, synthetic construct
  source 1..18: mol_type = other DNA
aaacactactgactatag

SEQ ID NO: 21916 - DNA, 18 bp, synthetic construct
  source 1..18: mol_type = other DNA
aaagacgtctcactttag

SEQ ID NO: 21917 - DNA, 18 bp, synthetic construct
  source 1..18: mol_type = other DNA
aaataagactcaatacag

SEQ ID NO: 21918 - DNA, 18 bp, synthetic construct
  source 1..18: mol_type = other DNA
aaataaggctcattatag

SEQ ID NO: 21919 - DNA, 18 bp, synthetic construct
  source 1..18: mol_type = other DNA
aaatacaaatcattatag

SEQ ID NO: 21920 - DNA, 18 bp, synthetic construct
  source 1..18: mol_type = other DNA
aaatacaacaaactatag

SEQ ID NO: 21921 - DNA, 18 bp, synthetic construct
  source 1..18: mol_type = other DNA
aaatacaactcacaacag

SEQ ID NO: 21922 - DNA, 18 bp, synthetic construct
  source 1..18: mol_type = other DNA
aaatacaattcactatgg

SEQ ID NO: 21923 - DNA, 18 bp, synthetic construct
  source 1..18: mol_type = other DNA
aaataccactcagtctag

SEQ ID NO: 21924 - DNA, 18 bp, synthetic construct
  source 1..18: mol_type = other DNA
aaataccatttactatag

SEQ ID NO: 21925 - DNA, 18 bp, synthetic construct
  source 1..18: mol_type = other DNA
aaatacgaatcactcaag

SEQ ID NO: 21926 - DNA, 18 bp, synthetic construct
  source 1..18: mol_type = other DNA
aaatacgacccaatatcg

SEQ ID NO: 21927 - DNA, 18 bp, synthetic construct
  source 1..18: mol_type = other DNA
aaatacgacccatcatag

SEQ ID NO: 21928 - DNA, 18 bp, synthetic construct
  source 1..18: mol_type = other DNA
aaatacgactctctctcg

SEQ ID NO: 21929 - DNA, 18 bp, synthetic construct
  source 1..18: mol_type = other DNA
aaatacgattcaaaatag

SEQ ID NO: 21930 - DNA, 18 bp, synthetic construct
  source 1..18: mol_type = other DNA
aaatacgattcaccatcg

SEQ ID NO: 21931 - DNA, 18 bp, synthetic construct
  source 1..18: mol_type = other DNA
aaatacgattcccaatag

SEQ ID NO: 21932 - DNA, 18 bp, synthetic construct
  source 1..18: mol_type = other DNA
aaatacgcctcaccaaag

SEQ ID NO: 21933 - DNA, 18 bp, synthetic construct
  source 1..18: mol_type = other DNA
aaatacggctcattctag

SEQ ID NO: 21934 - DNA, 18 bp, synthetic construct
  source 1..18: mol_type = other DNA
aaatacgtctctctgtag

SEQ ID NO: 21935 - DNA, 18 bp, synthetic construct
  source 1..18: mol_type = other DNA
aaatactactcactaagg

SEQ ID NO: 21936 - DNA, 18 bp, synthetic construct
  source 1..18: mol_type = other DNA
aaatactagtcactaaag

SEQ ID NO: 21937 - DNA, 18 bp, synthetic construct
  source 1..18: mol_type = other DNA
aaatactgctcagtatag

SEQ ID NO: 21938 - DNA, 18 bp, synthetic construct
  source 1..18: mol_type = other DNA
aaatagaaatcactatag

SEQ ID NO: 21939 - DNA, 18 bp, synthetic construct
  source 1..18: mol_type = other DNA
aaataggactcactgaag

SEQ ID NO: 21940 - DNA, 18 bp, synthetic construct
  source 1..18: mol_type = other DNA
aaataggactctctgtag

SEQ ID NO: 21941 - DNA, 18 bp, synthetic construct
  source 1..18: mol_type = other DNA
aaatatgactaactttag

SEQ ID NO: 21942 - DNA, 18 bp, synthetic construct
  source 1..18: mol_type = other DNA
aaatatgattcactttag

SEQ ID NO: 21943 - DNA, 18 bp, synthetic construct
  source 1..18: mol_type = other DNA
aaatatgcctcacaatag

SEQ ID NO: 21944 - DNA, 18 bp, synthetic construct
  source 1..18: mol_type = other DNA
aaatcatactcactatag

SEQ ID NO: 21945 - DNA, 18 bp, synthetic construct
  source 1..18: mol_type = other DNA
aaatcctactctctatag

SEQ ID NO: 21946 - DNA, 18 bp, synthetic construct
  source 1..18: mol_type = other DNA
aaatgcgaatcaccatag

SEQ ID NO: 21947 - DNA, 18 bp, synthetic construct
  source 1..18: mol_type = other DNA
aaatgcgacttactatcg

SEQ ID NO: 21948 - DNA, 18 bp, synthetic construct
  source 1..18: mol_type = other DNA
aaatgtgactcactttag

SEQ ID NO: 21949 - DNA, 18 bp, synthetic construct
  source 1..18: mol_type = other DNA
aactacgaatcaccatag

SEQ ID NO: 21950 - DNA, 18 bp, synthetic construct
  source 1..18: mol_type = other DNA
aactacgacgtactatag

SEQ ID NO: 21951 - DNA, 18 bp, synthetic construct
  source 1..18: mol_type = other DNA
aactacgtctcaatatag

SEQ ID NO: 21952 - DNA, 18 bp, synthetic construct
  source 1..18: mol_type = other DNA
aactccgacccactatag

SEQ ID NO: 21953 - DNA, 18 bp, synthetic construct
  source 1..18: mol_type = other DNA
aagaacgactcattatag

SEQ ID NO: 21954 - DNA, 18 bp, synthetic construct
  source 1..18: mol_type = other DNA
aagtaagactcaatatag

SEQ ID NO: 21955 - DNA, 18 bp, synthetic construct
  source 1..18: mol_type = other DNA
aagtacgacacacaatag

SEQ ID NO: 21956 - DNA, 18 bp, synthetic construct
  source 1..18: mol_type = other DNA
aattaagactcactgtag

SEQ ID NO: 21957 - DNA, 18 bp, synthetic construct
  source 1..18: mol_type = other DNA
aattacgactcatcatag

SEQ ID NO: 21958 - DNA, 18 bp, synthetic construct
  source 1..18: mol_type = other DNA
aattacgacttactaaag

SEQ ID NO: 21959 - DNA, 18 bp, synthetic construct
  source 1..18: mol_type = other DNA
aattccaactcactatag

SEQ ID NO: 21960 - DNA, 18 bp, synthetic construct
  source 1..18: mol_type = other DNA
aattgccactcactatag

SEQ ID NO: 21961 - DNA, 18 bp, synthetic construct
  source 1..18: mol_type = other DNA
acaaacgacccactatag

SEQ ID NO: 21962 - DNA, 18 bp, synthetic construct
  source 1..18: mol_type = other DNA
acatacgactccctctag

SEQ ID NO: 21963 - DNA, 18 bp, synthetic construct
  source 1..18: mol_type = other DNA
acctacgactcacaatag

SEQ ID NO: 21964 - DNA, 18 bp, synthetic construct
  source 1..18: mol_type = other DNA
agatacaactcacgatag

SEQ ID NO: 21965 - DNA, 18 bp, synthetic construct
  source 1..18: mol_type = other DNA
agataccactctctatag

SEQ ID NO: 21966 - DNA, 18 bp, synthetic construct
  source 1..18: mol_type = other DNA
agatatgactcactctag

SEQ ID NO: 21967 - DNA, 18 bp, synthetic construct
  source 1..18: mol_type = other DNA
agttacgaatcactatag

SEQ ID NO: 21968 - DNA, 18 bp, synthetic construct
  source 1..18: mol_type = other DNA
atatacgaatcaccatag

SEQ ID NO: 21969 - DNA, 18 bp, synthetic construct
  source 1..18: mol_type = other DNA
atatacgactaattatag

SEQ ID NO: 21970 - DNA, 18 bp, synthetic construct
  source 1..18: mol_type = other DNA
atatacgactccatatag

SEQ ID NO: 21971 - DNA, 18 bp, synthetic construct
  source 1..18: mol_type = other DNA
atatacgtctcactatgg

SEQ ID NO: 21972 - DNA, 18 bp, synthetic construct
  source 1..18: mol_type = other DNA
atgtatgactcactatag

SEQ ID NO: 21973 - DNA, 18 bp, synthetic construct
  source 1..18: mol_type = other DNA
caaaacaattcactatag

SEQ ID NO: 21974 - DNA, 18 bp, synthetic construct
  source 1..18: mol_type = other DNA
caacacaactcacaatag

SEQ ID NO: 21975 - DNA, 18 bp, synthetic construct
  source 1..18: mol_type = other DNA
caacacgaaccactatag

SEQ ID NO: 21976 - DNA, 18 bp, synthetic construct
  source 1..18: mol_type = other DNA
caacacgtctcattatag

SEQ ID NO: 21977 - DNA, 18 bp, synthetic construct
  source 1..18: mol_type = other DNA
caacatgtctcactatag

SEQ ID NO: 21978 - DNA, 18 bp, synthetic construct
  source 1..18: mol_type = other DNA
caagacggatcactatag

SEQ ID NO: 21979 - DNA, 18 bp, synthetic construct
  source 1..18: mol_type = other DNA
caataagacgcactttag

SEQ ID NO: 21980 - DNA, 18 bp, synthetic construct
  source 1..18: mol_type = other DNA
caataagtctcattatag

SEQ ID NO: 21981 - DNA, 18 bp, synthetic construct
  source 1..18: mol_type = other DNA
caatacaactccctaaag

SEQ ID NO: 21982 - DNA, 18 bp, synthetic construct
  source 1..18: mol_type = other DNA
caatacgaatcactaacg

SEQ ID NO: 21983 - DNA, 18 bp, synthetic construct
  source 1..18: mol_type = other DNA
caatacgaatcattaaag

SEQ ID NO: 21984 - DNA, 18 bp, synthetic construct
  source 1..18: mol_type = other DNA
caatacgaatctttatag

SEQ ID NO: 21985 - DNA, 18 bp, synthetic construct
  source 1..18: mol_type = other DNA
caatacgacaccatatag

SEQ ID NO: 21986 - DNA, 18 bp, synthetic construct
  source 1..18: mol_type = other DNA
caatacgacaccctaaag

SEQ ID NO: 21987 - DNA, 18 bp, synthetic construct
  source 1..18: mol_type = other DNA
caatacgactaattaaag

SEQ ID NO: 21988 - DNA, 18 bp, synthetic construct
  source 1..18: mol_type = other DNA
caatacgattacctatag

SEQ ID NO: 21989 - DNA, 18 bp, synthetic construct
  source 1..18: mol_type = other DNA
caatacgattcactcaag

SEQ ID NO: 21990 - DNA, 18 bp, synthetic construct
  source 1..18: mol_type = other DNA
caatacgattctatatag

SEQ ID NO: 21991 - DNA, 18 bp, synthetic construct
  source 1..18: mol_type = other DNA
caatactgctcactatgg

SEQ ID NO: 21992 - DNA, 18 bp, synthetic construct
  source 1..18: mol_type = other DNA
caataggactctttatag

SEQ ID NO: 21993 - DNA, 18 bp, synthetic construct
  source 1..18: mol_type = other DNA
caatatgcctaactatag

SEQ ID NO: 21994 - DNA, 18 bp, synthetic construct
  source 1..18: mol_type = other DNA
caatgcgaatcactaaag

SEQ ID NO: 21995 - DNA, 18 bp, synthetic construct
  source 1..18: mol_type = other DNA
cataacgagtcactatag

SEQ ID NO: 21996 - DNA, 18 bp, synthetic construct
  source 1..18: mol_type = other DNA
cattacaactcactacag

SEQ ID NO: 21997 - DNA, 18 bp, synthetic construct
  source 1..18: mol_type = other DNA
cattactcctcactatag

SEQ ID NO: 21998 - DNA, 18 bp, synthetic construct
  source 1..18: mol_type = other DNA
cattatgactcactacag

SEQ ID NO: 21999 - DNA, 18 bp, synthetic construct
  source 1..18: mol_type = other DNA
cattgcgacttactatag

SEQ ID NO: 22000 - DNA, 18 bp, synthetic construct
  source 1..18: mol_type = other DNA
ccatacgacttaccatag

SEQ ID NO: 22001 - DNA, 18 bp, synthetic construct
  source 1..18: mol_type = other DNA
cgatacgcctcactttag

SEQ ID NO: 22002 - DNA, 18 bp, synthetic construct
  source 1..18: mol_type = other DNA
cgtaacgactcactatag

SEQ ID NO: 22003 - DNA, 18 bp, synthetic construct
  source 1..18: mol_type = other DNA
ctacacgactcacaatag

SEQ ID NO: 22004 - DNA, 18 bp, synthetic construct
  source 1..18: mol_type = other DNA
ctacgcgactcactatag

SEQ ID NO: 22005 - DNA, 18 bp, synthetic construct
  source 1..18: mol_type = other DNA
ctataagactccctatag

SEQ ID NO: 22006 - DNA, 18 bp, synthetic construct
  source 1..18: mol_type = other DNA
ctatacgaatcactaaag

SEQ ID NO: 22007 - DNA, 18 bp, synthetic construct
  source 1..18: mol_type = other DNA
ctatacgactcacattag

SEQ ID NO: 22008 - DNA, 18 bp, synthetic construct
  source 1..18: mol_type = other DNA
ctatacgcctcactacag

SEQ ID NO: 22009 - DNA, 18 bp, synthetic construct
  source 1..18: mol_type = other DNA
ctatactactcactttag

SEQ ID NO: 22010 - DNA, 18 bp, synthetic construct
  source 1..18: mol_type = other DNA
ctatgcgactaactatag

SEQ ID NO: 22011 - DNA, 18 bp, synthetic construct
  source 1..18: mol_type = other DNA
ctatgcggctcactatag

SEQ ID NO: 22012 - DNA, 18 bp, synthetic construct
  source 1..18: mol_type = other DNA
ctctccgactcactatag

SEQ ID NO: 22013 - DNA, 18 bp, synthetic construct
  source 1..18: mol_type = other DNA
gaaaacgactcaatagag

SEQ ID NO: 22014 - DNA, 18 bp, synthetic construct
  source 1..18: mol_type = other DNA
gaataagactcaccctag

SEQ ID NO: 22015 - DNA, 18 bp, synthetic construct
  source 1..18: mol_type = other DNA
gaatacaattcactatgg

SEQ ID NO: 22016 - DNA, 18 bp, synthetic construct
  source 1..18: mol_type = other DNA
gaataccacacattatag

SEQ ID NO: 22017 - DNA, 18 bp, synthetic construct
  source 1..18: mol_type = other DNA
gaatacgacactcaatag

SEQ ID NO: 22018 - DNA, 18 bp, synthetic construct
  source 1..18: mol_type = other DNA
gaatacgactttctctag

SEQ ID NO: 22019 - DNA, 18 bp, synthetic construct
  source 1..18: mol_type = other DNA
gaatacgatacattatag

SEQ ID NO: 22020 - DNA, 18 bp, synthetic construct
  source 1..18: mol_type = other DNA
gaatactactgactttag

SEQ ID NO: 22021 - DNA, 18 bp, synthetic construct
  source 1..18: mol_type = other DNA
gattacgactaaccatag

SEQ ID NO: 22022 - DNA, 18 bp, synthetic construct
  source 1..18: mol_type = other DNA
gattacgactccctttag

SEQ ID NO: 22023 - DNA, 18 bp, synthetic construct
  source 1..18: mol_type = other DNA
gattacgacttactacag

SEQ ID NO: 22024 - DNA, 18 bp, synthetic construct
  source 1..18: mol_type = other DNA
gattacgattcacgatag

SEQ ID NO: 22025 - DNA, 18 bp, synthetic construct
  source 1..18: mol_type = other DNA
gcataggattcactatag

SEQ ID NO: 22026 - DNA, 18 bp, synthetic construct
  source 1..18: mol_type = other DNA
gcttacgactctctatag

SEQ ID NO: 22027 - DNA, 18 bp, synthetic construct
  source 1..18: mol_type = other DNA
gtatacaactcactacag

SEQ ID NO: 22028 - DNA, 18 bp, synthetic construct
  source 1..18: mol_type = other DNA
taaaaagacacactaaag

SEQ ID NO: 22029 - DNA, 18 bp, synthetic construct
  source 1..18: mol_type = other DNA
taaaaaggctcactttag

SEQ ID NO: 22030 - DNA, 18 bp, synthetic construct
  source 1..18: mol_type = other DNA
taaaaatagtcactatag

SEQ ID NO: 22031 - DNA, 18 bp, synthetic construct
  source 1..18: mol_type = other DNA
taaaacaacctactatag

SEQ ID NO: 22032 - DNA, 18 bp, synthetic construct
  source 1..18: mol_type = other DNA
taaaacaactctctagag

SEQ ID NO: 22033 - DNA, 18 bp, synthetic construct
  source 1..18: mol_type = other DNA
taaaaccacccacaatag

SEQ ID NO: 22034 - DNA, 18 bp, synthetic construct
  source 1..18: mol_type = other DNA
taaaacgaatcacagtag

SEQ ID NO: 22035 - DNA, 18 bp, synthetic construct
  source 1..18: mol_type = other DNA
taaaacgaatcaccacag

SEQ ID NO: 22036 - DNA, 18 bp, synthetic construct
  source 1..18: mol_type = other DNA
taaaacgacccacagtag

SEQ ID NO: 22037 - DNA, 18 bp, synthetic construct
  source 1..18: mol_type = other DNA
taaaacgactccctaacg

SEQ ID NO: 22038 - DNA, 18 bp, synthetic construct
  source 1..18: mol_type = other DNA
taaaacgactctccctag

SEQ ID NO: 22039 - DNA, 18 bp, synthetic construct
  source 1..18: mol_type = other DNA
taaaacgactctctttgg

SEQ ID NO: 22040 - DNA, 18 bp, synthetic construct
  source 1..18: mol_type = other DNA
taaaacgagtctctaaag

SEQ ID NO: 22041 - DNA, 18 bp, synthetic construct
  source 1..18: mol_type = other DNA
taaaacgattaactttag

SEQ ID NO: 22042 - DNA, 18 bp, synthetic construct
  source 1..18: mol_type = other DNA
taaaacgattcacaagag

SEQ ID NO: 22043 - DNA, 18 bp, synthetic construct
  source 1..18: mol_type = other DNA
taaaacgcatccctatag

SEQ ID NO: 22044 - DNA, 18 bp, synthetic construct
  source 1..18: mol_type = other DNA
taaaacgcctcattttag

SEQ ID NO: 22045 - DNA, 18 bp, synthetic construct
  source 1..18: mol_type = other DNA
taaaacgcttctctatag

SEQ ID NO: 22046 - DNA, 18 bp, synthetic construct
  source 1..18: mol_type = other DNA
taaaacggatcactatgg

SEQ ID NO: 22047 - DNA, 18 bp, synthetic construct
  source 1..18: mol_type = other DNA
taaaacggctcaccaaag

SEQ ID NO: 22048 - DNA, 18 bp, synthetic construct
  source 1..18: mol_type = other DNA
taaaacgtctaactagag

SEQ ID NO: 22049 - DNA, 18 bp, synthetic construct
  source 1..18: mol_type = other DNA
taaaacgtctcactcaag

SEQ ID NO: 22050 - DNA, 18 bp, synthetic construct
  source 1..18: mol_type = other DNA
taaaacgtctctctatgg

SEQ ID NO: 22051 - DNA, 18 bp, synthetic construct
  source 1..18: mol_type = other DNA
taaaacgtgttactatag

SEQ ID NO: 22052 - DNA, 18 bp, synthetic construct
  source 1..18: mol_type = other DNA
taaaactactcactgcag

SEQ ID NO: 22053 - DNA, 18 bp, synthetic construct
  source 1..18: mol_type = other DNA
taaaactactgactttag

SEQ ID NO: 22054 - DNA, 18 bp, synthetic construct
  source 1..18: mol_type = other DNA
taaaagaactcactgtag

SEQ ID NO: 22055 - DNA, 18 bp, synthetic construct
  source 1..18: mol_type = other DNA
taaaagaactctctatag

SEQ ID NO: 22056 - DNA, 18 bp, synthetic construct
  source 1..18: mol_type = other DNA
taaaaggacccactaaag

SEQ ID NO: 22057 - DNA, 18 bp, synthetic construct
  source 1..18: mol_type = other DNA
taaaaggacccactttag

SEQ ID NO: 22058 - DNA, 18 bp, synthetic construct
  source 1..18: mol_type = other DNA
taaaaggactccatatag

SEQ ID NO: 22059 - DNA, 18 bp, synthetic construct
  source 1..18: mol_type = other DNA
taaaatgaatcactttag

SEQ ID NO: 22060 - DNA, 18 bp, synthetic construct
  source 1..18: mol_type = other DNA
taaaatgactcagtttag

SEQ ID NO: 22061 - DNA, 18 bp, synthetic construct
  source 1..18: mol_type = other DNA
taaaatgagtcactatgg

SEQ ID NO: 22062 - DNA, 18 bp, synthetic construct
  source 1..18: mol_type = other DNA
taaaccgagtctctatag

SEQ ID NO: 22063 - DNA, 18 bp, synthetic construct
  source 1..18: mol_type = other DNA
taaaccggctcagtatag

SEQ ID NO: 22064 - DNA, 18 bp, synthetic construct
  source 1..18: mol_type = other DNA
taaactgaatcactatag

SEQ ID NO: 22065 - DNA, 18 bp, synthetic construct
  source 1..18: mol_type = other DNA
taaagctactcattatag

SEQ ID NO: 22066 - DNA, 18 bp, synthetic construct
  source 1..18: mol_type = other DNA
taaagggactctctatag

SEQ ID NO: 22067 - DNA, 18 bp, synthetic construct
  source 1..18: mol_type = other DNA
taacaaacctcactatag

SEQ ID NO: 22068 - DNA, 18 bp, synthetic construct
  source 1..18: mol_type = other DNA
taacaagactaaccatag

SEQ ID NO: 22069 - DNA, 18 bp, synthetic construct
  source 1..18: mol_type = other DNA
taacaatactctctatag

SEQ ID NO: 22070 - DNA, 18 bp, synthetic construct
  source 1..18: mol_type = other DNA
taacacaactcagaatag

SEQ ID NO: 22071 - DNA, 18 bp, synthetic construct
  source 1..18: mol_type = other DNA
taacaccactcaccgtag

SEQ ID NO: 22072 - DNA, 18 bp, synthetic construct
  source 1..18: mol_type = other DNA
taacacgaatccctaaag

SEQ ID NO: 22073 - DNA, 18 bp, synthetic construct
  source 1..18: mol_type = other DNA
taacacgactcacccaag

SEQ ID NO: 22074 - DNA, 18 bp, synthetic construct
  source 1..18: mol_type = other DNA
taacacgcatcactttag

SEQ ID NO: 22075 - DNA, 18 bp, synthetic construct
  source 1..18: mol_type = other DNA
taacacgtcacactagag

SEQ ID NO: 22076 - DNA, 18 bp, synthetic construct
  source 1..18: mol_type = other DNA
taacacgtctctctctag

SEQ ID NO: 22077 - DNA, 18 bp, synthetic construct
  source 1..18: mol_type = other DNA
taacactactctctgtag

SEQ ID NO: 22078 - DNA, 18 bp, synthetic construct
  source 1..18: mol_type = other DNA
taacactagtcactttag

SEQ ID NO: 22079 - DNA, 18 bp, synthetic construct
  source 1..18: mol_type = other DNA
taacagaacgcactatag

SEQ ID NO: 22080 - DNA, 18 bp, synthetic construct
  source 1..18: mol_type = other DNA
taacaggaatcagtatag

SEQ ID NO: 22081 - DNA, 18 bp, synthetic construct
  source 1..18: mol_type = other DNA
taacatgacacaatatag

SEQ ID NO: 22082 - DNA, 18 bp, synthetic construct
  source 1..18: mol_type = other DNA
taacattactcactaaag

SEQ ID NO: 22083 - DNA, 18 bp, synthetic construct
  source 1..18: mol_type = other DNA
taacccgactcacaaaag

SEQ ID NO: 22084 - DNA, 18 bp, synthetic construct
  source 1..18: mol_type = other DNA
taacgcaactcagtatag

SEQ ID NO: 22085 - DNA, 18 bp, synthetic construct
  source 1..18: mol_type = other DNA
taagaaggctcactagag

SEQ ID NO: 22086 - DNA, 18 bp, synthetic construct
  source 1..18: mol_type = other DNA
taagacgtctcaagatag

SEQ ID NO: 22087 - DNA, 18 bp, synthetic construct
  source 1..18: mol_type = other DNA
taagacgtctctgtatag

SEQ ID NO: 22088 - DNA, 18 bp, synthetic construct
  source 1..18: mol_type = other DNA
taataaaacttactacag

SEQ ID NO: 22089 - DNA, 18 bp, synthetic construct
  source 1..18: mol_type = other DNA
taataaagctcattatag

SEQ ID NO: 22090 - DNA, 18 bp, synthetic construct
  source 1..18: mol_type = other DNA
taataacaatcacaatag

SEQ ID NO: 22091 - DNA, 18 bp, synthetic construct
  source 1..18: mol_type = other DNA
taataacacacagtatag

SEQ ID NO: 22092 - DNA, 18 bp, synthetic construct
  source 1..18: mol_type = other DNA
taataacacaccctatag

SEQ ID NO: 22093 - DNA, 18 bp, synthetic construct
  source 1..18: mol_type = other DNA
taataacactcaacatag

SEQ ID NO: 22094 - DNA, 18 bp, synthetic construct
  source 1..18: mol_type = other DNA
taataacactctcaatag

SEQ ID NO: 22095 - DNA, 18 bp, synthetic construct
  source 1..18: mol_type = other DNA
taataacactctccatag

SEQ ID NO: 22096 - DNA, 18 bp, synthetic construct
  source 1..18: mol_type = other DNA
taataagaatcacttaag

SEQ ID NO: 22097 - DNA, 18 bp, synthetic construct
  source 1..18: mol_type = other DNA
taataagacacattctag

SEQ ID NO: 22098 - DNA, 18 bp, synthetic construct
  source 1..18: mol_type = other DNA
taataagaccctatatag

SEQ ID NO: 22099 - DNA, 18 bp, synthetic construct
  source 1..18: mol_type = other DNA
taataagacgctctatgg

SEQ ID NO: 22100 - DNA, 18 bp, synthetic construct
  source 1..18: mol_type = other DNA
taataagcatcactatcg

SEQ ID NO: 22101 - DNA, 18 bp, synthetic construct
  source 1..18: mol_type = other DNA
taataagcctctttatag

SEQ ID NO: 22102 - DNA, 18 bp, synthetic construct
  source 1..18: mol_type = other DNA
taataaggctcataatag

SEQ ID NO: 22103 - DNA, 18 bp, synthetic construct
  source 1..18: mol_type = other DNA
taataagtcacacgatag

SEQ ID NO: 22104 - DNA, 18 bp, synthetic construct
  source 1..18: mol_type = other DNA
taataagtctcaatgtag

SEQ ID NO: 22105 - DNA, 18 bp, synthetic construct
  source 1..18: mol_type = other DNA
taataataatcactaaag

SEQ ID NO: 22106 - DNA, 18 bp, synthetic construct
  source 1..18: mol_type = other DNA
taataataattactatag

SEQ ID NO: 22107 - DNA, 18 bp, synthetic construct
  source 1..18: mol_type = other DNA
taatacaaatgattatag

SEQ ID NO: 22108 - DNA, 18 bp, synthetic construct
  source 1..18: mol_type = other DNA
taatacaactacttatag

SEQ ID NO: 22109 - DNA, 18 bp, synthetic construct
  source 1..18: mol_type = other DNA
taatacaactcatattag

SEQ ID NO: 22110 - DNA, 18 bp, synthetic construct
  source 1..18: mol_type = other DNA
taatacaactgactgcag

SEQ ID NO: 22111 - DNA, 18 bp, synthetic construct
  source 1..18: mol_type = other DNA
taatacatcccattatag

SEQ ID NO: 22112 - DNA, 18 bp, synthetic construct
  source 1..18: mol_type = other DNA
taataccaagtactatag

SEQ ID NO: 22113 - DNA, 18 bp, synthetic construct
  source 1..18: mol_type = other DNA
taataccaatcactgtcg

SEQ ID NO: 22114 - DNA, 18 bp, synthetic construct
  source 1..18: mol_type = other DNA
taataccacacaatacag

SEQ ID NO: 22115 - DNA, 18 bp, synthetic construct
  source 1..18: mol_type = other DNA
taataccacatactctag

SEQ ID NO: 22116 - DNA, 18 bp, synthetic construct
  source 1..18: mol_type = other DNA
taataccactcaccttgg

SEQ ID NO: 22117 - DNA, 18 bp, synthetic construct
  source 1..18: mol_type = other DNA
taataccacttactaccg

SEQ ID NO: 22118 - DNA, 18 bp, synthetic construct
  source 1..18: mol_type = other DNA
taataccactttctatcg

SEQ ID NO: 22119 - DNA, 18 bp, synthetic construct
  source 1..18: mol_type = other DNA
taataccagccacaatag

SEQ ID NO: 22120 - DNA, 18 bp, synthetic construct
  source 1..18: mol_type = other DNA
taatacctcgcactaaag

SEQ ID NO: 22121 - DNA, 18 bp, synthetic construct
  source 1..18: mol_type = other DNA
taatacgaaactctgtag

SEQ ID NO: 22122 - DNA, 18 bp, synthetic construct
  source 1..18: mol_type = other DNA
taatacgaatcataatgg

SEQ ID NO: 22123 - DNA, 18 bp, synthetic construct
  source 1..18: mol_type = other DNA
taatacgaatctgcatag

SEQ ID NO: 22124 - DNA, 18 bp, synthetic construct
  source 1..18: mol_type = other DNA
taatacgacaaaatctag

SEQ ID NO: 22125 - DNA, 18 bp, synthetic construct
  source 1..18: mol_type = other DNA
taatacgacaaacagtag

SEQ ID NO: 22126 - DNA, 18 bp, synthetic construct
  source 1..18: mol_type = other DNA
taatacgacaccatatgg

SEQ ID NO: 22127 - DNA, 18 bp, synthetic construct
  source 1..18: mol_type = other DNA
taatacgacactgtgtag

SEQ ID NO: 22128 - DNA, 18 bp, synthetic construct
  source 1..18: mol_type = other DNA
taatacgaccctacatag

SEQ ID NO: 22129 - DNA, 18 bp, synthetic construct
  source 1..18: mol_type = other DNA
taatacgacctcctatcg

SEQ ID NO: 22130 - DNA, 18 bp, synthetic construct
  source 1..18: mol_type = other DNA
taatacgactatatatcg

SEQ ID NO: 22131 - DNA, 18 bp, synthetic construct
  source 1..18: mol_type = other DNA
taatacgactatcgttag

SEQ ID NO: 22132 - DNA, 18 bp, synthetic construct
  source 1..18: mol_type = other DNA
taatacgactatttacag

SEQ ID NO: 22133 - DNA, 18 bp, synthetic construct
  source 1..18: mol_type = other DNA
taatacgactcattgagg

SEQ ID NO: 22134 - DNA, 18 bp, synthetic construct
  source 1..18: mol_type = other DNA
taatacgactccaaacag

SEQ ID NO: 22135 - DNA, 18 bp, synthetic construct
  source 1..18: mol_type = other DNA
taatacgactcctgttag

SEQ ID NO: 22136 - DNA, 18 bp, synthetic construct
  source 1..18: mol_type = other DNA
taatacgactctataagg

SEQ ID NO: 22137 - DNA, 18 bp, synthetic construct
  source 1..18: mol_type = other DNA
taatacgactctatttgg

SEQ ID NO: 22138 - DNA, 18 bp, synthetic construct
  source 1..18: mol_type = other DNA
taatacgactctcaccag

SEQ ID NO: 22139 - DNA, 18 bp, synthetic construct
  source 1..18: mol_type = other DNA
taatacgactgtgtgtag

SEQ ID NO: 22140 - DNA, 18 bp, synthetic construct
  source 1..18: mol_type = other DNA
taatacgactttcaatcg

SEQ ID NO: 22141 - DNA, 18 bp, synthetic construct
  source 1..18: mol_type = other DNA
taatacgagtcaaaatgg

SEQ ID NO: 22142 - DNA, 18 bp, synthetic construct
  source 1..18: mol_type = other DNA
taatacgatcctctacag

SEQ ID NO: 22143 - DNA, 18 bp, synthetic construct
  source 1..18: mol_type = other DNA
taatacgattaattatcg

SEQ ID NO: 22144 - DNA, 18 bp, synthetic construct
  source 1..18: mol_type = other DNA
taatacgattcactcaaa

SEQ ID NO: 22145 - DNA, 18 bp, synthetic construct
  source 1..18: mol_type = other DNA
taatacgattgagtagag

SEQ ID NO: 22146 - DNA, 18 bp, synthetic construct
  source 1..18: mol_type = other DNA
taatacgatttaatatcg

SEQ ID NO: 22147 - DNA, 18 bp, synthetic construct
  source 1..18: mol_type = other DNA
taatacgcatctctctag

SEQ ID NO: 22148 - DNA, 18 bp, synthetic construct
  source 1..18: mol_type = other DNA
taatacgccacacaatgg

SEQ ID NO: 22149 - DNA, 18 bp, synthetic construct
  source 1..18: mol_type = other DNA
taatacgccacaccgtag

SEQ ID NO: 22150 - DNA, 18 bp, synthetic construct
  source 1..18: mol_type = other DNA
taatacgccacactggag

SEQ ID NO: 22151 - DNA, 18 bp, synthetic construct
  source 1..18: mol_type = other DNA
taatacgccacacttcag

SEQ ID NO: 22152 - DNA, 18 bp, synthetic construct
  source 1..18: mol_type = other DNA
taatacgcgtatctatag

SEQ ID NO: 22153 - DNA, 18 bp, synthetic construct
  source 1..18: mol_type = other DNA
taatacgcttcacgacag

SEQ ID NO: 22154 - DNA, 18 bp, synthetic construct
  source 1..18: mol_type = other DNA
taatacggaacattatag

SEQ ID NO: 22155 - DNA, 18 bp, synthetic construct
  source 1..18: mol_type = other DNA
taatacggcaatctatag

SEQ ID NO: 22156 - DNA, 18 bp, synthetic construct
  source 1..18: mol_type = other DNA
taatacggcacattaaag

SEQ ID NO: 22157 - DNA, 18 bp, synthetic construct
  source 1..18: mol_type = other DNA
taatacgggccactatgg

SEQ ID NO: 22158 - DNA, 18 bp, synthetic construct
  source 1..18: mol_type = other DNA
taatacggttaactttag

SEQ ID NO: 22159 - DNA, 18 bp, synthetic construct
  source 1..18: mol_type = other DNA
taatacgtcatacgatag

SEQ ID NO: 22160 - DNA, 18 bp, synthetic construct
  source 1..18: mol_type = other DNA
taatacgtccaactgtag

SEQ ID NO: 22161 - DNA, 18 bp, synthetic construct
  source 1..18: mol_type = other DNA
taatacgtccccatatag

SEQ ID NO: 22162 - DNA, 18 bp, synthetic construct
  source 1..18: mol_type = other DNA
taatacgtcgcattttag

SEQ ID NO: 22163 - DNA, 18 bp, synthetic construct
  source 1..18: mol_type = other DNA
taatacgtctccacatag

SEQ ID NO: 22164 - DNA, 18 bp, synthetic construct
  source 1..18: mol_type = other DNA
taatacgtctgacaatcg

SEQ ID NO: 22165 - DNA, 18 bp, synthetic construct
  source 1..18: mol_type = other DNA
taatacgtgtaactatcg

SEQ ID NO: 22166 - DNA, 18 bp, synthetic construct
  source 1..18: mol_type = other DNA
taatacgtgtccctatcg

SEQ ID NO: 22167 - DNA, 18 bp, synthetic construct
  source 1..18: mol_type = other DNA
taatacgttccactaaag

SEQ ID NO: 22168 - DNA, 18 bp, synthetic construct
  source 1..18: mol_type = other DNA
taatactacaccctacag

SEQ ID NO: 22169 - DNA, 18 bp, synthetic construct
  source 1..18: mol_type = other DNA
taatactactaacttgag

SEQ ID NO: 22170 - DNA, 18 bp, synthetic construct
  source 1..18: mol_type = other DNA
taatactactcatttgag

SEQ ID NO: 22171 - DNA, 18 bp, synthetic construct
  source 1..18: mol_type = other DNA
taatactactctctaccg

SEQ ID NO: 22172 - DNA, 18 bp, synthetic construct
  source 1..18: mol_type = other DNA
taatactactgcatatag

SEQ ID NO: 22173 - DNA, 18 bp, synthetic construct
  source 1..18: mol_type = other DNA
taatactatacactatcg

SEQ ID NO: 22174 - DNA, 18 bp, synthetic construct
  source 1..18: mol_type = other DNA
taatactgctcataatag

SEQ ID NO: 22175 - DNA, 18 bp, synthetic construct
  source 1..18: mol_type = other DNA
taatactgttcactaaag

SEQ ID NO: 22176 - DNA, 18 bp, synthetic construct
  source 1..18: mol_type = other DNA
taatacttctccctacag

SEQ ID NO: 22177 - DNA, 18 bp, synthetic construct
  source 1..18: mol_type = other DNA
taatagaactcaatttag

SEQ ID NO: 22178 - DNA, 18 bp, synthetic construct
  source 1..18: mol_type = other DNA
taatagaactcaccaaag

SEQ ID NO: 22179 - DNA, 18 bp, synthetic construct
  source 1..18: mol_type = other DNA
taatagaactctatatag

SEQ ID NO: 22180 - DNA, 18 bp, synthetic construct
  source 1..18: mol_type = other DNA
taatagaactctttatag

SEQ ID NO: 22181 - DNA, 18 bp, synthetic construct
  source 1..18: mol_type = other DNA
taataggaataactgtag

SEQ ID NO: 22182 - DNA, 18 bp, synthetic construct
  source 1..18: mol_type = other DNA
taataggacacacactag

SEQ ID NO: 22183 - DNA, 18 bp, synthetic construct
  source 1..18: mol_type = other DNA
taataggacatacgatag

SEQ ID NO: 22184 - DNA, 18 bp, synthetic construct
  source 1..18: mol_type = other DNA
taataggactcaaaaaag

SEQ ID NO: 22185 - DNA, 18 bp, synthetic construct
  source 1..18: mol_type = other DNA
taataggactcacttacg

SEQ ID NO: 22186 - DNA, 18 bp, synthetic construct
  source 1..18: mol_type = other DNA
taataggattcactaagg

SEQ ID NO: 22187 - DNA, 18 bp, synthetic construct
  source 1..18: mol_type = other DNA
taatagggcaaactatag

SEQ ID NO: 22188 - DNA, 18 bp, synthetic construct
  source 1..18: mol_type = other DNA
taatagggctcattaaag

SEQ ID NO: 22189 - DNA, 18 bp, synthetic construct
  source 1..18: mol_type = other DNA
taatagggcttactatcg

SEQ ID NO: 22190 - DNA, 18 bp, synthetic construct
  source 1..18: mol_type = other DNA
taataggtcactctatag

SEQ ID NO: 22191 - DNA, 18 bp, synthetic construct
  source 1..18: mol_type = other DNA
taataggtcccagtatag

SEQ ID NO: 22192 - DNA, 18 bp, synthetic construct
  source 1..18: mol_type = other DNA
taataggtctctcgatag

SEQ ID NO: 22193 - DNA, 18 bp, synthetic construct
  source 1..18: mol_type = other DNA
taatagtattcactatgg

SEQ ID NO: 22194 - DNA, 18 bp, synthetic construct
  source 1..18: mol_type = other DNA
taatatatcttactatag

SEQ ID NO: 22195 - DNA, 18 bp, synthetic construct
  source 1..18: mol_type = other DNA
taatatcacgcacaatag

SEQ ID NO: 22196 - DNA, 18 bp, synthetic construct
  source 1..18: mol_type = other DNA
taatatcactcattatcg

SEQ ID NO: 22197 - DNA, 18 bp, synthetic construct
  source 1..18: mol_type = other DNA
taatatcactgactttag

SEQ ID NO: 22198 - DNA, 18 bp, synthetic construct
  source 1..18: mol_type = other DNA
taatatgaatgattatag

SEQ ID NO: 22199 - DNA, 18 bp, synthetic construct
  source 1..18: mol_type = other DNA
taatatgacgctctatgg

SEQ ID NO: 22200 - DNA, 18 bp, synthetic construct
  source 1..18: mol_type = other DNA
taatatgactcacgtaag

SEQ ID NO: 22201 - DNA, 18 bp, synthetic construct
  source 1..18: mol_type = other DNA
taatatgactcatgatgg

SEQ ID NO: 22202 - DNA, 18 bp, synthetic construct
  source 1..18: mol_type = other DNA
taatatgactctctaagg

SEQ ID NO: 22203 - DNA, 18 bp, synthetic construct
  source 1..18: mol_type = other DNA
taatatgagttactatgg

SEQ ID NO: 22204 - DNA, 18 bp, synthetic construct
  source 1..18: mol_type = other DNA
taatatgataaactatag

SEQ ID NO: 22205 - DNA, 18 bp, synthetic construct
  source 1..18: mol_type = other DNA
taatatgattaactaaag

SEQ ID NO: 22206 - DNA, 18 bp, synthetic construct
  source 1..18: mol_type = other DNA
taatatgccacactttag

SEQ ID NO: 22207 - DNA, 18 bp, synthetic construct
  source 1..18: mol_type = other DNA
taatatgccccattatag

SEQ ID NO: 22208 - DNA, 18 bp, synthetic construct
  source 1..18: mol_type = other DNA
taatatggctctctaaag

SEQ ID NO: 22209 - DNA, 18 bp, synthetic construct
  source 1..18: mol_type = other DNA
taatattgatcactatag

SEQ ID NO: 22210 - DNA, 18 bp, synthetic construct
  source 1..18: mol_type = other DNA
taatcagcctctctatag

SEQ ID NO: 22211 - DNA, 18 bp, synthetic construct
  source 1..18: mol_type = other DNA
taatcagtatcactatag

SEQ ID NO: 22212 - DNA, 18 bp, synthetic construct
  source 1..18: mol_type = other DNA
taatcagtctaactatag

SEQ ID NO: 22213 - DNA, 18 bp, synthetic construct
  source 1..18: mol_type = other DNA
taatcatactgactatag

SEQ ID NO: 22214 - DNA, 18 bp, synthetic construct
  source 1..18: mol_type = other DNA
taatccgacccactcaag

SEQ ID NO: 22215 - DNA, 18 bp, synthetic construct
  source 1..18: mol_type = other DNA
taatccgagcaactatag

SEQ ID NO: 22216 - DNA, 18 bp, synthetic construct
  source 1..18: mol_type = other DNA
taatccgattatctatag

SEQ ID NO: 22217 - DNA, 18 bp, synthetic construct
  source 1..18: mol_type = other DNA
taatccgatttattatag

SEQ ID NO: 22218 - DNA, 18 bp, synthetic construct
  source 1..18: mol_type = other DNA
taatccgcatcactacag

SEQ ID NO: 22219 - DNA, 18 bp, synthetic construct
  source 1..18: mol_type = other DNA
taatccgccaaactatag

SEQ ID NO: 22220 - DNA, 18 bp, synthetic construct
  source 1..18: mol_type = other DNA
taatccggttcactttag

SEQ ID NO: 22221 - DNA, 18 bp, synthetic construct
  source 1..18: mol_type = other DNA
taatccgtcccactatcg

SEQ ID NO: 22222 - DNA, 18 bp, synthetic construct
  source 1..18: mol_type = other DNA
taatccgtcttactacag

SEQ ID NO: 22223 - DNA, 18 bp, synthetic construct
  source 1..18: mol_type = other DNA
taatccgttccactatag

SEQ ID NO: 22224 - DNA, 18 bp, synthetic construct
  source 1..18: mol_type = other DNA
taatcctactcacaaaag

SEQ ID NO: 22225 - DNA, 18 bp, synthetic construct
  source 1..18: mol_type = other DNA
taatcctacttactaaag

SEQ ID NO: 22226 - DNA, 18 bp, synthetic construct
  source 1..18: mol_type = other DNA
taatgagactcacttcag

SEQ ID NO: 22227 - DNA, 18 bp, synthetic construct
  source 1..18: mol_type = other DNA
taatgagacttactaaag

SEQ ID NO: 22228 - DNA, 18 bp, synthetic construct
  source 1..18: mol_type = other DNA
taatgcaactcacattag

SEQ ID NO: 22229 - DNA, 18 bp, synthetic construct
  source 1..18: mol_type = other DNA
taatgcgaatcacactag

SEQ ID NO: 22230 - DNA, 18 bp, synthetic construct
  source 1..18: mol_type = other DNA
taatgcgacacacaacag

SEQ ID NO: 22231 - DNA, 18 bp, synthetic construct
  source 1..18: mol_type = other DNA
taatgcgacgtcctatag

SEQ ID NO: 22232 - DNA, 18 bp, synthetic construct
  source 1..18: mol_type = other DNA
taatgcgactcaaaatcg

SEQ ID NO: 22233 - DNA, 18 bp, synthetic construct
  source 1..18: mol_type = other DNA
taatgcgactcagattag

SEQ ID NO: 22234 - DNA, 18 bp, synthetic construct
  source 1..18: mol_type = other DNA
taatgcgactcattaagg

SEQ ID NO: 22235 - DNA, 18 bp, synthetic construct
  source 1..18: mol_type = other DNA
taatgcgactcccaacag

SEQ ID NO: 22236 - DNA, 18 bp, synthetic construct
  source 1..18: mol_type = other DNA
taatgcgactcccttcag

SEQ ID NO: 22237 - DNA, 18 bp, synthetic construct
  source 1..18: mol_type = other DNA
taatgcgactctcagtag

SEQ ID NO: 22238 - DNA, 18 bp, synthetic construct
  source 1..18: mol_type = other DNA
taatgcgagtcaagatag

SEQ ID NO: 22239 - DNA, 18 bp, synthetic construct
  source 1..18: mol_type = other DNA
taatgcgcctctctaaag

SEQ ID NO: 22240 - DNA, 18 bp, synthetic construct
  source 1..18: mol_type = other DNA
taatgcggctcactctgg

SEQ ID NO: 22241 - DNA, 18 bp, synthetic construct
  source 1..18: mol_type = other DNA
taatgcgtatcacaatag

SEQ ID NO: 22242 - DNA, 18 bp, synthetic construct
  source 1..18: mol_type = other DNA
taatgcgtcttactctag

SEQ ID NO: 22243 - DNA, 18 bp, synthetic construct
  source 1..18: mol_type = other DNA
taatgctagacactatag

SEQ ID NO: 22244 - DNA, 18 bp, synthetic construct
  source 1..18: mol_type = other DNA
taatgctcatcactatag

SEQ ID NO: 22245 - DNA, 18 bp, synthetic construct
  source 1..18: mol_type = other DNA
taatgggactcaatttag

SEQ ID NO: 22246 - DNA, 18 bp, synthetic construct
  source 1..18: mol_type = other DNA
taatgggactccctttag

SEQ ID NO: 22247 - DNA, 18 bp, synthetic construct
  source 1..18: mol_type = other DNA
taatgggacttactttag

SEQ ID NO: 22248 - DNA, 18 bp, synthetic construct
  source 1..18: mol_type = other DNA
taatgggactttctatag

SEQ ID NO: 22249 - DNA, 18 bp, synthetic construct
  source 1..18: mol_type = other DNA
taatgtggctcacaatag

SEQ ID NO: 22250 - DNA, 18 bp, synthetic construct
  source 1..18: mol_type = other DNA
tacaacttctcactatag

SEQ ID NO: 22251 - DNA, 18 bp, synthetic construct
  source 1..18: mol_type = other DNA
tacgacgactgactatgg

SEQ ID NO: 22252 - DNA, 18 bp, synthetic construct
  source 1..18: mol_type = other DNA
tactaagattcactttag

SEQ ID NO: 22253 - DNA, 18 bp, synthetic construct
  source 1..18: mol_type = other DNA
tactacaattctctatag

SEQ ID NO: 22254 - DNA, 18 bp, synthetic construct
  source 1..18: mol_type = other DNA
tactaccacacattatag

SEQ ID NO: 22255 - DNA, 18 bp, synthetic construct
  source 1..18: mol_type = other DNA
tactaccactctatatag

SEQ ID NO: 22256 - DNA, 18 bp, synthetic construct
  source 1..18: mol_type = other DNA
tactacgaattactttag

SEQ ID NO: 22257 - DNA, 18 bp, synthetic construct
  source 1..18: mol_type = other DNA
tactacgacatactatcg

SEQ ID NO: 22258 - DNA, 18 bp, synthetic construct
  source 1..18: mol_type = other DNA
tactacgacatattatag

SEQ ID NO: 22259 - DNA, 18 bp, synthetic construct
  source 1..18: mol_type = other DNA
tactacgactctctgaag

SEQ ID NO: 22260 - DNA, 18 bp, synthetic construct
  source 1..18: mol_type = other DNA
tactacggcttaatatag

SEQ ID NO: 22261 - DNA, 18 bp, synthetic construct
  source 1..18: mol_type = other DNA
tactacgtctgactgtag

SEQ ID NO: 22262 - DNA, 18 bp, synthetic construct
  source 1..18: mol_type = other DNA
tactactactgacaatag

SEQ ID NO: 22263 - DNA, 18 bp, synthetic construct
  source 1..18: mol_type = other DNA
tactacttctcactaaag

SEQ ID NO: 22264 - DNA, 18 bp, synthetic construct
  source 1..18: mol_type = other DNA
tactacttctcactatgg

SEQ ID NO: 22265 - DNA, 18 bp, synthetic construct
  source 1..18: mol_type = other DNA
tactatcactctctatag

SEQ ID NO: 22266 - DNA, 18 bp, synthetic construct
  source 1..18: mol_type = other DNA
tactatgactcaatttag

SEQ ID NO: 22267 - DNA, 18 bp, synthetic construct
  source 1..18: mol_type = other DNA
tactatgactcattagag

SEQ ID NO: 22268 - DNA, 18 bp, synthetic construct
  source 1..18: mol_type = other DNA
tactgcgagtcacaatag

SEQ ID NO: 22269 - DNA, 18 bp, synthetic construct
  source 1..18: mol_type = other DNA
tagaacgacgtactatag

SEQ ID NO: 22270 - DNA, 18 bp, synthetic construct
  source 1..18: mol_type = other DNA
tagaacgactcagtgtag

SEQ ID NO: 22271 - DNA, 18 bp, synthetic construct
  source 1..18: mol_type = other DNA
tagaatgaatcactatag

SEQ ID NO: 22272 - DNA, 18 bp, synthetic construct
  source 1..18: mol_type = other DNA
tagaccgactcactacag

SEQ ID NO: 22273 - DNA, 18 bp, synthetic construct
  source 1..18: mol_type = other DNA
tagaccgtctcactatag

SEQ ID NO: 22274 - DNA, 18 bp, synthetic construct
  source 1..18: mol_type = other DNA
tagactgactcactatag

SEQ ID NO: 22275 - DNA, 18 bp, synthetic construct
  source 1..18: mol_type = other DNA
tagcaagactcaccatag

SEQ ID NO: 22276 - DNA, 18 bp, synthetic construct
  source 1..18: mol_type = other DNA
tagcactactcactttag

SEQ ID NO: 22277 - DNA, 18 bp, synthetic construct
  source 1..18: mol_type = other DNA
tagtaaaactcactttag

SEQ ID NO: 22278 - DNA, 18 bp, synthetic construct
  source 1..18: mol_type = other DNA
tagtaaaagtcactatag

SEQ ID NO: 22279 - DNA, 18 bp, synthetic construct
  source 1..18: mol_type = other DNA
tagtacaatttactatag

SEQ ID NO: 22280 - DNA, 18 bp, synthetic construct
  source 1..18: mol_type = other DNA
tagtaccaatctctatag

SEQ ID NO: 22281 - DNA, 18 bp, synthetic construct
  source 1..18: mol_type = other DNA
tagtaccatacactatag

SEQ ID NO: 22282 - DNA, 18 bp, synthetic construct
  source 1..18: mol_type = other DNA
tagtacgaatcactttcg

SEQ ID NO: 22283 - DNA, 18 bp, synthetic construct
  source 1..18: mol_type = other DNA
tagtacgactcatttaag

SEQ ID NO: 22284 - DNA, 18 bp, synthetic construct
  source 1..18: mol_type = other DNA
tagtacgactctttatgg

SEQ ID NO: 22285 - DNA, 18 bp, synthetic construct
  source 1..18: mol_type = other DNA
tagtacgattcattttag

SEQ ID NO: 22286 - DNA, 18 bp, synthetic construct
  source 1..18: mol_type = other DNA
tagtactactcaagatag

SEQ ID NO: 22287 - DNA, 18 bp, synthetic construct
  source 1..18: mol_type = other DNA
tagtactactcacttcag

SEQ ID NO: 22288 - DNA, 18 bp, synthetic construct
  source 1..18: mol_type = other DNA
tagtacttctcactataa

SEQ ID NO: 22289 - DNA, 18 bp, synthetic construct
  source 1..18: mol_type = other DNA
tagtatgaatcaatatag

SEQ ID NO: 22290 - DNA, 18 bp, synthetic construct
  source 1..18: mol_type = other DNA
tagtatgattcactatcg

SEQ ID NO: 22291 - DNA, 18 bp, synthetic construct
  source 1..18: mol_type = other DNA
tagtccgacaaactatag

SEQ ID NO: 22292 - DNA, 18 bp, synthetic construct
  source 1..18: mol_type = other DNA
tagtccgattcactgtag

SEQ ID NO: 22293 - DNA, 18 bp, synthetic construct
  source 1..18: mol_type = other DNA
tagtgcgaatcactaaag

SEQ ID NO: 22294 - DNA, 18 bp, synthetic construct
  source 1..18: mol_type = other DNA
tataacgaatcactgtag

SEQ ID NO: 22295 - DNA, 18 bp, synthetic construct
  source 1..18: mol_type = other DNA
tataacgactaactctag

SEQ ID NO: 22296 - DNA, 18 bp, synthetic construct
  source 1..18: mol_type = other DNA
tataacgactcaatatcg

SEQ ID NO: 22297 - DNA, 18 bp, synthetic construct
  source 1..18: mol_type = other DNA
tataacgactcccaatag

SEQ ID NO: 22298 - DNA, 18 bp, synthetic construct
  source 1..18: mol_type = other DNA
tataacgactccctatcg

SEQ ID NO: 22299 - DNA, 18 bp, synthetic construct
  source 1..18: mol_type = other DNA
tataacgacttactagag

SEQ ID NO: 22300 - DNA, 18 bp, synthetic construct
  source 1..18: mol_type = other DNA
tataacgagccactatag

SEQ ID NO: 22301 - DNA, 18 bp, synthetic construct
  source 1..18: mol_type = other DNA
tatcacgaattactatag

SEQ ID NO: 22302 - DNA, 18 bp, synthetic construct
  source 1..18: mol_type = other DNA
tatcacgcctctctatag

SEQ ID NO: 22303 - DNA, 18 bp, synthetic construct
  source 1..18: mol_type = other DNA
tatgacgacacactaaag

SEQ ID NO: 22304 - DNA, 18 bp, synthetic construct
  source 1..18: mol_type = other DNA
tattaagcctaactatag

SEQ ID NO: 22305 - DNA, 18 bp, synthetic construct
  source 1..18: mol_type = other DNA
tattaaggctcaatatag

SEQ ID NO: 22306 - DNA, 18 bp, synthetic construct
  source 1..18: mol_type = other DNA
tattaatagtcactatag

SEQ ID NO: 22307 - DNA, 18 bp, synthetic construct
  source 1..18: mol_type = other DNA
tattaatcctcactatag

SEQ ID NO: 22308 - DNA, 18 bp, synthetic construct
  source 1..18: mol_type = other DNA
tattacaacccactaaag

SEQ ID NO: 22309 - DNA, 18 bp, synthetic construct
  source 1..18: mol_type = other DNA
tattacaactcactcgag

SEQ ID NO: 22310 - DNA, 18 bp, synthetic construct
  source 1..18: mol_type = other DNA
tattacaactctctagag

SEQ ID NO: 22311 - DNA, 18 bp, synthetic construct
  source 1..18: mol_type = other DNA
tattacaactctctatcg

SEQ ID NO: 22312 - DNA, 18 bp, synthetic construct
  source 1..18: mol_type = other DNA
tattacaacttattatag

SEQ ID NO: 22313 - DNA, 18 bp, synthetic construct
  source 1..18: mol_type = other DNA
tattacaagtcagtatag

SEQ ID NO: 22314 - DNA, 18 bp, synthetic construct
  source 1..18: mol_type = other DNA
tattacacgtcactatag

SEQ ID NO: 22315 - DNA, 18 bp, synthetic construct
  source 1..18: mol_type = other DNA
tattacagctcattatag

SEQ ID NO: 22316 - DNA, 18 bp, synthetic construct
  source 1..18: mol_type = other DNA
tattaccacacagtatag

SEQ ID NO: 22317 - DNA, 18 bp, synthetic construct
  source 1..18: mol_type = other DNA
tattaccacttacaatag

SEQ ID NO: 22318 - DNA, 18 bp, synthetic construct
  source 1..18: mol_type = other DNA
tattacctcacactatag

SEQ ID NO: 22319 - DNA, 18 bp, synthetic construct
  source 1..18: mol_type = other DNA
tattacgacccactacgg

SEQ ID NO: 22320 - DNA, 18 bp, synthetic construct
  source 1..18: mol_type = other DNA
tattacgactcacagtgg

SEQ ID NO: 22321 - DNA, 18 bp, synthetic construct
  source 1..18: mol_type = other DNA
tattacgactcacattgg

SEQ ID NO: 22322 - DNA, 18 bp, synthetic construct
  source 1..18: mol_type = other DNA
tattacgactcacggcag

SEQ ID NO: 22323 - DNA, 18 bp, synthetic construct
  source 1..18: mol_type = other DNA
tattacgactcagtttgg

SEQ ID NO: 22324 - DNA, 18 bp, synthetic construct
  source 1..18: mol_type = other DNA
tattacgactgtcaatag

SEQ ID NO: 22325 - DNA, 18 bp, synthetic construct
  source 1..18: mol_type = other DNA
tattacgacttactttcg

SEQ ID NO: 22326 - DNA, 18 bp, synthetic construct
  source 1..18: mol_type = other DNA
tattacgacttagtatcg

SEQ ID NO: 22327 - DNA, 18 bp, synthetic construct
  source 1..18: mol_type = other DNA
tattacgacttattagag

SEQ ID NO: 22328 - DNA, 18 bp, synthetic construct
  source 1..18: mol_type = other DNA
tattacgacttattatgg

SEQ ID NO: 22329 - DNA, 18 bp, synthetic construct
  source 1..18: mol_type = other DNA
tattacgagactctatag

SEQ ID NO: 22330 - DNA, 18 bp, synthetic construct
  source 1..18: mol_type = other DNA
tattacgagatactatag

SEQ ID NO: 22331 - DNA, 18 bp, synthetic construct
  source 1..18: mol_type = other DNA
tattacgagcctctatag

SEQ ID NO: 22332 - DNA, 18 bp, synthetic construct
  source 1..18: mol_type = other DNA
tattacgattcaatagag

SEQ ID NO: 22333 - DNA, 18 bp, synthetic construct
  source 1..18: mol_type = other DNA
tattacgattcactgtcg

SEQ ID NO: 22334 - DNA, 18 bp, synthetic construct
  source 1..18: mol_type = other DNA
tattacggctcacgaaag

SEQ ID NO: 22335 - DNA, 18 bp, synthetic construct
  source 1..18: mol_type = other DNA
tattacggctgtctatag

SEQ ID NO: 22336 - DNA, 18 bp, synthetic construct
  source 1..18: mol_type = other DNA
tattacgtcttactatgg

SEQ ID NO: 22337 - DNA, 18 bp, synthetic construct
  source 1..18: mol_type = other DNA
tattactaaccactatag

SEQ ID NO: 22338 - DNA, 18 bp, synthetic construct
  source 1..18: mol_type = other DNA
tattactactcaaaatag

SEQ ID NO: 22339 - DNA, 18 bp, synthetic construct
  source 1..18: mol_type = other DNA
tattactactcaagatag

SEQ ID NO: 22340 - DNA, 18 bp, synthetic construct
  source 1..18: mol_type = other DNA
tattactactctctatgg

SEQ ID NO: 22341 - DNA, 18 bp, synthetic construct
  source 1..18: mol_type = other DNA
tattactaggcactatag

SEQ ID NO: 22342 - DNA, 18 bp, synthetic construct
  source 1..18: mol_type = other DNA
tattactcctcaatatag

SEQ ID NO: 22343 - DNA, 18 bp, synthetic construct
  source 1..18: mol_type = other DNA
tattaggaccaactatag

SEQ ID NO: 22344 - DNA, 18 bp, synthetic construct
  source 1..18: mol_type = other DNA
tattaggactcactgaag

SEQ ID NO: 22345 - DNA, 18 bp, synthetic construct
  source 1..18: mol_type = other DNA
tattaggcctcactttag

SEQ ID NO: 22346 - DNA, 18 bp, synthetic construct
  source 1..18: mol_type = other DNA
tattatcgctcactatag

SEQ ID NO: 22347 - DNA, 18 bp, synthetic construct
  source 1..18: mol_type = other DNA
tattatgactcaatatgg

SEQ ID NO: 22348 - DNA, 18 bp, synthetic construct
  source 1..18: mol_type = other DNA
tattatgactctgtatag

SEQ ID NO: 22349 - DNA, 18 bp, synthetic construct
  source 1..18: mol_type = other DNA
tattcagacacactatag

SEQ ID NO: 22350 - DNA, 18 bp, synthetic construct
  source 1..18: mol_type = other DNA
tattccgaccccctatag

SEQ ID NO: 22351 - DNA, 18 bp, synthetic construct
  source 1..18: mol_type = other DNA
tattccgactccatatag

SEQ ID NO: 22352 - DNA, 18 bp, synthetic construct
  source 1..18: mol_type = other DNA
tattcctattcactatag

SEQ ID NO: 22353 - DNA, 18 bp, synthetic construct
  source 1..18: mol_type = other DNA
tattgagaatcactatag

SEQ ID NO: 22354 - DNA, 18 bp, synthetic construct
  source 1..18: mol_type = other DNA
tattgcgaatcactgtag

SEQ ID NO: 22355 - DNA, 18 bp, synthetic construct
  source 1..18: mol_type = other DNA
tattgcgactctgtatag

SEQ ID NO: 22356 - DNA, 18 bp, synthetic construct
  source 1..18: mol_type = other DNA
tattgcggctcattatag

SEQ ID NO: 22357 - DNA, 18 bp, synthetic construct
  source 1..18: mol_type = other DNA
tcaaaggactcacaatag

SEQ ID NO: 22358 - DNA, 18 bp, synthetic construct
  source 1..18: mol_type = other DNA
tcataagactaactttag

SEQ ID NO: 22359 - DNA, 18 bp, synthetic construct
  source 1..18: mol_type = other DNA
tcataagactctatatag

SEQ ID NO: 22360 - DNA, 18 bp, synthetic construct
  source 1..18: mol_type = other DNA
tcatacagctcattatag

SEQ ID NO: 22361 - DNA, 18 bp, synthetic construct
  source 1..18: mol_type = other DNA
tcataccactgactacag

SEQ ID NO: 22362 - DNA, 18 bp, synthetic construct
  source 1..18: mol_type = other DNA
tcataccattcactagag

SEQ ID NO: 22363 - DNA, 18 bp, synthetic construct
  source 1..18: mol_type = other DNA
tcataccattcactatgg

SEQ ID NO: 22364 - DNA, 18 bp, synthetic construct
  source 1..18: mol_type = other DNA
tcatacgacccaaaatag

SEQ ID NO: 22365 - DNA, 18 bp, synthetic construct
  source 1..18: mol_type = other DNA
tcatacgacgcaccaaag

SEQ ID NO: 22366 - DNA, 18 bp, synthetic construct
  source 1..18: mol_type = other DNA
tcatacgactacctctag

SEQ ID NO: 22367 - DNA, 18 bp, synthetic construct
  source 1..18: mol_type = other DNA
tcatacgactcctaatag

SEQ ID NO: 22368 - DNA, 18 bp, synthetic construct
  source 1..18: mol_type = other DNA
tcatacgactctatttag

SEQ ID NO: 22369 - DNA, 18 bp, synthetic construct
  source 1..18: mol_type = other DNA
tcatacgactgactaagg

SEQ ID NO: 22370 - DNA, 18 bp, synthetic construct
  source 1..18: mol_type = other DNA
tcatacgacttccaatag

SEQ ID NO: 22371 - DNA, 18 bp, synthetic construct
  source 1..18: mol_type = other DNA
tcatacgagacactttag

SEQ ID NO: 22372 - DNA, 18 bp, synthetic construct
  source 1..18: mol_type = other DNA
tcatacgatacactagag

SEQ ID NO: 22373 - DNA, 18 bp, synthetic construct
  source 1..18: mol_type = other DNA
tcatacgcctgactatcg

SEQ ID NO: 22374 - DNA, 18 bp, synthetic construct
  source 1..18: mol_type = other DNA
tcatacggatcactttag

SEQ ID NO: 22375 - DNA, 18 bp, synthetic construct
  source 1..18: mol_type = other DNA
tcatacggctcaccttag

SEQ ID NO: 22376 - DNA, 18 bp, synthetic construct
  source 1..18: mol_type = other DNA
tcatacgtctcacaatgg

SEQ ID NO: 22377 - DNA, 18 bp, synthetic construct
  source 1..18: mol_type = other DNA
tcatacgtctcactgaag

SEQ ID NO: 22378 - DNA, 18 bp, synthetic construct
  source 1..18: mol_type = other DNA
tcatacgtctcccaatag

SEQ ID NO: 22379 - DNA, 18 bp, synthetic construct
  source 1..18: mol_type = other DNA
tcatactactgactaaag

SEQ ID NO: 22380 - DNA, 18 bp, synthetic construct
  source 1..18: mol_type = other DNA
tcataggtctcactatgg

SEQ ID NO: 22381 - DNA, 18 bp, synthetic construct
  source 1..18: mol_type = other DNA
tcatatgtctccctatag

SEQ ID NO: 22382 - DNA, 18 bp, synthetic construct
  source 1..18: mol_type = other DNA
tcatattactcattatag

SEQ ID NO: 22383 - DNA, 18 bp, synthetic construct
  source 1..18: mol_type = other DNA
tcatatttctcactatag

SEQ ID NO: 22384 - DNA, 18 bp, synthetic construct
  source 1..18: mol_type = other DNA
tcatccgactcaatctag

SEQ ID NO: 22385 - DNA, 18 bp, synthetic construct
  source 1..18: mol_type = other DNA
tcatgcggctcacaatag

SEQ ID NO: 22386 - DNA, 18 bp, synthetic construct
  source 1..18: mol_type = other DNA
tcatgtgactcactacag

SEQ ID NO: 22387 - DNA, 18 bp, synthetic construct
  source 1..18: mol_type = other DNA
tcctacgactaactctag

SEQ ID NO: 22388 - DNA, 18 bp, synthetic construct
  source 1..18: mol_type = other DNA
tcctacgactcactaacg

SEQ ID NO: 22389 - DNA, 18 bp, synthetic construct
  source 1..18: mol_type = other DNA
tcctacgactcactttgg

SEQ ID NO: 22390 - DNA, 18 bp, synthetic construct
  source 1..18: mol_type = other DNA
tctcacgactcactttag

SEQ ID NO: 22391 - DNA, 18 bp, synthetic construct
  source 1..18: mol_type = other DNA
tcttacgactctccatag

SEQ ID NO: 22392 - DNA, 18 bp, synthetic construct
  source 1..18: mol_type = other DNA
tcttacgactgacaatag

SEQ ID NO: 22393 - DNA, 18 bp, synthetic construct
  source 1..18: mol_type = other DNA
tcttacgacttaccatag

SEQ ID NO: 22394 - DNA, 18 bp, synthetic construct
  source 1..18: mol_type = other DNA
tgaaaagactcattatag

SEQ ID NO: 22395 - DNA, 18 bp, synthetic construct
  source 1..18: mol_type = other DNA
tgaaaccactcactagag

SEQ ID NO: 22396 - DNA, 18 bp, synthetic construct
  source 1..18: mol_type = other DNA
tgaaacgatacactatag

SEQ ID NO: 22397 - DNA, 18 bp, synthetic construct
  source 1..18: mol_type = other DNA
tgacaagagtcactatag

SEQ ID NO: 22398 - DNA, 18 bp, synthetic construct
  source 1..18: mol_type = other DNA
tgacatgactcactatgg

SEQ ID NO: 22399 - DNA, 18 bp, synthetic construct
  source 1..18: mol_type = other DNA
tgatacaacttactacag

SEQ ID NO: 22400 - DNA, 18 bp, synthetic construct
  source 1..18: mol_type = other DNA
tgataccaatcactatgg

SEQ ID NO: 22401 - DNA, 18 bp, synthetic construct
  source 1..18: mol_type = other DNA
tgatacctctctctatag

SEQ ID NO: 22402 - DNA, 18 bp, synthetic construct
  source 1..18: mol_type = other DNA
tgatacgaataattatag

SEQ ID NO: 22403 - DNA, 18 bp, synthetic construct
  source 1..18: mol_type = other DNA
tgatacgacatacaatag

SEQ ID NO: 22404 - DNA, 18 bp, synthetic construct
  source 1..18: mol_type = other DNA
tgatacgactcaagttag

SEQ ID NO: 22405 - DNA, 18 bp, synthetic construct
  source 1..18: mol_type = other DNA
tgatacgactcattaacg

SEQ ID NO: 22406 - DNA, 18 bp, synthetic construct
  source 1..18: mol_type = other DNA
tgatacgactcccaacag

SEQ ID NO: 22407 - DNA, 18 bp, synthetic construct
  source 1..18: mol_type = other DNA
tgatacgacttaatttag

SEQ ID NO: 22408 - DNA, 18 bp, synthetic construct
  source 1..18: mol_type = other DNA
tgatacgatttacaatag

SEQ ID NO: 22409 - DNA, 18 bp, synthetic construct
  source 1..18: mol_type = other DNA
tgatacgtctcattacag

SEQ ID NO: 22410 - DNA, 18 bp, synthetic construct
  source 1..18: mol_type = other DNA
tgatacgtctctcgatag

SEQ ID NO: 22411 - DNA, 18 bp, synthetic construct
  source 1..18: mol_type = other DNA
tgatacgtgacactatag

SEQ ID NO: 22412 - DNA, 18 bp, synthetic construct
  source 1..18: mol_type = other DNA
tgatactattcactatcg

SEQ ID NO: 22413 - DNA, 18 bp, synthetic construct
  source 1..18: mol_type = other DNA
tgatatgaatcacaatag

SEQ ID NO: 22414 - DNA, 18 bp, synthetic construct
  source 1..18: mol_type = other DNA
tgatccgatacactatag

SEQ ID NO: 22415 - DNA, 18 bp, synthetic construct
  source 1..18: mol_type = other DNA
tgatgcaactcactttag

SEQ ID NO: 22416 - DNA, 18 bp, synthetic construct
  source 1..18: mol_type = other DNA
tgatgcgacccactctag

SEQ ID NO: 22417 - DNA, 18 bp, synthetic construct
  source 1..18: mol_type = other DNA
tgatgcgattcacaatag

SEQ ID NO: 22418 - DNA, 18 bp, synthetic construct
  source 1..18: mol_type = other DNA
tggtacgaatcactagag

SEQ ID NO: 22419 - DNA, 18 bp, synthetic construct
  source 1..18: mol_type = other DNA
tgtaacgaatcactatag

SEQ ID NO: 22420 - DNA, 18 bp, synthetic construct
  source 1..18: mol_type = other DNA
tgttacgactaacaatag

SEQ ID NO: 22421 - DNA, 18 bp, synthetic construct
  source 1..18: mol_type = other DNA
tgttacggctcactgtag

SEQ ID NO: 22422 - DNA, 18 bp, synthetic construct
  source 1..18: mol_type = other DNA
tgttataactcactatag

SEQ ID NO: 22423 - DNA, 18 bp, synthetic construct
  source 1..18: mol_type = other DNA
ttaaacaacccactatag

SEQ ID NO: 22424 - DNA, 18 bp, synthetic construct
  source 1..18: mol_type = other DNA
ttaaacaactcactatgg

SEQ ID NO: 22425 - DNA, 18 bp, synthetic construct
  source 1..18: mol_type = other DNA
ttaaacgacccaccatag

SEQ ID NO: 22426 - DNA, 18 bp, synthetic construct
  source 1..18: mol_type = other DNA
ttaaacgactcagtatcg

SEQ ID NO: 22427 - DNA, 18 bp, synthetic construct
  source 1..18: mol_type = other DNA
ttaaacgactcatgatag

SEQ ID NO: 22428 - DNA, 18 bp, synthetic construct
  source 1..18: mol_type = other DNA
ttaaacgactcattagag

SEQ ID NO: 22429 - DNA, 18 bp, synthetic construct
  source 1..18: mol_type = other DNA
ttaaacgacttactacag

SEQ ID NO: 22430 - DNA, 18 bp, synthetic construct
  source 1..18: mol_type = other DNA
ttaaacgagccactatag

SEQ ID NO: 22431 - DNA, 18 bp, synthetic construct
  source 1..18: mol_type = other DNA
ttaaacggcttactatag

SEQ ID NO: 22432 - DNA, 18 bp, synthetic construct
  source 1..18: mol_type = other DNA
ttaaccgactcagtatag

SEQ ID NO: 22433 - DNA, 18 bp, synthetic construct
  source 1..18: mol_type = other DNA
ttaagcgtctcactatag

SEQ ID NO: 22434 - DNA, 18 bp, synthetic construct
  source 1..18: mol_type = other DNA
ttacaccactcactaaag

SEQ ID NO: 22435 - DNA, 18 bp, synthetic construct
  source 1..18: mol_type = other DNA
ttacacgaaacactatag

SEQ ID NO: 22436 - DNA, 18 bp, synthetic construct
  source 1..18: mol_type = other DNA
ttacacgactccatatag

SEQ ID NO: 22437 - DNA, 18 bp, synthetic construct
  source 1..18: mol_type = other DNA
ttacacgactgactaaag

SEQ ID NO: 22438 - DNA, 18 bp, synthetic construct
  source 1..18: mol_type = other DNA
ttagacaattcactatag

SEQ ID NO: 22439 - DNA, 18 bp, synthetic construct
  source 1..18: mol_type = other DNA
ttataacacacactatag

SEQ ID NO: 22440 - DNA, 18 bp, synthetic construct
  source 1..18: mol_type = other DNA
ttataagagtcactaaag

SEQ ID NO: 22441 - DNA, 18 bp, synthetic construct
  source 1..18: mol_type = other DNA
ttatacaactcacgacag

SEQ ID NO: 22442 - DNA, 18 bp, synthetic construct
  source 1..18: mol_type = other DNA
ttatacaactgactatcg

SEQ ID NO: 22443 - DNA, 18 bp, synthetic construct
  source 1..18: mol_type = other DNA
ttataccactcattatcg

SEQ ID NO: 22444 - DNA, 18 bp, synthetic construct
  source 1..18: mol_type = other DNA
ttataccattcactacag

SEQ ID NO: 22445 - DNA, 18 bp, synthetic construct
  source 1..18: mol_type = other DNA
ttatacccctccctatag

SEQ ID NO: 22446 - DNA, 18 bp, synthetic construct
  source 1..18: mol_type = other DNA
ttataccgatcactatag

SEQ ID NO: 22447 - DNA, 18 bp, synthetic construct
  source 1..18: mol_type = other DNA
ttataccgctcacgatag

SEQ ID NO: 22448 - DNA, 18 bp, synthetic construct
  source 1..18: mol_type = other DNA
ttatacgaagctctatag

SEQ ID NO: 22449 - DNA, 18 bp, synthetic construct
  source 1..18: mol_type = other DNA
ttatacgaatcacaatgg

SEQ ID NO: 22450 - DNA, 18 bp, synthetic construct
  source 1..18: mol_type = other DNA
ttatacgaatcagtaaag

SEQ ID NO: 22451 - DNA, 18 bp, synthetic construct
  source 1..18: mol_type = other DNA
ttatacgacacacgacag

SEQ ID NO: 22452 - DNA, 18 bp, synthetic construct
  source 1..18: mol_type = other DNA
ttatacgacccacaaaag

SEQ ID NO: 22453 - DNA, 18 bp, synthetic construct
  source 1..18: mol_type = other DNA
ttatacgacccatgatag

SEQ ID NO: 22454 - DNA, 18 bp, synthetic construct
  source 1..18: mol_type = other DNA
ttatacgacctactaaag

SEQ ID NO: 22455 - DNA, 18 bp, synthetic construct
  source 1..18: mol_type = other DNA
ttatacgactcaccctcg

SEQ ID NO: 22456 - DNA, 18 bp, synthetic construct
  source 1..18: mol_type = other DNA
ttatacgactcacggaag

SEQ ID NO: 22457 - DNA, 18 bp, synthetic construct
  source 1..18: mol_type = other DNA
ttatacgactcatcatgg

SEQ ID NO: 22458 - DNA, 18 bp, synthetic construct
  source 1..18: mol_type = other DNA
ttatacgactcccgctag

SEQ ID NO: 22459 - DNA, 18 bp, synthetic construct
  source 1..18: mol_type = other DNA
ttatacgactctctcgag

SEQ ID NO: 22460 - DNA, 18 bp, synthetic construct
  source 1..18: mol_type = other DNA
ttatacgacttactgtcg

SEQ ID NO: 22461 - DNA, 18 bp, synthetic construct
  source 1..18: mol_type = other DNA
ttatacgacttactttcg

SEQ ID NO: 22462 - DNA, 18 bp, synthetic construct
  source 1..18: mol_type = other DNA
ttatacgacttagtttag

SEQ ID NO: 22463 - DNA, 18 bp, synthetic construct
  source 1..18: mol_type = other DNA
ttatacgacttcctaaag

SEQ ID NO: 22464 - DNA, 18 bp, synthetic construct
  source 1..18: mol_type = other DNA
ttatacgagtcacattag

SEQ ID NO: 22465 - DNA, 18 bp, synthetic construct
  source 1..18: mol_type = other DNA
ttatacgatccactatcg

SEQ ID NO: 22466 - DNA, 18 bp, synthetic construct
  source 1..18: mol_type = other DNA
ttatacgccgctctatag

SEQ ID NO: 22467 - DNA, 18 bp, synthetic construct
  source 1..18: mol_type = other DNA
ttatacgcctcattttag

SEQ ID NO: 22468 - DNA, 18 bp, synthetic construct
  source 1..18: mol_type = other DNA
ttatacggctccatatag

SEQ ID NO: 22469 - DNA, 18 bp, synthetic construct
  source 1..18: mol_type = other DNA
ttatacgtctctccatag

SEQ ID NO: 22470 - DNA, 18 bp, synthetic construct
  source 1..18: mol_type = other DNA
ttatactaatcactagag

SEQ ID NO: 22471 - DNA, 18 bp, synthetic construct
  source 1..18: mol_type = other DNA
ttatactacacactacag

SEQ ID NO: 22472 - DNA, 18 bp, synthetic construct
  source 1..18: mol_type = other DNA
ttatactacgtactatag

SEQ ID NO: 22473 - DNA, 18 bp, synthetic construct
  source 1..18: mol_type = other DNA
ttatactactcaggatag

SEQ ID NO: 22474 - DNA, 18 bp, synthetic construct
  source 1..18: mol_type = other DNA
ttatactattcaatatag

SEQ ID NO: 22475 - DNA, 18 bp, synthetic construct
  source 1..18: mol_type = other DNA
ttataggactctatatag

SEQ ID NO: 22476 - DNA, 18 bp, synthetic construct
  source 1..18: mol_type = other DNA
ttataggactctctatcg

SEQ ID NO: 22477 - DNA, 18 bp, synthetic construct
  source 1..18: mol_type = other DNA
ttataggtctcactgtag

SEQ ID NO: 22478 - DNA, 18 bp, synthetic construct
  source 1..18: mol_type = other DNA
ttatataactcactctag

SEQ ID NO: 22479 - DNA, 18 bp, synthetic construct
  source 1..18: mol_type = other DNA
ttatatgaatcaccatag

SEQ ID NO: 22480 - DNA, 18 bp, synthetic construct
  source 1..18: mol_type = other DNA
ttatatgactaactatgg

SEQ ID NO: 22481 - DNA, 18 bp, synthetic construct
  source 1..18: mol_type = other DNA
ttatatggcccactatag

SEQ ID NO: 22482 - DNA, 18 bp, synthetic construct
  source 1..18: mol_type = other DNA
ttatccgactctctatgg

SEQ ID NO: 22483 - DNA, 18 bp, synthetic construct
  source 1..18: mol_type = other DNA
ttatccgacttactaaag

SEQ ID NO: 22484 - DNA, 18 bp, synthetic construct
  source 1..18: mol_type = other DNA
ttatccgtcccactatag

SEQ ID NO: 22485 - DNA, 18 bp, synthetic construct
  source 1..18: mol_type = other DNA
ttatgcgactcacaatgg

SEQ ID NO: 22486 - DNA, 18 bp, synthetic construct
  source 1..18: mol_type = other DNA
ttatgcggctaactatag

SEQ ID NO: 22487 - DNA, 18 bp, synthetic construct
  source 1..18: mol_type = other DNA
ttctacgtcgcactatag

SEQ ID NO: 22488 - DNA, 18 bp, synthetic construct
  source 1..18: mol_type = other DNA
ttctatgactcactctag

SEQ ID NO: 22489 - DNA, 18 bp, synthetic construct
  source 1..18: mol_type = other DNA
ttgtacgactcagtatgg

SEQ ID NO: 22490 - DNA, 18 bp, synthetic construct
  source 1..18: mol_type = other DNA
ttgtacgactccccatag

SEQ ID NO: 22491 - DNA, 18 bp, synthetic construct
  source 1..18: mol_type = other DNA
ttgtacgattcactgtag

SEQ ID NO: 22492 - DNA, 18 bp, synthetic construct
  source 1..18: mol_type = other DNA
tttcacgagtcactatag

SEQ ID NO: 22493 - DNA, 18 bp, synthetic construct
  source 1..18: mol_type = other DNA
ttttatgactaactatag

SEQ ID NO: 22494 - DNA, 18 bp, synthetic construct
  source 1..18: mol_type = other DNA
aatttcgactcactatcg

SEQ ID NO: 22495 - DNA, 18 bp, synthetic construct
  source 1..18: mol_type = other DNA
taattagattcaatatag

SEQ ID NO: 22496 - DNA, 18 bp, synthetic construct
  source 1..18: mol_type = other DNA
cattacgtcacactatag

SEQ ID NO: 22497 - DNA, 18 bp, synthetic construct
  source 1..18: mol_type = other DNA
tttcacgactcactttag

SEQ ID NO: 22498 - DNA, 18 bp, synthetic construct
  source 1..18: mol_type = other DNA
aaatatgtctcactacag

SEQ ID NO: 22499 - DNA, 18 bp, synthetic construct
  source 1..18: mol_type = other DNA
taaaacgattcattttag

SEQ ID NO: 22500 - DNA, 18 bp, synthetic construct
  source 1..18: mol_type = other DNA
taatacgacgagctattg

SEQ ID NO: 22501 - DNA, 18 bp, synthetic construct
  source 1..18: mol_type = other DNA
gcattcgactcaatatag

SEQ ID NO: 22502 - DNA, 18 bp, synthetic construct
  source 1..18: mol_type = other DNA
taatatgactcccttttg

SEQ ID NO: 22503 - DNA, 18 bp, synthetic construct
  source 1..18: mol_type = other DNA
taattcgattcaataaag

SEQ ID NO: 22504 - DNA, 18 bp, synthetic construct
  source 1..18: mol_type = other DNA
taattcgtattactatag

SEQ ID NO: 22505 - DNA, 18 bp, synthetic construct
  source 1..18: mol_type = other DNA
tattacaactcactactg

SEQ ID NO: 22506 - DNA, 18 bp, synthetic construct
  source 1..18: mol_type = other DNA
tattatgactcacaattg

SEQ ID NO: 22507 - DNA, 18 bp, synthetic construct
  source 1..18: mol_type = other DNA
ttattcgactcagtaaag

SEQ ID NO: 22508 - DNA, 18 bp, synthetic construct
  source 1..18: mol_type = other DNA
ttgtacgacacactattg

SEQ ID NO: 22509 - DNA, 18 bp, synthetic construct
  source 1..18: mol_type = other DNA
aatgacgactcactttag

SEQ ID NO: 22510 - DNA, 18 bp, synthetic construct
  source 1..18: mol_type = other DNA
taaaacgacacagtaaag

SEQ ID NO: 22511 - DNA, 18 bp, synthetic construct
  source 1..18: mol_type = other DNA
taatacgataccctttag

SEQ ID NO: 22512 - DNA, 18 bp, synthetic construct
  source 1..18: mol_type = other DNA
taatacgtaacactttag

SEQ ID NO: 22513 - DNA, 18 bp, synthetic construct
  source 1..18: mol_type = other DNA
taatacgtctcataaaag

SEQ ID NO: 22514 - DNA, 18 bp, synthetic construct
  source 1..18: mol_type = other DNA
tataactactcactctag

SEQ ID NO: 22515 - DNA, 18 bp, synthetic construct
  source 1..18: mol_type = other DNA
tgatacgtctttctatag

SEQ ID NO: 22516 - DNA, 18 bp, synthetic construct
  source 1..18: mol_type = other DNA
ttatacgacccaataaag

SEQ ID NO: 22517 - DNA, 18 bp, synthetic construct
  source 1..18: mol_type = other DNA
ttatacgacttactaacg

SEQ ID NO: 22518 - DNA, 18 bp, synthetic construct
  source 1..18: mol_type = other DNA
ttatacgacttattctag

SEQ ID NO: 22519 - DNA, 18 bp, synthetic construct
  source 1..18: mol_type = other DNA
ttttacgactcacattag

SEQ ID NO: 22520 - DNA, 18 bp, synthetic construct
  source 1..18: mol_type = other DNA
tatattgactcactatag

SEQ ID NO: 22521 - DNA, 18 bp, synthetic construct
  source 1..18: mol_type = other DNA
tataacgactctctaaag

SEQ ID NO: 22522 - DNA, 18 bp, synthetic construct
  source 1..18: mol_type = other DNA
tattatgactcgctattg

SEQ ID NO: 22523 - DNA, 18 bp, synthetic construct
  source 1..18: mol_type = other DNA
aaaaaccactcactattg

SEQ ID NO: 22524 - DNA, 18 bp, synthetic construct
  source 1..18: mol_type = other DNA
aaatacgactctccattg

SEQ ID NO: 22525 - DNA, 18 bp, synthetic construct
  source 1..18: mol_type = other DNA
aaattcgactcaatatcg

SEQ ID NO: 22526 - DNA, 18 bp, synthetic construct
  source 1..18: mol_type = other DNA
aaattcgactctctacag

SEQ ID NO: 22527 - DNA, 18 bp, synthetic construct
  source 1..18: mol_type = other DNA
aaatttgtctcactatag

SEQ ID NO: 22528 - DNA, 18 bp, synthetic construct
  source 1..18: mol_type = other DNA
caaatcgtctcactatag

SEQ ID NO: 22529 - DNA, 18 bp, synthetic construct
  source 1..18: mol_type = other DNA
taaataaactcactatag

SEQ ID NO: 22530 - DNA, 18 bp, synthetic construct
  source 1..18: mol_type = other DNA
taactagactcactctag

SEQ ID NO: 22531 - DNA, 18 bp, synthetic construct
  source 1..18: mol_type = other DNA
taactcgactctcaatag

SEQ ID NO: 22532 - DNA, 18 bp, synthetic construct
  source 1..18: mol_type = other DNA
taagacgacttgctaaag

SEQ ID NO: 22533 - DNA, 18 bp, synthetic construct
  source 1..18: mol_type = other DNA
taataagactcactcatg

SEQ ID NO: 22534 - DNA, 18 bp, synthetic construct
  source 1..18: mol_type = other DNA
taataagactcgcttaag

SEQ ID NO: 22535 - DNA, 18 bp, synthetic construct
  source 1..18: mol_type = other DNA
taataccactcattaatg

SEQ ID NO: 22536 - DNA, 18 bp, synthetic construct
  source 1..18: mol_type = other DNA
taataccactgactaatg

SEQ ID NO: 22537 - DNA, 18 bp, synthetic construct
  source 1..18: mol_type = other DNA
taatacgaatctctaatg

SEQ ID NO: 22538 - DNA, 18 bp, synthetic construct
  source 1..18: mol_type = other DNA
taatacgagtcattaatg

SEQ ID NO: 22539 - DNA, 18 bp, synthetic construct
  source 1..18: mol_type = other DNA
taatacgcctcattaatg

SEQ ID NO: 22540 - DNA, 18 bp, synthetic construct
  source 1..18: mol_type = other DNA
taatacgtatcactactg

SEQ ID NO: 22541 - DNA, 18 bp, synthetic construct
  source 1..18: mol_type = other DNA
taatactacgccctattg

SEQ ID NO: 22542 - DNA, 18 bp, synthetic construct
  source 1..18: mol_type = other DNA
taataggacacactagtg

SEQ ID NO: 22543 - DNA, 18 bp, synthetic construct
  source 1..18: mol_type = other DNA
taatataactcgcaatag

SEQ ID NO: 22544 - DNA, 18 bp, synthetic construct
  source 1..18: mol_type = other DNA
taatattactcactagtg

SEQ ID NO: 22545 - DNA, 18 bp, synthetic construct
  source 1..18: mol_type = other DNA
taatccgactcgctaacg

SEQ ID NO: 22546 - DNA, 18 bp, synthetic construct
  source 1..18: mol_type = other DNA
taatgcgaataactattg

SEQ ID NO: 22547 - DNA, 18 bp, synthetic construct
  source 1..18: mol_type = other DNA
taattcgtatcactatgg

SEQ ID NO: 22548 - DNA, 18 bp, synthetic construct
  source 1..18: mol_type = other DNA
taattcgtctcaatatcg

SEQ ID NO: 22549 - DNA, 18 bp, synthetic construct
  source 1..18: mol_type = other DNA
taattctactatctatag

SEQ ID NO: 22550 - DNA, 18 bp, synthetic construct
  source 1..18: mol_type = other DNA
taatttgacttactacag

SEQ ID NO: 22551 - DNA, 18 bp, synthetic construct
  source 1..18: mol_type = other DNA
tagtacggctcattattg

SEQ ID NO: 22552 - DNA, 18 bp, synthetic construct
  source 1..18: mol_type = other DNA
tattaagactcaatattg

SEQ ID NO: 22553 - DNA, 18 bp, synthetic construct
  source 1..18: mol_type = other DNA
tatttcgactcactaacg

SEQ ID NO: 22554 - DNA, 18 bp, synthetic construct
  source 1..18: mol_type = other DNA
ttatacgactaaccattg

SEQ ID NO: 22555 - DNA, 18 bp, synthetic construct
  source 1..18: mol_type = other DNA
ttattcgactaactttag

SEQ ID NO: 22556 - DNA, 18 bp, synthetic construct
  source 1..18: mol_type = other DNA
aaaaacgaatcaatatag

SEQ ID NO: 22557 - DNA, 18 bp, synthetic construct
  source 1..18: mol_type = other DNA
aaataagactcaatttag

SEQ ID NO: 22558 - DNA, 18 bp, synthetic construct
  source 1..18: mol_type = other DNA
aaataagattcacaatag

SEQ ID NO: 22559 - DNA, 18 bp, synthetic construct
  source 1..18: mol_type = other DNA
aaatacaacactctatag

SEQ ID NO: 22560 - DNA, 18 bp, synthetic construct
  source 1..18: mol_type = other DNA
aaatacgaatcactttgg

SEQ ID NO: 22561 - DNA, 18 bp, synthetic construct
  source 1..18: mol_type = other DNA
aaatacgatccactaaag

SEQ ID NO: 22562 - DNA, 18 bp, synthetic construct
  source 1..18: mol_type = other DNA
aaatactattcattatag

SEQ ID NO: 22563 - DNA, 18 bp, synthetic construct
  source 1..18: mol_type = other DNA
aaataggactctatatag

SEQ ID NO: 22564 - DNA, 18 bp, synthetic construct
  source 1..18: mol_type = other DNA
aaatccgcctcacaatag

SEQ ID NO: 22565 - DNA, 18 bp, synthetic construct
  source 1..18: mol_type = other DNA
acatacgactcataatag

SEQ ID NO: 22566 - DNA, 18 bp, synthetic construct
  source 1..18: mol_type = other DNA
atacacgacttactatag

SEQ ID NO: 22567 - DNA, 18 bp, synthetic construct
  source 1..18: mol_type = other DNA
caaaacgactcaccacag

SEQ ID NO: 22568 - DNA, 18 bp, synthetic construct
  source 1..18: mol_type = other DNA
caatacgcatcactaaag

SEQ ID NO: 22569 - DNA, 18 bp, synthetic construct
  source 1..18: mol_type = other DNA
taaaacgattctctgtag

SEQ ID NO: 22570 - DNA, 18 bp, synthetic construct
  source 1..18: mol_type = other DNA
taaaacgctttactatag

SEQ ID NO: 22571 - DNA, 18 bp, synthetic construct
  source 1..18: mol_type = other DNA
taaaacgtcacactatgg

SEQ ID NO: 22572 - DNA, 18 bp, synthetic construct
  source 1..18: mol_type = other DNA
taaagccactcactacag

SEQ ID NO: 22573 - DNA, 18 bp, synthetic construct
  source 1..18: mol_type = other DNA
taagacaacacaatatag

SEQ ID NO: 22574 - DNA, 18 bp, synthetic construct
  source 1..18: mol_type = other DNA
taataaaactctctaaag

SEQ ID NO: 22575 - DNA, 18 bp, synthetic construct
  source 1..18: mol_type = other DNA
taataagaatcaaaatag

SEQ ID NO: 22576 - DNA, 18 bp, synthetic construct
  source 1..18: mol_type = other DNA
taataagaatcactaacg

SEQ ID NO: 22577 - DNA, 18 bp, synthetic construct
  source 1..18: mol_type = other DNA
taataagactccatatgg

SEQ ID NO: 22578 - DNA, 18 bp, synthetic construct
  source 1..18: mol_type = other DNA
taatacaaccaactttag

SEQ ID NO: 22579 - DNA, 18 bp, synthetic construct
  source 1..18: mol_type = other DNA
taatacaactcacccaag

SEQ ID NO: 22580 - DNA, 18 bp, synthetic construct
  source 1..18: mol_type = other DNA
taataccaatcattatgg

SEQ ID NO: 22581 - DNA, 18 bp, synthetic construct
  source 1..18: mol_type = other DNA
taatacgacagacactag

SEQ ID NO: 22582 - DNA, 18 bp, synthetic construct
  source 1..18: mol_type = other DNA
taatacgattcaatgaag

SEQ ID NO: 22583 - DNA, 18 bp, synthetic construct
  source 1..18: mol_type = other DNA
taatacgcatcacattag

SEQ ID NO: 22584 - DNA, 18 bp, synthetic construct
  source 1..18: mol_type = other DNA
taatacggttcactgaag

SEQ ID NO: 22585 - DNA, 18 bp, synthetic construct
  source 1..18: mol_type = other DNA
taatacgtccctctttag

SEQ ID NO: 22586 - DNA, 18 bp, synthetic construct
  source 1..18: mol_type = other DNA
taatacgtctcataatcg

SEQ ID NO: 22587 - DNA, 18 bp, synthetic construct
  source 1..18: mol_type = other DNA
taatactacactctgtag

SEQ ID NO: 22588 - DNA, 18 bp, synthetic construct
  source 1..18: mol_type = other DNA
taatactacgctcaatag

SEQ ID NO: 22589 - DNA, 18 bp, synthetic construct
  source 1..18: mol_type = other DNA
taatatgacttaatctag

SEQ ID NO: 22590 - DNA, 18 bp, synthetic construct
  source 1..18: mol_type = other DNA
taatccaactcataatag

SEQ ID NO: 22591 - DNA, 18 bp, synthetic construct
  source 1..18: mol_type = other DNA
taatccgactctttatgg

SEQ ID NO: 22592 - DNA, 18 bp, synthetic construct
  source 1..18: mol_type = other DNA
taatcctactctcaatag

SEQ ID NO: 22593 - DNA, 18 bp, synthetic construct
  source 1..18: mol_type = other DNA
tactacgactaacattag

SEQ ID NO: 22594 - DNA, 18 bp, synthetic construct
  source 1..18: mol_type = other DNA
tagtaatactctctatag

SEQ ID NO: 22595 - DNA, 18 bp, synthetic construct
  source 1..18: mol_type = other DNA
tataaccgctcactatag

SEQ ID NO: 22596 - DNA, 18 bp, synthetic construct
  source 1..18: mol_type = other DNA
tataacgactaaatatag

SEQ ID NO: 22597 - DNA, 18 bp, synthetic construct
  source 1..18: mol_type = other DNA
tataacggctctctatag

SEQ ID NO: 22598 - DNA, 18 bp, synthetic construct
  source 1..18: mol_type = other DNA
tataactactcactttag

SEQ ID NO: 22599 - DNA, 18 bp, synthetic construct
  source 1..18: mol_type = other DNA
tatcacgaatcactaaag

SEQ ID NO: 22600 - DNA, 18 bp, synthetic construct
  source 1..18: mol_type = other DNA
tattaagtctcactctag

SEQ ID NO: 22601 - DNA, 18 bp, synthetic construct
  source 1..18: mol_type = other DNA
tattacgactaaacatag

SEQ ID NO: 22602 - DNA, 18 bp, synthetic construct
  source 1..18: mol_type = other DNA
tattacgtatcactgtag

SEQ ID NO: 22603 - DNA, 18 bp, synthetic construct
  source 1..18: mol_type = other DNA
tattacgtctcactaccg

SEQ ID NO: 22604 - DNA, 18 bp, synthetic construct
  source 1..18: mol_type = other DNA
tattacgtctcactgtcg

SEQ ID NO: 22605 - DNA, 18 bp, synthetic construct
  source 1..18: mol_type = other DNA
tattccgtctcagtatag

SEQ ID NO: 22606 - DNA, 18 bp, synthetic construct
  source 1..18: mol_type = other DNA
tattctgactcactaaag

SEQ ID NO: 22607 - DNA, 18 bp, synthetic construct
  source 1..18: mol_type = other DNA
tattctgactcactagag

SEQ ID NO: 22608 - DNA, 18 bp, synthetic construct
  source 1..18: mol_type = other DNA
tcatacggctcaataaag

SEQ ID NO: 22609 - DNA, 18 bp, synthetic construct
  source 1..18: mol_type = other DNA
tcatacgtcacactgtag

SEQ ID NO: 22610 - DNA, 18 bp, synthetic construct
  source 1..18: mol_type = other DNA
tgatacgacacacagtag

SEQ ID NO: 22611 - DNA, 18 bp, synthetic construct
  source 1..18: mol_type = other DNA
ttataagactcagtttag

SEQ ID NO: 22612 - DNA, 18 bp, synthetic construct
  source 1..18: mol_type = other DNA
ttatacgactgacaatcg

SEQ ID NO: 22613 - DNA, 18 bp, synthetic construct
  source 1..18: mol_type = other DNA
ttatacggctctctaaag

SEQ ID NO: 22614 - DNA, 18 bp, synthetic construct
  source 1..18: mol_type = other DNA
ttatacgtctcactggag

SEQ ID NO: 22615 - DNA, 18 bp, synthetic construct
  source 1..18: mol_type = other DNA
ttcaacgactaactatag

SEQ ID NO: 22616 - DNA, 18 bp, synthetic construct
  source 1..18: mol_type = other DNA
ttgtacgactcacagtag

SEQ ID NO: 22617 - DNA, 18 bp, synthetic construct
  source 1..18: mol_type = other DNA
tttaacgactcaatatag

SEQ ID NO: 22618 - DNA, 18 bp, synthetic construct
  source 1..18: mol_type = other DNA
ttttacgactaactttag

SEQ ID NO: 22619 - DNA, 18 bp, synthetic construct
  source 1..18: mol_type = other DNA
ttattcgaatcattatag

SEQ ID NO: 22620 - DNA, 18 bp, synthetic construct
  source 1..18: mol_type = other DNA
atacacgactctctatag

SEQ ID NO: 22621 - DNA, 18 bp, synthetic construct
  source 1..18: mol_type = other DNA
caattcgactgcctatag

SEQ ID NO: 22622 - DNA, 18 bp, synthetic construct
  source 1..18: mol_type = other DNA
taatacatcacactattg

SEQ ID NO: 22623 - DNA, 18 bp, synthetic construct
  source 1..18: mol_type = other DNA
taatacgacactgtattg

SEQ ID NO: 22624 - DNA, 18 bp, synthetic construct
  source 1..18: mol_type = other DNA
taattctactacctatag

SEQ ID NO: 22625 - DNA, 18 bp, synthetic construct
  source 1..18: mol_type = other DNA
tattacaactcaatattg

SEQ ID NO: 22626 - DNA, 18 bp, synthetic construct
  source 1..18: mol_type = other DNA
tatttctaatcactatag

SEQ ID NO: 22627 - DNA, 18 bp, synthetic construct
  source 1..18: mol_type = other DNA
tctaacgactcactattg

SEQ ID NO: 22628 - DNA, 18 bp, synthetic construct
  source 1..18: mol_type = other DNA
ttatacaactcgcaatag

SEQ ID NO: 22629 - DNA, 18 bp, synthetic construct
  source 1..18: mol_type = other DNA
aaatatgactcacttaag

SEQ ID NO: 22630 - DNA, 18 bp, synthetic construct
  source 1..18: mol_type = other DNA
taaaacgattctatatag

SEQ ID NO: 22631 - DNA, 18 bp, synthetic construct
  source 1..18: mol_type = other DNA
taaaacgtctcaccttag

SEQ ID NO: 22632 - DNA, 18 bp, synthetic construct
  source 1..18: mol_type = other DNA
taataagaaacattatag

SEQ ID NO: 22633 - DNA, 18 bp, synthetic construct
  source 1..18: mol_type = other DNA
taatacaacacaatatcg

SEQ ID NO: 22634 - DNA, 18 bp, synthetic construct
  source 1..18: mol_type = other DNA
taatacaacactctacag

SEQ ID NO: 22635 - DNA, 18 bp, synthetic construct
  source 1..18: mol_type = other DNA
taatacgactaaaaaaag

SEQ ID NO: 22636 - DNA, 18 bp, synthetic construct
  source 1..18: mol_type = other DNA
taatactacccacaaaag

SEQ ID NO: 22637 - DNA, 18 bp, synthetic construct
  source 1..18: mol_type = other DNA
taatactcctcacttaag

SEQ ID NO: 22638 - DNA, 18 bp, synthetic construct
  source 1..18: mol_type = other DNA
taatatgacttacattag

SEQ ID NO: 22639 - DNA, 18 bp, synthetic construct
  source 1..18: mol_type = other DNA
taatcctactcattaaag

SEQ ID NO: 22640 - DNA, 18 bp, synthetic construct
  source 1..18: mol_type = other DNA
taatgcaactctcaatag

SEQ ID NO: 22641 - DNA, 18 bp, synthetic construct
  source 1..18: mol_type = other DNA
tactacgtctctctttag

SEQ ID NO: 22642 - DNA, 18 bp, synthetic construct
  source 1..18: mol_type = other DNA
tataacaactcactatcg

SEQ ID NO: 22643 - DNA, 18 bp, synthetic construct
  source 1..18: mol_type = other DNA
tataactactcactatcg

SEQ ID NO: 22644 - DNA, 18 bp, synthetic construct
  source 1..18: mol_type = other DNA
tattacaactcagaatag

SEQ ID NO: 22645 - DNA, 18 bp, synthetic construct
  source 1..18: mol_type = other DNA
tattgcgtctcaatatag

SEQ ID NO: 22646 - DNA, 18 bp, synthetic construct
  source 1..18: mol_type = other DNA
ttacaccattcactatag

SEQ ID NO: 22647 - DNA, 18 bp, synthetic construct
  source 1..18: mol_type = other DNA
ttatattactcactgtag

SEQ ID NO: 22648 - DNA, 18 bp, synthetic construct
  source 1..18: mol_type = other DNA
taatatgactcgctaatg

SEQ ID NO: 22649 - DNA, 18 bp, synthetic construct
  source 1..18: mol_type = other DNA
tgattcgacacactattg

SEQ ID NO: 22650 - DNA, 18 bp, synthetic construct
  source 1..18: mol_type = other DNA
ttattcgaatcactttag

SEQ ID NO: 22651 - DNA, 18 bp, synthetic construct
  source 1..18: mol_type = other DNA
taaaatgactctcaatag

SEQ ID NO: 22652 - DNA, 18 bp, synthetic construct
  source 1..18: mol_type = other DNA
aaattccactcactgtag

SEQ ID NO: 22653 - DNA, 18 bp, synthetic construct
  source 1..18: mol_type = other DNA
atattcggctcactatag

SEQ ID NO: 22654 - DNA, 18 bp, synthetic construct
  source 1..18: mol_type = other DNA
ctatacgtctcgctatag

SEQ ID NO: 22655 - DNA, 18 bp, synthetic construct
  source 1..18: mol_type = other DNA
taaaacgacacagtattg

SEQ ID NO: 22656 - DNA, 18 bp, synthetic construct
  source 1..18: mol_type = other DNA
taatacttctcacttttg

SEQ ID NO: 22657 - DNA, 18 bp, synthetic construct
  source 1..18: mol_type = other DNA
taatttgacttactaaag

SEQ ID NO: 22658 - DNA, 18 bp, synthetic construct
  source 1..18: mol_type = other DNA
tatttcgactcataatag

SEQ ID NO: 22659 - DNA, 18 bp, synthetic construct
  source 1..18: mol_type = other DNA
ttattcgacacactgtag

SEQ ID NO: 22660 - DNA, 18 bp, synthetic construct
  source 1..18: mol_type = other DNA
atttacgactcactatcg

SEQ ID NO: 22661 - DNA, 18 bp, synthetic construct
  source 1..18: mol_type = other DNA
cgatacgactctcaatag

SEQ ID NO: 22662 - DNA, 18 bp, synthetic construct
  source 1..18: mol_type = other DNA
taaaacgacaaacaatag

SEQ ID NO: 22663 - DNA, 18 bp, synthetic construct
  source 1..18: mol_type = other DNA
tatcacgattcaccatag

SEQ ID NO: 22664 - DNA, 18 bp, synthetic construct
  source 1..18: mol_type = other DNA
tattatgactaacaatag

SEQ ID NO: 22665 - DNA, 18 bp, synthetic construct
  source 1..18: mol_type = other DNA
tattatgactcacaatcg

SEQ ID NO: 22666 - DNA, 18 bp, synthetic construct
  source 1..18: mol_type = other DNA
tattccgactcacattag

SEQ ID NO: 22667 - DNA, 18 bp, synthetic construct
  source 1..18: mol_type = other DNA
ttatacgactctttttag

SEQ ID NO: 22668 - DNA, 18 bp, synthetic construct
  source 1..18: mol_type = other DNA
ttttacgactcacttcag

SEQ ID NO: 22669 - DNA, 18 bp, synthetic construct
  source 1..18: mol_type = other DNA
ttttacgacttactctag

SEQ ID NO: 22670 - DNA, 18 bp, synthetic construct
  source 1..18: mol_type = other DNA
caattcgactcacaattg

SEQ ID NO: 22671 - DNA, 18 bp, synthetic construct
  source 1..18: mol_type = other DNA
taacccgactcgctattg

SEQ ID NO: 22672 - DNA, 18 bp, synthetic construct
  source 1..18: mol_type = other DNA
taatacaactggctattg

SEQ ID NO: 22673 - DNA, 18 bp, synthetic construct
  source 1..18: mol_type = other DNA
taatacgaatcgcttttg

SEQ ID NO: 22674 - DNA, 18 bp, synthetic construct
  source 1..18: mol_type = other DNA
taatacgacacgccattg

SEQ ID NO: 22675 - DNA, 18 bp, synthetic construct
  source 1..18: mol_type = other DNA
taatacggctcgctgttg

SEQ ID NO: 22676 - DNA, 18 bp, synthetic construct
  source 1..18: mol_type = other DNA
taattcaactagctatag

SEQ ID NO: 22677 - DNA, 18 bp, synthetic construct
  source 1..18: mol_type = other DNA
taattccactcaccattg

SEQ ID NO: 22678 - DNA, 18 bp, synthetic construct
  source 1..18: mol_type = other DNA
taattcgaattgctatag

SEQ ID NO: 22679 - DNA, 18 bp, synthetic construct
  source 1..18: mol_type = other DNA
taattcgactcaacattg

SEQ ID NO: 22680 - DNA, 18 bp, synthetic construct
  source 1..18: mol_type = other DNA
taattcgactcgcttcag

SEQ ID NO: 22681 - DNA, 18 bp, synthetic construct
  source 1..18: mol_type = other DNA
taattcggctcaccattg

SEQ ID NO: 22682 - DNA, 18 bp, synthetic construct
  source 1..18: mol_type = other DNA
taattcgtctagctatag

SEQ ID NO: 22683 - DNA, 18 bp, synthetic construct
  source 1..18: mol_type = other DNA
taattcgtctcgctctag

SEQ ID NO: 22684 - DNA, 18 bp, synthetic construct
  source 1..18: mol_type = other DNA
taattctactcaccattg

SEQ ID NO: 22685 - DNA, 18 bp, synthetic construct
  source 1..18: mol_type = other DNA
taattggactccctattg

SEQ ID NO: 22686 - DNA, 18 bp, synthetic construct
  source 1..18: mol_type = other DNA
taatttgactcgctatgg

SEQ ID NO: 22687 - DNA, 18 bp, synthetic construct
  source 1..18: mol_type = other DNA
tactacgaatcgctattg

SEQ ID NO: 22688 - DNA, 18 bp, synthetic construct
  source 1..18: mol_type = other DNA
tactacggctcgctattg

SEQ ID NO: 22689 - DNA, 18 bp, synthetic construct
  source 1..18: mol_type = other DNA
tacttagactcactattg

SEQ ID NO: 22690 - DNA, 18 bp, synthetic construct
  source 1..18: mol_type = other DNA
aaataccgctcgctatag

SEQ ID NO: 22691 - DNA, 18 bp, synthetic construct
  source 1..18: mol_type = other DNA
aaatacgactcacgactg

SEQ ID NO: 22692 - DNA, 18 bp, synthetic construct
  source 1..18: mol_type = other DNA
aaatacgactccccattg

SEQ ID NO: 22693 - DNA, 18 bp, synthetic construct
  source 1..18: mol_type = other DNA
aaattcaactccctatag

SEQ ID NO: 22694 - DNA, 18 bp, synthetic construct
  source 1..18: mol_type = other DNA
aaattcgactcaccatgg

SEQ ID NO: 22695 - DNA, 18 bp, synthetic construct
  source 1..18: mol_type = other DNA
aaattcgactgattatag

SEQ ID NO: 22696 - DNA, 18 bp, synthetic construct
  source 1..18: mol_type = other DNA
aaattcgacttactgtag

SEQ ID NO: 22697 - DNA, 18 bp, synthetic construct
  source 1..18: mol_type = other DNA
aacaacgactcgctatag

SEQ ID NO: 22698 - DNA, 18 bp, synthetic construct
  source 1..18: mol_type = other DNA
aacttagactcactatag

SEQ ID NO: 22699 - DNA, 18 bp, synthetic construct
  source 1..18: mol_type = other DNA
aagtacgaatcactattg

SEQ ID NO: 22700 - DNA, 18 bp, synthetic construct
  source 1..18: mol_type = other DNA
caaaacgactctctattg

SEQ ID NO: 22701 - DNA, 18 bp, synthetic construct
  source 1..18: mol_type = other DNA
caaatcgactcactttag

SEQ ID NO: 22702 - DNA, 18 bp, synthetic construct
  source 1..18: mol_type = other DNA
caatacaactcagtattg

SEQ ID NO: 22703 - DNA, 18 bp, synthetic construct
  source 1..18: mol_type = other DNA
caatacgactaactactg

SEQ ID NO: 22704 - DNA, 18 bp, synthetic construct
  source 1..18: mol_type = other DNA
caattcgacccactttag

SEQ ID NO: 22705 - DNA, 18 bp, synthetic construct
  source 1..18: mol_type = other DNA
caattcgactcactaacg

SEQ ID NO: 22706 - DNA, 18 bp, synthetic construct
  source 1..18: mol_type = other DNA
caattcgcctcactttag

SEQ ID NO: 22707 - DNA, 18 bp, synthetic construct
  source 1..18: mol_type = other DNA
cataacgactcgctatag

SEQ ID NO: 22708 - DNA, 18 bp, synthetic construct
  source 1..18: mol_type = other DNA
ccatacaactcactattg

SEQ ID NO: 22709 - DNA, 18 bp, synthetic construct
  source 1..18: mol_type = other DNA
gaataaaactcactattg

SEQ ID NO: 22710 - DNA, 18 bp, synthetic construct
  source 1..18: mol_type = other DNA
gaatacgaatccctattg

SEQ ID NO: 22711 - DNA, 18 bp, synthetic construct
  source 1..18: mol_type = other DNA
gaatacgatttactattg

SEQ ID NO: 22712 - DNA, 18 bp, synthetic construct
  source 1..18: mol_type = other DNA
gacttcgactcagtatag

SEQ ID NO: 22713 - DNA, 18 bp, synthetic construct
  source 1..18: mol_type = other DNA
gattacgattcactattg

SEQ ID NO: 22714 - DNA, 18 bp, synthetic construct
  source 1..18: mol_type = other DNA
gtatacgactcactaatg

SEQ ID NO: 22715 - DNA, 18 bp, synthetic construct
  source 1..18: mol_type = other DNA
gtatacgtctcactattg

SEQ ID NO: 22716 - DNA, 18 bp, synthetic construct
  source 1..18: mol_type = other DNA
taaaaagactcactatta

SEQ ID NO: 22717 - DNA, 18 bp, synthetic construct
  source 1..18: mol_type = other DNA
taaaacgactacctattg

SEQ ID NO: 22718 - DNA, 18 bp, synthetic construct
  source 1..18: mol_type = other DNA
taaaacgtctcaatattg

SEQ ID NO: 22719 - DNA, 18 bp, synthetic construct
  source 1..18: mol_type = other DNA
taaaacgtctcggtatag

SEQ ID NO: 22720 - DNA, 18 bp, synthetic construct
  source 1..18: mol_type = other DNA
taaaatgactcactgttg

SEQ ID NO: 22721 - DNA, 18 bp, synthetic construct
  source 1..18: mol_type = other DNA
taaaccgactcgctacag

SEQ ID NO: 22722 - DNA, 18 bp, synthetic construct
  source 1..18: mol_type = other DNA
taaatcgaatcagtatag

SEQ ID NO: 22723 - DNA, 18 bp, synthetic construct
  source 1..18: mol_type = other DNA
taaatcgactccctttag

SEQ ID NO: 22724 - DNA, 18 bp, synthetic construct
  source 1..18: mol_type = other DNA
taacaagactcaccattg

SEQ ID NO: 22725 - DNA, 18 bp, synthetic construct
  source 1..18: mol_type = other DNA
taacacaacccactattg

SEQ ID NO: 22726 - DNA, 18 bp, synthetic construct
  source 1..18: mol_type = other DNA
taacacgactcacaactg

SEQ ID NO: 22727 - DNA, 18 bp, synthetic construct
  source 1..18: mol_type = other DNA
taacacgacttactactg

SEQ ID NO: 22728 - DNA, 18 bp, synthetic construct
  source 1..18: mol_type = other DNA
taacacgatttgctatag

SEQ ID NO: 22729 - DNA, 18 bp, synthetic construct
  source 1..18: mol_type = other DNA
taacacgtctcacttttg

SEQ ID NO: 22730 - DNA, 18 bp, synthetic construct
  source 1..18: mol_type = other DNA
taacgcgcctcactattg

SEQ ID NO: 22731 - DNA, 18 bp, synthetic construct
  source 1..18: mol_type = other DNA
taactcacctcactatag

SEQ ID NO: 22732 - DNA, 18 bp, synthetic construct
  source 1..18: mol_type = other DNA
taactcgaatcactttag

SEQ ID NO: 22733 - DNA, 18 bp, synthetic construct
  source 1..18: mol_type = other DNA
taagactactcacttttg

SEQ ID NO: 22734 - DNA, 18 bp, synthetic construct
  source 1..18: mol_type = other DNA
taagatgcctcactattg

SEQ ID NO: 22735 - DNA, 18 bp, synthetic construct
  source 1..18: mol_type = other DNA
taagtccactcaatatag

SEQ ID NO: 22736 - DNA, 18 bp, synthetic construct
  source 1..18: mol_type = other DNA
taagtcggctccctatag

SEQ ID NO: 22737 - DNA, 18 bp, synthetic construct
  source 1..18: mol_type = other DNA
taataacaatcactattg

SEQ ID NO: 22738 - DNA, 18 bp, synthetic construct
  source 1..18: mol_type = other DNA
taataagaatcgatatag

SEQ ID NO: 22739 - DNA, 18 bp, synthetic construct
  source 1..18: mol_type = other DNA
taataagtctagctatag

SEQ ID NO: 22740 - DNA, 18 bp, synthetic construct
  source 1..18: mol_type = other DNA
taatacaactcacctttg

SEQ ID NO: 22741 - DNA, 18 bp, synthetic construct
  source 1..18: mol_type = other DNA
taatacaactctctcttg

SEQ ID NO: 22742 - DNA, 18 bp, synthetic construct
  source 1..18: mol_type = other DNA
taatacaacttactagtg

SEQ ID NO: 22743 - DNA, 18 bp, synthetic construct
  source 1..18: mol_type = other DNA
taatacaccccgctatag

SEQ ID NO: 22744 - DNA, 18 bp, synthetic construct
  source 1..18: mol_type = other DNA
taatacgaaacgctaaag

SEQ ID NO: 22745 - DNA, 18 bp, synthetic construct
  source 1..18: mol_type = other DNA
taatacgaaccacttttg

SEQ ID NO: 22746 - DNA, 18 bp, synthetic construct
  source 1..18: mol_type = other DNA
taatacgaatctctactg

SEQ ID NO: 22747 - DNA, 18 bp, synthetic construct
  source 1..18: mol_type = other DNA
taatacgacacagttttg

SEQ ID NO: 22748 - DNA, 18 bp, synthetic construct
  source 1..18: mol_type = other DNA
taatacgacacccttttg

SEQ ID NO: 22749 - DNA, 18 bp, synthetic construct
  source 1..18: mol_type = other DNA
taatacgacacgcagtag

SEQ ID NO: 22750 - DNA, 18 bp, synthetic construct
  source 1..18: mol_type = other DNA
taatacgacatactatta

SEQ ID NO: 22751 - DNA, 18 bp, synthetic construct
  source 1..18: mol_type = other DNA
taatacgaccaaccattg

SEQ ID NO: 22752 - DNA, 18 bp, synthetic construct
  source 1..18: mol_type = other DNA
taatacgaccctctaatg

SEQ ID NO: 22753 - DNA, 18 bp, synthetic construct
  source 1..18: mol_type = other DNA
taatacgaccggctacag

SEQ ID NO: 22754 - DNA, 18 bp, synthetic construct
  source 1..18: mol_type = other DNA
taatacgacgcggtttag

SEQ ID NO: 22755 - DNA, 18 bp, synthetic construct
  source 1..18: mol_type = other DNA
taatacgactaagtcttg

SEQ ID NO: 22756 - DNA, 18 bp, synthetic construct
  source 1..18: mol_type = other DNA
taatacgactcagcactg

SEQ ID NO: 22757 - DNA, 18 bp, synthetic construct
  source 1..18: mol_type = other DNA
taatacgactcccatttg

SEQ ID NO: 22758 - DNA, 18 bp, synthetic construct
  source 1..18: mol_type = other DNA
taatacgactctggattg

SEQ ID NO: 22759 - DNA, 18 bp, synthetic construct
  source 1..18: mol_type = other DNA
taatacgacttactcatg

SEQ ID NO: 22760 - DNA, 18 bp, synthetic construct
  source 1..18: mol_type = other DNA
taatacgatgctctattg

SEQ ID NO: 22761 - DNA, 18 bp, synthetic construct
  source 1..18: mol_type = other DNA
taatacgattctctagtg

SEQ ID NO: 22762 - DNA, 18 bp, synthetic construct
  source 1..18: mol_type = other DNA
taatacgattgacaattg

SEQ ID NO: 22763 - DNA, 18 bp, synthetic construct
  source 1..18: mol_type = other DNA
taatacgcaccactattg

SEQ ID NO: 22764 - DNA, 18 bp, synthetic construct
  source 1..18: mol_type = other DNA
taatacgcctcacagttg

SEQ ID NO: 22765 - DNA, 18 bp, synthetic construct
  source 1..18: mol_type = other DNA
taatacgcctgattattg

SEQ ID NO: 22766 - DNA, 18 bp, synthetic construct
  source 1..18: mol_type = other DNA
taatacggttcattattg

SEQ ID NO: 22767 - DNA, 18 bp, synthetic construct
  source 1..18: mol_type = other DNA
taatacgtctcgcttaag

SEQ ID NO: 22768 - DNA, 18 bp, synthetic construct
  source 1..18: mol_type = other DNA
taatacgtcttaccattg

SEQ ID NO: 22769 - DNA, 18 bp, synthetic construct
  source 1..18: mol_type = other DNA
taatactacctactattg

SEQ ID NO: 22770 - DNA, 18 bp, synthetic construct
  source 1..18: mol_type = other DNA
taatactactcaatcttg

SEQ ID NO: 22771 - DNA, 18 bp, synthetic construct
  source 1..18: mol_type = other DNA
taatactacttactgttg

SEQ ID NO: 22772 - DNA, 18 bp, synthetic construct
  source 1..18: mol_type = other DNA
taatactattgactattg

SEQ ID NO: 22773 - DNA, 18 bp, synthetic construct
  source 1..18: mol_type = other DNA
taatactcctcacttttg

SEQ ID NO: 22774 - DNA, 18 bp, synthetic construct
  source 1..18: mol_type = other DNA
taatagaactcgctacag

SEQ ID NO: 22775 - DNA, 18 bp, synthetic construct
  source 1..18: mol_type = other DNA
taataggactcacaaatg

SEQ ID NO: 22776 - DNA, 18 bp, synthetic construct
  source 1..18: mol_type = other DNA
taataggtcttactattg

SEQ ID NO: 22777 - DNA, 18 bp, synthetic construct
  source 1..18: mol_type = other DNA
taatatgacacaccattg

SEQ ID NO: 22778 - DNA, 18 bp, synthetic construct
  source 1..18: mol_type = other DNA
taatatgacacgctttag

SEQ ID NO: 22779 - DNA, 18 bp, synthetic construct
  source 1..18: mol_type = other DNA
taatattagtcactattg

SEQ ID NO: 22780 - DNA, 18 bp, synthetic construct
  source 1..18: mol_type = other DNA
taatccgaatcattattg

SEQ ID NO: 22781 - DNA, 18 bp, synthetic construct
  source 1..18: mol_type = other DNA
taatcggactcacaattg

SEQ ID NO: 22782 - DNA, 18 bp, synthetic construct
  source 1..18: mol_type = other DNA
taatgcgactcgcaaaag

SEQ ID NO: 22783 - DNA, 18 bp, synthetic construct
  source 1..18: mol_type = other DNA
taatgcgacttaatattg

SEQ ID NO: 22784 - DNA, 18 bp, synthetic construct
  source 1..18: mol_type = other DNA
taattaaactcactaaag

SEQ ID NO: 22785 - DNA, 18 bp, synthetic construct
  source 1..18: mol_type = other DNA
taattagactcagcatag

SEQ ID NO: 22786 - DNA, 18 bp, synthetic construct
  source 1..18: mol_type = other DNA
taattagactccctttag

SEQ ID NO: 22787 - DNA, 18 bp, synthetic construct
  source 1..18: mol_type = other DNA
taattagagtctctatag

SEQ ID NO: 22788 - DNA, 18 bp, synthetic construct
  source 1..18: mol_type = other DNA
taattagattaactatag

SEQ ID NO: 22789 - DNA, 18 bp, synthetic construct
  source 1..18: mol_type = other DNA
taattagtctcactatcg

SEQ ID NO: 22790 - DNA, 18 bp, synthetic construct
  source 1..18: mol_type = other DNA
taattagtcttactatag

SEQ ID NO: 22791 - DNA, 18 bp, synthetic construct
  source 1..18: mol_type = other DNA
taattcaaatccctatag

SEQ ID NO: 22792 - DNA, 18 bp, synthetic construct
  source 1..18: mol_type = other DNA
taattcaacacacaatag

SEQ ID NO: 22793 - DNA, 18 bp, synthetic construct
  source 1..18: mol_type = other DNA
taattcaacctactatag

SEQ ID NO: 22794 - DNA, 18 bp, synthetic construct
  source 1..18: mol_type = other DNA
taattcaactcactgtgg

SEQ ID NO: 22795 - DNA, 18 bp, synthetic construct
  source 1..18: mol_type = other DNA
taattccacacactctag

SEQ ID NO: 22796 - DNA, 18 bp, synthetic construct
  source 1..18: mol_type = other DNA
taattcgaaaaactatag

SEQ ID NO: 22797 - DNA, 18 bp, synthetic construct
  source 1..18: mol_type = other DNA
taattcgaaacactatgg

SEQ ID NO: 22798 - DNA, 18 bp, synthetic construct
  source 1..18: mol_type = other DNA
taattcgaagcactacag

SEQ ID NO: 22799 - DNA, 18 bp, synthetic construct
  source 1..18: mol_type = other DNA
taattcgaatcacagtag

SEQ ID NO: 22800 - DNA, 18 bp, synthetic construct
  source 1..18: mol_type = other DNA
taattcgaatcaccgtag

SEQ ID NO: 22801 - DNA, 18 bp, synthetic construct
  source 1..18: mol_type = other DNA
taattcgacacattatcg

SEQ ID NO: 22802 - DNA, 18 bp, synthetic construct
  source 1..18: mol_type = other DNA
taattcgactcaaaagag

SEQ ID NO: 22803 - DNA, 18 bp, synthetic construct
  source 1..18: mol_type = other DNA
taattcgactcaagttag

SEQ ID NO: 22804 - DNA, 18 bp, synthetic construct
  source 1..18: mol_type = other DNA
taattcgactccttaaag

SEQ ID NO: 22805 - DNA, 18 bp, synthetic construct
  source 1..18: mol_type = other DNA
taattcgactctcagtag

SEQ ID NO: 22806 - DNA, 18 bp, synthetic construct
  source 1..18: mol_type = other DNA
taattcgactctccctag

SEQ ID NO: 22807 - DNA, 18 bp, synthetic construct
  source 1..18: mol_type = other DNA
taattcgactctttacag

SEQ ID NO: 22808 - DNA, 18 bp, synthetic construct
  source 1..18: mol_type = other DNA
taattcgattgaccatag

SEQ ID NO: 22809 - DNA, 18 bp, synthetic construct
  source 1..18: mol_type = other DNA
taattcgccacacgatag

SEQ ID NO: 22810 - DNA, 18 bp, synthetic construct
  source 1..18: mol_type = other DNA
taattcgccacactagag

SEQ ID NO: 22811 - DNA, 18 bp, synthetic construct
  source 1..18: mol_type = other DNA
taattcgtatcactctag

SEQ ID NO: 22812 - DNA, 18 bp, synthetic construct
  source 1..18: mol_type = other DNA
taattcgtcccactctag

SEQ ID NO: 22813 - DNA, 18 bp, synthetic construct
  source 1..18: mol_type = other DNA
taattcgtcttactatgg

SEQ ID NO: 22814 - DNA, 18 bp, synthetic construct
  source 1..18: mol_type = other DNA
taattcgtgacactatag

SEQ ID NO: 22815 - DNA, 18 bp, synthetic construct
  source 1..18: mol_type = other DNA
taattctacccaccatag

SEQ ID NO: 22816 - DNA, 18 bp, synthetic construct
  source 1..18: mol_type = other DNA
taattctactaactagag

SEQ ID NO: 22817 - DNA, 18 bp, synthetic construct
  source 1..18: mol_type = other DNA
taattctattcacaatag

SEQ ID NO: 22818 - DNA, 18 bp, synthetic construct
  source 1..18: mol_type = other DNA
taattggactcactctcg

SEQ ID NO: 22819 - DNA, 18 bp, synthetic construct
  source 1..18: mol_type = other DNA
taatttgactcactaagg

SEQ ID NO: 22820 - DNA, 18 bp, synthetic construct
  source 1..18: mol_type = other DNA
taatttgcctcactttag

SEQ ID NO: 22821 - DNA, 18 bp, synthetic construct
  source 1..18: mol_type = other DNA
taatttgcctgactatag

SEQ ID NO: 22822 - DNA, 18 bp, synthetic construct
  source 1..18: mol_type = other DNA
tacaacgacacactattg

SEQ ID NO: 22823 - DNA, 18 bp, synthetic construct
  source 1..18: mol_type = other DNA
tacaacgactcattattg

SEQ ID NO: 22824 - DNA, 18 bp, synthetic construct
  source 1..18: mol_type = other DNA
tactacgactcgcttcag

SEQ ID NO: 22825 - DNA, 18 bp, synthetic construct
  source 1..18: mol_type = other DNA
tactactactctctattg

SEQ ID NO: 22826 - DNA, 18 bp, synthetic construct
  source 1..18: mol_type = other DNA
tactaggactcgcaatag

SEQ ID NO: 22827 - DNA, 18 bp, synthetic construct
  source 1..18: mol_type = other DNA
tacttcgactcactggag

SEQ ID NO: 22828 - DNA, 18 bp, synthetic construct
  source 1..18: mol_type = other DNA
tacttcgagtcactacag

SEQ ID NO: 22829 - DNA, 18 bp, synthetic construct
  source 1..18: mol_type = other DNA
tacttctactcactatcg

SEQ ID NO: 22830 - DNA, 18 bp, synthetic construct
  source 1..18: mol_type = other DNA
tagctcgacacactatag

SEQ ID NO: 22831 - DNA, 18 bp, synthetic construct
  source 1..18: mol_type = other DNA
tagttcgcctcactaaag

SEQ ID NO: 22832 - DNA, 18 bp, synthetic construct
  source 1..18: mol_type = other DNA
tattacgactcacttgtg

SEQ ID NO: 22833 - DNA, 18 bp, synthetic construct
  source 1..18: mol_type = other DNA
tattacgactcagtcttg

SEQ ID NO: 22834 - DNA, 18 bp, synthetic construct
  source 1..18: mol_type = other DNA
tattacgacttattattg

SEQ ID NO: 22835 - DNA, 18 bp, synthetic construct
  source 1..18: mol_type = other DNA
tattacgtctcgttatag

SEQ ID NO: 22836 - DNA, 18 bp, synthetic construct
  source 1..18: mol_type = other DNA
tattatgactcgcaatag

SEQ ID NO: 22837 - DNA, 18 bp, synthetic construct
  source 1..18: mol_type = other DNA
tattgctactcactattg

SEQ ID NO: 22838 - DNA, 18 bp, synthetic construct
  source 1..18: mol_type = other DNA
tatttccagtcactatag

SEQ ID NO: 22839 - DNA, 18 bp, synthetic construct
  source 1..18: mol_type = other DNA
tcaatcgacgcactatag

SEQ ID NO: 22840 - DNA, 18 bp, synthetic construct
  source 1..18: mol_type = other DNA
tcactcgcctcactatag

SEQ ID NO: 22841 - DNA, 18 bp, synthetic construct
  source 1..18: mol_type = other DNA
tcatacgtcacgctatag

SEQ ID NO: 22842 - DNA, 18 bp, synthetic construct
  source 1..18: mol_type = other DNA
tcattcgaatcaatatag

SEQ ID NO: 22843 - DNA, 18 bp, synthetic construct
  source 1..18: mol_type = other DNA
tcattcgacagactatag

SEQ ID NO: 22844 - DNA, 18 bp, synthetic construct
  source 1..18: mol_type = other DNA
tcatttgacttactatag

SEQ ID NO: 22845 - DNA, 18 bp, synthetic construct
  source 1..18: mol_type = other DNA
tcctactactcactattg

SEQ ID NO: 22846 - DNA, 18 bp, synthetic construct
  source 1..18: mol_type = other DNA
tctttcgactcactagag

SEQ ID NO: 22847 - DNA, 18 bp, synthetic construct
  source 1..18: mol_type = other DNA
tgaaacgactcacaattg

SEQ ID NO: 22848 - DNA, 18 bp, synthetic construct
  source 1..18: mol_type = other DNA
tgatacgacacacaattg

SEQ ID NO: 22849 - DNA, 18 bp, synthetic construct
  source 1..18: mol_type = other DNA
tgatacgacaccctattg

SEQ ID NO: 22850 - DNA, 18 bp, synthetic construct
  source 1..18: mol_type = other DNA
tgatacgactctgtattg

SEQ ID NO: 22851 - DNA, 18 bp, synthetic construct
  source 1..18: mol_type = other DNA
tgatacgattaactattg

SEQ ID NO: 22852 - DNA, 18 bp, synthetic construct
  source 1..18: mol_type = other DNA
tgatacgattcacgattg

SEQ ID NO: 22853 - DNA, 18 bp, synthetic construct
  source 1..18: mol_type = other DNA
tgatacgtcttactattg

SEQ ID NO: 22854 - DNA, 18 bp, synthetic construct
  source 1..18: mol_type = other DNA
tgatccgactgactattg

SEQ ID NO: 22855 - DNA, 18 bp, synthetic construct
  source 1..18: mol_type = other DNA
tgatccgtctcactattg

SEQ ID NO: 22856 - DNA, 18 bp, synthetic construct
  source 1..18: mol_type = other DNA
tgatgcgactcattattg

SEQ ID NO: 22857 - DNA, 18 bp, synthetic construct
  source 1..18: mol_type = other DNA
tgattcgactgagtatag

SEQ ID NO: 22858 - DNA, 18 bp, synthetic construct
  source 1..18: mol_type = other DNA
tgattctactcattatag

SEQ ID NO: 22859 - DNA, 18 bp, synthetic construct
  source 1..18: mol_type = other DNA
tgcatcgactcactatag

SEQ ID NO: 22860 - DNA, 18 bp, synthetic construct
  source 1..18: mol_type = other DNA
tgttccgactcactattg

SEQ ID NO: 22861 - DNA, 18 bp, synthetic construct
  source 1..18: mol_type = other DNA
ttatacaactcaccattg

SEQ ID NO: 22862 - DNA, 18 bp, synthetic construct
  source 1..18: mol_type = other DNA
ttatacgacacactagtg

SEQ ID NO: 22863 - DNA, 18 bp, synthetic construct
  source 1..18: mol_type = other DNA
ttatacgacacgctatcg

SEQ ID NO: 22864 - DNA, 18 bp, synthetic construct
  source 1..18: mol_type = other DNA
ttatacgactcactcctg

SEQ ID NO: 22865 - DNA, 18 bp, synthetic construct
  source 1..18: mol_type = other DNA
ttataggattcactattg

SEQ ID NO: 22866 - DNA, 18 bp, synthetic construct
  source 1..18: mol_type = other DNA
ttatccgactcgctttag

SEQ ID NO: 22867 - DNA, 18 bp, synthetic construct
  source 1..18: mol_type = other DNA
ttatgggactcactattg

SEQ ID NO: 22868 - DNA, 18 bp, synthetic construct
  source 1..18: mol_type = other DNA
ttattagactcactatcg

SEQ ID NO: 22869 - DNA, 18 bp, synthetic construct
  source 1..18: mol_type = other DNA
ttattagactcactctag

SEQ ID NO: 22870 - DNA, 18 bp, synthetic construct
  source 1..18: mol_type = other DNA
ttattcaagtcactatag

SEQ ID NO: 22871 - DNA, 18 bp, synthetic construct
  source 1..18: mol_type = other DNA
ttattcgacacactacag

SEQ ID NO: 22872 - DNA, 18 bp, synthetic construct
  source 1..18: mol_type = other DNA
ttattcgagacactatag

SEQ ID NO: 22873 - DNA, 18 bp, synthetic construct
  source 1..18: mol_type = other DNA
ttattcggatcactatag

SEQ ID NO: 22874 - DNA, 18 bp, synthetic construct
  source 1..18: mol_type = other DNA
ttattcgtctcactctag

SEQ ID NO: 22875 - DNA, 18 bp, synthetic construct
  source 1..18: mol_type = other DNA
ttctacgacttactattg

SEQ ID NO: 22876 - DNA, 18 bp, synthetic construct
  source 1..18: mol_type = other DNA
aaaaatgactcactaaag

SEQ ID NO: 22877 - DNA, 18 bp, synthetic construct
  source 1..18: mol_type = other DNA
aaaagcggctcactatag

SEQ ID NO: 22878 - DNA, 18 bp, synthetic construct
  source 1..18: mol_type = other DNA
aaacacgactaactctag

SEQ ID NO: 22879 - DNA, 18 bp, synthetic construct
  source 1..18: mol_type = other DNA
aaacacgattcactttag

SEQ ID NO: 22880 - DNA, 18 bp, synthetic construct
  source 1..18: mol_type = other DNA
aaataacactcacaatag

SEQ ID NO: 22881 - DNA, 18 bp, synthetic construct
  source 1..18: mol_type = other DNA
aaataagaaccactatag

SEQ ID NO: 22882 - DNA, 18 bp, synthetic construct
  source 1..18: mol_type = other DNA
aaataagacgctctatag

SEQ ID NO: 22883 - DNA, 18 bp, synthetic construct
  source 1..18: mol_type = other DNA
aaatacaaatcactatcg

SEQ ID NO: 22884 - DNA, 18 bp, synthetic construct
  source 1..18: mol_type = other DNA
aaatacaactaactatgg

SEQ ID NO: 22885 - DNA, 18 bp, synthetic construct
  source 1..18: mol_type = other DNA
aaatacagctcacaatag

SEQ ID NO: 22886 - DNA, 18 bp, synthetic construct
  source 1..18: mol_type = other DNA
aaataccaccaactatag

SEQ ID NO: 22887 - DNA, 18 bp, synthetic construct
  source 1..18: mol_type = other DNA
aaataccactcactgaag

SEQ ID NO: 22888 - DNA, 18 bp, synthetic construct
  source 1..18: mol_type = other DNA
aaatacgactctccatgg

SEQ ID NO: 22889 - DNA, 18 bp, synthetic construct
  source 1..18: mol_type = other DNA
aaatacgactgacttaag

SEQ ID NO: 22890 - DNA, 18 bp, synthetic construct
  source 1..18: mol_type = other DNA
aaatacgactgagtaaag

SEQ ID NO: 22891 - DNA, 18 bp, synthetic construct
  source 1..18: mol_type = other DNA
aaatacgacttactttgg

SEQ ID NO: 22892 - DNA, 18 bp, synthetic construct
  source 1..18: mol_type = other DNA
aaatacgcatcaatatag

SEQ ID NO: 22893 - DNA, 18 bp, synthetic construct
  source 1..18: mol_type = other DNA
aaatactacccactaaag

SEQ ID NO: 22894 - DNA, 18 bp, synthetic construct
  source 1..18: mol_type = other DNA
aaataggactaactttag

SEQ ID NO: 22895 - DNA, 18 bp, synthetic construct
  source 1..18: mol_type = other DNA
aaataggactcaatctag

SEQ ID NO: 22896 - DNA, 18 bp, synthetic construct
  source 1..18: mol_type = other DNA
aaataggactcaccaaag

SEQ ID NO: 22897 - DNA, 18 bp, synthetic construct
  source 1..18: mol_type = other DNA
aaatatcactaactatag

SEQ ID NO: 22898 - DNA, 18 bp, synthetic construct
  source 1..18: mol_type = other DNA
aaatatgactcattctag

SEQ ID NO: 22899 - DNA, 18 bp, synthetic construct
  source 1..18: mol_type = other DNA
aaatatgattcaatatag

SEQ ID NO: 22900 - DNA, 18 bp, synthetic construct
  source 1..18: mol_type = other DNA
aaatattactcactacag

SEQ ID NO: 22901 - DNA, 18 bp, synthetic construct
  source 1..18: mol_type = other DNA
aaatccgacaaactatag

SEQ ID NO: 22902 - DNA, 18 bp, synthetic construct
  source 1..18: mol_type = other DNA
aaatccgtctcactctag

SEQ ID NO: 22903 - DNA, 18 bp, synthetic construct
  source 1..18: mol_type = other DNA
aaatgcgtctctctatag

SEQ ID NO: 22904 - DNA, 18 bp, synthetic construct
  source 1..18: mol_type = other DNA
aactacgactcattttag

SEQ ID NO: 22905 - DNA, 18 bp, synthetic construct
  source 1..18: mol_type = other DNA
aactccgacacactatag

SEQ ID NO: 22906 - DNA, 18 bp, synthetic construct
  source 1..18: mol_type = other DNA
aagtacaactcacaatag

SEQ ID NO: 22907 - DNA, 18 bp, synthetic construct
  source 1..18: mol_type = other DNA
aattaagcctcactatag

SEQ ID NO: 22908 - DNA, 18 bp, synthetic construct
  source 1..18: mol_type = other DNA
aattacaacccactatag

SEQ ID NO: 22909 - DNA, 18 bp, synthetic construct
  source 1..18: mol_type = other DNA
aattaccacgcactatag

SEQ ID NO: 22910 - DNA, 18 bp, synthetic construct
  source 1..18: mol_type = other DNA
aattacgtcgcactatag

SEQ ID NO: 22911 - DNA, 18 bp, synthetic construct
  source 1..18: mol_type = other DNA
aattaggactcattatag

SEQ ID NO: 22912 - DNA, 18 bp, synthetic construct
  source 1..18: mol_type = other DNA
aattgcgactcacgatag

SEQ ID NO: 22913 - DNA, 18 bp, synthetic construct
  source 1..18: mol_type = other DNA
acataggactcacgatag

SEQ ID NO: 22914 - DNA, 18 bp, synthetic construct
  source 1..18: mol_type = other DNA
acatccgactcactaaag

SEQ ID NO: 22915 - DNA, 18 bp, synthetic construct
  source 1..18: mol_type = other DNA
agatacgacttactttag

SEQ ID NO: 22916 - DNA, 18 bp, synthetic construct
  source 1..18: mol_type = other DNA
agcaacgactcactatag

SEQ ID NO: 22917 - DNA, 18 bp, synthetic construct
  source 1..18: mol_type = other DNA
atacacgacgcactatag

SEQ ID NO: 22918 - DNA, 18 bp, synthetic construct
  source 1..18: mol_type = other DNA
atatacgacccattatag

SEQ ID NO: 22919 - DNA, 18 bp, synthetic construct
  source 1..18: mol_type = other DNA
atatacgactcactctgg

SEQ ID NO: 22920 - DNA, 18 bp, synthetic construct
  source 1..18: mol_type = other DNA
atatacgactcccgatag

SEQ ID NO: 22921 - DNA, 18 bp, synthetic construct
  source 1..18: mol_type = other DNA
atatacgatgcactatag

SEQ ID NO: 22922 - DNA, 18 bp, synthetic construct
  source 1..18: mol_type = other DNA
atatccgactcaatatag

SEQ ID NO: 22923 - DNA, 18 bp, synthetic construct
  source 1..18: mol_type = other DNA
atatgcgactcaatatag

SEQ ID NO: 22924 - DNA, 18 bp, synthetic construct
  source 1..18: mol_type = other DNA
caaaacgactcagtctag

SEQ ID NO: 22925 - DNA, 18 bp, synthetic construct
  source 1..18: mol_type = other DNA
caaaactacccactatag

SEQ ID NO: 22926 - DNA, 18 bp, synthetic construct
  source 1..18: mol_type = other DNA
caagatgactcactttag

SEQ ID NO: 22927 - DNA, 18 bp, synthetic construct
  source 1..18: mol_type = other DNA
caatacaacacactctag

SEQ ID NO: 22928 - DNA, 18 bp, synthetic construct
  source 1..18: mol_type = other DNA
caatacaactaattatag

SEQ ID NO: 22929 - DNA, 18 bp, synthetic construct
  source 1..18: mol_type = other DNA
caatacgacaaactaaag

SEQ ID NO: 22930 - DNA, 18 bp, synthetic construct
  source 1..18: mol_type = other DNA
caatacgacacactaacg

SEQ ID NO: 22931 - DNA, 18 bp, synthetic construct
  source 1..18: mol_type = other DNA
caatacgattcactaagg

SEQ ID NO: 22932 - DNA, 18 bp, synthetic construct
  source 1..18: mol_type = other DNA
caatacgattccttatag

SEQ ID NO: 22933 - DNA, 18 bp, synthetic construct
  source 1..18: mol_type = other DNA
caatacggctcattatgg

SEQ ID NO: 22934 - DNA, 18 bp, synthetic construct
  source 1..18: mol_type = other DNA
caatacgtcttactatcg

SEQ ID NO: 22935 - DNA, 18 bp, synthetic construct
  source 1..18: mol_type = other DNA
caatactacacactaaag

SEQ ID NO: 22936 - DNA, 18 bp, synthetic construct
  source 1..18: mol_type = other DNA
caatactactcattctag

SEQ ID NO: 22937 - DNA, 18 bp, synthetic construct
  source 1..18: mol_type = other DNA
caatatgactcaataaag

SEQ ID NO: 22938 - DNA, 18 bp, synthetic construct
  source 1..18: mol_type = other DNA
caatatgactcactttcg

SEQ ID NO: 22939 - DNA, 18 bp, synthetic construct
  source 1..18: mol_type = other DNA
caatccgactctgtatag

SEQ ID NO: 22940 - DNA, 18 bp, synthetic construct
  source 1..18: mol_type = other DNA
caatgcgccccactatag

SEQ ID NO: 22941 - DNA, 18 bp, synthetic construct
  source 1..18: mol_type = other DNA
caatgcgtctcaatatag

SEQ ID NO: 22942 - DNA, 18 bp, synthetic construct
  source 1..18: mol_type = other DNA
caatgctactctctatag

SEQ ID NO: 22943 - DNA, 18 bp, synthetic construct
  source 1..18: mol_type = other DNA
cactaagactcactagag

SEQ ID NO: 22944 - DNA, 18 bp, synthetic construct
  source 1..18: mol_type = other DNA
cactatgactcactttag

SEQ ID NO: 22945 - DNA, 18 bp, synthetic construct
  source 1..18: mol_type = other DNA
cagaacgacttactatag

SEQ ID NO: 22946 - DNA, 18 bp, synthetic construct
  source 1..18: mol_type = other DNA
cagtacgaatcacaatag

SEQ ID NO: 22947 - DNA, 18 bp, synthetic construct
  source 1..18: mol_type = other DNA
cagtacgacaaactatag

SEQ ID NO: 22948 - DNA, 18 bp, synthetic construct
  source 1..18: mol_type = other DNA
cataacgattcactatag

SEQ ID NO: 22949 - DNA, 18 bp, synthetic construct
  source 1..18: mol_type = other DNA
cattacgacacacgatag

SEQ ID NO: 22950 - DNA, 18 bp, synthetic construct
  source 1..18: mol_type = other DNA
cattacgactctctgtag

SEQ ID NO: 22951 - DNA, 18 bp, synthetic construct
  source 1..18: mol_type = other DNA
cattacgatacactatag

SEQ ID NO: 22952 - DNA, 18 bp, synthetic construct
  source 1..18: mol_type = other DNA
cattccgactaactatag

SEQ ID NO: 22953 - DNA, 18 bp, synthetic construct
  source 1..18: mol_type = other DNA
cattgcgagtcactatag

SEQ ID NO: 22954 - DNA, 18 bp, synthetic construct
  source 1..18: mol_type = other DNA
ccatacaagtcactatag

SEQ ID NO: 22955 - DNA, 18 bp, synthetic construct
  source 1..18: mol_type = other DNA
ccatacgacacactaaag

SEQ ID NO: 22956 - DNA, 18 bp, synthetic construct
  source 1..18: mol_type = other DNA
ccgtacgactcattatag

SEQ ID NO: 22957 - DNA, 18 bp, synthetic construct
  source 1..18: mol_type = other DNA
cgagaccactcactatag

SEQ ID NO: 22958 - DNA, 18 bp, synthetic construct
  source 1..18: mol_type = other DNA
cgcaacgactcactatag

SEQ ID NO: 22959 - DNA, 18 bp, synthetic construct
  source 1..18: mol_type = other DNA
cgctacgagtcactatag

SEQ ID NO: 22960 - DNA, 18 bp, synthetic construct
  source 1..18: mol_type = other DNA
ctatacgactcaatagag

SEQ ID NO: 22961 - DNA, 18 bp, synthetic construct
  source 1..18: mol_type = other DNA
ctatacgactcattaaag

SEQ ID NO: 22962 - DNA, 18 bp, synthetic construct
  source 1..18: mol_type = other DNA
ctatacgccccactatag

SEQ ID NO: 22963 - DNA, 18 bp, synthetic construct
  source 1..18: mol_type = other DNA
ctataggacttactatag

SEQ ID NO: 22964 - DNA, 18 bp, synthetic construct
  source 1..18: mol_type = other DNA
ctgtacgactcactttag

SEQ ID NO: 22965 - DNA, 18 bp, synthetic construct
  source 1..18: mol_type = other DNA
gaatacccctcaatatag

SEQ ID NO: 22966 - DNA, 18 bp, synthetic construct
  source 1..18: mol_type = other DNA
gaatacgaatatctatag

SEQ ID NO: 22967 - DNA, 18 bp, synthetic construct
  source 1..18: mol_type = other DNA
gaatacgactctcaaaag

SEQ ID NO: 22968 - DNA, 18 bp, synthetic construct
  source 1..18: mol_type = other DNA
gaatagaactcactaaag

SEQ ID NO: 22969 - DNA, 18 bp, synthetic construct
  source 1..18: mol_type = other DNA
gactactgctcactatag

SEQ ID NO: 22970 - DNA, 18 bp, synthetic construct
  source 1..18: mol_type = other DNA
gattaccactcacaatag

SEQ ID NO: 22971 - DNA, 18 bp, synthetic construct
  source 1..18: mol_type = other DNA
gattacgactatctatag

SEQ ID NO: 22972 - DNA, 18 bp, synthetic construct
  source 1..18: mol_type = other DNA
gattacgtgtcactatag

SEQ ID NO: 22973 - DNA, 18 bp, synthetic construct
  source 1..18: mol_type = other DNA
gattaggagtcactatag

SEQ ID NO: 22974 - DNA, 18 bp, synthetic construct
  source 1..18: mol_type = other DNA
gcataagacttactatag

SEQ ID NO: 22975 - DNA, 18 bp, synthetic construct
  source 1..18: mol_type = other DNA
gcatacgactaactacag

SEQ ID NO: 22976 - DNA, 18 bp, synthetic construct
  source 1..18: mol_type = other DNA
gcatacgattcacaatag

SEQ ID NO: 22977 - DNA, 18 bp, synthetic construct
  source 1..18: mol_type = other DNA
ggatacgactatctatag

SEQ ID NO: 22978 - DNA, 18 bp, synthetic construct
  source 1..18: mol_type = other DNA
gtatacgaatcactctag

SEQ ID NO: 22979 - DNA, 18 bp, synthetic construct
  source 1..18: mol_type = other DNA
gtatacgtctctctatag

SEQ ID NO: 22980 - DNA, 18 bp, synthetic construct
  source 1..18: mol_type = other DNA
gtatatgactaactatag

SEQ ID NO: 22981 - DNA, 18 bp, synthetic construct
  source 1..18: mol_type = other DNA
taaaacaactaacgatag

SEQ ID NO: 22982 - DNA, 18 bp, synthetic construct
  source 1..18: mol_type = other DNA
taaaacctttcactatag

SEQ ID NO: 22983 - DNA, 18 bp, synthetic construct
  source 1..18: mol_type = other DNA
taaaacgaaccactagag

SEQ ID NO: 22984 - DNA, 18 bp, synthetic construct
  source 1..18: mol_type = other DNA
taaaacgaatcacttcag

SEQ ID NO: 22985 - DNA, 18 bp, synthetic construct
  source 1..18: mol_type = other DNA
taaaacgaatcagtctag

SEQ ID NO: 22986 - DNA, 18 bp, synthetic construct
  source 1..18: mol_type = other DNA
taaaacgactcaccaagg

SEQ ID NO: 22987 - DNA, 18 bp, synthetic construct
  source 1..18: mol_type = other DNA
taaaacgactcactcccg

SEQ ID NO: 22988 - DNA, 18 bp, synthetic construct
  source 1..18: mol_type = other DNA
taaaacgactctatagag

SEQ ID NO: 22989 - DNA, 18 bp, synthetic construct
  source 1..18: mol_type = other DNA
taaaacgactctgtgtag

SEQ ID NO: 22990 - DNA, 18 bp, synthetic construct
  source 1..18: mol_type = other DNA
taaaacgactctttctag

SEQ ID NO: 22991 - DNA, 18 bp, synthetic construct
  source 1..18: mol_type = other DNA
taaaacgacttactccag

SEQ ID NO: 22992 - DNA, 18 bp, synthetic construct
  source 1..18: mol_type = other DNA
taaaacgattcactttcg

SEQ ID NO: 22993 - DNA, 18 bp, synthetic construct
  source 1..18: mol_type = other DNA
taaaacgcctaactacag

SEQ ID NO: 22994 - DNA, 18 bp, synthetic construct
  source 1..18: mol_type = other DNA
taaaacgcctcataatag

SEQ ID NO: 22995 - DNA, 18 bp, synthetic construct
  source 1..18: mol_type = other DNA
taaaacgcctccccatag

SEQ ID NO: 22996 - DNA, 18 bp, synthetic construct
  source 1..18: mol_type = other DNA
taaaacgcctctctatgg

SEQ ID NO: 22997 - DNA, 18 bp, synthetic construct
  source 1..18: mol_type = other DNA
taaaacgcttcactaaag

SEQ ID NO: 22998 - DNA, 18 bp, synthetic construct
  source 1..18: mol_type = other DNA
taaaacgtatcactaaag

SEQ ID NO: 22999 - DNA, 18 bp, synthetic construct
  source 1..18: mol_type = other DNA
taaaacgtcgcactttag

SEQ ID NO: 23000 - DNA, 18 bp, synthetic construct
  source 1..18: mol_type = other DNA
taaaacgtctgactttag

SEQ ID NO: 23001 - DNA, 18 bp, synthetic construct
  source 1..18: mol_type = other DNA
taaaactaatcattatag

SEQ ID NO: 23002 - DNA, 18 bp, synthetic construct
  source 1..18: mol_type = other DNA
taaaactactcattatcg

SEQ ID NO: 23003 - DNA, 18 bp, synthetic construct
  source 1..18: mol_type = other DNA
taaaactactccccatag

SEQ ID NO: 23004 - DNA, 18 bp, synthetic construct
  source 1..18: mol_type = other DNA
taaaacttctcactatcg

SEQ ID NO: 23005 - DNA, 18 bp, synthetic construct
  source 1..18: mol_type = other DNA
taaaagcagtcactatag

SEQ ID NO: 23006 - DNA, 18 bp, synthetic construct
  source 1..18: mol_type = other DNA
taaaaggactctctacag

SEQ ID NO: 23007 - DNA, 18 bp, synthetic construct
  source 1..18: mol_type = other DNA
taaaaggactgactaaag

SEQ ID NO: 23008 - DNA, 18 bp, synthetic construct
  source 1..18: mol_type = other DNA
taaaatgactcactaacg

SEQ ID NO: 23009 - DNA, 18 bp, synthetic construct
  source 1..18: mol_type = other DNA
taaaatgacttactagag

SEQ ID NO: 23010 - DNA, 18 bp, synthetic construct
  source 1..18: mol_type = other DNA
taaaatgcatcactatag

SEQ ID NO: 23011 - DNA, 18 bp, synthetic construct
  source 1..18: mol_type = other DNA
taaaatgtctcactagag

SEQ ID NO: 23012 - DNA, 18 bp, synthetic construct
  source 1..18: mol_type = other DNA
taaaatgtctcactatgg

SEQ ID NO: 23013 - DNA, 18 bp, synthetic construct
  source 1..18: mol_type = other DNA
taaaccgagtcactaaag

SEQ ID NO: 23014 - DNA, 18 bp, synthetic construct
  source 1..18: mol_type = other DNA
taaaccggatcactatag

SEQ ID NO: 23015 - DNA, 18 bp, synthetic construct
  source 1..18: mol_type = other DNA
taaacctactcactgtag

SEQ ID NO: 23016 - DNA, 18 bp, synthetic construct
  source 1..18: mol_type = other DNA
taaagcaactcattatag

SEQ ID NO: 23017 - DNA, 18 bp, synthetic construct
  source 1..18: mol_type = other DNA
taaagcgactcaccctag

SEQ ID NO: 23018 - DNA, 18 bp, synthetic construct
  source 1..18: mol_type = other DNA
taaagtgtctcactatag

SEQ ID NO: 23019 - DNA, 18 bp, synthetic construct
  source 1..18: mol_type = other DNA
taacaaaacacactatag

SEQ ID NO: 23020 - DNA, 18 bp, synthetic construct
  source 1..18: mol_type = other DNA
taacaagacttactacag

SEQ ID NO: 23021 - DNA, 18 bp, synthetic construct
  source 1..18: mol_type = other DNA
taacacatctcactacag

SEQ ID NO: 23022 - DNA, 18 bp, synthetic construct
  source 1..18: mol_type = other DNA
taacacgacacattagag

SEQ ID NO: 23023 - DNA, 18 bp, synthetic construct
  source 1..18: mol_type = other DNA
taacacgacttaccatgg

SEQ ID NO: 23024 - DNA, 18 bp, synthetic construct
  source 1..18: mol_type = other DNA
taacacggctcccaatag

SEQ ID NO: 23025 - DNA, 18 bp, synthetic construct
  source 1..18: mol_type = other DNA
taacacgtcccactttag

SEQ ID NO: 23026 - DNA, 18 bp, synthetic construct
  source 1..18: mol_type = other DNA
taacacgtctcaatatgg

SEQ ID NO: 23027 - DNA, 18 bp, synthetic construct
  source 1..18: mol_type = other DNA
taacacgtgtcactatcg

SEQ ID NO: 23028 - DNA, 18 bp, synthetic construct
  source 1..18: mol_type = other DNA
taacacgtttcaatatag

SEQ ID NO: 23029 - DNA, 18 bp, synthetic construct
  source 1..18: mol_type = other DNA
taacactacgctctatag

SEQ ID NO: 23030 - DNA, 18 bp, synthetic construct
  source 1..18: mol_type = other DNA
taacactactaactaaag

SEQ ID NO: 23031 - DNA, 18 bp, synthetic construct
  source 1..18: mol_type = other DNA
taacagtactcactatcg

SEQ ID NO: 23032 - DNA, 18 bp, synthetic construct
  source 1..18: mol_type = other DNA
taacatgactcacactag

SEQ ID NO: 23033 - DNA, 18 bp, synthetic construct
  source 1..18: mol_type = other DNA
taaccgtactcactatag

SEQ ID NO: 23034 - DNA, 18 bp, synthetic construct
  source 1..18: mol_type = other DNA
taacgcgaatcagtatag

SEQ ID NO: 23035 - DNA, 18 bp, synthetic construct
  source 1..18: mol_type = other DNA
taagaagaataactatag

SEQ ID NO: 23036 - DNA, 18 bp, synthetic construct
  source 1..18: mol_type = other DNA
taagacctctcacgatag

SEQ ID NO: 23037 - DNA, 18 bp, synthetic construct
  source 1..18: mol_type = other DNA
taagacgaatcactgtcg

SEQ ID NO: 23038 - DNA, 18 bp, synthetic construct
  source 1..18: mol_type = other DNA
taagacgaccctctaaag

SEQ ID NO: 23039 - DNA, 18 bp, synthetic construct
  source 1..18: mol_type = other DNA
taagacgacttactttcg

SEQ ID NO: 23040 - DNA, 18 bp, synthetic construct
  source 1..18: mol_type = other DNA
taagacgaggcattatag

SEQ ID NO: 23041 - DNA, 18 bp, synthetic construct
  source 1..18: mol_type = other DNA
taagacgtctcattaaag

SEQ ID NO: 23042 - DNA, 18 bp, synthetic construct
  source 1..18: mol_type = other DNA
taagacgtttcacaatag

SEQ ID NO: 23043 - DNA, 18 bp, synthetic construct
  source 1..18: mol_type = other DNA
taagaggacaaactatag

SEQ ID NO: 23044 - DNA, 18 bp, synthetic construct
  source 1..18: mol_type = other DNA
taagccgactctcaatag

SEQ ID NO: 23045 - DNA, 18 bp, synthetic construct
  source 1..18: mol_type = other DNA
taataaaacccacaatag

SEQ ID NO: 23046 - DNA, 18 bp, synthetic construct
  source 1..18: mol_type = other DNA
taataacacactctatag

SEQ ID NO: 23047 - DNA, 18 bp, synthetic construct
  source 1..18: mol_type = other DNA
taataacacgcaatatag

SEQ ID NO: 23048 - DNA, 18 bp, synthetic construct
  source 1..18: mol_type = other DNA
taataacactcaatttag

SEQ ID NO: 23049 - DNA, 18 bp, synthetic construct
  source 1..18: mol_type = other DNA
taataacactctctatcg

SEQ ID NO: 23050 - DNA, 18 bp, synthetic construct
  source 1..18: mol_type = other DNA
taataagactatctatcg

SEQ ID NO: 23051 - DNA, 18 bp, synthetic construct
  source 1..18: mol_type = other DNA
taataagactcaatctcg

SEQ ID NO: 23052 - DNA, 18 bp, synthetic construct
  source 1..18: mol_type = other DNA
taataagactcacctaag

SEQ ID NO: 23053 - DNA, 18 bp, synthetic construct
  source 1..18: mol_type = other DNA
taataagactccataaag

SEQ ID NO: 23054 - DNA, 18 bp, synthetic construct
  source 1..18: mol_type = other DNA
taataagacttcgtatag

SEQ ID NO: 23055 - DNA, 18 bp, synthetic construct
  source 1..18: mol_type = other DNA
taataagagtctatatag

SEQ ID NO: 23056 - DNA, 18 bp, synthetic construct
  source 1..18: mol_type = other DNA
taataagatcaactatag

SEQ ID NO: 23057 - DNA, 18 bp, synthetic construct
  source 1..18: mol_type = other DNA
taataagatttactatgg

SEQ ID NO: 23058 - DNA, 18 bp, synthetic construct
  source 1..18: mol_type = other DNA
taataagcccctctatag

SEQ ID NO: 23059 - DNA, 18 bp, synthetic construct
  source 1..18: mol_type = other DNA
taataagtctcactaagg

SEQ ID NO: 23060 - DNA, 18 bp, synthetic construct
  source 1..18: mol_type = other DNA
taataagtctctctatcg

SEQ ID NO: 23061 - DNA, 18 bp, synthetic construct
  source 1..18: mol_type = other DNA
taataatactcactttcg

SEQ ID NO: 23062 - DNA, 18 bp, synthetic construct
  source 1..18: mol_type = other DNA
taataatactcattgtag

SEQ ID NO: 23063 - DNA, 18 bp, synthetic construct
  source 1..18: mol_type = other DNA
taataatactctccatag

SEQ ID NO: 23064 - DNA, 18 bp, synthetic construct
  source 1..18: mol_type = other DNA
taataatattcactttag

SEQ ID NO: 23065 - DNA, 18 bp, synthetic construct
  source 1..18: mol_type = other DNA
taataatcttcactatag

SEQ ID NO: 23066 - DNA, 18 bp, synthetic construct
  source 1..18: mol_type = other DNA
taataatgctcactctag

SEQ ID NO: 23067 - DNA, 18 bp, synthetic construct
  source 1..18: mol_type = other DNA
taatacaaactactatag

SEQ ID NO: 23068 - DNA, 18 bp, synthetic construct
  source 1..18: mol_type = other DNA
taatacaaataaatatag

SEQ ID NO: 23069 - DNA, 18 bp, synthetic construct
  source 1..18: mol_type = other DNA
taatacaaatcacaatcg

SEQ ID NO: 23070 - DNA, 18 bp, synthetic construct
  source 1..18: mol_type = other DNA
taatacaacgctctatgg

SEQ ID NO: 23071 - DNA, 18 bp, synthetic construct
  source 1..18: mol_type = other DNA
taatacaactcagaatcg

SEQ ID NO: 23072 - DNA, 18 bp, synthetic construct
  source 1..18: mol_type = other DNA
taatacaactcatttgag

SEQ ID NO: 23073 - DNA, 18 bp, synthetic construct
  source 1..18: mol_type = other DNA
taatacaagtcaataaag

SEQ ID NO: 23074 - DNA, 18 bp, synthetic construct
  source 1..18: mol_type = other DNA
taatacaattcaatacag

SEQ ID NO: 23075 - DNA, 18 bp, synthetic construct
  source 1..18: mol_type = other DNA
taatacacctcattaaag

SEQ ID NO: 23076 - DNA, 18 bp, synthetic construct
  source 1..18: mol_type = other DNA
taatacagttctctatag

SEQ ID NO: 23077 - DNA, 18 bp, synthetic construct
  source 1..18: mol_type = other DNA
taatacatatcaatatag

SEQ ID NO: 23078 - DNA, 18 bp, synthetic construct
  source 1..18: mol_type = other DNA
taatacatttcagtatag

SEQ ID NO: 23079 - DNA, 18 bp, synthetic construct
  source 1..18: mol_type = other DNA
taatacattttactatag

SEQ ID NO: 23080 - DNA, 18 bp, synthetic construct
  source 1..18: mol_type = other DNA
taataccacactctttag

SEQ ID NO: 23081 - DNA, 18 bp, synthetic construct
  source 1..18: mol_type = other DNA
taataccactcatttaag

SEQ ID NO: 23082 - DNA, 18 bp, synthetic construct
  source 1..18: mol_type = other DNA
taataccactctcgatcg

SEQ ID NO: 23083 - DNA, 18 bp, synthetic construct
  source 1..18: mol_type = other DNA
taataccactgatcatag

SEQ ID NO: 23084 - DNA, 18 bp, synthetic construct
  source 1..18: mol_type = other DNA
taataccattaagtatag

SEQ ID NO: 23085 - DNA, 18 bp, synthetic construct
  source 1..18: mol_type = other DNA
taataccgatctctatag

SEQ ID NO: 23086 - DNA, 18 bp, synthetic construct
  source 1..18: mol_type = other DNA
taataccgctcattaaag

SEQ ID NO: 23087 - DNA, 18 bp, synthetic construct
  source 1..18: mol_type = other DNA
taatacctcttaccatag

SEQ ID NO: 23088 - DNA, 18 bp, synthetic construct
  source 1..18: mol_type = other DNA
taatacgaaccacattag

SEQ ID NO: 23089 - DNA, 18 bp, synthetic construct
  source 1..18: mol_type = other DNA
taatacgaaggagtatag

SEQ ID NO: 23090 - DNA, 18 bp, synthetic construct
  source 1..18: mol_type = other DNA
taatacgaataacaacag

SEQ ID NO: 23091 - DNA, 18 bp, synthetic construct
  source 1..18: mol_type = other DNA
taatacgaatcataatcg

SEQ ID NO: 23092 - DNA, 18 bp, synthetic construct
  source 1..18: mol_type = other DNA
taatacgaattaatttag

SEQ ID NO: 23093 - DNA, 18 bp, synthetic construct
  source 1..18: mol_type = other DNA
taatacgaatttctatcg

SEQ ID NO: 23094 - DNA, 18 bp, synthetic construct
  source 1..18: mol_type = other DNA
taatacgacaaaggatag

SEQ ID NO: 23095 - DNA, 18 bp, synthetic construct
  source 1..18: mol_type = other DNA
taatacgacaaattaaag

SEQ ID NO: 23096 - DNA, 18 bp, synthetic construct
  source 1..18: mol_type = other DNA
taatacgacacacaaccg

SEQ ID NO: 23097 - DNA, 18 bp, synthetic construct
  source 1..18: mol_type = other DNA
taatacgacacacagtcg

SEQ ID NO: 23098 - DNA, 18 bp, synthetic construct
  source 1..18: mol_type = other DNA
taatacgacacccttcag

SEQ ID NO: 23099 - DNA, 18 bp, synthetic construct
  source 1..18: mol_type = other DNA
taatacgacctataatag

SEQ ID NO: 23100 - DNA, 18 bp, synthetic construct
  source 1..18: mol_type = other DNA
taatacgaccttctctag

SEQ ID NO: 23101 - DNA, 18 bp, synthetic construct
  source 1..18: mol_type = other DNA
taatacgactcaccgtcc

SEQ ID NO: 23102 - DNA, 18 bp, synthetic construct
  source 1..18: mol_type = other DNA
taatacgactctgagtag

SEQ ID NO: 23103 - DNA, 18 bp, synthetic construct
  source 1..18: mol_type = other DNA
taatacgactctttttgg

SEQ ID NO: 23104 - DNA, 18 bp, synthetic construct
  source 1..18: mol_type = other DNA
taatacgactgtatgtag

SEQ ID NO: 23105 - DNA, 18 bp, synthetic construct
  source 1..18: mol_type = other DNA
taatacgacttagaagag

SEQ ID NO: 23106 - DNA, 18 bp, synthetic construct
  source 1..18: mol_type = other DNA
taatacgagacacttcag

SEQ ID NO: 23107 - DNA, 18 bp, synthetic construct
  source 1..18: mol_type = other DNA
taatacgagagactaaag

SEQ ID NO: 23108 - DNA, 18 bp, synthetic construct
  source 1..18: mol_type = other DNA
taatacgagatactatcg

SEQ ID NO: 23109 - DNA, 18 bp, synthetic construct
  source 1..18: mol_type = other DNA
taatacgagtcaacttag

SEQ ID NO: 23110 - DNA, 18 bp, synthetic construct
  source 1..18: mol_type = other DNA
taatacgatacattatcg

SEQ ID NO: 23111 - DNA, 18 bp, synthetic construct
  source 1..18: mol_type = other DNA
taatacgatccattaaag

SEQ ID NO: 23112 - DNA, 18 bp, synthetic construct
  source 1..18: mol_type = other DNA
taatacgattaacaacag

SEQ ID NO: 23113 - DNA, 18 bp, synthetic construct
  source 1..18: mol_type = other DNA
taatacgattcactgcgg

SEQ ID NO: 23114 - DNA, 18 bp, synthetic construct
  source 1..18: mol_type = other DNA
taatacgattcccaatcg

SEQ ID NO: 23115 - DNA, 18 bp, synthetic construct
  source 1..18: mol_type = other DNA
taatacgattccctaacg

SEQ ID NO: 23116 - DNA, 18 bp, synthetic construct
  source 1..18: mol_type = other DNA
taatacgcatctatatag

SEQ ID NO: 23117 - DNA, 18 bp, synthetic construct
  source 1..18: mol_type = other DNA
taatacgccataccatag

SEQ ID NO: 23118 - DNA, 18 bp, synthetic construct
  source 1..18: mol_type = other DNA
taatacgcctcaattcag

SEQ ID NO: 23119 - DNA, 18 bp, synthetic construct
  source 1..18: mol_type = other DNA
taatacgcttaactttag

SEQ ID NO: 23120 - DNA, 18 bp, synthetic construct
  source 1..18: mol_type = other DNA
taatacgcttcacaaaag

SEQ ID NO: 23121 - DNA, 18 bp, synthetic construct
  source 1..18: mol_type = other DNA
taatacggcacaatacag

SEQ ID NO: 23122 - DNA, 18 bp, synthetic construct
  source 1..18: mol_type = other DNA
taatacggcactctaaag

SEQ ID NO: 23123 - DNA, 18 bp, synthetic construct
  source 1..18: mol_type = other DNA
taatacggcgcacttgag

SEQ ID NO: 23124 - DNA, 18 bp, synthetic construct
  source 1..18: mol_type = other DNA
taatacggctaaaaatag

SEQ ID NO: 23125 - DNA, 18 bp, synthetic construct
  source 1..18: mol_type = other DNA
taatacggcttaaaatag

SEQ ID NO: 23126 - DNA, 18 bp, synthetic construct
  source 1..18: mol_type = other DNA
taatacggtccacaatag

SEQ ID NO: 23127 - DNA, 18 bp, synthetic construct
  source 1..18: mol_type = other DNA
taatacgtacccctatag

SEQ ID NO: 23128 - DNA, 18 bp, synthetic construct
  source 1..18: mol_type = other DNA
taatacgtatcacactag

SEQ ID NO: 23129 - DNA, 18 bp, synthetic construct
  source 1..18: mol_type = other DNA
taatacgtcagactttag

SEQ ID NO: 23130 - DNA, 18 bp, synthetic construct
  source 1..18: mol_type = other DNA
taatacgtcctactttag

SEQ ID NO: 23131 - DNA, 18 bp, synthetic construct
  source 1..18: mol_type = other DNA
taatacgtctcacctaag

SEQ ID NO: 23132 - DNA, 18 bp, synthetic construct
  source 1..18: mol_type = other DNA
taatacgtctccctaacg

SEQ ID NO: 23133 - DNA, 18 bp, synthetic construct
  source 1..18: mol_type = other DNA
taatacgtctctctttcg

SEQ ID NO: 23134 - DNA, 18 bp, synthetic construct
  source 1..18: mol_type = other DNA
taatacgtctgagaatag

SEQ ID NO: 23135 - DNA, 18 bp, synthetic construct
  source 1..18: mol_type = other DNA
taatacgtgtcactacgg

SEQ ID NO: 23136 - DNA, 18 bp, synthetic construct
  source 1..18: mol_type = other DNA
taatacgttccactttag

SEQ ID NO: 23137 - DNA, 18 bp, synthetic construct
  source 1..18: mol_type = other DNA
taatacgtttcacgttag

SEQ ID NO: 23138 - DNA, 18 bp, synthetic construct
  source 1..18: mol_type = other DNA
taatactaatcaccttag

SEQ ID NO: 23139 - DNA, 18 bp, synthetic construct
  source 1..18: mol_type = other DNA
taatactaatcacgatcg

SEQ ID NO: 23140 - DNA, 18 bp, synthetic construct
  source 1..18: mol_type = other DNA
taatactaattactttag

SEQ ID NO: 23141 - DNA, 18 bp, synthetic construct
  source 1..18: mol_type = other DNA
taatactacatactatgg

SEQ ID NO: 23142 - DNA, 18 bp, synthetic construct
  source 1..18: mol_type = other DNA
taatactactcaccaaaa

SEQ ID NO: 23143 - DNA, 18 bp, synthetic construct
  source 1..18: mol_type = other DNA
taatactactcagtaagg

SEQ ID NO: 23144 - DNA, 18 bp, synthetic construct
  source 1..18: mol_type = other DNA
taatactactctctaacg

SEQ ID NO: 23145 - DNA, 18 bp, synthetic construct
  source 1..18: mol_type = other DNA
taatactactctcttgag

SEQ ID NO: 23146 - DNA, 18 bp, synthetic construct
  source 1..18: mol_type = other DNA
taatactattgattatag

SEQ ID NO: 23147 - DNA, 18 bp, synthetic construct
  source 1..18: mol_type = other DNA
taatactcctcattttag

SEQ ID NO: 23148 - DNA, 18 bp, synthetic construct
  source 1..18: mol_type = other DNA
taatacttctcactgcag

SEQ ID NO: 23149 - DNA, 18 bp, synthetic construct
  source 1..18: mol_type = other DNA
taatacttttcactagag

SEQ ID NO: 23150 - DNA, 18 bp, synthetic construct
  source 1..18: mol_type = other DNA
taatagaattcactatgg

SEQ ID NO: 23151 - DNA, 18 bp, synthetic construct
  source 1..18: mol_type = other DNA
taatagatctcacaatag

SEQ ID NO: 23152 - DNA, 18 bp, synthetic construct
  source 1..18: mol_type = other DNA
taataggaattactaaag

SEQ ID NO: 23153 - DNA, 18 bp, synthetic construct
  source 1..18: mol_type = other DNA
taataggacgtaatatag

SEQ ID NO: 23154 - DNA, 18 bp, synthetic construct
  source 1..18: mol_type = other DNA
taataggtctcattatcg

SEQ ID NO: 23155 - DNA, 18 bp, synthetic construct
  source 1..18: mol_type = other DNA
taataggtcttactctag

SEQ ID NO: 23156 - DNA, 18 bp, synthetic construct
  source 1..18: mol_type = other DNA
taatagtaatcactctag

SEQ ID NO: 23157 - DNA, 18 bp, synthetic construct
  source 1..18: mol_type = other DNA
taatagttctcactatcg

SEQ ID NO: 23158 - DNA, 18 bp, synthetic construct
  source 1..18: mol_type = other DNA
taatataactcacttcag

SEQ ID NO: 23159 - DNA, 18 bp, synthetic construct
  source 1..18: mol_type = other DNA
taatataactgactacag

SEQ ID NO: 23160 - DNA, 18 bp, synthetic construct
  source 1..18: mol_type = other DNA
taatataactttctatag

SEQ ID NO: 23161 - DNA, 18 bp, synthetic construct
  source 1..18: mol_type = other DNA
taatatcactcattttag

SEQ ID NO: 23162 - DNA, 18 bp, synthetic construct
  source 1..18: mol_type = other DNA
taatatgacccacactag

SEQ ID NO: 23163 - DNA, 18 bp, synthetic construct
  source 1..18: mol_type = other DNA
taatatgactcaatttgg

SEQ ID NO: 23164 - DNA, 18 bp, synthetic construct
  source 1..18: mol_type = other DNA
taatatgactcagtctgg

SEQ ID NO: 23165 - DNA, 18 bp, synthetic construct
  source 1..18: mol_type = other DNA
taatatgactctatatcg

SEQ ID NO: 23166 - DNA, 18 bp, synthetic construct
  source 1..18: mol_type = other DNA
taatatgacttataatag

SEQ ID NO: 23167 - DNA, 18 bp, synthetic construct
  source 1..18: mol_type = other DNA
taatatgcttgactatag

SEQ ID NO: 23168 - DNA, 18 bp, synthetic construct
  source 1..18: mol_type = other DNA
taatatgtctgactgtag

SEQ ID NO: 23169 - DNA, 18 bp, synthetic construct
  source 1..18: mol_type = other DNA
taatattacacaccatag

SEQ ID NO: 23170 - DNA, 18 bp, synthetic construct
  source 1..18: mol_type = other DNA
taatattacccaatatag

SEQ ID NO: 23171 - DNA, 18 bp, synthetic construct
  source 1..18: mol_type = other DNA
taatcagactcactaacg

SEQ ID NO: 23172 - DNA, 18 bp, synthetic construct
  source 1..18: mol_type = other DNA
taatccatcccactatag

SEQ ID NO: 23173 - DNA, 18 bp, synthetic construct
  source 1..18: mol_type = other DNA
taatccgaattaatatag

SEQ ID NO: 23174 - DNA, 18 bp, synthetic construct
  source 1..18: mol_type = other DNA
taatccgactctcattag

SEQ ID NO: 23175 - DNA, 18 bp, synthetic construct
  source 1..18: mol_type = other DNA
taatccgacttattatcg

SEQ ID NO: 23176 - DNA, 18 bp, synthetic construct
  source 1..18: mol_type = other DNA
taatccgagtcaataaag

SEQ ID NO: 23177 - DNA, 18 bp, synthetic construct
  source 1..18: mol_type = other DNA
taatccgcctcagtaaag

SEQ ID NO: 23178 - DNA, 18 bp, synthetic construct
  source 1..18: mol_type = other DNA
taatccgtcagactatag

SEQ ID NO: 23179 - DNA, 18 bp, synthetic construct
  source 1..18: mol_type = other DNA
taatccgtttcactaaag

SEQ ID NO: 23180 - DNA, 18 bp, synthetic construct
  source 1..18: mol_type = other DNA
taatcctacacactgtag

SEQ ID NO: 23181 - DNA, 18 bp, synthetic construct
  source 1..18: mol_type = other DNA
taatcctactcaatttag

SEQ ID NO: 23182 - DNA, 18 bp, synthetic construct
  source 1..18: mol_type = other DNA
taatcctgctcaccatag

SEQ ID NO: 23183 - DNA, 18 bp, synthetic construct
  source 1..18: mol_type = other DNA
taatcggactccctttag

SEQ ID NO: 23184 - DNA, 18 bp, synthetic construct
  source 1..18: mol_type = other DNA
taatctgactcacattag

SEQ ID NO: 23185 - DNA, 18 bp, synthetic construct
  source 1..18: mol_type = other DNA
taatctgccacactatag

SEQ ID NO: 23186 - DNA, 18 bp, synthetic construct
  source 1..18: mol_type = other DNA
taatctgcctcactatcg

SEQ ID NO: 23187 - DNA, 18 bp, synthetic construct
  source 1..18: mol_type = other DNA
taatgagacccactacag

SEQ ID NO: 23188 - DNA, 18 bp, synthetic construct
  source 1..18: mol_type = other DNA
taatgagacttacaatag

SEQ ID NO: 23189 - DNA, 18 bp, synthetic construct
  source 1..18: mol_type = other DNA
taatgccactctctaaag

SEQ ID NO: 23190 - DNA, 18 bp, synthetic construct
  source 1..18: mol_type = other DNA
taatgcccctcacaatag

SEQ ID NO: 23191 - DNA, 18 bp, synthetic construct
  source 1..18: mol_type = other DNA
taatgcgacattctatag

SEQ ID NO: 23192 - DNA, 18 bp, synthetic construct
  source 1..18: mol_type = other DNA
taatgcgactcacgtaag

SEQ ID NO: 23193 - DNA, 18 bp, synthetic construct
  source 1..18: mol_type = other DNA
taatgcgactccttttag

SEQ ID NO: 23194 - DNA, 18 bp, synthetic construct
  source 1..18: mol_type = other DNA
taatgcgactctctcaag

SEQ ID NO: 23195 - DNA, 18 bp, synthetic construct
  source 1..18: mol_type = other DNA
taatgcgtcccactttag

SEQ ID NO: 23196 - DNA, 18 bp, synthetic construct
  source 1..18: mol_type = other DNA
taatgcgtctcagtaaag

SEQ ID NO: 23197 - DNA, 18 bp, synthetic construct
  source 1..18: mol_type = other DNA
taatgcgtctcattagag

SEQ ID NO: 23198 - DNA, 18 bp, synthetic construct
  source 1..18: mol_type = other DNA
taatgctaattactatag

SEQ ID NO: 23199 - DNA, 18 bp, synthetic construct
  source 1..18: mol_type = other DNA
taatgctactcaccttag

SEQ ID NO: 23200 - DNA, 18 bp, synthetic construct
  source 1..18: mol_type = other DNA
taatgctagtcactacag

SEQ ID NO: 23201 - DNA, 18 bp, synthetic construct
  source 1..18: mol_type = other DNA
taatgtgaatcactctag

SEQ ID NO: 23202 - DNA, 18 bp, synthetic construct
  source 1..18: mol_type = other DNA
tacaaagactccctatag

SEQ ID NO: 23203 - DNA, 18 bp, synthetic construct
  source 1..18: mol_type = other DNA
tacaacgacacaccatag

SEQ ID NO: 23204 - DNA, 18 bp, synthetic construct
  source 1..18: mol_type = other DNA
tacaacgacactctatag

SEQ ID NO: 23205 - DNA, 18 bp, synthetic construct
  source 1..18: mol_type = other DNA
tacaacgactgacaatag

SEQ ID NO: 23206 - DNA, 18 bp, synthetic construct
  source 1..18: mol_type = other DNA
taccaggactcacaatag

SEQ ID NO: 23207 - DNA, 18 bp, synthetic construct
  source 1..18: mol_type = other DNA
tacgacgactcagtctag

SEQ ID NO: 23208 - DNA, 18 bp, synthetic construct
  source 1..18: mol_type = other DNA
tactaagactaattatag

SEQ ID NO: 23209 - DNA, 18 bp, synthetic construct
  source 1..18: mol_type = other DNA
tactaagacttactaaag

SEQ ID NO: 23210 - DNA, 18 bp, synthetic construct
  source 1..18: mol_type = other DNA
tactaatactaactatag

SEQ ID NO: 23211 - DNA, 18 bp, synthetic construct
  source 1..18: mol_type = other DNA
tactacaactaactaaag

SEQ ID NO: 23212 - DNA, 18 bp, synthetic construct
  source 1..18: mol_type = other DNA
tactacaactcattatcg

SEQ ID NO: 23213 - DNA, 18 bp, synthetic construct
  source 1..18: mol_type = other DNA
tactacaacttactctag

SEQ ID NO: 23214 - DNA, 18 bp, synthetic construct
  source 1..18: mol_type = other DNA
tactacatctcaatatag

SEQ ID NO: 23215 - DNA, 18 bp, synthetic construct
  source 1..18: mol_type = other DNA
tactaccactaactaaag

SEQ ID NO: 23216 - DNA, 18 bp, synthetic construct
  source 1..18: mol_type = other DNA
tactacgagtcaccaaag

SEQ ID NO: 23217 - DNA, 18 bp, synthetic construct
  source 1..18: mol_type = other DNA
tactacgattcaatacag

SEQ ID NO: 23218 - DNA, 18 bp, synthetic construct
  source 1..18: mol_type = other DNA
tactacgcctaacaatag

SEQ ID NO: 23219 - DNA, 18 bp, synthetic construct
  source 1..18: mol_type = other DNA
tactacgtgacactatag

SEQ ID NO: 23220 - DNA, 18 bp, synthetic construct
  source 1..18: mol_type = other DNA
tactaggacacattatag

SEQ ID NO: 23221 - DNA, 18 bp, synthetic construct
  source 1..18: mol_type = other DNA
tactaggattcactacag

SEQ ID NO: 23222 - DNA, 18 bp, synthetic construct
  source 1..18: mol_type = other DNA
tactatgaaccactatag

SEQ ID NO: 23223 - DNA, 18 bp, synthetic construct
  source 1..18: mol_type = other DNA
tactatgattcactatgg

SEQ ID NO: 23224 - DNA, 18 bp, synthetic construct
  source 1..18: mol_type = other DNA
tactcctaatcactatag

SEQ ID NO: 23225 - DNA, 18 bp, synthetic construct
  source 1..18: mol_type = other DNA
tactgcgacacaccatag

SEQ ID NO: 23226 - DNA, 18 bp, synthetic construct
  source 1..18: mol_type = other DNA
tagaaagtctcactatag

SEQ ID NO: 23227 - DNA, 18 bp, synthetic construct
  source 1..18: mol_type = other DNA
tagaaccactctctatag

SEQ ID NO: 23228 - DNA, 18 bp, synthetic construct
  source 1..18: mol_type = other DNA
tagaacgacagactatag

SEQ ID NO: 23229 - DNA, 18 bp, synthetic construct
  source 1..18: mol_type = other DNA
tagcatgactctctatag

SEQ ID NO: 23230 - DNA, 18 bp, synthetic construct
  source 1..18: mol_type = other DNA
taggacgactcacattag

SEQ ID NO: 23231 - DNA, 18 bp, synthetic construct
  source 1..18: mol_type = other DNA
tagtaacactcactatcg

SEQ ID NO: 23232 - DNA, 18 bp, synthetic construct
  source 1..18: mol_type = other DNA
tagtaacacttactatag

SEQ ID NO: 23233 - DNA, 18 bp, synthetic construct
  source 1..18: mol_type = other DNA
tagtaagacccactttag

SEQ ID NO: 23234 - DNA, 18 bp, synthetic construct
  source 1..18: mol_type = other DNA
tagtacaaccctctatag

SEQ ID NO: 23235 - DNA, 18 bp, synthetic construct
  source 1..18: mol_type = other DNA
tagtacaactcaatatcg

SEQ ID NO: 23236 - DNA, 18 bp, synthetic construct
  source 1..18: mol_type = other DNA
tagtacgacagattatag

SEQ ID NO: 23237 - DNA, 18 bp, synthetic construct
  source 1..18: mol_type = other DNA
tagtacgacttaatatgg

SEQ ID NO: 23238 - DNA, 18 bp, synthetic construct
  source 1..18: mol_type = other DNA
tagtacgtctatctatag

SEQ ID NO: 23239 - DNA, 18 bp, synthetic construct
  source 1..18: mol_type = other DNA
tagtacgtctcagtttag

SEQ ID NO: 23240 - DNA, 18 bp, synthetic construct
  source 1..18: mol_type = other DNA
tagtactaatcattatag

SEQ ID NO: 23241 - DNA, 18 bp, synthetic construct
  source 1..18: mol_type = other DNA
tagtaggacaccctatag

SEQ ID NO: 23242 - DNA, 18 bp, synthetic construct
  source 1..18: mol_type = other DNA
tataaagactcactagag

SEQ ID NO: 23243 - DNA, 18 bp, synthetic construct
  source 1..18: mol_type = other DNA
tataacgactcaatctag

SEQ ID NO: 23244 - DNA, 18 bp, synthetic construct
  source 1..18: mol_type = other DNA
tataacgactcacaatgg

SEQ ID NO: 23245 - DNA, 18 bp, synthetic construct
  source 1..18: mol_type = other DNA
tataacgactcactaacg

SEQ ID NO: 23246 - DNA, 18 bp, synthetic construct
  source 1..18: mol_type = other DNA
tataacgactctctacag

SEQ ID NO: 23247 - DNA, 18 bp, synthetic construct
  source 1..18: mol_type = other DNA
tataacgattctctatag

SEQ ID NO: 23248 - DNA, 18 bp, synthetic construct
  source 1..18: mol_type = other DNA
tatcacgtctcactgtag

SEQ ID NO: 23249 - DNA, 18 bp, synthetic construct
  source 1..18: mol_type = other DNA
tatcactactcactatgg

SEQ ID NO: 23250 - DNA, 18 bp, synthetic construct
  source 1..18: mol_type = other DNA
tatcaggactcactttag

SEQ ID NO: 23251 - DNA, 18 bp, synthetic construct
  source 1..18: mol_type = other DNA
tatcaggactcagtatag

SEQ ID NO: 23252 - DNA, 18 bp, synthetic construct
  source 1..18: mol_type = other DNA
tatgccgactcactaaag

SEQ ID NO: 23253 - DNA, 18 bp, synthetic construct
  source 1..18: mol_type = other DNA
tattaagattaactatag

SEQ ID NO: 23254 - DNA, 18 bp, synthetic construct
  source 1..18: mol_type = other DNA
tattacaactcaatgtag

SEQ ID NO: 23255 - DNA, 18 bp, synthetic construct
  source 1..18: mol_type = other DNA
tattacaattcactatat

SEQ ID NO: 23256 - DNA, 18 bp, synthetic construct
  source 1..18: mol_type = other DNA
tattaccaatcacgatag

SEQ ID NO: 23257 - DNA, 18 bp, synthetic construct
  source 1..18: mol_type = other DNA
tattaccactcacaatcg

SEQ ID NO: 23258 - DNA, 18 bp, synthetic construct
  source 1..18: mol_type = other DNA
tattaccattcactttag

SEQ ID NO: 23259 - DNA, 18 bp, synthetic construct
  source 1..18: mol_type = other DNA
tattacgaataactgtag

SEQ ID NO: 23260 - DNA, 18 bp, synthetic construct
  source 1..18: mol_type = other DNA
tattacgacccaatttag

SEQ ID NO: 23261 - DNA, 18 bp, synthetic construct
  source 1..18: mol_type = other DNA
tattacgactcaaactag

SEQ ID NO: 23262 - DNA, 18 bp, synthetic construct
  source 1..18: mol_type = other DNA
tattacgactcacaacgg

SEQ ID NO: 23263 - DNA, 18 bp, synthetic construct
  source 1..18: mol_type = other DNA
tattacgactcacccaag

SEQ ID NO: 23264 - DNA, 18 bp, synthetic construct
  source 1..18: mol_type = other DNA
tattacgactcataatcg

SEQ ID NO: 23265 - DNA, 18 bp, synthetic construct
  source 1..18: mol_type = other DNA
tattacgactctttatcg

SEQ ID NO: 23266 - DNA, 18 bp, synthetic construct
  source 1..18: mol_type = other DNA
tattacgagtcaccatcg

SEQ ID NO: 23267 - DNA, 18 bp, synthetic construct
  source 1..18: mol_type = other DNA
tattacgatacactatcg

SEQ ID NO: 23268 - DNA, 18 bp, synthetic construct
  source 1..18: mol_type = other DNA
tattacggttaactatag

SEQ ID NO: 23269 - DNA, 18 bp, synthetic construct
  source 1..18: mol_type = other DNA
tattacgtatcactacag

SEQ ID NO: 23270 - DNA, 18 bp, synthetic construct
  source 1..18: mol_type = other DNA
tattacgtctcactgaag

SEQ ID NO: 23271 - DNA, 18 bp, synthetic construct
  source 1..18: mol_type = other DNA
tattactactcaccttag

SEQ ID NO: 23272 - DNA, 18 bp, synthetic construct
  source 1..18: mol_type = other DNA
tattaggtcttactatag

SEQ ID NO: 23273 - DNA, 18 bp, synthetic construct
  source 1..18: mol_type = other DNA
tattatcactcaccatag

SEQ ID NO: 23274 - DNA, 18 bp, synthetic construct
  source 1..18: mol_type = other DNA
tattatgacacactatgg

SEQ ID NO: 23275 - DNA, 18 bp, synthetic construct
  source 1..18: mol_type = other DNA
tattatgactaactaaag

SEQ ID NO: 23276 - DNA, 18 bp, synthetic construct
  source 1..18: mol_type = other DNA
tattcccaatcactatag

SEQ ID NO: 23277 - DNA, 18 bp, synthetic construct
  source 1..18: mol_type = other DNA
tattctggctcactatag

SEQ ID NO: 23278 - DNA, 18 bp, synthetic construct
  source 1..18: mol_type = other DNA
tattgcgactcattaaag

SEQ ID NO: 23279 - DNA, 18 bp, synthetic construct
  source 1..18: mol_type = other DNA
tcaaaagacttactatag

SEQ ID NO: 23280 - DNA, 18 bp, synthetic construct
  source 1..18: mol_type = other DNA
tcaaacgactcagtgtag

SEQ ID NO: 23281 - DNA, 18 bp, synthetic construct
  source 1..18: mol_type = other DNA
tcacacgactaactaaag

SEQ ID NO: 23282 - DNA, 18 bp, synthetic construct
  source 1..18: mol_type = other DNA
tcacacgcttcactatag

SEQ ID NO: 23283 - DNA, 18 bp, synthetic construct
  source 1..18: mol_type = other DNA
tcacgcgactcactttag

SEQ ID NO: 23284 - DNA, 18 bp, synthetic construct
  source 1..18: mol_type = other DNA
tcagaggactctctatag

SEQ ID NO: 23285 - DNA, 18 bp, synthetic construct
  source 1..18: mol_type = other DNA
tcataccactcaataaag

SEQ ID NO: 23286 - DNA, 18 bp, synthetic construct
  source 1..18: mol_type = other DNA
tcatacgacccaccaaag

SEQ ID NO: 23287 - DNA, 18 bp, synthetic construct
  source 1..18: mol_type = other DNA
tcatacgactcaatttcg

SEQ ID NO: 23288 - DNA, 18 bp, synthetic construct
  source 1..18: mol_type = other DNA
tcatacgactgacattag

SEQ ID NO: 23289 - DNA, 18 bp, synthetic construct
  source 1..18: mol_type = other DNA
tcatacgactttcaatag

SEQ ID NO: 23290 - DNA, 18 bp, synthetic construct
  source 1..18: mol_type = other DNA
tcatacgagtcaccaaag

SEQ ID NO: 23291 - DNA, 18 bp, synthetic construct
  source 1..18: mol_type = other DNA
tcatacgattaacaatag

SEQ ID NO: 23292 - DNA, 18 bp, synthetic construct
  source 1..18: mol_type = other DNA
tcatacgattcaatagag

SEQ ID NO: 23293 - DNA, 18 bp, synthetic construct
  source 1..18: mol_type = other DNA
tcatacgtctcactttgg

SEQ ID NO: 23294 - DNA, 18 bp, synthetic construct
  source 1..18: mol_type = other DNA
tcatactactcaatttag

SEQ ID NO: 23295 - DNA, 18 bp, synthetic construct
  source 1..18: mol_type = other DNA
tcatactactctctatcg

SEQ ID NO: 23296 - DNA, 18 bp, synthetic construct
  source 1..18: mol_type = other DNA
tcataggactcaataaag

SEQ ID NO: 23297 - DNA, 18 bp, synthetic construct
  source 1..18: mol_type = other DNA
tcatccgattcacaatag

SEQ ID NO: 23298 - DNA, 18 bp, synthetic construct
  source 1..18: mol_type = other DNA
tcgaacgattcactatag

SEQ ID NO: 23299 - DNA, 18 bp, synthetic construct
  source 1..18: mol_type = other DNA
tcgtacgacactctatag

SEQ ID NO: 23300 - DNA, 18 bp, synthetic construct
  source 1..18: mol_type = other DNA
tcttaagactcactttag

SEQ ID NO: 23301 - DNA, 18 bp, synthetic construct
  source 1..18: mol_type = other DNA
tcttacaacttactatag

SEQ ID NO: 23302 - DNA, 18 bp, synthetic construct
  source 1..18: mol_type = other DNA
tcttaccgctcactatag

SEQ ID NO: 23303 - DNA, 18 bp, synthetic construct
  source 1..18: mol_type = other DNA
tcttacgagtccctatag

SEQ ID NO: 23304 - DNA, 18 bp, synthetic construct
  source 1..18: mol_type = other DNA
tcttactactgactatag

SEQ ID NO: 23305 - DNA, 18 bp, synthetic construct
  source 1..18: mol_type = other DNA
tcttatgagtcactatag

SEQ ID NO: 23306 - DNA, 18 bp, synthetic construct
  source 1..18: mol_type = other DNA
tcttctgactcactatag

SEQ ID NO: 23307 - DNA, 18 bp, synthetic construct
  source 1..18: mol_type = other DNA
tgaaaccactaactatag

SEQ ID NO: 23308 - DNA, 18 bp, synthetic construct
  source 1..18: mol_type = other DNA
tgaaacgattaactatag

SEQ ID NO: 23309 - DNA, 18 bp, synthetic construct
  source 1..18: mol_type = other DNA
tgaaactactcaatatag

SEQ ID NO: 23310 - DNA, 18 bp, synthetic construct
  source 1..18: mol_type = other DNA
tgaaatgacacactatag

SEQ ID NO: 23311 - DNA, 18 bp, synthetic construct
  source 1..18: mol_type = other DNA
tgaaatgactcagtatag

SEQ ID NO: 23312 - DNA, 18 bp, synthetic construct
  source 1..18: mol_type = other DNA
tgaaccgactgactatag

SEQ ID NO: 23313 - DNA, 18 bp, synthetic construct
  source 1..18: mol_type = other DNA
tgacaccacttactatag

SEQ ID NO: 23314 - DNA, 18 bp, synthetic construct
  source 1..18: mol_type = other DNA
tgataaaacgcactatag

SEQ ID NO: 23315 - DNA, 18 bp, synthetic construct
  source 1..18: mol_type = other DNA
tgatacgacattctatag

SEQ ID NO: 23316 - DNA, 18 bp, synthetic construct
  source 1..18: mol_type = other DNA
tgatacgactaacttaag

SEQ ID NO: 23317 - DNA, 18 bp, synthetic construct
  source 1..18: mol_type = other DNA
tgatacgacttccaatag

SEQ ID NO: 23318 - DNA, 18 bp, synthetic construct
  source 1..18: mol_type = other DNA
tgatacgattcacttgag

SEQ ID NO: 23319 - DNA, 18 bp, synthetic construct
  source 1..18: mol_type = other DNA
tgatacgattgaatatag

SEQ ID NO: 23320 - DNA, 18 bp, synthetic construct
  source 1..18: mol_type = other DNA
tgatacgatttactaaag

SEQ ID NO: 23321 - DNA, 18 bp, synthetic construct
  source 1..18: mol_type = other DNA
tgataggaatcactttag

SEQ ID NO: 23322 - DNA, 18 bp, synthetic construct
  source 1..18: mol_type = other DNA
tgatatgactcaccatcg

SEQ ID NO: 23323 - DNA, 18 bp, synthetic construct
  source 1..18: mol_type = other DNA
tgatatgtttcactatag

SEQ ID NO: 23324 - DNA, 18 bp, synthetic construct
  source 1..18: mol_type = other DNA
tgatccgaatgactatag

SEQ ID NO: 23325 - DNA, 18 bp, synthetic construct
  source 1..18: mol_type = other DNA
tgatgcgagacactatag

SEQ ID NO: 23326 - DNA, 18 bp, synthetic construct
  source 1..18: mol_type = other DNA
tgctacgactcactctcg

SEQ ID NO: 23327 - DNA, 18 bp, synthetic construct
  source 1..18: mol_type = other DNA
tgctacgagtcaccatag

SEQ ID NO: 23328 - DNA, 18 bp, synthetic construct
  source 1..18: mol_type = other DNA
tgctactactcactttag

SEQ ID NO: 23329 - DNA, 18 bp, synthetic construct
  source 1..18: mol_type = other DNA
tggaacgactaactatag

SEQ ID NO: 23330 - DNA, 18 bp, synthetic construct
  source 1..18: mol_type = other DNA
tgttaaaactcactatag

SEQ ID NO: 23331 - DNA, 18 bp, synthetic construct
  source 1..18: mol_type = other DNA
tgttaagactctctatag

SEQ ID NO: 23332 - DNA, 18 bp, synthetic construct
  source 1..18: mol_type = other DNA
tgttacgactatctatag

SEQ ID NO: 23333 - DNA, 18 bp, synthetic construct
  source 1..18: mol_type = other DNA
tgttatgactcactctag

SEQ ID NO: 23334 - DNA, 18 bp, synthetic construct
  source 1..18: mol_type = other DNA
tgttccgaatcactatag

SEQ ID NO: 23335 - DNA, 18 bp, synthetic construct
  source 1..18: mol_type = other DNA
tgttgctactcactatag

SEQ ID NO: 23336 - DNA, 18 bp, synthetic construct
  source 1..18: mol_type = other DNA
ttaaaagactcactatcg

SEQ ID NO: 23337 - DNA, 18 bp, synthetic construct
  source 1..18: mol_type = other DNA
ttaaacgactcaccatcg

SEQ ID NO: 23338 - DNA, 18 bp, synthetic construct
  source 1..18: mol_type = other DNA
ttaaacgactgacgatag

SEQ ID NO: 23339 - DNA, 18 bp, synthetic construct
  source 1..18: mol_type = other DNA
ttaaacgagttactatag

SEQ ID NO: 23340 - DNA, 18 bp, synthetic construct
  source 1..18: mol_type = other DNA
ttacacgaatctctatag

SEQ ID NO: 23341 - DNA, 18 bp, synthetic construct
  source 1..18: mol_type = other DNA
ttacacggctctctatag

SEQ ID NO: 23342 - DNA, 18 bp, synthetic construct
  source 1..18: mol_type = other DNA
ttacatgacacactatag

SEQ ID NO: 23343 - DNA, 18 bp, synthetic construct
  source 1..18: mol_type = other DNA
ttagaccactcattatag

SEQ ID NO: 23344 - DNA, 18 bp, synthetic construct
  source 1..18: mol_type = other DNA
ttagacgactaactaaag

SEQ ID NO: 23345 - DNA, 18 bp, synthetic construct
  source 1..18: mol_type = other DNA
ttagacgactccttatag

SEQ ID NO: 23346 - DNA, 18 bp, synthetic construct
  source 1..18: mol_type = other DNA
ttaggcgagtcactatag

SEQ ID NO: 23347 - DNA, 18 bp, synthetic construct
  source 1..18: mol_type = other DNA
ttataagtctgactatag

SEQ ID NO: 23348 - DNA, 18 bp, synthetic construct
  source 1..18: mol_type = other DNA
ttatacaattcactatcg

SEQ ID NO: 23349 - DNA, 18 bp, synthetic construct
  source 1..18: mol_type = other DNA
ttatacatctcactagag

SEQ ID NO: 23350 - DNA, 18 bp, synthetic construct
  source 1..18: mol_type = other DNA
ttataccactcagaatag

SEQ ID NO: 23351 - DNA, 18 bp, synthetic construct
  source 1..18: mol_type = other DNA
ttatacgaatcagtctag

SEQ ID NO: 23352 - DNA, 18 bp, synthetic construct
  source 1..18: mol_type = other DNA
ttatacgaatccctttag

SEQ ID NO: 23353 - DNA, 18 bp, synthetic construct
  source 1..18: mol_type = other DNA
ttatacgaatgacaatag

SEQ ID NO: 23354 - DNA, 18 bp, synthetic construct
  source 1..18: mol_type = other DNA
ttatacgacaccctatcg

SEQ ID NO: 23355 - DNA, 18 bp, synthetic construct
  source 1..18: mol_type = other DNA
ttatacgaccaactatcg

SEQ ID NO: 23356 - DNA, 18 bp, synthetic construct
  source 1..18: mol_type = other DNA
ttatacgactcacatcag

SEQ ID NO: 23357 - DNA, 18 bp, synthetic construct
  source 1..18: mol_type = other DNA
ttatacgactcaccttcg

SEQ ID NO: 23358 - DNA, 18 bp, synthetic construct
  source 1..18: mol_type = other DNA
ttatacgactcatgacag

SEQ ID NO: 23359 - DNA, 18 bp, synthetic construct
  source 1..18: mol_type = other DNA
ttatacgactccttctag

SEQ ID NO: 23360 - DNA, 18 bp, synthetic construct
  source 1..18: mol_type = other DNA
ttatacgacttaatctag

SEQ ID NO: 23361 - DNA, 18 bp, synthetic construct
  source 1..18: mol_type = other DNA
ttatacgacttagcatag

SEQ ID NO: 23362 - DNA, 18 bp, synthetic construct
  source 1..18: mol_type = other DNA
ttatacgagacactatcg

SEQ ID NO: 23363 - DNA, 18 bp, synthetic construct
  source 1..18: mol_type = other DNA
ttatacgccaaactatag

SEQ ID NO: 23364 - DNA, 18 bp, synthetic construct
  source 1..18: mol_type = other DNA
ttatacggctcaatagag

SEQ ID NO: 23365 - DNA, 18 bp, synthetic construct
  source 1..18: mol_type = other DNA
ttatacgtctcactgcag

SEQ ID NO: 23366 - DNA, 18 bp, synthetic construct
  source 1..18: mol_type = other DNA
ttatactacccaccatag

SEQ ID NO: 23367 - DNA, 18 bp, synthetic construct
  source 1..18: mol_type = other DNA
ttatactacgcactgtag

SEQ ID NO: 23368 - DNA, 18 bp, synthetic construct
  source 1..18: mol_type = other DNA
ttatagcactcaatatag

SEQ ID NO: 23369 - DNA, 18 bp, synthetic construct
  source 1..18: mol_type = other DNA
ttatatgaaccactatag

SEQ ID NO: 23370 - DNA, 18 bp, synthetic construct
  source 1..18: mol_type = other DNA
ttatatgaatcagtatag

SEQ ID NO: 23371 - DNA, 18 bp, synthetic construct
  source 1..18: mol_type = other DNA
ttatatgaatccctatag

SEQ ID NO: 23372 - DNA, 18 bp, synthetic construct
  source 1..18: mol_type = other DNA
ttatcagactcaatatag

SEQ ID NO: 23373 - DNA, 18 bp, synthetic construct
  source 1..18: mol_type = other DNA
ttatccaactcactctag

SEQ ID NO: 23374 - DNA, 18 bp, synthetic construct
  source 1..18: mol_type = other DNA
ttatcccactcactgtag

SEQ ID NO: 23375 - DNA, 18 bp, synthetic construct
  source 1..18: mol_type = other DNA
ttatccgactcacaatgg

SEQ ID NO: 23376 - DNA, 18 bp, synthetic construct
  source 1..18: mol_type = other DNA
ttatccggctcacaatag

SEQ ID NO: 23377 - DNA, 18 bp, synthetic construct
  source 1..18: mol_type = other DNA
ttatgagattcactatag

SEQ ID NO: 23378 - DNA, 18 bp, synthetic construct
  source 1..18: mol_type = other DNA
ttatgcgactccccatag

SEQ ID NO: 23379 - DNA, 18 bp, synthetic construct
  source 1..18: mol_type = other DNA
ttatgctactcactaaag

SEQ ID NO: 23380 - DNA, 18 bp, synthetic construct
  source 1..18: mol_type = other DNA
ttatgggacccactatag

SEQ ID NO: 23381 - DNA, 18 bp, synthetic construct
  source 1..18: mol_type = other DNA
ttatgggactcacaatag

SEQ ID NO: 23382 - DNA, 18 bp, synthetic construct
  source 1..18: mol_type = other DNA
ttccacgactcacaatag

SEQ ID NO: 23383 - DNA, 18 bp, synthetic construct
  source 1..18: mol_type = other DNA
ttccactactcactatag

SEQ ID NO: 23384 - DNA, 18 bp, synthetic construct
  source 1..18: mol_type = other DNA
ttctacgtctcactatcg

SEQ ID NO: 23385 - DNA, 18 bp, synthetic construct
  source 1..18: mol_type = other DNA
ttctaggactcactagag

SEQ ID NO: 23386 - DNA, 18 bp, synthetic construct
  source 1..18: mol_type = other DNA
ttgtaccactcaccatag

SEQ ID NO: 23387 - DNA, 18 bp, synthetic construct
  source 1..18: mol_type = other DNA
ttgtacgactcactaagg

SEQ ID NO: 23388 - DNA, 18 bp, synthetic construct
  source 1..18: mol_type = other DNA
ttttaagactcacaatag

SEQ ID NO: 23389 - DNA, 18 bp, synthetic construct
  source 1..18: mol_type = other DNA
ttttacgactcactgaag

SEQ ID NO: 23390 - DNA, 18 bp, synthetic construct
  source 1..18: mol_type = other DNA
ttttacgactctctatcg

SEQ ID NO: 23391 - DNA, 18 bp, synthetic construct
  source 1..18: mol_type = other DNA
ttttccgactcactagag

SEQ ID NO: 23392 - DNA, 18 bp, synthetic construct
  source 1..18: mol_type = other DNA
taaatcgactcacattag

SEQ ID NO: 23393 - DNA, 18 bp, synthetic construct
  source 1..18: mol_type = other DNA
tataactactctctatag

SEQ ID NO: 23394 - DNA, 18 bp, synthetic construct
  source 1..18: mol_type = other DNA
aaaaacgactcacaattg

SEQ ID NO: 23395 - DNA, 18 bp, synthetic construct
  source 1..18: mol_type = other DNA
taatacgcctctcaattg

SEQ ID NO: 23396 - DNA, 18 bp, synthetic construct
  source 1..18: mol_type = other DNA
taatactactaattattg

SEQ ID NO: 23397 - DNA, 18 bp, synthetic construct
  source 1..18: mol_type = other DNA
caataagacacactattg

SEQ ID NO: 23398 - DNA, 18 bp, synthetic construct
  source 1..18: mol_type = other DNA
taacacgactgtctattg

SEQ ID NO: 23399 - DNA, 18 bp, synthetic construct
  source 1..18: mol_type = other DNA
taatcctactaactattg

SEQ ID NO: 23400 - DNA, 18 bp, synthetic construct
  source 1..18: mol_type = other DNA
taatgcgagtcacttttg

SEQ ID NO: 23401 - DNA, 18 bp, synthetic construct
  source 1..18: mol_type = other DNA
ttatacaactcgctaaag

SEQ ID NO: 23402 - DNA, 18 bp, synthetic construct
  source 1..18: mol_type = other DNA
ttatacgactcacgaatg

SEQ ID NO: 23403 - DNA, 18 bp, synthetic construct
  source 1..18: mol_type = other DNA
actaacgactcactatag

SEQ ID NO: 23404 - DNA, 18 bp, synthetic construct
  source 1..18: mol_type = other DNA
atatacgacttactatgg

SEQ ID NO: 23405 - DNA, 18 bp, synthetic construct
  source 1..18: mol_type = other DNA
gtatacgacttaatatag

SEQ ID NO: 23406 - DNA, 18 bp, synthetic construct
  source 1..18: mol_type = other DNA
taaaaccacacactaaag

SEQ ID NO: 23407 - DNA, 18 bp, synthetic construct
  source 1..18: mol_type = other DNA
taacacgaaacactaaag

SEQ ID NO: 23408 - DNA, 18 bp, synthetic construct
  source 1..18: mol_type = other DNA
taatacgatctactatcg

SEQ ID NO: 23409 - DNA, 18 bp, synthetic construct
  source 1..18: mol_type = other DNA
taatacgtatccttatag

SEQ ID NO: 23410 - DNA, 18 bp, synthetic construct
  source 1..18: mol_type = other DNA
taatacgtttcacaaaag

SEQ ID NO: 23411 - DNA, 18 bp, synthetic construct
  source 1..18: mol_type = other DNA
taatattaatcacaatag

SEQ ID NO: 23412 - DNA, 18 bp, synthetic construct
  source 1..18: mol_type = other DNA
ttgtacaattcactatag

SEQ ID NO: 23413 - DNA, 18 bp, synthetic construct
  source 1..18: mol_type = other DNA
taaatagtctcactatag

SEQ ID NO: 23414 - DNA, 18 bp, synthetic construct
  source 1..18: mol_type = other DNA
ttatacgaatctcaatag

SEQ ID NO: 23415 - DNA, 18 bp, synthetic construct
  source 1..18: mol_type = other DNA
taaatggactcactattg

SEQ ID NO: 23416 - DNA, 18 bp, synthetic construct
  source 1..18: mol_type = other DNA
taataagactcgcttttg

SEQ ID NO: 23417 - DNA, 18 bp, synthetic construct
  source 1..18: mol_type = other DNA
taattagtctcgctatag

SEQ ID NO: 23418 - DNA, 18 bp, synthetic construct
  source 1..18: mol_type = other DNA
taatttgacgcactattg

SEQ ID NO: 23419 - DNA, 18 bp, synthetic construct
  source 1..18: mol_type = other DNA
taacacgtctgactattg

SEQ ID NO: 23420 - DNA, 18 bp, synthetic construct
  source 1..18: mol_type = other DNA
taataaaacacgctatag

SEQ ID NO: 23421 - DNA, 18 bp, synthetic construct
  source 1..18: mol_type = other DNA
taatacgaccgactaatg

SEQ ID NO: 23422 - DNA, 18 bp, synthetic construct
  source 1..18: mol_type = other DNA
taatacgagttactagtg

SEQ ID NO: 23423 - DNA, 18 bp, synthetic construct
  source 1..18: mol_type = other DNA
taatacgtctcacctttg

SEQ ID NO: 23424 - DNA, 18 bp, synthetic construct
  source 1..18: mol_type = other DNA
taatatgactcaacattg

SEQ ID NO: 23425 - DNA, 18 bp, synthetic construct
  source 1..18: mol_type = other DNA
taatatgcctctctattg

SEQ ID NO: 23426 - DNA, 18 bp, synthetic construct
  source 1..18: mol_type = other DNA
taatcctactcacttttg

SEQ ID NO: 23427 - DNA, 18 bp, synthetic construct
  source 1..18: mol_type = other DNA
taatcctactcgctttag

SEQ ID NO: 23428 - DNA, 18 bp, synthetic construct
  source 1..18: mol_type = other DNA
taattcagctcactttag

SEQ ID NO: 23429 - DNA, 18 bp, synthetic construct
  source 1..18: mol_type = other DNA
taattcgacaaactacag

SEQ ID NO: 23430 - DNA, 18 bp, synthetic construct
  source 1..18: mol_type = other DNA
taattggactctctatcg

SEQ ID NO: 23431 - DNA, 18 bp, synthetic construct
  source 1..18: mol_type = other DNA
taatttgattaactatag

SEQ ID NO: 23432 - DNA, 18 bp, synthetic construct
  source 1..18: mol_type = other DNA
taatttgtctcactctag

SEQ ID NO: 23433 - DNA, 18 bp, synthetic construct
  source 1..18: mol_type = other DNA
tattacggctaactattg

SEQ ID NO: 23434 - DNA, 18 bp, synthetic construct
  source 1..18: mol_type = other DNA
tattaggactcagtattg

SEQ ID NO: 23435 - DNA, 18 bp, synthetic construct
  source 1..18: mol_type = other DNA
tcatacaactcagtattg

SEQ ID NO: 23436 - DNA, 18 bp, synthetic construct
  source 1..18: mol_type = other DNA
tcattcctctcactatag

SEQ ID NO: 23437 - DNA, 18 bp, synthetic construct
  source 1..18: mol_type = other DNA
tgatacgtctcattattg

SEQ ID NO: 23438 - DNA, 18 bp, synthetic construct
  source 1..18: mol_type = other DNA
tgattcgtctcacaatag

SEQ ID NO: 23439 - DNA, 18 bp, synthetic construct
  source 1..18: mol_type = other DNA
ttaatcgaatcactatag

SEQ ID NO: 23440 - DNA, 18 bp, synthetic construct
  source 1..18: mol_type = other DNA
ttactagactcactatag

SEQ ID NO: 23441 - DNA, 18 bp, synthetic construct
  source 1..18: mol_type = other DNA
ttatacgactagcaatag

SEQ ID NO: 23442 - DNA, 18 bp, synthetic construct
  source 1..18: mol_type = other DNA
ttatacgactcacttgtg

SEQ ID NO: 23443 - DNA, 18 bp, synthetic construct
  source 1..18: mol_type = other DNA
ttatgcgacacactattg

SEQ ID NO: 23444 - DNA, 18 bp, synthetic construct
  source 1..18: mol_type = other DNA
ttttacgtctcgctatag

SEQ ID NO: 23445 - DNA, 18 bp, synthetic construct
  source 1..18: mol_type = other DNA
tttttcgcctcactatag

SEQ ID NO: 23446 - DNA, 18 bp, synthetic construct
  source 1..18: mol_type = other DNA
aaacactactcattatag

SEQ ID NO: 23447 - DNA, 18 bp, synthetic construct
  source 1..18: mol_type = other DNA
aaagacgactatctatag

SEQ ID NO: 23448 - DNA, 18 bp, synthetic construct
  source 1..18: mol_type = other DNA
aaatacgtatcactatcg

SEQ ID NO: 23449 - DNA, 18 bp, synthetic construct
  source 1..18: mol_type = other DNA
aaatacgtctgactacag

SEQ ID NO: 23450 - DNA, 18 bp, synthetic construct
  source 1..18: mol_type = other DNA
aaatactcatcactatag

SEQ ID NO: 23451 - DNA, 18 bp, synthetic construct
  source 1..18: mol_type = other DNA
aaatatgactctcaatag

SEQ ID NO: 23452 - DNA, 18 bp, synthetic construct
  source 1..18: mol_type = other DNA
aattacgtctcactctag

SEQ ID NO: 23453 - DNA, 18 bp, synthetic construct
  source 1..18: mol_type = other DNA
aattactattcactatag

SEQ ID NO: 23454 - DNA, 18 bp, synthetic construct
  source 1..18: mol_type = other DNA
agaaacgaatcactatag

SEQ ID NO: 23455 - DNA, 18 bp, synthetic construct
  source 1..18: mol_type = other DNA
agctacgacgcactatag

SEQ ID NO: 23456 - DNA, 18 bp, synthetic construct
  source 1..18: mol_type = other DNA
caataagattcactaaag

SEQ ID NO: 23457 - DNA, 18 bp, synthetic construct
  source 1..18: mol_type = other DNA
caatacgactctcgatcg

SEQ ID NO: 23458 - DNA, 18 bp, synthetic construct
  source 1..18: mol_type = other DNA
caatacgtttcacaatag

SEQ ID NO: 23459 - DNA, 18 bp, synthetic construct
  source 1..18: mol_type = other DNA
caatatgattcactaaag

SEQ ID NO: 23460 - DNA, 18 bp, synthetic construct
  source 1..18: mol_type = other DNA
cataacgactcacaatag

SEQ ID NO: 23461 - DNA, 18 bp, synthetic construct
  source 1..18: mol_type = other DNA
ctgtacgactcacaatag

SEQ ID NO: 23462 - DNA, 18 bp, synthetic construct
  source 1..18: mol_type = other DNA
taaaacgacaaaatatag

SEQ ID NO: 23463 - DNA, 18 bp, synthetic construct
  source 1..18: mol_type = other DNA
taaaacgactctacatag

SEQ ID NO: 23464 - DNA, 18 bp, synthetic construct
  source 1..18: mol_type = other DNA
taaaacgtatcactagag

SEQ ID NO: 23465 - DNA, 18 bp, synthetic construct
  source 1..18: mol_type = other DNA
taaagcgtttcactatag

SEQ ID NO: 23466 - DNA, 18 bp, synthetic construct
  source 1..18: mol_type = other DNA
taacaagtcacactatag

SEQ ID NO: 23467 - DNA, 18 bp, synthetic construct
  source 1..18: mol_type = other DNA
taacactactcattttag

SEQ ID NO: 23468 - DNA, 18 bp, synthetic construct
  source 1..18: mol_type = other DNA
taatacaattcacactag

SEQ ID NO: 23469 - DNA, 18 bp, synthetic construct
  source 1..18: mol_type = other DNA
taataccacacactcaag

SEQ ID NO: 23470 - DNA, 18 bp, synthetic construct
  source 1..18: mol_type = other DNA
taataccattcacattag

SEQ ID NO: 23471 - DNA, 18 bp, synthetic construct
  source 1..18: mol_type = other DNA
taatacgaatgattaaag

SEQ ID NO: 23472 - DNA, 18 bp, synthetic construct
  source 1..18: mol_type = other DNA
taatacgactatcaatgg

SEQ ID NO: 23473 - DNA, 18 bp, synthetic construct
  source 1..18: mol_type = other DNA
taatacgactcaaactcg

SEQ ID NO: 23474 - DNA, 18 bp, synthetic construct
  source 1..18: mol_type = other DNA
taatacgatttaccttag

SEQ ID NO: 23475 - DNA, 18 bp, synthetic construct
  source 1..18: mol_type = other DNA
taatactgaacactatag

SEQ ID NO: 23476 - DNA, 18 bp, synthetic construct
  source 1..18: mol_type = other DNA
taatacttctaactacag

SEQ ID NO: 23477 - DNA, 18 bp, synthetic construct
  source 1..18: mol_type = other DNA
taatataattcactaaag

SEQ ID NO: 23478 - DNA, 18 bp, synthetic construct
  source 1..18: mol_type = other DNA
taatatgactctcaatcg

SEQ ID NO: 23479 - DNA, 18 bp, synthetic construct
  source 1..18: mol_type = other DNA
taatccttctcactttag

SEQ ID NO: 23480 - DNA, 18 bp, synthetic construct
  source 1..18: mol_type = other DNA
taatgagactctgtatag

SEQ ID NO: 23481 - DNA, 18 bp, synthetic construct
  source 1..18: mol_type = other DNA
taatgcgactatgtatag

SEQ ID NO: 23482 - DNA, 18 bp, synthetic construct
  source 1..18: mol_type = other DNA
tactacgatccacgatag

SEQ ID NO: 23483 - DNA, 18 bp, synthetic construct
  source 1..18: mol_type = other DNA
tagaacgactctctaaag

SEQ ID NO: 23484 - DNA, 18 bp, synthetic construct
  source 1..18: mol_type = other DNA
tataacgacaaactatag

SEQ ID NO: 23485 - DNA, 18 bp, synthetic construct
  source 1..18: mol_type = other DNA
tatgacaactcactttag

SEQ ID NO: 23486 - DNA, 18 bp, synthetic construct
  source 1..18: mol_type = other DNA
tattaccactaactaaag

SEQ ID NO: 23487 - DNA, 18 bp, synthetic construct
  source 1..18: mol_type = other DNA
tattacgaatcacttcag

SEQ ID NO: 23488 - DNA, 18 bp, synthetic construct
  source 1..18: mol_type = other DNA
tattacgattaaatatag

SEQ ID NO: 23489 - DNA, 18 bp, synthetic construct
  source 1..18: mol_type = other DNA
tattacgtctccatatag

SEQ ID NO: 23490 - DNA, 18 bp, synthetic construct
  source 1..18: mol_type = other DNA
tattacgtcttattatag

SEQ ID NO: 23491 - DNA, 18 bp, synthetic construct
  source 1..18: mol_type = other DNA
tattagaactcactatcg

SEQ ID NO: 23492 - DNA, 18 bp, synthetic construct
  source 1..18: mol_type = other DNA
tattatgactcagtaaag

SEQ ID NO: 23493 - DNA, 18 bp, synthetic construct
  source 1..18: mol_type = other DNA
tattccaactaactatag

SEQ ID NO: 23494 - DNA, 18 bp, synthetic construct
  source 1..18: mol_type = other DNA
tattccggctcactacag

SEQ ID NO: 23495 - DNA, 18 bp, synthetic construct
  source 1..18: mol_type = other DNA
tattcctactctctatag

SEQ ID NO: 23496 - DNA, 18 bp, synthetic construct
  source 1..18: mol_type = other DNA
tcatactactctccatag

SEQ ID NO: 23497 - DNA, 18 bp, synthetic construct
  source 1..18: mol_type = other DNA
tgatactactcacttcag

SEQ ID NO: 23498 - DNA, 18 bp, synthetic construct
  source 1..18: mol_type = other DNA
ttaaacgcctcacaatag

SEQ ID NO: 23499 - DNA, 18 bp, synthetic construct
  source 1..18: mol_type = other DNA
ttaaacggctcacgatag

SEQ ID NO: 23500 - DNA, 18 bp, synthetic construct
  source 1..18: mol_type = other DNA
ttataccactccctttag

SEQ ID NO: 23501 - DNA, 18 bp, synthetic construct
  source 1..18: mol_type = other DNA
ttatacgactaagaatag

SEQ ID NO: 23502 - DNA, 18 bp, synthetic construct
  source 1..18: mol_type = other DNA
ttatacgcctcattaaag

SEQ ID NO: 23503 - DNA, 18 bp, synthetic construct
  source 1..18: mol_type = other DNA
ttatacgtttcagtatag

SEQ ID NO: 23504 - DNA, 18 bp, synthetic construct
  source 1..18: mol_type = other DNA
ttataggacttactttag

SEQ ID NO: 23505 - DNA, 18 bp, synthetic construct
  source 1..18: mol_type = other DNA
ttatccgtctcactatcg

SEQ ID NO: 23506 - DNA, 18 bp, synthetic construct
  source 1..18: mol_type = other DNA
ttatcctactcactaaag

SEQ ID NO: 23507 - DNA, 18 bp, synthetic construct
  source 1..18: mol_type = other DNA
ttatgcgattcactctag

SEQ ID NO: 23508 - DNA, 18 bp, synthetic construct
  source 1..18: mol_type = other DNA
ttctacgactcacttaag

SEQ ID NO: 23509 - DNA, 18 bp, synthetic construct
  source 1..18: mol_type = other DNA
aaattcgtctcgctatag

SEQ ID NO: 23510 - DNA, 18 bp, synthetic construct
  source 1..18: mol_type = other DNA
atatgcgactcactattg

SEQ ID NO: 23511 - DNA, 18 bp, synthetic construct
  source 1..18: mol_type = other DNA
taacacgtctcactaatg

SEQ ID NO: 23512 - DNA, 18 bp, synthetic construct
  source 1..18: mol_type = other DNA
tattacgaatcaccattg

SEQ ID NO: 23513 - DNA, 18 bp, synthetic construct
  source 1..18: mol_type = other DNA
tattacgactcacttctg

SEQ ID NO: 23514 - DNA, 18 bp, synthetic construct
  source 1..18: mol_type = other DNA
taatactacaaactctag

SEQ ID NO: 23515 - DNA, 18 bp, synthetic construct
  source 1..18: mol_type = other DNA
tattacgtgtcaatatag

SEQ ID NO: 23516 - DNA, 18 bp, synthetic construct
  source 1..18: mol_type = other DNA
tgttacgactcacattag

SEQ ID NO: 23517 - DNA, 18 bp, synthetic construct
  source 1..18: mol_type = other DNA
ttatacgtctgacaatag

SEQ ID NO: 23518 - DNA, 18 bp, synthetic construct
  source 1..18: mol_type = other DNA
tatttcgtctcactattg

SEQ ID NO: 23519 - DNA, 18 bp, synthetic construct
  source 1..18: mol_type = other DNA
aaatacgactctttattg

SEQ ID NO: 23520 - DNA, 18 bp, synthetic construct
  source 1..18: mol_type = other DNA
tataacgactgactattg

SEQ ID NO: 23521 - DNA, 18 bp, synthetic construct
  source 1..18: mol_type = other DNA
taatacgactctattaag

SEQ ID NO: 23522 - DNA, 18 bp, synthetic construct
  source 1..18: mol_type = other DNA
tatcacgacatactatag

SEQ ID NO: 23523 - DNA, 18 bp, synthetic construct
  source 1..18: mol_type = other DNA
tattacgactctgtaaag

SEQ ID NO: 23524 - DNA, 18 bp, synthetic construct
  source 1..18: mol_type = other DNA
aaattccactcactattg

SEQ ID NO: 23525 - DNA, 18 bp, synthetic construct
  source 1..18: mol_type = other DNA
taaaacgattcgctattg

SEQ ID NO: 23526 - DNA, 18 bp, synthetic construct
  source 1..18: mol_type = other DNA
taaatcgaatcgctatag

SEQ ID NO: 23527 - DNA, 18 bp, synthetic construct
  source 1..18: mol_type = other DNA
taagccgactcgctattg

SEQ ID NO: 23528 - DNA, 18 bp, synthetic construct
  source 1..18: mol_type = other DNA
taatacgaattgctattg

SEQ ID NO: 23529 - DNA, 18 bp, synthetic construct
  source 1..18: mol_type = other DNA
taatacgactcgacattg

SEQ ID NO: 23530 - DNA, 18 bp, synthetic construct
  source 1..18: mol_type = other DNA
taatactactcgatattg

SEQ ID NO: 23531 - DNA, 18 bp, synthetic construct
  source 1..18: mol_type = other DNA
taatactactcgcaattg

SEQ ID NO: 23532 - DNA, 18 bp, synthetic construct
  source 1..18: mol_type = other DNA
taatatgactcgcttttg

SEQ ID NO: 23533 - DNA, 18 bp, synthetic construct
  source 1..18: mol_type = other DNA
taattagactcgctgtag

SEQ ID NO: 23534 - DNA, 18 bp, synthetic construct
  source 1..18: mol_type = other DNA
taattcgactcagtagtg

SEQ ID NO: 23535 - DNA, 18 bp, synthetic construct
  source 1..18: mol_type = other DNA
taattcgactcatttttg

SEQ ID NO: 23536 - DNA, 18 bp, synthetic construct
  source 1..18: mol_type = other DNA
tacttcgactcacttttg

SEQ ID NO: 23537 - DNA, 18 bp, synthetic construct
  source 1..18: mol_type = other DNA
tactttgactcactattg

SEQ ID NO: 23538 - DNA, 18 bp, synthetic construct
  source 1..18: mol_type = other DNA
tatttcgacccactattg

SEQ ID NO: 23539 - DNA, 18 bp, synthetic construct
  source 1..18: mol_type = other DNA
tatttcgactcgttatag

SEQ ID NO: 23540 - DNA, 18 bp, synthetic construct
  source 1..18: mol_type = other DNA
tgaaacgactcgctattg

SEQ ID NO: 23541 - DNA, 18 bp, synthetic construct
  source 1..18: mol_type = other DNA
tgattcgactcactcttg

SEQ ID NO: 23542 - DNA, 18 bp, synthetic construct
  source 1..18: mol_type = other DNA
aaagacgactaactattg

SEQ ID NO: 23543 - DNA, 18 bp, synthetic construct
  source 1..18: mol_type = other DNA
aaatacgaatcactactg

SEQ ID NO: 23544 - DNA, 18 bp, synthetic construct
  source 1..18: mol_type = other DNA
aaatacgacacacttttg

SEQ ID NO: 23545 - DNA, 18 bp, synthetic construct
  source 1..18: mol_type = other DNA
aaatacgactcactcctg

SEQ ID NO: 23546 - DNA, 18 bp, synthetic construct
  source 1..18: mol_type = other DNA
aaatacgattcacgattg

SEQ ID NO: 23547 - DNA, 18 bp, synthetic construct
  source 1..18: mol_type = other DNA
aaatacgcctcactaatg

SEQ ID NO: 23548 - DNA, 18 bp, synthetic construct
  source 1..18: mol_type = other DNA
aaatactactcgttatag

SEQ ID NO: 23549 - DNA, 18 bp, synthetic construct
  source 1..18: mol_type = other DNA
aaataggactccctattg

SEQ ID NO: 23550 - DNA, 18 bp, synthetic construct
  source 1..18: mol_type = other DNA
aaatatggctcactattg

SEQ ID NO: 23551 - DNA, 18 bp, synthetic construct
  source 1..18: mol_type = other DNA
aaatgcaactcactattg

SEQ ID NO: 23552 - DNA, 18 bp, synthetic construct
  source 1..18: mol_type = other DNA
aaattcgaatcactctag

SEQ ID NO: 23553 - DNA, 18 bp, synthetic construct
  source 1..18: mol_type = other DNA
aaattcgactgactttag

SEQ ID NO: 23554 - DNA, 18 bp, synthetic construct
  source 1..18: mol_type = other DNA
agaatcgactcactatag

SEQ ID NO: 23555 - DNA, 18 bp, synthetic construct
  source 1..18: mol_type = other DNA
caaatagactcactatag

SEQ ID NO: 23556 - DNA, 18 bp, synthetic construct
  source 1..18: mol_type = other DNA
caaatcgcctcactatag

SEQ ID NO: 23557 - DNA, 18 bp, synthetic construct
  source 1..18: mol_type = other DNA
caatacgactcattgttg

SEQ ID NO: 23558 - DNA, 18 bp, synthetic construct
  source 1..18: mol_type = other DNA
caatacgactcgcttaag

SEQ ID NO: 23559 - DNA, 18 bp, synthetic construct
  source 1..18: mol_type = other DNA
caatacgactctcttttg

SEQ ID NO: 23560 - DNA, 18 bp, synthetic construct
  source 1..18: mol_type = other DNA
caatatgactaactattg

SEQ ID NO: 23561 - DNA, 18 bp, synthetic construct
  source 1..18: mol_type = other DNA
caattcgtctcactacag

SEQ ID NO: 23562 - DNA, 18 bp, synthetic construct
  source 1..18: mol_type = other DNA
cattacgactcacaattg

SEQ ID NO: 23563 - DNA, 18 bp, synthetic construct
  source 1..18: mol_type = other DNA
catttcgactcactagag

SEQ ID NO: 23564 - DNA, 18 bp, synthetic construct
  source 1..18: mol_type = other DNA
cgattcgactcactgtag

SEQ ID NO: 23565 - DNA, 18 bp, synthetic construct
  source 1..18: mol_type = other DNA
ctattcgacgcactatag

SEQ ID NO: 23566 - DNA, 18 bp, synthetic construct
  source 1..18: mol_type = other DNA
ctattcgactcactgtag

SEQ ID NO: 23567 - DNA, 18 bp, synthetic construct
  source 1..18: mol_type = other DNA
gaatccgactcattattg

SEQ ID NO: 23568 - DNA, 18 bp, synthetic construct
  source 1..18: mol_type = other DNA
gaattcaactcactacag

SEQ ID NO: 23569 - DNA, 18 bp, synthetic construct
  source 1..18: mol_type = other DNA
gaattcgattctctatag

SEQ ID NO: 23570 - DNA, 18 bp, synthetic construct
  source 1..18: mol_type = other DNA
gattgcgactcactattg

SEQ ID NO: 23571 - DNA, 18 bp, synthetic construct
  source 1..18: mol_type = other DNA
gcatacgactcaatattg

SEQ ID NO: 23572 - DNA, 18 bp, synthetic construct
  source 1..18: mol_type = other DNA
taaaaagactcacttttg

SEQ ID NO: 23573 - DNA, 18 bp, synthetic construct
  source 1..18: mol_type = other DNA
taaaacacctcactattg

SEQ ID NO: 23574 - DNA, 18 bp, synthetic construct
  source 1..18: mol_type = other DNA
taaaacatctcgctatag

SEQ ID NO: 23575 - DNA, 18 bp, synthetic construct
  source 1..18: mol_type = other DNA
taaaacgagtcagtattg

SEQ ID NO: 23576 - DNA, 18 bp, synthetic construct
  source 1..18: mol_type = other DNA
taaaacgattcactactg

SEQ ID NO: 23577 - DNA, 18 bp, synthetic construct
  source 1..18: mol_type = other DNA
taaaacgcctcaccattg

SEQ ID NO: 23578 - DNA, 18 bp, synthetic construct
  source 1..18: mol_type = other DNA
taaaacgcctcacttttg

SEQ ID NO: 23579 - DNA, 18 bp, synthetic construct
  source 1..18: mol_type = other DNA
taaatcgacttagtatag

SEQ ID NO: 23580 - DNA, 18 bp, synthetic construct
  source 1..18: mol_type = other DNA
taaatcgcatcactatag

SEQ ID NO: 23581 - DNA, 18 bp, synthetic construct
  source 1..18: mol_type = other DNA
taaattgactcattatag

SEQ ID NO: 23582 - DNA, 18 bp, synthetic construct
  source 1..18: mol_type = other DNA
taacacgaataactattg

SEQ ID NO: 23583 - DNA, 18 bp, synthetic construct
  source 1..18: mol_type = other DNA
taacacgacaaactattg

SEQ ID NO: 23584 - DNA, 18 bp, synthetic construct
  source 1..18: mol_type = other DNA
taacacgactcgctcgag

SEQ ID NO: 23585 - DNA, 18 bp, synthetic construct
  source 1..18: mol_type = other DNA
taacacgacttacaattg

SEQ ID NO: 23586 - DNA, 18 bp, synthetic construct
  source 1..18: mol_type = other DNA
taacacgacttactagtg

SEQ ID NO: 23587 - DNA, 18 bp, synthetic construct
  source 1..18: mol_type = other DNA
taacacgagtagctatag

SEQ ID NO: 23588 - DNA, 18 bp, synthetic construct
  source 1..18: mol_type = other DNA
taactcgacctactatag

SEQ ID NO: 23589 - DNA, 18 bp, synthetic construct
  source 1..18: mol_type = other DNA
taagacgactcgccatcg

SEQ ID NO: 23590 - DNA, 18 bp, synthetic construct
  source 1..18: mol_type = other DNA
taagtcttctcactatag

SEQ ID NO: 23591 - DNA, 18 bp, synthetic construct
  source 1..18: mol_type = other DNA
taagttgactaactatag

SEQ ID NO: 23592 - DNA, 18 bp, synthetic construct
  source 1..18: mol_type = other DNA
taataagactccatattg

SEQ ID NO: 23593 - DNA, 18 bp, synthetic construct
  source 1..18: mol_type = other DNA
taataagattcgatatag

SEQ ID NO: 23594 - DNA, 18 bp, synthetic construct
  source 1..18: mol_type = other DNA
taatacaaatcattattg

SEQ ID NO: 23595 - DNA, 18 bp, synthetic construct
  source 1..18: mol_type = other DNA
taatacaactcaatagtg

SEQ ID NO: 23596 - DNA, 18 bp, synthetic construct
  source 1..18: mol_type = other DNA
taataccccgcactattg

SEQ ID NO: 23597 - DNA, 18 bp, synthetic construct
  source 1..18: mol_type = other DNA
taatacgaatcagtactg

SEQ ID NO: 23598 - DNA, 18 bp, synthetic construct
  source 1..18: mol_type = other DNA
taatacgacaaacaattg

SEQ ID NO: 23599 - DNA, 18 bp, synthetic construct
  source 1..18: mol_type = other DNA
taatacgacccaccaatg

SEQ ID NO: 23600 - DNA, 18 bp, synthetic construct
  source 1..18: mol_type = other DNA
taatacgaccccttattg

SEQ ID NO: 23601 - DNA, 18 bp, synthetic construct
  source 1..18: mol_type = other DNA
taatacgactaagttttg

SEQ ID NO: 23602 - DNA, 18 bp, synthetic construct
  source 1..18: mol_type = other DNA
taatacgactcaaaactg

SEQ ID NO: 23603 - DNA, 18 bp, synthetic construct
  source 1..18: mol_type = other DNA
taatacgagtctgtattg

SEQ ID NO: 23604 - DNA, 18 bp, synthetic construct
  source 1..18: mol_type = other DNA
taatacgatacgctaaag

SEQ ID NO: 23605 - DNA, 18 bp, synthetic construct
  source 1..18: mol_type = other DNA
taatacgcctcacttctg

SEQ ID NO: 23606 - DNA, 18 bp, synthetic construct
  source 1..18: mol_type = other DNA
taatacgcctcgcaaaag

SEQ ID NO: 23607 - DNA, 18 bp, synthetic construct
  source 1..18: mol_type = other DNA
taatacgtctcgctcaag

SEQ ID NO: 23608 - DNA, 18 bp, synthetic construct
  source 1..18: mol_type = other DNA
taatacgtctggctctag

SEQ ID NO: 23609 - DNA, 18 bp, synthetic construct
  source 1..18: mol_type = other DNA
taatactaatcactgttg

SEQ ID NO: 23610 - DNA, 18 bp, synthetic construct
  source 1..18: mol_type = other DNA
taatactacaggctatag

SEQ ID NO: 23611 - DNA, 18 bp, synthetic construct
  source 1..18: mol_type = other DNA
taatactcctctctattg

SEQ ID NO: 23612 - DNA, 18 bp, synthetic construct
  source 1..18: mol_type = other DNA
taatactgcccactattg

SEQ ID NO: 23613 - DNA, 18 bp, synthetic construct
  source 1..18: mol_type = other DNA
taataggaatcactaatg

SEQ ID NO: 23614 - DNA, 18 bp, synthetic construct
  source 1..18: mol_type = other DNA
taataggactagctacag

SEQ ID NO: 23615 - DNA, 18 bp, synthetic construct
  source 1..18: mol_type = other DNA
taatatcactcacttttg

SEQ ID NO: 23616 - DNA, 18 bp, synthetic construct
  source 1..18: mol_type = other DNA
taatatgactccctagtg

SEQ ID NO: 23617 - DNA, 18 bp, synthetic construct
  source 1..18: mol_type = other DNA
taatatgactctctatta

SEQ ID NO: 23618 - DNA, 18 bp, synthetic construct
  source 1..18: mol_type = other DNA
taatatgacttaccattg

SEQ ID NO: 23619 - DNA, 18 bp, synthetic construct
  source 1..18: mol_type = other DNA
taatatgatttactattg

SEQ ID NO: 23620 - DNA, 18 bp, synthetic construct
  source 1..18: mol_type = other DNA
taatccgactcaattttg

SEQ ID NO: 23621 - DNA, 18 bp, synthetic construct
  source 1..18: mol_type = other DNA
taatccgactcacgtttg

SEQ ID NO: 23622 - DNA, 18 bp, synthetic construct
  source 1..18: mol_type = other DNA
taatgagattcactattg

SEQ ID NO: 23623 - DNA, 18 bp, synthetic construct
  source 1..18: mol_type = other DNA
taatgcaagtcactattg

SEQ ID NO: 23624 - DNA, 18 bp, synthetic construct
  source 1..18: mol_type = other DNA
taatgcgactcgttaaag

SEQ ID NO: 23625 - DNA, 18 bp, synthetic construct
  source 1..18: mol_type = other DNA
taattaaactccctatag

SEQ ID NO: 23626 - DNA, 18 bp, synthetic construct
  source 1..18: mol_type = other DNA
taattacactcacgatag

SEQ ID NO: 23627 - DNA, 18 bp, synthetic construct
  source 1..18: mol_type = other DNA
taattattctcactatag

SEQ ID NO: 23628 - DNA, 18 bp, synthetic construct
  source 1..18: mol_type = other DNA
taattcaacgcattatag

SEQ ID NO: 23629 - DNA, 18 bp, synthetic construct
  source 1..18: mol_type = other DNA
taattcaactcaatatgg

SEQ ID NO: 23630 - DNA, 18 bp, synthetic construct
  source 1..18: mol_type = other DNA
taattcaactcacaacag

SEQ ID NO: 23631 - DNA, 18 bp, synthetic construct
  source 1..18: mol_type = other DNA
taattcaactctctatcg

SEQ ID NO: 23632 - DNA, 18 bp, synthetic construct
  source 1..18: mol_type = other DNA
taattcaactctctgtag

SEQ ID NO: 23633 - DNA, 18 bp, synthetic construct
  source 1..18: mol_type = other DNA
taattcatctgactatag

SEQ ID NO: 23634 - DNA, 18 bp, synthetic construct
  source 1..18: mol_type = other DNA
taattccactcaccaaag

SEQ ID NO: 23635 - DNA, 18 bp, synthetic construct
  source 1..18: mol_type = other DNA
taattccattcactgtag

SEQ ID NO: 23636 - DNA, 18 bp, synthetic construct
  source 1..18: mol_type = other DNA
taattcgaatcacactag

SEQ ID NO: 23637 - DNA, 18 bp, synthetic construct
  source 1..18: mol_type = other DNA
taattcgactaagtttag

SEQ ID NO: 23638 - DNA, 18 bp, synthetic construct
  source 1..18: mol_type = other DNA
taattcgactcaagacag

SEQ ID NO: 23639 - DNA, 18 bp, synthetic construct
  source 1..18: mol_type = other DNA
taattcgactctttatgg

SEQ ID NO: 23640 - DNA, 18 bp, synthetic construct
  source 1..18: mol_type = other DNA
taattcgactttctctag

SEQ ID NO: 23641 - DNA, 18 bp, synthetic construct
  source 1..18: mol_type = other DNA
taattcgagtgactctag

SEQ ID NO: 23642 - DNA, 18 bp, synthetic construct
  source 1..18: mol_type = other DNA
taattcgcctctcgatag

SEQ ID NO: 23643 - DNA, 18 bp, synthetic construct
  source 1..18: mol_type = other DNA
taattcggctcattaaag

SEQ ID NO: 23644 - DNA, 18 bp, synthetic construct
  source 1..18: mol_type = other DNA
taattcggctgactaaag

SEQ ID NO: 23645 - DNA, 18 bp, synthetic construct
  source 1..18: mol_type = other DNA
taattcggttcactttag

SEQ ID NO: 23646 - DNA, 18 bp, synthetic construct
  source 1..18: mol_type = other DNA
taattcgtcccaatatag

SEQ ID NO: 23647 - DNA, 18 bp, synthetic construct
  source 1..18: mol_type = other DNA
taattcgtctaaccatag

SEQ ID NO: 23648 - DNA, 18 bp, synthetic construct
  source 1..18: mol_type = other DNA
taattcgtctcacattag

SEQ ID NO: 23649 - DNA, 18 bp, synthetic construct
  source 1..18: mol_type = other DNA
taattctactcaatttag

SEQ ID NO: 23650 - DNA, 18 bp, synthetic construct
  source 1..18: mol_type = other DNA
taattctagtcaatatag

SEQ ID NO: 23651 - DNA, 18 bp, synthetic construct
  source 1..18: mol_type = other DNA
taattggactcagtatgg

SEQ ID NO: 23652 - DNA, 18 bp, synthetic construct
  source 1..18: mol_type = other DNA
taattggactgactaaag

SEQ ID NO: 23653 - DNA, 18 bp, synthetic construct
  source 1..18: mol_type = other DNA
taattggactgactttag

SEQ ID NO: 23654 - DNA, 18 bp, synthetic construct
  source 1..18: mol_type = other DNA
taattgtacacactatag

SEQ ID NO: 23655 - DNA, 18 bp, synthetic construct
  source 1..18: mol_type = other DNA
taatttgaatccctatag

SEQ ID NO: 23656 - DNA, 18 bp, synthetic construct
  source 1..18: mol_type = other DNA
taatttgattccctatag

SEQ ID NO: 23657 - DNA, 18 bp, synthetic construct
  source 1..18: mol_type = other DNA
taatttgtctcactatcg

SEQ ID NO: 23658 - DNA, 18 bp, synthetic construct
  source 1..18: mol_type = other DNA
taattttactcactttag

SEQ ID NO: 23659 - DNA, 18 bp, synthetic construct
  source 1..18: mol_type = other DNA
taccacgacttgctatag

SEQ ID NO: 23660 - DNA, 18 bp, synthetic construct
  source 1..18: mol_type = other DNA
tactaagactcaatattg

SEQ ID NO: 23661 - DNA, 18 bp, synthetic construct
  source 1..18: mol_type = other DNA
tactaccactcgctaaag

SEQ ID NO: 23662 - DNA, 18 bp, synthetic construct
  source 1..18: mol_type = other DNA
tactacgaatcgctctag

SEQ ID NO: 23663 - DNA, 18 bp, synthetic construct
  source 1..18: mol_type = other DNA
tactacgacccacaattg

SEQ ID NO: 23664 - DNA, 18 bp, synthetic construct
  source 1..18: mol_type = other DNA
tactacgactaaatattg

SEQ ID NO: 23665 - DNA, 18 bp, synthetic construct
  source 1..18: mol_type = other DNA
tactacgactgactactg

SEQ ID NO: 23666 - DNA, 18 bp, synthetic construct
  source 1..18: mol_type = other DNA
tactcagactcactattg

SEQ ID NO: 23667 - DNA, 18 bp, synthetic construct
  source 1..18: mol_type = other DNA
tactccgactcagtattg

SEQ ID NO: 23668 - DNA, 18 bp, synthetic construct
  source 1..18: mol_type = other DNA
tacttccactcaccatag

SEQ ID NO: 23669 - DNA, 18 bp, synthetic construct
  source 1..18: mol_type = other DNA
tacttccactcactgtag

SEQ ID NO: 23670 - DNA, 18 bp, synthetic construct
  source 1..18: mol_type = other DNA
tactttgcctcactatag

SEQ ID NO: 23671 - DNA, 18 bp, synthetic construct
  source 1..18: mol_type = other DNA
tagctcgcctcactatag

SEQ ID NO: 23672 - DNA, 18 bp, synthetic construct
  source 1..18: mol_type = other DNA
taggaggactcactattg

SEQ ID NO: 23673 - DNA, 18 bp, synthetic construct
  source 1..18: mol_type = other DNA
tagtacgactcgataaag

SEQ ID NO: 23674 - DNA, 18 bp, synthetic construct
  source 1..18: mol_type = other DNA
tagttcgattccctatag

SEQ ID NO: 23675 - DNA, 18 bp, synthetic construct
  source 1..18: mol_type = other DNA
tagttctactcacaatag

SEQ ID NO: 23676 - DNA, 18 bp, synthetic construct
  source 1..18: mol_type = other DNA
tatctcggctcactatag

SEQ ID NO: 23677 - DNA, 18 bp, synthetic construct
  source 1..18: mol_type = other DNA
tattacgacgcactaatg

SEQ ID NO: 23678 - DNA, 18 bp, synthetic construct
  source 1..18: mol_type = other DNA
tattacggctccctattg

SEQ ID NO: 23679 - DNA, 18 bp, synthetic construct
  source 1..18: mol_type = other DNA
tattacgtctcgccatag

SEQ ID NO: 23680 - DNA, 18 bp, synthetic construct
  source 1..18: mol_type = other DNA
tattacgtgtcgctatag

SEQ ID NO: 23681 - DNA, 18 bp, synthetic construct
  source 1..18: mol_type = other DNA
tattactactcgctttag

SEQ ID NO: 23682 - DNA, 18 bp, synthetic construct
  source 1..18: mol_type = other DNA
tattaggactcattattg

SEQ ID NO: 23683 - DNA, 18 bp, synthetic construct
  source 1..18: mol_type = other DNA
tattccgactcaatattg

SEQ ID NO: 23684 - DNA, 18 bp, synthetic construct
  source 1..18: mol_type = other DNA
tatttagactcaccatag

SEQ ID NO: 23685 - DNA, 18 bp, synthetic construct
  source 1..18: mol_type = other DNA
tatttccactaactatag

SEQ ID NO: 23686 - DNA, 18 bp, synthetic construct
  source 1..18: mol_type = other DNA
tatttcgactaaccatag

SEQ ID NO: 23687 - DNA, 18 bp, synthetic construct
  source 1..18: mol_type = other DNA
tatttcgagtaactatag

SEQ ID NO: 23688 - DNA, 18 bp, synthetic construct
  source 1..18: mol_type = other DNA
tatttcggctcagtatag

SEQ ID NO: 23689 - DNA, 18 bp, synthetic construct
  source 1..18: mol_type = other DNA
tcataccactcacttttg

SEQ ID NO: 23690 - DNA, 18 bp, synthetic construct
  source 1..18: mol_type = other DNA
tcatacgacaaactattg

SEQ ID NO: 23691 - DNA, 18 bp, synthetic construct
  source 1..18: mol_type = other DNA
tcatacgattcgctaaag

SEQ ID NO: 23692 - DNA, 18 bp, synthetic construct
  source 1..18: mol_type = other DNA
tcatatgattcactattg

SEQ ID NO: 23693 - DNA, 18 bp, synthetic construct
  source 1..18: mol_type = other DNA
tcatccgactcgctaaag

SEQ ID NO: 23694 - DNA, 18 bp, synthetic construct
  source 1..18: mol_type = other DNA
tcatgcgaatcactattg

SEQ ID NO: 23695 - DNA, 18 bp, synthetic construct
  source 1..18: mol_type = other DNA
tcattagactctctatag

SEQ ID NO: 23696 - DNA, 18 bp, synthetic construct
  source 1..18: mol_type = other DNA
tcattagtctcactatag

SEQ ID NO: 23697 - DNA, 18 bp, synthetic construct
  source 1..18: mol_type = other DNA
tcattcgactcaccatcg

SEQ ID NO: 23698 - DNA, 18 bp, synthetic construct
  source 1..18: mol_type = other DNA
tcattcgacttactatgg

SEQ ID NO: 23699 - DNA, 18 bp, synthetic construct
  source 1..18: mol_type = other DNA
tcattcgcctaactatag

SEQ ID NO: 23700 - DNA, 18 bp, synthetic construct
  source 1..18: mol_type = other DNA
tcattcttctcactatag

SEQ ID NO: 23701 - DNA, 18 bp, synthetic construct
  source 1..18: mol_type = other DNA
tctttcgactcattatag

SEQ ID NO: 23702 - DNA, 18 bp, synthetic construct
  source 1..18: mol_type = other DNA
tgaatcaactcactatag

SEQ ID NO: 23703 - DNA, 18 bp, synthetic construct
  source 1..18: mol_type = other DNA
tgataagactcacttttg

SEQ ID NO: 23704 - DNA, 18 bp, synthetic construct
  source 1..18: mol_type = other DNA
tgatacgaatcaatattg

SEQ ID NO: 23705 - DNA, 18 bp, synthetic construct
  source 1..18: mol_type = other DNA
tgatacgaccctctattg

SEQ ID NO: 23706 - DNA, 18 bp, synthetic construct
  source 1..18: mol_type = other DNA
tgatacgactcccttttg

SEQ ID NO: 23707 - DNA, 18 bp, synthetic construct
  source 1..18: mol_type = other DNA
tgatacgactccttattg

SEQ ID NO: 23708 - DNA, 18 bp, synthetic construct
  source 1..18: mol_type = other DNA
tgatacgactcgccctag

SEQ ID NO: 23709 - DNA, 18 bp, synthetic construct
  source 1..18: mol_type = other DNA
tgatacgagtcactgttg

SEQ ID NO: 23710 - DNA, 18 bp, synthetic construct
  source 1..18: mol_type = other DNA
tgatacgattcacaattg

SEQ ID NO: 23711 - DNA, 18 bp, synthetic construct
  source 1..18: mol_type = other DNA
tgataggactctctattg

SEQ ID NO: 23712 - DNA, 18 bp, synthetic construct
  source 1..18: mol_type = other DNA
tgatgcgactcacaattg

SEQ ID NO: 23713 - DNA, 18 bp, synthetic construct
  source 1..18: mol_type = other DNA
tgattcgaaacactatag

SEQ ID NO: 23714 - DNA, 18 bp, synthetic construct
  source 1..18: mol_type = other DNA
tgattctactccctatag

SEQ ID NO: 23715 - DNA, 18 bp, synthetic construct
  source 1..18: mol_type = other DNA
tgtttcgactcactacag

SEQ ID NO: 23716 - DNA, 18 bp, synthetic construct
  source 1..18: mol_type = other DNA
ttaatcgactcaatatag

SEQ ID NO: 23717 - DNA, 18 bp, synthetic construct
  source 1..18: mol_type = other DNA
ttataaggctcgctatag

SEQ ID NO: 23718 - DNA, 18 bp, synthetic construct
  source 1..18: mol_type = other DNA
ttatacgaatcgccatag

SEQ ID NO: 23719 - DNA, 18 bp, synthetic construct
  source 1..18: mol_type = other DNA
ttatacgaccaactattg

SEQ ID NO: 23720 - DNA, 18 bp, synthetic construct
  source 1..18: mol_type = other DNA
ttatacgactcacaagtg

SEQ ID NO: 23721 - DNA, 18 bp, synthetic construct
  source 1..18: mol_type = other DNA
ttatacgtatcgctatag

SEQ ID NO: 23722 - DNA, 18 bp, synthetic construct
  source 1..18: mol_type = other DNA
ttatgcgactcgcgatag

SEQ ID NO: 23723 - DNA, 18 bp, synthetic construct
  source 1..18: mol_type = other DNA
ttattccactcagtatag

SEQ ID NO: 23724 - DNA, 18 bp, synthetic construct
  source 1..18: mol_type = other DNA
ttattcgactctctgtag

SEQ ID NO: 23725 - DNA, 18 bp, synthetic construct
  source 1..18: mol_type = other DNA
tttttcgactcactagag

SEQ ID NO: 23726 - DNA, 18 bp, synthetic construct
  source 1..18: mol_type = other DNA
aaaaacgactaactacag

SEQ ID NO: 23727 - DNA, 18 bp, synthetic construct
  source 1..18: mol_type = other DNA
aaaaacgcttcactatag

SEQ ID NO: 23728 - DNA, 18 bp, synthetic construct
  source 1..18: mol_type = other DNA
aaacacgactcactaggg

SEQ ID NO: 23729 - DNA, 18 bp, synthetic construct
  source 1..18: mol_type = other DNA
aaacacgagtcaccatag

SEQ ID NO: 23730 - DNA, 18 bp, synthetic construct
  source 1..18: mol_type = other DNA
aaagatgactctctatag

SEQ ID NO: 23731 - DNA, 18 bp, synthetic construct
  source 1..18: mol_type = other DNA
aaataagacctactatag

SEQ ID NO: 23732 - DNA, 18 bp, synthetic construct
  source 1..18: mol_type = other DNA
aaataagactcacaacag

SEQ ID NO: 23733 - DNA, 18 bp, synthetic construct
  source 1..18: mol_type = other DNA
aaataatactcaatatag

SEQ ID NO: 23734 - DNA, 18 bp, synthetic construct
  source 1..18: mol_type = other DNA
aaatacaacccactttag

SEQ ID NO: 23735 - DNA, 18 bp, synthetic construct
  source 1..18: mol_type = other DNA
aaatacaactaactacag

SEQ ID NO: 23736 - DNA, 18 bp, synthetic construct
  source 1..18: mol_type = other DNA
aaatacaactcactttgg

SEQ ID NO: 23737 - DNA, 18 bp, synthetic construct
  source 1..18: mol_type = other DNA
aaatacaactctctgtag

SEQ ID NO: 23738 - DNA, 18 bp, synthetic construct
  source 1..18: mol_type = other DNA
aaatacaagtcacaatag

SEQ ID NO: 23739 - DNA, 18 bp, synthetic construct
  source 1..18: mol_type = other DNA
aaatacaattctctatag

SEQ ID NO: 23740 - DNA, 18 bp, synthetic construct
  source 1..18: mol_type = other DNA
aaatacatcttactatag

SEQ ID NO: 23741 - DNA, 18 bp, synthetic construct
  source 1..18: mol_type = other DNA
aaatacgactatcgatag

SEQ ID NO: 23742 - DNA, 18 bp, synthetic construct
  source 1..18: mol_type = other DNA
aaatacgactcatactag

SEQ ID NO: 23743 - DNA, 18 bp, synthetic construct
  source 1..18: mol_type = other DNA
aaatacgacttaatacag

SEQ ID NO: 23744 - DNA, 18 bp, synthetic construct
  source 1..18: mol_type = other DNA
aaatacgactttatatag

SEQ ID NO: 23745 - DNA, 18 bp, synthetic construct
  source 1..18: mol_type = other DNA
aaatacgagttattatag

SEQ ID NO: 23746 - DNA, 18 bp, synthetic construct
  source 1..18: mol_type = other DNA
aaatacgattcagaatag

SEQ ID NO: 23747 - DNA, 18 bp, synthetic construct
  source 1..18: mol_type = other DNA
aaatacgattctatatag

SEQ ID NO: 23748 - DNA, 18 bp, synthetic construct
  source 1..18: mol_type = other DNA
aaatacgccacactttag

SEQ ID NO: 23749 - DNA, 18 bp, synthetic construct
  source 1..18: mol_type = other DNA
aaatacgctacactatag

SEQ ID NO: 23750 - DNA, 18 bp, synthetic construct
  source 1..18: mol_type = other DNA
aaatacgtctaactgtag

SEQ ID NO: 23751 - DNA, 18 bp, synthetic construct
  source 1..18: mol_type = other DNA
aaatacgtctcataatag

SEQ ID NO: 23752 - DNA, 18 bp, synthetic construct
  source 1..18: mol_type = other DNA
aaatacgtctcattacag

SEQ ID NO: 23753 - DNA, 18 bp, synthetic construct
  source 1..18: mol_type = other DNA
aaatacgtctccgtatag

SEQ ID NO: 23754 - DNA, 18 bp, synthetic construct
  source 1..18: mol_type = other DNA
aaatacgttccactatag

SEQ ID NO: 23755 - DNA, 18 bp, synthetic construct
  source 1..18: mol_type = other DNA
aaatactacacactagag

SEQ ID NO: 23756 - DNA, 18 bp, synthetic construct
  source 1..18: mol_type = other DNA
aaatactacctactatag

SEQ ID NO: 23757 - DNA, 18 bp, synthetic construct
  source 1..18: mol_type = other DNA
aaatactactaaatatag

SEQ ID NO: 23758 - DNA, 18 bp, synthetic construct
  source 1..18: mol_type = other DNA
aaatactacttactaaag

SEQ ID NO: 23759 - DNA, 18 bp, synthetic construct
  source 1..18: mol_type = other DNA
aaatactacttactataa

SEQ ID NO: 23760 - DNA, 18 bp, synthetic construct
  source 1..18: mol_type = other DNA
aaatactattcactagag

SEQ ID NO: 23761 - DNA, 18 bp, synthetic construct
  source 1..18: mol_type = other DNA
aaatactattcactatcg

SEQ ID NO: 23762 - DNA, 18 bp, synthetic construct
  source 1..18: mol_type = other DNA
aaatactcctctctatag

SEQ ID NO: 23763 - DNA, 18 bp, synthetic construct
  source 1..18: mol_type = other DNA
aaatacttctcagtatag

SEQ ID NO: 23764 - DNA, 18 bp, synthetic construct
  source 1..18: mol_type = other DNA
aaataggagttactatag

SEQ ID NO: 23765 - DNA, 18 bp, synthetic construct
  source 1..18: mol_type = other DNA
aaatattgctcactatag

SEQ ID NO: 23766 - DNA, 18 bp, synthetic construct
  source 1..18: mol_type = other DNA
aaatccggcttactatag

SEQ ID NO: 23767 - DNA, 18 bp, synthetic construct
  source 1..18: mol_type = other DNA
aaatccgtcacactatag

SEQ ID NO: 23768 - DNA, 18 bp, synthetic construct
  source 1..18: mol_type = other DNA
aaatgcgactcactccag

SEQ ID NO: 23769 - DNA, 18 bp, synthetic construct
  source 1..18: mol_type = other DNA
aaatgcgtctcactctag

SEQ ID NO: 23770 - DNA, 18 bp, synthetic construct
  source 1..18: mol_type = other DNA
aaatgtgactcactgtag

SEQ ID NO: 23771 - DNA, 18 bp, synthetic construct
  source 1..18: mol_type = other DNA
aacaacgcctcactatag

SEQ ID NO: 23772 - DNA, 18 bp, synthetic construct
  source 1..18: mol_type = other DNA
aactacgactgactatcg

SEQ ID NO: 23773 - DNA, 18 bp, synthetic construct
  source 1..18: mol_type = other DNA
aagtactactcacaatag

SEQ ID NO: 23774 - DNA, 18 bp, synthetic construct
  source 1..18: mol_type = other DNA
aataaagactcactatag

SEQ ID NO: 23775 - DNA, 18 bp, synthetic construct
  source 1..18: mol_type = other DNA
aataacgacgcactatag

SEQ ID NO: 23776 - DNA, 18 bp, synthetic construct
  source 1..18: mol_type = other DNA
aattaagactcactaaag

SEQ ID NO: 23777 - DNA, 18 bp, synthetic construct
  source 1..18: mol_type = other DNA
aattacgactcaccagag

SEQ ID NO: 23778 - DNA, 18 bp, synthetic construct
  source 1..18: mol_type = other DNA
aattacgacttcctatag

SEQ ID NO: 23779 - DNA, 18 bp, synthetic construct
  source 1..18: mol_type = other DNA
acacaagactcactatag

SEQ ID NO: 23780 - DNA, 18 bp, synthetic construct
  source 1..18: mol_type = other DNA
acataccactcactaaag

SEQ ID NO: 23781 - DNA, 18 bp, synthetic construct
  source 1..18: mol_type = other DNA
acatacctctcactatag

SEQ ID NO: 23782 - DNA, 18 bp, synthetic construct
  source 1..18: mol_type = other DNA
acatacgaattactatag

SEQ ID NO: 23783 - DNA, 18 bp, synthetic construct
  source 1..18: mol_type = other DNA
acatactactctctatag

SEQ ID NO: 23784 - DNA, 18 bp, synthetic construct
  source 1..18: mol_type = other DNA
agatacgactctcaatag

SEQ ID NO: 23785 - DNA, 18 bp, synthetic construct
  source 1..18: mol_type = other DNA
agataggactcactatcg

SEQ ID NO: 23786 - DNA, 18 bp, synthetic construct
  source 1..18: mol_type = other DNA
atatacgaatcacgatag

SEQ ID NO: 23787 - DNA, 18 bp, synthetic construct
  source 1..18: mol_type = other DNA
atatacgacccactctag

SEQ ID NO: 23788 - DNA, 18 bp, synthetic construct
  source 1..18: mol_type = other DNA
atatgcgaatcactatag

SEQ ID NO: 23789 - DNA, 18 bp, synthetic construct
  source 1..18: mol_type = other DNA
caaaacgattgactatag

SEQ ID NO: 23790 - DNA, 18 bp, synthetic construct
  source 1..18: mol_type = other DNA
caaaactactcattatag

SEQ ID NO: 23791 - DNA, 18 bp, synthetic construct
  source 1..18: mol_type = other DNA
caacacgactcactcgag

SEQ ID NO: 23792 - DNA, 18 bp, synthetic construct
  source 1..18: mol_type = other DNA
caacacgattcaccatag

SEQ ID NO: 23793 - DNA, 18 bp, synthetic construct
  source 1..18: mol_type = other DNA
caataagacacactatgg

SEQ ID NO: 23794 - DNA, 18 bp, synthetic construct
  source 1..18: mol_type = other DNA
caatacaacccactacag

SEQ ID NO: 23795 - DNA, 18 bp, synthetic construct
  source 1..18: mol_type = other DNA
caataccacccactatgg

SEQ ID NO: 23796 - DNA, 18 bp, synthetic construct
  source 1..18: mol_type = other DNA
caatacctctccctatag

SEQ ID NO: 23797 - DNA, 18 bp, synthetic construct
  source 1..18: mol_type = other DNA
caatacgaatgactttag

SEQ ID NO: 23798 - DNA, 18 bp, synthetic construct
  source 1..18: mol_type = other DNA
caatacgactaacttaag

SEQ ID NO: 23799 - DNA, 18 bp, synthetic construct
  source 1..18: mol_type = other DNA
caatacgactcaattcag

SEQ ID NO: 23800 - DNA, 18 bp, synthetic construct
  source 1..18: mol_type = other DNA
caatacgactcaatttcg

SEQ ID NO: 23801 - DNA, 18 bp, synthetic construct
  source 1..18: mol_type = other DNA
caatacgagtctctaaag

SEQ ID NO: 23802 - DNA, 18 bp, synthetic construct
  source 1..18: mol_type = other DNA
caatacgattcacaatgg

SEQ ID NO: 23803 - DNA, 18 bp, synthetic construct
  source 1..18: mol_type = other DNA
caatacgatttactacag

SEQ ID NO: 23804 - DNA, 18 bp, synthetic construct
  source 1..18: mol_type = other DNA
caatacgtcatactatag

SEQ ID NO: 23805 - DNA, 18 bp, synthetic construct
  source 1..18: mol_type = other DNA
caatacgtcttactaaag

SEQ ID NO: 23806 - DNA, 18 bp, synthetic construct
  source 1..18: mol_type = other DNA
caatacgtgtcactaaag

SEQ ID NO: 23807 - DNA, 18 bp, synthetic construct
  source 1..18: mol_type = other DNA
caatactactctctatcg

SEQ ID NO: 23808 - DNA, 18 bp, synthetic construct
  source 1..18: mol_type = other DNA
caatacttctcactttag

SEQ ID NO: 23809 - DNA, 18 bp, synthetic construct
  source 1..18: mol_type = other DNA
caatgcgaatcattatag

SEQ ID NO: 23810 - DNA, 18 bp, synthetic construct
  source 1..18: mol_type = other DNA
cactacgaccctctatag

SEQ ID NO: 23811 - DNA, 18 bp, synthetic construct
  source 1..18: mol_type = other DNA
cactacgattctctatag

SEQ ID NO: 23812 - DNA, 18 bp, synthetic construct
  source 1..18: mol_type = other DNA
cattacaactcactctag

SEQ ID NO: 23813 - DNA, 18 bp, synthetic construct
  source 1..18: mol_type = other DNA
cattacatctcactatag

SEQ ID NO: 23814 - DNA, 18 bp, synthetic construct
  source 1..18: mol_type = other DNA
cattacgacaaactatag

SEQ ID NO: 23815 - DNA, 18 bp, synthetic construct
  source 1..18: mol_type = other DNA
cattacgacccactaaag

SEQ ID NO: 23816 - DNA, 18 bp, synthetic construct
  source 1..18: mol_type = other DNA
cattacgattcactgtag

SEQ ID NO: 23817 - DNA, 18 bp, synthetic construct
  source 1..18: mol_type = other DNA
cattacgtctcactagag

SEQ ID NO: 23818 - DNA, 18 bp, synthetic construct
  source 1..18: mol_type = other DNA
cattctgactcactatag

SEQ ID NO: 23819 - DNA, 18 bp, synthetic construct
  source 1..18: mol_type = other DNA
ccaaacgacacactatag

SEQ ID NO: 23820 - DNA, 18 bp, synthetic construct
  source 1..18: mol_type = other DNA
cgatgcgactcactacag

SEQ ID NO: 23821 - DNA, 18 bp, synthetic construct
  source 1..18: mol_type = other DNA
ctaaacgactcactatgg

SEQ ID NO: 23822 - DNA, 18 bp, synthetic construct
  source 1..18: mol_type = other DNA
ctatacgaatcagtatag

SEQ ID NO: 23823 - DNA, 18 bp, synthetic construct
  source 1..18: mol_type = other DNA
ctctactactcactatag

SEQ ID NO: 23824 - DNA, 18 bp, synthetic construct
  source 1..18: mol_type = other DNA
ctttaccactcactatag

SEQ ID NO: 23825 - DNA, 18 bp, synthetic construct
  source 1..18: mol_type = other DNA
ctttacgactccctatag

SEQ ID NO: 23826 - DNA, 18 bp, synthetic construct
  source 1..18: mol_type = other DNA
gaaaacgactcatcatag

SEQ ID NO: 23827 - DNA, 18 bp, synthetic construct
  source 1..18: mol_type = other DNA
gaaaactaatcactatag

SEQ ID NO: 23828 - DNA, 18 bp, synthetic construct
  source 1..18: mol_type = other DNA
gaatacatcacactatag

SEQ ID NO: 23829 - DNA, 18 bp, synthetic construct
  source 1..18: mol_type = other DNA
gaatacatctcattatag

SEQ ID NO: 23830 - DNA, 18 bp, synthetic construct
  source 1..18: mol_type = other DNA
gaatacgatacactaaag

SEQ ID NO: 23831 - DNA, 18 bp, synthetic construct
  source 1..18: mol_type = other DNA
gaatatgactatctatag

SEQ ID NO: 23832 - DNA, 18 bp, synthetic construct
  source 1..18: mol_type = other DNA
gaggacgactcaatatag

SEQ ID NO: 23833 - DNA, 18 bp, synthetic construct
  source 1..18: mol_type = other DNA
gcaaatgactcactatag

SEQ ID NO: 23834 - DNA, 18 bp, synthetic construct
  source 1..18: mol_type = other DNA
gcatacgtctcactttag

SEQ ID NO: 23835 - DNA, 18 bp, synthetic construct
  source 1..18: mol_type = other DNA
ggatacaagtcactatag

SEQ ID NO: 23836 - DNA, 18 bp, synthetic construct
  source 1..18: mol_type = other DNA
ggctacgactcaatatag

SEQ ID NO: 23837 - DNA, 18 bp, synthetic construct
  source 1..18: mol_type = other DNA
taaaaagactcagtaaag

SEQ ID NO: 23838 - DNA, 18 bp, synthetic construct
  source 1..18: mol_type = other DNA
taaaacaacccagtatag

SEQ ID NO: 23839 - DNA, 18 bp, synthetic construct
  source 1..18: mol_type = other DNA
taaaaccactcactaagg

SEQ ID NO: 23840 - DNA, 18 bp, synthetic construct
  source 1..18: mol_type = other DNA
taaaaccactcagtacag

SEQ ID NO: 23841 - DNA, 18 bp, synthetic construct
  source 1..18: mol_type = other DNA
taaaacgaaacactaaag

SEQ ID NO: 23842 - DNA, 18 bp, synthetic construct
  source 1..18: mol_type = other DNA
taaaacgaatcagtatcg

SEQ ID NO: 23843 - DNA, 18 bp, synthetic construct
  source 1..18: mol_type = other DNA
taaaacgaccctctgtag

SEQ ID NO: 23844 - DNA, 18 bp, synthetic construct
  source 1..18: mol_type = other DNA
taaaacgactcaaagtag

SEQ ID NO: 23845 - DNA, 18 bp, synthetic construct
  source 1..18: mol_type = other DNA
taaaacgattccctatcg

SEQ ID NO: 23846 - DNA, 18 bp, synthetic construct
  source 1..18: mol_type = other DNA
taaaacgcatcactaaag

SEQ ID NO: 23847 - DNA, 18 bp, synthetic construct
  source 1..18: mol_type = other DNA
taaaacgcctcacttaag

SEQ ID NO: 23848 - DNA, 18 bp, synthetic construct
  source 1..18: mol_type = other DNA
taaaacgtcgcacaatag

SEQ ID NO: 23849 - DNA, 18 bp, synthetic construct
  source 1..18: mol_type = other DNA
taaaactactcaatacag

SEQ ID NO: 23850 - DNA, 18 bp, synthetic construct
  source 1..18: mol_type = other DNA
taaaactactcaatatcg

SEQ ID NO: 23851 - DNA, 18 bp, synthetic construct
  source 1..18: mol_type = other DNA
taaaactcctcaatatag

SEQ ID NO: 23852 - DNA, 18 bp, synthetic construct
  source 1..18: mol_type = other DNA
taaaactccttactatag

SEQ ID NO: 23853 - DNA, 18 bp, synthetic construct
  source 1..18: mol_type = other DNA
taaaactcttcactatag

SEQ ID NO: 23854 - DNA, 18 bp, synthetic construct
  source 1..18: mol_type = other DNA
taaaaggacatactatag

SEQ ID NO: 23855 - DNA, 18 bp, synthetic construct
  source 1..18: mol_type = other DNA
taaaaggactcacaaaag

SEQ ID NO: 23856 - DNA, 18 bp, synthetic construct
  source 1..18: mol_type = other DNA
taaaaggactctctttag

SEQ ID NO: 23857 - DNA, 18 bp, synthetic construct
  source 1..18: mol_type = other DNA
taaaagggctcagtatag

SEQ ID NO: 23858 - DNA, 18 bp, synthetic construct
  source 1..18: mol_type = other DNA
taaaatgacaaactatag

SEQ ID NO: 23859 - DNA, 18 bp, synthetic construct
  source 1..18: mol_type = other DNA
taaaatgacttattatag

SEQ ID NO: 23860 - DNA, 18 bp, synthetic construct
  source 1..18: mol_type = other DNA
taaacagactcactatgg

SEQ ID NO: 23861 - DNA, 18 bp, synthetic construct
  source 1..18: mol_type = other DNA
taaaccgaatcactacag

SEQ ID NO: 23862 - DNA, 18 bp, synthetic construct
  source 1..18: mol_type = other DNA
taaaccgacaccctatag

SEQ ID NO: 23863 - DNA, 18 bp, synthetic construct
  source 1..18: mol_type = other DNA
taaaccgactcactcaag

SEQ ID NO: 23864 - DNA, 18 bp, synthetic construct
  source 1..18: mol_type = other DNA
taaactgcctcactatag

SEQ ID NO: 23865 - DNA, 18 bp, synthetic construct
  source 1..18: mol_type = other DNA
taaagcgaatcacaatag

SEQ ID NO: 23866 - DNA, 18 bp, synthetic construct
  source 1..18: mol_type = other DNA
taaagcgactcatgatag

SEQ ID NO: 23867 - DNA, 18 bp, synthetic construct
  source 1..18: mol_type = other DNA
taacaagactcacagtag

SEQ ID NO: 23868 - DNA, 18 bp, synthetic construct
  source 1..18: mol_type = other DNA
taacaatagtcactatag

SEQ ID NO: 23869 - DNA, 18 bp, synthetic construct
  source 1..18: mol_type = other DNA
taacacaactaactaaag

SEQ ID NO: 23870 - DNA, 18 bp, synthetic construct
  source 1..18: mol_type = other DNA
taacacaactcataatag

SEQ ID NO: 23871 - DNA, 18 bp, synthetic construct
  source 1..18: mol_type = other DNA
taacaccactctctttag

SEQ ID NO: 23872 - DNA, 18 bp, synthetic construct
  source 1..18: mol_type = other DNA
taacacgacacacttgag

SEQ ID NO: 23873 - DNA, 18 bp, synthetic construct
  source 1..18: mol_type = other DNA
taacacgacactctatcg

SEQ ID NO: 23874 - DNA, 18 bp, synthetic construct
  source 1..18: mol_type = other DNA
taacacgactaactggag

SEQ ID NO: 23875 - DNA, 18 bp, synthetic construct
  source 1..18: mol_type = other DNA
taacacgattaactttag

SEQ ID NO: 23876 - DNA, 18 bp, synthetic construct
  source 1..18: mol_type = other DNA
taacacgattgtctatag

SEQ ID NO: 23877 - DNA, 18 bp, synthetic construct
  source 1..18: mol_type = other DNA
taacacgtattactatag

SEQ ID NO: 23878 - DNA, 18 bp, synthetic construct
  source 1..18: mol_type = other DNA
taacactacacactttag

SEQ ID NO: 23879 - DNA, 18 bp, synthetic construct
  source 1..18: mol_type = other DNA
taacacttctcactacag

SEQ ID NO: 23880 - DNA, 18 bp, synthetic construct
  source 1..18: mol_type = other DNA
taacaggacacactaaag

SEQ ID NO: 23881 - DNA, 18 bp, synthetic construct
  source 1..18: mol_type = other DNA
taacagtactcactttag

SEQ ID NO: 23882 - DNA, 18 bp, synthetic construct
  source 1..18: mol_type = other DNA
taaccctactcactaaag

SEQ ID NO: 23883 - DNA, 18 bp, synthetic construct
  source 1..18: mol_type = other DNA
taagaaaactctctatag

SEQ ID NO: 23884 - DNA, 18 bp, synthetic construct
  source 1..18: mol_type = other DNA
taagaagacacactttag

SEQ ID NO: 23885 - DNA, 18 bp, synthetic construct
  source 1..18: mol_type = other DNA
taagacgaatcacttcag

SEQ ID NO: 23886 - DNA, 18 bp, synthetic construct
  source 1..18: mol_type = other DNA
taagacgtttcactatgg

SEQ ID NO: 23887 - DNA, 18 bp, synthetic construct
  source 1..18: mol_type = other DNA
taagactactcaaaatag

SEQ ID NO: 23888 - DNA, 18 bp, synthetic construct
  source 1..18: mol_type = other DNA
taagactactcaatttag

SEQ ID NO: 23889 - DNA, 18 bp, synthetic construct
  source 1..18: mol_type = other DNA
taagactactcaccttag

SEQ ID NO: 23890 - DNA, 18 bp, synthetic construct
  source 1..18: mol_type = other DNA
taagactactctctatgg

SEQ ID NO: 23891 - DNA, 18 bp, synthetic construct
  source 1..18: mol_type = other DNA
taagactacttactaaag

SEQ ID NO: 23892 - DNA, 18 bp, synthetic construct
  source 1..18: mol_type = other DNA
taagatgacttcctatag

SEQ ID NO: 23893 - DNA, 18 bp, synthetic construct
  source 1..18: mol_type = other DNA
taagatttctcactatag

SEQ ID NO: 23894 - DNA, 18 bp, synthetic construct
  source 1..18: mol_type = other DNA
taaggtgactcactatgg

SEQ ID NO: 23895 - DNA, 18 bp, synthetic construct
  source 1..18: mol_type = other DNA
taataaaaatctctatag

SEQ ID NO: 23896 - DNA, 18 bp, synthetic construct
  source 1..18: mol_type = other DNA
taataaaactaaccatag

SEQ ID NO: 23897 - DNA, 18 bp, synthetic construct
  source 1..18: mol_type = other DNA
taataaaactaactttag

SEQ ID NO: 23898 - DNA, 18 bp, synthetic construct
  source 1..18: mol_type = other DNA
taataaatctcacgatag

SEQ ID NO: 23899 - DNA, 18 bp, synthetic construct
  source 1..18: mol_type = other DNA
taataacacttagtatag

SEQ ID NO: 23900 - DNA, 18 bp, synthetic construct
  source 1..18: mol_type = other DNA
taataagaccgattatag

SEQ ID NO: 23901 - DNA, 18 bp, synthetic construct
  source 1..18: mol_type = other DNA
taataagactcaaattag

SEQ ID NO: 23902 - DNA, 18 bp, synthetic construct
  source 1..18: mol_type = other DNA
taataagactctttatcg

SEQ ID NO: 23903 - DNA, 18 bp, synthetic construct
  source 1..18: mol_type = other DNA
taataagacttacactag

SEQ ID NO: 23904 - DNA, 18 bp, synthetic construct
  source 1..18: mol_type = other DNA
taataagagacactgtag

SEQ ID NO: 23905 - DNA, 18 bp, synthetic construct
  source 1..18: mol_type = other DNA
taataagatccacaatag

SEQ ID NO: 23906 - DNA, 18 bp, synthetic construct
  source 1..18: mol_type = other DNA
taataagattcacgacag

SEQ ID NO: 23907 - DNA, 18 bp, synthetic construct
  source 1..18: mol_type = other DNA
taataagtatcactaaag

SEQ ID NO: 23908 - DNA, 18 bp, synthetic construct
  source 1..18: mol_type = other DNA
taataagttccactatag

SEQ ID NO: 23909 - DNA, 18 bp, synthetic construct
  source 1..18: mol_type = other DNA
taataatacacacaatag

SEQ ID NO: 23910 - DNA, 18 bp, synthetic construct
  source 1..18: mol_type = other DNA
taataatactctgtatag

SEQ ID NO: 23911 - DNA, 18 bp, synthetic construct
  source 1..18: mol_type = other DNA
taatacaacacaccaaag

SEQ ID NO: 23912 - DNA, 18 bp, synthetic construct
  source 1..18: mol_type = other DNA
taatacaacccagcatag

SEQ ID NO: 23913 - DNA, 18 bp, synthetic construct
  source 1..18: mol_type = other DNA
taatacaactcacttacg

SEQ ID NO: 23914 - DNA, 18 bp, synthetic construct
  source 1..18: mol_type = other DNA
taatacaactcattttcg

SEQ ID NO: 23915 - DNA, 18 bp, synthetic construct
  source 1..18: mol_type = other DNA
taatacaactccatacag

SEQ ID NO: 23916 - DNA, 18 bp, synthetic construct
  source 1..18: mol_type = other DNA
taatacaactccctctcg

SEQ ID NO: 23917 - DNA, 18 bp, synthetic construct
  source 1..18: mol_type = other DNA
taatacaacttacttgag

SEQ ID NO: 23918 - DNA, 18 bp, synthetic construct
  source 1..18: mol_type = other DNA
taatacaatttaccatag

SEQ ID NO: 23919 - DNA, 18 bp, synthetic construct
  source 1..18: mol_type = other DNA
taatacacctaactttag

SEQ ID NO: 23920 - DNA, 18 bp, synthetic construct
  source 1..18: mol_type = other DNA
taatacacttcactctag

SEQ ID NO: 23921 - DNA, 18 bp, synthetic construct
  source 1..18: mol_type = other DNA
taatacatctcacactag

SEQ ID NO: 23922 - DNA, 18 bp, synthetic construct
  source 1..18: mol_type = other DNA
taataccaatgactaaag

SEQ ID NO: 23923 - DNA, 18 bp, synthetic construct
  source 1..18: mol_type = other DNA
taataccacttatcatag

SEQ ID NO: 23924 - DNA, 18 bp, synthetic construct
  source 1..18: mol_type = other DNA
taataccattcaatctag

SEQ ID NO: 23925 - DNA, 18 bp, synthetic construct
  source 1..18: mol_type = other DNA
taataccgctcccgatag

SEQ ID NO: 23926 - DNA, 18 bp, synthetic construct
  source 1..18: mol_type = other DNA
taatacctcatactatag

SEQ ID NO: 23927 - DNA, 18 bp, synthetic construct
  source 1..18: mol_type = other DNA
taatacctctcactccag

SEQ ID NO: 23928 - DNA, 18 bp, synthetic construct
  source 1..18: mol_type = other DNA
taatacctgtctctatag

SEQ ID NO: 23929 - DNA, 18 bp, synthetic construct
  source 1..18: mol_type = other DNA
taatacctttcactatgg

SEQ ID NO: 23930 - DNA, 18 bp, synthetic construct
  source 1..18: mol_type = other DNA
taatacgaaacactgcag

SEQ ID NO: 23931 - DNA, 18 bp, synthetic construct
  source 1..18: mol_type = other DNA
taatacgaacctatatag

SEQ ID NO: 23932 - DNA, 18 bp, synthetic construct
  source 1..18: mol_type = other DNA
taatacgaatcaccctcg

SEQ ID NO: 23933 - DNA, 18 bp, synthetic construct
  source 1..18: mol_type = other DNA
taatacgacaaactcaag

SEQ ID NO: 23934 - DNA, 18 bp, synthetic construct
  source 1..18: mol_type = other DNA
taatacgacaatctctag

SEQ ID NO: 23935 - DNA, 18 bp, synthetic construct
  source 1..18: mol_type = other DNA
taatacgacactcgttag

SEQ ID NO: 23936 - DNA, 18 bp, synthetic construct
  source 1..18: mol_type = other DNA
taatacgacagacttgag

SEQ ID NO: 23937 - DNA, 18 bp, synthetic construct
  source 1..18: mol_type = other DNA
taatacgacccattttgg

SEQ ID NO: 23938 - DNA, 18 bp, synthetic construct
  source 1..18: mol_type = other DNA
taatacgacctactttcg

SEQ ID NO: 23939 - DNA, 18 bp, synthetic construct
  source 1..18: mol_type = other DNA
taatacgacgctccatcg

SEQ ID NO: 23940 - DNA, 18 bp, synthetic construct
  source 1..18: mol_type = other DNA
taatacgactcagataag

SEQ ID NO: 23941 - DNA, 18 bp, synthetic construct
  source 1..18: mol_type = other DNA
taatacgactccttaacg

SEQ ID NO: 23942 - DNA, 18 bp, synthetic construct
  source 1..18: mol_type = other DNA
taatacgactgcttctag

SEQ ID NO: 23943 - DNA, 18 bp, synthetic construct
  source 1..18: mol_type = other DNA
taatacgacttaacatcg

SEQ ID NO: 23944 - DNA, 18 bp, synthetic construct
  source 1..18: mol_type = other DNA
taatacgactttataaag

SEQ ID NO: 23945 - DNA, 18 bp, synthetic construct
  source 1..18: mol_type = other DNA
taatacgactttccttag

SEQ ID NO: 23946 - DNA, 18 bp, synthetic construct
  source 1..18: mol_type = other DNA
taatacgagtcaccaagg

SEQ ID NO: 23947 - DNA, 18 bp, synthetic construct
  source 1..18: mol_type = other DNA
taatacgagttatcatag

SEQ ID NO: 23948 - DNA, 18 bp, synthetic construct
  source 1..18: mol_type = other DNA
taatacgagttattatgg

SEQ ID NO: 23949 - DNA, 18 bp, synthetic construct
  source 1..18: mol_type = other DNA
taatacgatgaattatag

SEQ ID NO: 23950 - DNA, 18 bp, synthetic construct
  source 1..18: mol_type = other DNA
taatacgatgcacttaag

SEQ ID NO: 23951 - DNA, 18 bp, synthetic construct
  source 1..18: mol_type = other DNA
taatacgattaagtttag

SEQ ID NO: 23952 - DNA, 18 bp, synthetic construct
  source 1..18: mol_type = other DNA
taatacgattcagttaag

SEQ ID NO: 23953 - DNA, 18 bp, synthetic construct
  source 1..18: mol_type = other DNA
taatacgattcatgttag

SEQ ID NO: 23954 - DNA, 18 bp, synthetic construct
  source 1..18: mol_type = other DNA
taatacgattcattctgg

SEQ ID NO: 23955 - DNA, 18 bp, synthetic construct
  source 1..18: mol_type = other DNA
taatacgcctaacgttag

SEQ ID NO: 23956 - DNA, 18 bp, synthetic construct
  source 1..18: mol_type = other DNA
taatacgcctgacattag

SEQ ID NO: 23957 - DNA, 18 bp, synthetic construct
  source 1..18: mol_type = other DNA
taatacgcctgtcaatag

SEQ ID NO: 23958 - DNA, 18 bp, synthetic construct
  source 1..18: mol_type = other DNA
taatacggctcaacaaag

SEQ ID NO: 23959 - DNA, 18 bp, synthetic construct
  source 1..18: mol_type = other DNA
taatacggctctcttaag

SEQ ID NO: 23960 - DNA, 18 bp, synthetic construct
  source 1..18: mol_type = other DNA
taatacgtaccactacag

SEQ ID NO: 23961 - DNA, 18 bp, synthetic construct
  source 1..18: mol_type = other DNA
taatacgtcccacttaag

SEQ ID NO: 23962 - DNA, 18 bp, synthetic construct
  source 1..18: mol_type = other DNA
taatacgtctcacagtcg

SEQ ID NO: 23963 - DNA, 18 bp, synthetic construct
  source 1..18: mol_type = other DNA
taatacgtctctgtttag

SEQ ID NO: 23964 - DNA, 18 bp, synthetic construct
  source 1..18: mol_type = other DNA
taatacgtgtcacaatcg

SEQ ID NO: 23965 - DNA, 18 bp, synthetic construct
  source 1..18: mol_type = other DNA
taatacgtttaattatag

SEQ ID NO: 23966 - DNA, 18 bp, synthetic construct
  source 1..18: mol_type = other DNA
taatacgtttcatcatag

SEQ ID NO: 23967 - DNA, 18 bp, synthetic construct
  source 1..18: mol_type = other DNA
taatactacatactagag

SEQ ID NO: 23968 - DNA, 18 bp, synthetic construct
  source 1..18: mol_type = other DNA
taatactactcaacttag

SEQ ID NO: 23969 - DNA, 18 bp, synthetic construct
  source 1..18: mol_type = other DNA
taatactactcagaacag

SEQ ID NO: 23970 - DNA, 18 bp, synthetic construct
  source 1..18: mol_type = other DNA
taatactactctctctcg

SEQ ID NO: 23971 - DNA, 18 bp, synthetic construct
  source 1..18: mol_type = other DNA
taatactagatactatag

SEQ ID NO: 23972 - DNA, 18 bp, synthetic construct
  source 1..18: mol_type = other DNA
taatactagtcaccaaag

SEQ ID NO: 23973 - DNA, 18 bp, synthetic construct
  source 1..18: mol_type = other DNA
taatactattaattatag

SEQ ID NO: 23974 - DNA, 18 bp, synthetic construct
  source 1..18: mol_type = other DNA
taatactattcacttcag

SEQ ID NO: 23975 - DNA, 18 bp, synthetic construct
  source 1..18: mol_type = other DNA
taatacttctcacaagag

SEQ ID NO: 23976 - DNA, 18 bp, synthetic construct
  source 1..18: mol_type = other DNA
taatagcactctcaatag

SEQ ID NO: 23977 - DNA, 18 bp, synthetic construct
  source 1..18: mol_type = other DNA
taataggaatgcctatag

SEQ ID NO: 23978 - DNA, 18 bp, synthetic construct
  source 1..18: mol_type = other DNA
taataggacccacattag

SEQ ID NO: 23979 - DNA, 18 bp, synthetic construct
  source 1..18: mol_type = other DNA
taataggacgctctgtag

SEQ ID NO: 23980 - DNA, 18 bp, synthetic construct
  source 1..18: mol_type = other DNA
taataggactaacttaag

SEQ ID NO: 23981 - DNA, 18 bp, synthetic construct
  source 1..18: mol_type = other DNA
taataggacttcctaaag

SEQ ID NO: 23982 - DNA, 18 bp, synthetic construct
  source 1..18: mol_type = other DNA
taatagggctttctatag

SEQ ID NO: 23983 - DNA, 18 bp, synthetic construct
  source 1..18: mol_type = other DNA
taataggtttcactaaag

SEQ ID NO: 23984 - DNA, 18 bp, synthetic construct
  source 1..18: mol_type = other DNA
taatataactcatcatag

SEQ ID NO: 23985 - DNA, 18 bp, synthetic construct
  source 1..18: mol_type = other DNA
taatatgacacaatacag

SEQ ID NO: 23986 - DNA, 18 bp, synthetic construct
  source 1..18: mol_type = other DNA
taatatgactaattttag

SEQ ID NO: 23987 - DNA, 18 bp, synthetic construct
  source 1..18: mol_type = other DNA
taatatgactctccatgg

SEQ ID NO: 23988 - DNA, 18 bp, synthetic construct
  source 1..18: mol_type = other DNA
taatatgactctcttcag

SEQ ID NO: 23989 - DNA, 18 bp, synthetic construct
  source 1..18: mol_type = other DNA
taatatgactgagaatag

SEQ ID NO: 23990 - DNA, 18 bp, synthetic construct
  source 1..18: mol_type = other DNA
taatatgacttattctag

SEQ ID NO: 23991 - DNA, 18 bp, synthetic construct
  source 1..18: mol_type = other DNA
taatatgagtctctatcg

SEQ ID NO: 23992 - DNA, 18 bp, synthetic construct
  source 1..18: mol_type = other DNA
taatatgattcaataaag

SEQ ID NO: 23993 - DNA, 18 bp, synthetic construct
  source 1..18: mol_type = other DNA
taatatgattcacgacag

SEQ ID NO: 23994 - DNA, 18 bp, synthetic construct
  source 1..18: mol_type = other DNA
taatatgattcataatag

SEQ ID NO: 23995 - DNA, 18 bp, synthetic construct
  source 1..18: mol_type = other DNA
taatatggcccactacag

SEQ ID NO: 23996 - DNA, 18 bp, synthetic construct
  source 1..18: mol_type = other DNA
taatatggctccctacag

SEQ ID NO: 23997 - DNA, 18 bp, synthetic construct
  source 1..18: mol_type = other DNA
taatatgtttcattatag

SEQ ID NO: 23998 - DNA, 18 bp, synthetic construct
  source 1..18: mol_type = other DNA
taatattaccaactatag

SEQ ID NO: 23999 - DNA, 18 bp, synthetic construct
  source 1..18: mol_type = other DNA
taatattactcaccaaag

SEQ ID NO: 24000 - DNA, 18 bp, synthetic construct
  source 1..18: mol_type = other DNA
taatattactcacttcag

SEQ ID NO: 24001 - DNA, 18 bp, synthetic construct
  source 1..18: mol_type = other DNA
taatattattcactctag

SEQ ID NO: 24002 - DNA, 18 bp, synthetic construct
  source 1..18: mol_type = other DNA
taatcagacttaccatag

SEQ ID NO: 24003 - DNA, 18 bp, synthetic construct
  source 1..18: mol_type = other DNA
taatcaggctcactttag

SEQ ID NO: 24004 - DNA, 18 bp, synthetic construct
  source 1..18: mol_type = other DNA
taatccaactcagtttag

SEQ ID NO: 24005 - DNA, 18 bp, synthetic construct
  source 1..18: mol_type = other DNA
taatccgaatgactaaag

SEQ ID NO: 24006 - DNA, 18 bp, synthetic construct
  source 1..18: mol_type = other DNA
taatccgactcaattaag

SEQ ID NO: 24007 - DNA, 18 bp, synthetic construct
  source 1..18: mol_type = other DNA
taatcctactcaatgtag

SEQ ID NO: 24008 - DNA, 18 bp, synthetic construct
  source 1..18: mol_type = other DNA
taatcctactctctgtag

SEQ ID NO: 24009 - DNA, 18 bp, synthetic construct
  source 1..18: mol_type = other DNA
taatcctagtcacaatag

SEQ ID NO: 24010 - DNA, 18 bp, synthetic construct
  source 1..18: mol_type = other DNA
taatcctattcactacag

SEQ ID NO: 24011 - DNA, 18 bp, synthetic construct
  source 1..18: mol_type = other DNA
taatcctcctcactaaag

SEQ ID NO: 24012 - DNA, 18 bp, synthetic construct
  source 1..18: mol_type = other DNA
taatctcactcattatag

SEQ ID NO: 24013 - DNA, 18 bp, synthetic construct
  source 1..18: mol_type = other DNA
taatctgactcataatag

SEQ ID NO: 24014 - DNA, 18 bp, synthetic construct
  source 1..18: mol_type = other DNA
taatgagagtcattatag

SEQ ID NO: 24015 - DNA, 18 bp, synthetic construct
  source 1..18: mol_type = other DNA
taatgcaacacaccatag

SEQ ID NO: 24016 - DNA, 18 bp, synthetic construct
  source 1..18: mol_type = other DNA
taatgccattctctatag

SEQ ID NO: 24017 - DNA, 18 bp, synthetic construct
  source 1..18: mol_type = other DNA
taatgcctttcactatag

SEQ ID NO: 24018 - DNA, 18 bp, synthetic construct
  source 1..18: mol_type = other DNA
taatgcgaataactgtag

SEQ ID NO: 24019 - DNA, 18 bp, synthetic construct
  source 1..18: mol_type = other DNA
taatgcgacctactacag

SEQ ID NO: 24020 - DNA, 18 bp, synthetic construct
  source 1..18: mol_type = other DNA
taatgcgactctccaaag

SEQ ID NO: 24021 - DNA, 18 bp, synthetic construct
  source 1..18: mol_type = other DNA
taatgcgactgattatcg

SEQ ID NO: 24022 - DNA, 18 bp, synthetic construct
  source 1..18: mol_type = other DNA
taatgcgagccattatag

SEQ ID NO: 24023 - DNA, 18 bp, synthetic construct
  source 1..18: mol_type = other DNA
taatgcgagtgattatag

SEQ ID NO: 24024 - DNA, 18 bp, synthetic construct
  source 1..18: mol_type = other DNA
taatgcgattccctgtag

SEQ ID NO: 24025 - DNA, 18 bp, synthetic construct
  source 1..18: mol_type = other DNA
taatgcgattgactttag

SEQ ID NO: 24026 - DNA, 18 bp, synthetic construct
  source 1..18: mol_type = other DNA
taatgcgcctttctatag

SEQ ID NO: 24027 - DNA, 18 bp, synthetic construct
  source 1..18: mol_type = other DNA
taatgcggctcattttag

SEQ ID NO: 24028 - DNA, 18 bp, synthetic construct
  source 1..18: mol_type = other DNA
taatgcgtctctctacag

SEQ ID NO: 24029 - DNA, 18 bp, synthetic construct
  source 1..18: mol_type = other DNA
taatgcgtttaactatag

SEQ ID NO: 24030 - DNA, 18 bp, synthetic construct
  source 1..18: mol_type = other DNA
taatgcttctcactgtag

SEQ ID NO: 24031 - DNA, 18 bp, synthetic construct
  source 1..18: mol_type = other DNA
taatggtacccactatag

SEQ ID NO: 24032 - DNA, 18 bp, synthetic construct
  source 1..18: mol_type = other DNA
taatgttactcacaatag

SEQ ID NO: 24033 - DNA, 18 bp, synthetic construct
  source 1..18: mol_type = other DNA
tacaacggctcactaaag

SEQ ID NO: 24034 - DNA, 18 bp, synthetic construct
  source 1..18: mol_type = other DNA
tacaatgacacactatag

SEQ ID NO: 24035 - DNA, 18 bp, synthetic construct
  source 1..18: mol_type = other DNA
tacaatgactcaccatag

SEQ ID NO: 24036 - DNA, 18 bp, synthetic construct
  source 1..18: mol_type = other DNA
taccacgacccactttag

SEQ ID NO: 24037 - DNA, 18 bp, synthetic construct
  source 1..18: mol_type = other DNA
taccacgactatctatag

SEQ ID NO: 24038 - DNA, 18 bp, synthetic construct
  source 1..18: mol_type = other DNA
tactacaacagactatag

SEQ ID NO: 24039 - DNA, 18 bp, synthetic construct
  source 1..18: mol_type = other DNA
tactacaactcaccttag

SEQ ID NO: 24040 - DNA, 18 bp, synthetic construct
  source 1..18: mol_type = other DNA
tactacaactccctgtag

SEQ ID NO: 24041 - DNA, 18 bp, synthetic construct
  source 1..18: mol_type = other DNA
tactacaactctatatag

SEQ ID NO: 24042 - DNA, 18 bp, synthetic construct
  source 1..18: mol_type = other DNA
tactacaacttaatatag

SEQ ID NO: 24043 - DNA, 18 bp, synthetic construct
  source 1..18: mol_type = other DNA
tactaccaatcaccatag

SEQ ID NO: 24044 - DNA, 18 bp, synthetic construct
  source 1..18: mol_type = other DNA
tactacctctcactgtag

SEQ ID NO: 24045 - DNA, 18 bp, synthetic construct
  source 1..18: mol_type = other DNA
tactacgacccagtttag

SEQ ID NO: 24046 - DNA, 18 bp, synthetic construct
  source 1..18: mol_type = other DNA
tactacgacgctcaatag

SEQ ID NO: 24047 - DNA, 18 bp, synthetic construct
  source 1..18: mol_type = other DNA
tactacgattcaaaatag

SEQ ID NO: 24048 - DNA, 18 bp, synthetic construct
  source 1..18: mol_type = other DNA
tactacgattcactttgg

SEQ ID NO: 24049 - DNA, 18 bp, synthetic construct
  source 1..18: mol_type = other DNA
tactacggctcaatgtag

SEQ ID NO: 24050 - DNA, 18 bp, synthetic construct
  source 1..18: mol_type = other DNA
tactacgtcccacaatag

SEQ ID NO: 24051 - DNA, 18 bp, synthetic construct
  source 1..18: mol_type = other DNA
tactactactcaataaag

SEQ ID NO: 24052 - DNA, 18 bp, synthetic construct
  source 1..18: mol_type = other DNA
tactactactcaccttag

SEQ ID NO: 24053 - DNA, 18 bp, synthetic construct
  source 1..18: mol_type = other DNA
tactacttctccctatag

SEQ ID NO: 24054 - DNA, 18 bp, synthetic construct
  source 1..18: mol_type = other DNA
tactatgactcccaatag

SEQ ID NO: 24055 - DNA, 18 bp, synthetic construct
  source 1..18: mol_type = other DNA
tactgtgacacactatag

SEQ ID NO: 24056 - DNA, 18 bp, synthetic construct
  source 1..18: mol_type = other DNA
tagaaagattcactatag

SEQ ID NO: 24057 - DNA, 18 bp, synthetic construct
  source 1..18: mol_type = other DNA
tagaaatactcactatag

SEQ ID NO: 24058 - DNA, 18 bp, synthetic construct
  source 1..18: mol_type = other DNA
tagaacaaatcactatag

SEQ ID NO: 24059 - DNA, 18 bp, synthetic construct
  source 1..18: mol_type = other DNA
tagaacaactcacaatag

SEQ ID NO: 24060 - DNA, 18 bp, synthetic construct
  source 1..18: mol_type = other DNA
tagtaacacacactatag

SEQ ID NO: 24061 - DNA, 18 bp, synthetic construct
  source 1..18: mol_type = other DNA
tagtacaaatcaccatag

SEQ ID NO: 24062 - DNA, 18 bp, synthetic construct
  source 1..18: mol_type = other DNA
tagtacgacgctctttag

SEQ ID NO: 24063 - DNA, 18 bp, synthetic construct
  source 1..18: mol_type = other DNA
tagtacgactcactgcgg

SEQ ID NO: 24064 - DNA, 18 bp, synthetic construct
  source 1..18: mol_type = other DNA
tagtacgactcacttagg

SEQ ID NO: 24065 - DNA, 18 bp, synthetic construct
  source 1..18: mol_type = other DNA
tagtacgactcattctgg

SEQ ID NO: 24066 - DNA, 18 bp, synthetic construct
  source 1..18: mol_type = other DNA
tagtacgactctatttag

SEQ ID NO: 24067 - DNA, 18 bp, synthetic construct
  source 1..18: mol_type = other DNA
tagtacgattcacaatgg

SEQ ID NO: 24068 - DNA, 18 bp, synthetic construct
  source 1..18: mol_type = other DNA
tagtacggctcatcatag

SEQ ID NO: 24069 - DNA, 18 bp, synthetic construct
  source 1..18: mol_type = other DNA
tagtacgtctaacaatag

SEQ ID NO: 24070 - DNA, 18 bp, synthetic construct
  source 1..18: mol_type = other DNA
tagtacgttacactatag

SEQ ID NO: 24071 - DNA, 18 bp, synthetic construct
  source 1..18: mol_type = other DNA
tagtagggctcactatgg

SEQ ID NO: 24072 - DNA, 18 bp, synthetic construct
  source 1..18: mol_type = other DNA
tagtatgactcactagcg

SEQ ID NO: 24073 - DNA, 18 bp, synthetic construct
  source 1..18: mol_type = other DNA
tagtatgtctcacaatag

SEQ ID NO: 24074 - DNA, 18 bp, synthetic construct
  source 1..18: mol_type = other DNA
tagtccgacacacaatag

SEQ ID NO: 24075 - DNA, 18 bp, synthetic construct
  source 1..18: mol_type = other DNA
tagtcctactctctatag

SEQ ID NO: 24076 - DNA, 18 bp, synthetic construct
  source 1..18: mol_type = other DNA
tagtgcgacacactaaag

SEQ ID NO: 24077 - DNA, 18 bp, synthetic construct
  source 1..18: mol_type = other DNA
tataacaactcattatag

SEQ ID NO: 24078 - DNA, 18 bp, synthetic construct
  source 1..18: mol_type = other DNA
tataacgaatcactatcg

SEQ ID NO: 24079 - DNA, 18 bp, synthetic construct
  source 1..18: mol_type = other DNA
tataacggctcactatgg

SEQ ID NO: 24080 - DNA, 18 bp, synthetic construct
  source 1..18: mol_type = other DNA
tataaggactcattatag

SEQ ID NO: 24081 - DNA, 18 bp, synthetic construct
  source 1..18: mol_type = other DNA
tatcaagactcactatcg

SEQ ID NO: 24082 - DNA, 18 bp, synthetic construct
  source 1..18: mol_type = other DNA
tatcacaactcaatatag

SEQ ID NO: 24083 - DNA, 18 bp, synthetic construct
  source 1..18: mol_type = other DNA
tatcacaattcactatag

SEQ ID NO: 24084 - DNA, 18 bp, synthetic construct
  source 1..18: mol_type = other DNA
tatcacgacctactatag

SEQ ID NO: 24085 - DNA, 18 bp, synthetic construct
  source 1..18: mol_type = other DNA
tatcacgactcacaaaag

SEQ ID NO: 24086 - DNA, 18 bp, synthetic construct
  source 1..18: mol_type = other DNA
tatcgcgactcactaaag

SEQ ID NO: 24087 - DNA, 18 bp, synthetic construct
  source 1..18: mol_type = other DNA
tatcgggactcactatag

SEQ ID NO: 24088 - DNA, 18 bp, synthetic construct
  source 1..18: mol_type = other DNA
tatgacaagtcactatag

SEQ ID NO: 24089 - DNA, 18 bp, synthetic construct
  source 1..18: mol_type = other DNA
tattaagacacactctag

SEQ ID NO: 24090 - DNA, 18 bp, synthetic construct
  source 1..18: mol_type = other DNA
tattaagacctactatag

SEQ ID NO: 24091 - DNA, 18 bp, synthetic construct
  source 1..18: mol_type = other DNA
tattaagactcaatctag

SEQ ID NO: 24092 - DNA, 18 bp, synthetic construct
  source 1..18: mol_type = other DNA
tattaagattcattatag

SEQ ID NO: 24093 - DNA, 18 bp, synthetic construct
  source 1..18: mol_type = other DNA
tattacaactccctatcg

SEQ ID NO: 24094 - DNA, 18 bp, synthetic construct
  source 1..18: mol_type = other DNA
tattaccactcaatatgg

SEQ ID NO: 24095 - DNA, 18 bp, synthetic construct
  source 1..18: mol_type = other DNA
tattaccactcaatttag

SEQ ID NO: 24096 - DNA, 18 bp, synthetic construct
  source 1..18: mol_type = other DNA
tattaccactcacttgag

SEQ ID NO: 24097 - DNA, 18 bp, synthetic construct
  source 1..18: mol_type = other DNA
tattacctctcactaaag

SEQ ID NO: 24098 - DNA, 18 bp, synthetic construct
  source 1..18: mol_type = other DNA
tattacgaatccctacag

SEQ ID NO: 24099 - DNA, 18 bp, synthetic construct
  source 1..18: mol_type = other DNA
tattacgaatctccatag

SEQ ID NO: 24100 - DNA, 18 bp, synthetic construct
  source 1..18: mol_type = other DNA
tattacgacacaatatgg

SEQ ID NO: 24101 - DNA, 18 bp, synthetic construct
  source 1..18: mol_type = other DNA
tattacgacacactgaag

SEQ ID NO: 24102 - DNA, 18 bp, synthetic construct
  source 1..18: mol_type = other DNA
tattacgacaccctatcg

SEQ ID NO: 24103 - DNA, 18 bp, synthetic construct
  source 1..18: mol_type = other DNA
tattacgacagactttag

SEQ ID NO: 24104 - DNA, 18 bp, synthetic construct
  source 1..18: mol_type = other DNA
tattacgacgcacactag

SEQ ID NO: 24105 - DNA, 18 bp, synthetic construct
  source 1..18: mol_type = other DNA
tattacgacgcattaaag

SEQ ID NO: 24106 - DNA, 18 bp, synthetic construct
  source 1..18: mol_type = other DNA
tattacgactcacctaag

SEQ ID NO: 24107 - DNA, 18 bp, synthetic construct
  source 1..18: mol_type = other DNA
tattacgactcatttgag

SEQ ID NO: 24108 - DNA, 18 bp, synthetic construct
  source 1..18: mol_type = other DNA
tattacgactctttatgg

SEQ ID NO: 24109 - DNA, 18 bp, synthetic construct
  source 1..18: mol_type = other DNA
tattacgacttattatcg

SEQ ID NO: 24110 - DNA, 18 bp, synthetic construct
  source 1..18: mol_type = other DNA
tattacgactttctatcg

SEQ ID NO: 24111 - DNA, 18 bp, synthetic construct
  source 1..18: mol_type = other DNA
tattacgagaaactatag

SEQ ID NO: 24112 - DNA, 18 bp, synthetic construct
  source 1..18: mol_type = other DNA
tattacgattctccatag

SEQ ID NO: 24113 - DNA, 18 bp, synthetic construct
  source 1..18: mol_type = other DNA
tattacgcctaactaaag

SEQ ID NO: 24114 - DNA, 18 bp, synthetic construct
  source 1..18: mol_type = other DNA
tattacggataactatag

SEQ ID NO: 24115 - DNA, 18 bp, synthetic construct
  source 1..18: mol_type = other DNA
tattacggctctgtatag

SEQ ID NO: 24116 - DNA, 18 bp, synthetic construct
  source 1..18: mol_type = other DNA
tattacgtctcaatacag

SEQ ID NO: 24117 - DNA, 18 bp, synthetic construct
  source 1..18: mol_type = other DNA
tattacgtctctctatgg

SEQ ID NO: 24118 - DNA, 18 bp, synthetic construct
  source 1..18: mol_type = other DNA
tattacgtctgtctatag

SEQ ID NO: 24119 - DNA, 18 bp, synthetic construct
  source 1..18: mol_type = other DNA
tattacgtgtcactagag

SEQ ID NO: 24120 - DNA, 18 bp, synthetic construct
  source 1..18: mol_type = other DNA
tattacgtgtgactatag

SEQ ID NO: 24121 - DNA, 18 bp, synthetic construct
  source 1..18: mol_type = other DNA
tattactaataactatag

SEQ ID NO: 24122 - DNA, 18 bp, synthetic construct
  source 1..18: mol_type = other DNA
tattataactcaccatag

SEQ ID NO: 24123 - DNA, 18 bp, synthetic construct
  source 1..18: mol_type = other DNA
tattataagtcactatag

SEQ ID NO: 24124 - DNA, 18 bp, synthetic construct
  source 1..18: mol_type = other DNA
tattatcacccactatag

SEQ ID NO: 24125 - DNA, 18 bp, synthetic construct
  source 1..18: mol_type = other DNA
tattatgaaccactatag

SEQ ID NO: 24126 - DNA, 18 bp, synthetic construct
  source 1..18: mol_type = other DNA
tattatgactcaagatag

SEQ ID NO: 24127 - DNA, 18 bp, synthetic construct
  source 1..18: mol_type = other DNA
tattatgactcactaccg

SEQ ID NO: 24128 - DNA, 18 bp, synthetic construct
  source 1..18: mol_type = other DNA
tattatttctcactatag

SEQ ID NO: 24129 - DNA, 18 bp, synthetic construct
  source 1..18: mol_type = other DNA
tattccgtctgactatag

SEQ ID NO: 24130 - DNA, 18 bp, synthetic construct
  source 1..18: mol_type = other DNA
tattgcgactcaaaatag

SEQ ID NO: 24131 - DNA, 18 bp, synthetic construct
  source 1..18: mol_type = other DNA
tattgcgacttactaaag

SEQ ID NO: 24132 - DNA, 18 bp, synthetic construct
  source 1..18: mol_type = other DNA
tattgcgattcaatatag

SEQ ID NO: 24133 - DNA, 18 bp, synthetic construct
  source 1..18: mol_type = other DNA
tattgtgactcactaaag

SEQ ID NO: 24134 - DNA, 18 bp, synthetic construct
  source 1..18: mol_type = other DNA
tcaagcgactctctatag

SEQ ID NO: 24135 - DNA, 18 bp, synthetic construct
  source 1..18: mol_type = other DNA
tcataagacactctatag

SEQ ID NO: 24136 - DNA, 18 bp, synthetic construct
  source 1..18: mol_type = other DNA
tcataagagtcattatag

SEQ ID NO: 24137 - DNA, 18 bp, synthetic construct
  source 1..18: mol_type = other DNA
tcataagtcacactatag

SEQ ID NO: 24138 - DNA, 18 bp, synthetic construct
  source 1..18: mol_type = other DNA
tcatacaatacactatag

SEQ ID NO: 24139 - DNA, 18 bp, synthetic construct
  source 1..18: mol_type = other DNA
tcatacgaaccactctag

SEQ ID NO: 24140 - DNA, 18 bp, synthetic construct
  source 1..18: mol_type = other DNA
tcatacgactaataatag

SEQ ID NO: 24141 - DNA, 18 bp, synthetic construct
  source 1..18: mol_type = other DNA
tcatacgactcacaaagg

SEQ ID NO: 24142 - DNA, 18 bp, synthetic construct
  source 1..18: mol_type = other DNA
tcatacgactcatcaaag

SEQ ID NO: 24143 - DNA, 18 bp, synthetic construct
  source 1..18: mol_type = other DNA
tcatactccacactatag

SEQ ID NO: 24144 - DNA, 18 bp, synthetic construct
  source 1..18: mol_type = other DNA
tcatacttctcactacag

SEQ ID NO: 24145 - DNA, 18 bp, synthetic construct
  source 1..18: mol_type = other DNA
tcatagaagtcactatag

SEQ ID NO: 24146 - DNA, 18 bp, synthetic construct
  source 1..18: mol_type = other DNA
tcatatgtctcactacag

SEQ ID NO: 24147 - DNA, 18 bp, synthetic construct
  source 1..18: mol_type = other DNA
tcatcctactctctatag

SEQ ID NO: 24148 - DNA, 18 bp, synthetic construct
  source 1..18: mol_type = other DNA
tcatcggactcactatgg

SEQ ID NO: 24149 - DNA, 18 bp, synthetic construct
  source 1..18: mol_type = other DNA
tcatgcgacacacaatag

SEQ ID NO: 24150 - DNA, 18 bp, synthetic construct
  source 1..18: mol_type = other DNA
tcgtacgacacactacag

SEQ ID NO: 24151 - DNA, 18 bp, synthetic construct
  source 1..18: mol_type = other DNA
tcgtacgacttcctatag

SEQ ID NO: 24152 - DNA, 18 bp, synthetic construct
  source 1..18: mol_type = other DNA
tctaacgacacactatag

SEQ ID NO: 24153 - DNA, 18 bp, synthetic construct
  source 1..18: mol_type = other DNA
tcttacgaatcaatatag

SEQ ID NO: 24154 - DNA, 18 bp, synthetic construct
  source 1..18: mol_type = other DNA
tcttacggttcactatag

SEQ ID NO: 24155 - DNA, 18 bp, synthetic construct
  source 1..18: mol_type = other DNA
tgaaaagacttactatag

SEQ ID NO: 24156 - DNA, 18 bp, synthetic construct
  source 1..18: mol_type = other DNA
tgaaacgatttactatag

SEQ ID NO: 24157 - DNA, 18 bp, synthetic construct
  source 1..18: mol_type = other DNA
tgaaacgtctctctatag

SEQ ID NO: 24158 - DNA, 18 bp, synthetic construct
  source 1..18: mol_type = other DNA
tgaaatgactcaatatag

SEQ ID NO: 24159 - DNA, 18 bp, synthetic construct
  source 1..18: mol_type = other DNA
tgacacaaatcactatag

SEQ ID NO: 24160 - DNA, 18 bp, synthetic construct
  source 1..18: mol_type = other DNA
tgagacgtctcaccatag

SEQ ID NO: 24161 - DNA, 18 bp, synthetic construct
  source 1..18: mol_type = other DNA
tgataagacacactctag

SEQ ID NO: 24162 - DNA, 18 bp, synthetic construct
  source 1..18: mol_type = other DNA
tgataatactcactaaag

SEQ ID NO: 24163 - DNA, 18 bp, synthetic construct
  source 1..18: mol_type = other DNA
tgatacaactccccatag

SEQ ID NO: 24164 - DNA, 18 bp, synthetic construct
  source 1..18: mol_type = other DNA
tgatacatcacactatag

SEQ ID NO: 24165 - DNA, 18 bp, synthetic construct
  source 1..18: mol_type = other DNA
tgatacgaatcaataaag

SEQ ID NO: 24166 - DNA, 18 bp, synthetic construct
  source 1..18: mol_type = other DNA
tgatacgaatcagtttag

SEQ ID NO: 24167 - DNA, 18 bp, synthetic construct
  source 1..18: mol_type = other DNA
tgatacgactaacttcag

SEQ ID NO: 24168 - DNA, 18 bp, synthetic construct
  source 1..18: mol_type = other DNA
tgatacgactcttaatag

SEQ ID NO: 24169 - DNA, 18 bp, synthetic construct
  source 1..18: mol_type = other DNA
tgatacgcctatctatag

SEQ ID NO: 24170 - DNA, 18 bp, synthetic construct
  source 1..18: mol_type = other DNA
tgatacgtctcaagatag

SEQ ID NO: 24171 - DNA, 18 bp, synthetic construct
  source 1..18: mol_type = other DNA
tgatacgtcttactatcg

SEQ ID NO: 24172 - DNA, 18 bp, synthetic construct
  source 1..18: mol_type = other DNA
tgatactattcaatatag

SEQ ID NO: 24173 - DNA, 18 bp, synthetic construct
  source 1..18: mol_type = other DNA
tgataggaatcaatatag

SEQ ID NO: 24174 - DNA, 18 bp, synthetic construct
  source 1..18: mol_type = other DNA
tgatatcaatcactatag

SEQ ID NO: 24175 - DNA, 18 bp, synthetic construct
  source 1..18: mol_type = other DNA
tgatatgacttactaaag

SEQ ID NO: 24176 - DNA, 18 bp, synthetic construct
  source 1..18: mol_type = other DNA
tgatccgacccactatgg

SEQ ID NO: 24177 - DNA, 18 bp, synthetic construct
  source 1..18: mol_type = other DNA
tgatccgactcattatcg

SEQ ID NO: 24178 - DNA, 18 bp, synthetic construct
  source 1..18: mol_type = other DNA
tgatccgtctcaatatag

SEQ ID NO: 24179 - DNA, 18 bp, synthetic construct
  source 1..18: mol_type = other DNA
tgatccgtctcactagag

SEQ ID NO: 24180 - DNA, 18 bp, synthetic construct
  source 1..18: mol_type = other DNA
tgatgcatctcactatag

SEQ ID NO: 24181 - DNA, 18 bp, synthetic construct
  source 1..18: mol_type = other DNA
tgatgcgcctcacaatag

SEQ ID NO: 24182 - DNA, 18 bp, synthetic construct
  source 1..18: mol_type = other DNA
tgatgcgtttcactatag

SEQ ID NO: 24183 - DNA, 18 bp, synthetic construct
  source 1..18: mol_type = other DNA
tgctaagactctctatag

SEQ ID NO: 24184 - DNA, 18 bp, synthetic construct
  source 1..18: mol_type = other DNA
tgctattactcactatag

SEQ ID NO: 24185 - DNA, 18 bp, synthetic construct
  source 1..18: mol_type = other DNA
tggtaagactcaccatag

SEQ ID NO: 24186 - DNA, 18 bp, synthetic construct
  source 1..18: mol_type = other DNA
tggtacgactcaatgtag

SEQ ID NO: 24187 - DNA, 18 bp, synthetic construct
  source 1..18: mol_type = other DNA
tggtacgactcagtaaag

SEQ ID NO: 24188 - DNA, 18 bp, synthetic construct
  source 1..18: mol_type = other DNA
tggtacgccacactatag

SEQ ID NO: 24189 - DNA, 18 bp, synthetic construct
  source 1..18: mol_type = other DNA
tgtaacgattcactatag

SEQ ID NO: 24190 - DNA, 18 bp, synthetic construct
  source 1..18: mol_type = other DNA
tgttacaactcactacag

SEQ ID NO: 24191 - DNA, 18 bp, synthetic construct
  source 1..18: mol_type = other DNA
tgttacggctcattatag

SEQ ID NO: 24192 - DNA, 18 bp, synthetic construct
  source 1..18: mol_type = other DNA
tgttactactcactacag

SEQ ID NO: 24193 - DNA, 18 bp, synthetic construct
  source 1..18: mol_type = other DNA
tgttatgactctctatag

SEQ ID NO: 24194 - DNA, 18 bp, synthetic construct
  source 1..18: mol_type = other DNA
tgttgtgactcactatag

SEQ ID NO: 24195 - DNA, 18 bp, synthetic construct
  source 1..18: mol_type = other DNA
ttaaacgacgcactttag

SEQ ID NO: 24196 - DNA, 18 bp, synthetic construct
  source 1..18: mol_type = other DNA
ttaaatgactcactacag

SEQ ID NO: 24197 - DNA, 18 bp, synthetic construct
  source 1..18: mol_type = other DNA
ttaaatgactgactatag

SEQ ID NO: 24198 - DNA, 18 bp, synthetic construct
  source 1..18: mol_type = other DNA
ttaaccgactcactaaag

SEQ ID NO: 24199 - DNA, 18 bp, synthetic construct
  source 1..18: mol_type = other DNA
ttaagcgaatcactatag

SEQ ID NO: 24200 - DNA, 18 bp, synthetic construct
  source 1..18: mol_type = other DNA
ttacacgactcacaacag

SEQ ID NO: 24201 - DNA, 18 bp, synthetic construct
  source 1..18: mol_type = other DNA
ttataagatccactatag

SEQ ID NO: 24202 - DNA, 18 bp, synthetic construct
  source 1..18: mol_type = other DNA
ttatacaactaagtatag

SEQ ID NO: 24203 - DNA, 18 bp, synthetic construct
  source 1..18: mol_type = other DNA
ttatacaactcactttcg

SEQ ID NO: 24204 - DNA, 18 bp, synthetic construct
  source 1..18: mol_type = other DNA
ttatacaactctctctag

SEQ ID NO: 24205 - DNA, 18 bp, synthetic construct
  source 1..18: mol_type = other DNA
ttataccactcactttgg

SEQ ID NO: 24206 - DNA, 18 bp, synthetic construct
  source 1..18: mol_type = other DNA
ttataccactccctatcg

SEQ ID NO: 24207 - DNA, 18 bp, synthetic construct
  source 1..18: mol_type = other DNA
ttatacgacacattgtag

SEQ ID NO: 24208 - DNA, 18 bp, synthetic construct
  source 1..18: mol_type = other DNA
ttatacgacccactaccg

SEQ ID NO: 24209 - DNA, 18 bp, synthetic construct
  source 1..18: mol_type = other DNA
ttatacgactacctctag

SEQ ID NO: 24210 - DNA, 18 bp, synthetic construct
  source 1..18: mol_type = other DNA
ttatacgactcataagag

SEQ ID NO: 24211 - DNA, 18 bp, synthetic construct
  source 1..18: mol_type = other DNA
ttatacgactcatactag

SEQ ID NO: 24212 - DNA, 18 bp, synthetic construct
  source 1..18: mol_type = other DNA
ttatacgactgtctagag

SEQ ID NO: 24213 - DNA, 18 bp, synthetic construct
  source 1..18: mol_type = other DNA
ttatacgattcaatagag

SEQ ID NO: 24214 - DNA, 18 bp, synthetic construct
  source 1..18: mol_type = other DNA
ttatacgccacacaatag

SEQ ID NO: 24215 - DNA, 18 bp, synthetic construct
  source 1..18: mol_type = other DNA
ttatacgccacactaaag

SEQ ID NO: 24216 - DNA, 18 bp, synthetic construct
  source 1..18: mol_type = other DNA
ttatacgccccaatatag

SEQ ID NO: 24217 - DNA, 18 bp, synthetic construct
  source 1..18: mol_type = other DNA
ttatacgcctcaatatcg

SEQ ID NO: 24218 - DNA, 18 bp, synthetic construct
  source 1..18: mol_type = other DNA
ttatacggctctctgtag

SEQ ID NO: 24219 - DNA, 18 bp, synthetic construct
  source 1..18: mol_type = other DNA
ttatacgtctcagtgtag

SEQ ID NO: 24220 - DNA, 18 bp, synthetic construct
  source 1..18: mol_type = other DNA
ttatagtactcacaatag

SEQ ID NO: 24221 - DNA, 18 bp, synthetic construct
  source 1..18: mol_type = other DNA
ttatatgactcaacatag

SEQ ID NO: 24222 - DNA, 18 bp, synthetic construct
  source 1..18: mol_type = other DNA
ttatatgccccactatag

SEQ ID NO: 24223 - DNA, 18 bp, synthetic construct
  source 1..18: mol_type = other DNA
ttatatgcctcactatgg

SEQ ID NO: 24224 - DNA, 18 bp, synthetic construct
  source 1..18: mol_type = other DNA
ttatccgacacagtatag

SEQ ID NO: 24225 - DNA, 18 bp, synthetic construct
  source 1..18: mol_type = other DNA
ttatccgactcattatcg

SEQ ID NO: 24226 - DNA, 18 bp, synthetic construct
  source 1..18: mol_type = other DNA
ttatcctactcactatcg

SEQ ID NO: 24227 - DNA, 18 bp, synthetic construct
  source 1..18: mol_type = other DNA
ttatgagaatcactatag

SEQ ID NO: 24228 - DNA, 18 bp, synthetic construct
  source 1..18: mol_type = other DNA
ttatgcgaatctctatag

SEQ ID NO: 24229 - DNA, 18 bp, synthetic construct
  source 1..18: mol_type = other DNA
ttatgcgactcaatttag

SEQ ID NO: 24230 - DNA, 18 bp, synthetic construct
  source 1..18: mol_type = other DNA
ttatgcgactctctttag

SEQ ID NO: 24231 - DNA, 18 bp, synthetic construct
  source 1..18: mol_type = other DNA
ttatgcgtcccactatag

SEQ ID NO: 24232 - DNA, 18 bp, synthetic construct
  source 1..18: mol_type = other DNA
ttatgctactcactttag

SEQ ID NO: 24233 - DNA, 18 bp, synthetic construct
  source 1..18: mol_type = other DNA
ttctacgactcattatgg

SEQ ID NO: 24234 - DNA, 18 bp, synthetic construct
  source 1..18: mol_type = other DNA
ttctacttctcactatag

SEQ ID NO: 24235 - DNA, 18 bp, synthetic construct
  source 1..18: mol_type = other DNA
ttgtaagactctctatag

SEQ ID NO: 24236 - DNA, 18 bp, synthetic construct
  source 1..18: mol_type = other DNA
ttgtacgactccctacag

SEQ ID NO: 24237 - DNA, 18 bp, synthetic construct
  source 1..18: mol_type = other DNA
tttaacgactcacgatag

SEQ ID NO: 24238 - DNA, 18 bp, synthetic construct
  source 1..18: mol_type = other DNA
ttttacgactcactaagg

SEQ ID NO: 24239 - DNA, 18 bp, synthetic construct
  source 1..18: mol_type = other DNA
ttttacgattaactatag

SEQ ID NO: 24240 - DNA, 18 bp, synthetic construct
  source 1..18: mol_type = other DNA
ttttacgcctcagtatag

SEQ ID NO: 24241 - DNA, 18 bp, synthetic construct
  source 1..18: mol_type = other DNA
ttttacggctcactaaag

SEQ ID NO: 24242 - DNA, 18 bp, synthetic construct
  source 1..18: mol_type = other DNA
ttttaggactcattatag

SEQ ID NO: 24243 - DNA, 18 bp, synthetic construct
  source 1..18: mol_type = other DNA
atattcgactcactttag

SEQ ID NO: 24244 - DNA, 18 bp, synthetic construct
  source 1..18: mol_type = other DNA
taatataactcactaatg

SEQ ID NO: 24245 - DNA, 18 bp, synthetic construct
  source 1..18: mol_type = other DNA
tattacgactcattaatg

SEQ ID NO: 24246 - DNA, 18 bp, synthetic construct
  source 1..18: mol_type = other DNA
ttatacatctcactaaag

SEQ ID NO: 24247 - DNA, 18 bp, synthetic construct
  source 1..18: mol_type = other DNA
tgtttcgtctcactatag

SEQ ID NO: 24248 - DNA, 18 bp, synthetic construct
  source 1..18: mol_type = other DNA
ttaaacaactcactattg

SEQ ID NO: 24249 - DNA, 18 bp, synthetic construct
  source 1..18: mol_type = other DNA
ttattagactcaatatag

SEQ ID NO: 24250 - DNA, 18 bp, synthetic construct
  source 1..18: mol_type = other DNA
taattagactaactattg

SEQ ID NO: 24251 - DNA, 18 bp, synthetic construct
  source 1..18: mol_type = other DNA
aattacgacttactattg

SEQ ID NO: 24252 - DNA, 18 bp, synthetic construct
  source 1..18: mol_type = other DNA
caatacgacactctattg

SEQ ID NO: 24253 - DNA, 18 bp, synthetic construct
  source 1..18: mol_type = other DNA
caattctactcacaatag

SEQ ID NO: 24254 - DNA, 18 bp, synthetic construct
  source 1..18: mol_type = other DNA
tattgcaactcactattg

SEQ ID NO: 24255 - DNA, 18 bp, synthetic construct
  source 1..18: mol_type = other DNA
ttattagtctcactatag

SEQ ID NO: 24256 - DNA, 18 bp, synthetic construct
  source 1..18: mol_type = other DNA
taatacgacacaaaaaag

SEQ ID NO: 24257 - DNA, 18 bp, synthetic construct
  source 1..18: mol_type = other DNA
taatgaaactcattatag

SEQ ID NO: 24258 - DNA, 18 bp, synthetic construct
  source 1..18: mol_type = other DNA
tataacgacacattatag

SEQ ID NO: 24259 - DNA, 18 bp, synthetic construct
  source 1..18: mol_type = other DNA
tatgacgactcacattag

SEQ ID NO: 24260 - DNA, 18 bp, synthetic construct
  source 1..18: mol_type = other DNA
tattacgcctcactaagg

SEQ ID NO: 24261 - DNA, 18 bp, synthetic construct
  source 1..18: mol_type = other DNA
tattatgaatctctatag

SEQ ID NO: 24262 - DNA, 18 bp, synthetic construct
  source 1..18: mol_type = other DNA
ttaaacgtctcaccatag

SEQ ID NO: 24263 - DNA, 18 bp, synthetic construct
  source 1..18: mol_type = other DNA
ttatacaactcaatttag

SEQ ID NO: 24264 - DNA, 18 bp, synthetic construct
  source 1..18: mol_type = other DNA
ttatacaactcacactag

SEQ ID NO: 24265 - DNA, 18 bp, synthetic construct
  source 1..18: mol_type = other DNA
ttatacgactcactcacg

SEQ ID NO: 24266 - DNA, 18 bp, synthetic construct
  source 1..18: mol_type = other DNA
ttatacgataaactatag

SEQ ID NO: 24267 - DNA, 18 bp, synthetic construct
  source 1..18: mol_type = other DNA
ttaaacgtcacactatag

SEQ ID NO: 24268 - DNA, 18 bp, synthetic construct
  source 1..18: mol_type = other DNA
aaattcgactctctattg

SEQ ID NO: 24269 - DNA, 18 bp, synthetic construct
  source 1..18: mol_type = other DNA
taatacatctcgctattg

SEQ ID NO: 24270 - DNA, 18 bp, synthetic construct
  source 1..18: mol_type = other DNA
taatacgactcgtaattg

SEQ ID NO: 24271 - DNA, 18 bp, synthetic construct
  source 1..18: mol_type = other DNA
tcattcgactccctattg

SEQ ID NO: 24272 - DNA, 18 bp, synthetic construct
  source 1..18: mol_type = other DNA
tgattcgtctcactattg

SEQ ID NO: 24273 - DNA, 18 bp, synthetic construct
  source 1..18: mol_type = other DNA
aaatacgacacacaattg

SEQ ID NO: 24274 - DNA, 18 bp, synthetic construct
  source 1..18: mol_type = other DNA
aaattcgtctcactctag

SEQ ID NO: 24275 - DNA, 18 bp, synthetic construct
  source 1..18: mol_type = other DNA
acattcgactaactatag

SEQ ID NO: 24276 - DNA, 18 bp, synthetic construct
  source 1..18: mol_type = other DNA
caatacgtctcacttttg

SEQ ID NO: 24277 - DNA, 18 bp, synthetic construct
  source 1..18: mol_type = other DNA
caattctactctctatag

SEQ ID NO: 24278 - DNA, 18 bp, synthetic construct
  source 1..18: mol_type = other DNA
taaaacgaatcactcttg

SEQ ID NO: 24279 - DNA, 18 bp, synthetic construct
  source 1..18: mol_type = other DNA
taaagcaactcactattg

SEQ ID NO: 24280 - DNA, 18 bp, synthetic construct
  source 1..18: mol_type = other DNA
taaatcgacacactatcg

SEQ ID NO: 24281 - DNA, 18 bp, synthetic construct
  source 1..18: mol_type = other DNA
taataagacacactcttg

SEQ ID NO: 24282 - DNA, 18 bp, synthetic construct
  source 1..18: mol_type = other DNA
taataagactcagttttg

SEQ ID NO: 24283 - DNA, 18 bp, synthetic construct
  source 1..18: mol_type = other DNA
taatacgactatatattg

SEQ ID NO: 24284 - DNA, 18 bp, synthetic construct
  source 1..18: mol_type = other DNA
taatacgacttactgatg

SEQ ID NO: 24285 - DNA, 18 bp, synthetic construct
  source 1..18: mol_type = other DNA
taatattactcactactg

SEQ ID NO: 24286 - DNA, 18 bp, synthetic construct
  source 1..18: mol_type = other DNA
taattagtctcactttag

SEQ ID NO: 24287 - DNA, 18 bp, synthetic construct
  source 1..18: mol_type = other DNA
taattatattcactatag

SEQ ID NO: 24288 - DNA, 18 bp, synthetic construct
  source 1..18: mol_type = other DNA
taattcgacttacttaag

SEQ ID NO: 24289 - DNA, 18 bp, synthetic construct
  source 1..18: mol_type = other DNA
taattcgtcacactctag

SEQ ID NO: 24290 - DNA, 18 bp, synthetic construct
  source 1..18: mol_type = other DNA
taattctactcataatag

SEQ ID NO: 24291 - DNA, 18 bp, synthetic construct
  source 1..18: mol_type = other DNA
taattggacacactttag

SEQ ID NO: 24292 - DNA, 18 bp, synthetic construct
  source 1..18: mol_type = other DNA
taatttgtgtcactatag

SEQ ID NO: 24293 - DNA, 18 bp, synthetic construct
  source 1..18: mol_type = other DNA
tacttcgactcacaacag

SEQ ID NO: 24294 - DNA, 18 bp, synthetic construct
  source 1..18: mol_type = other DNA
tagtacacctcactattg

SEQ ID NO: 24295 - DNA, 18 bp, synthetic construct
  source 1..18: mol_type = other DNA
tagtacgactctcaattg

SEQ ID NO: 24296 - DNA, 18 bp, synthetic construct
  source 1..18: mol_type = other DNA
tagtacgtttcactattg

SEQ ID NO: 24297 - DNA, 18 bp, synthetic construct
  source 1..18: mol_type = other DNA
tataccgactcgctatag

SEQ ID NO: 24298 - DNA, 18 bp, synthetic construct
  source 1..18: mol_type = other DNA
tattaagactcacttttg

SEQ ID NO: 24299 - DNA, 18 bp, synthetic construct
  source 1..18: mol_type = other DNA
tatttcgacccactttag

SEQ ID NO: 24300 - DNA, 18 bp, synthetic construct
  source 1..18: mol_type = other DNA
tatttcgactcacgttag

SEQ ID NO: 24301 - DNA, 18 bp, synthetic construct
  source 1..18: mol_type = other DNA
tcttacgactcactaatg

SEQ ID NO: 24302 - DNA, 18 bp, synthetic construct
  source 1..18: mol_type = other DNA
tgactcgtctcactatag

SEQ ID NO: 24303 - DNA, 18 bp, synthetic construct
  source 1..18: mol_type = other DNA
ttatacaattcgctatag

SEQ ID NO: 24304 - DNA, 18 bp, synthetic construct
  source 1..18: mol_type = other DNA
ttattagcctcactatag

SEQ ID NO: 24305 - DNA, 18 bp, synthetic construct
  source 1..18: mol_type = other DNA
ttttacgactcgctaaag

SEQ ID NO: 24306 - DNA, 18 bp, synthetic construct
  source 1..18: mol_type = other DNA
aaataccactcactttcg

SEQ ID NO: 24307 - DNA, 18 bp, synthetic construct
  source 1..18: mol_type = other DNA
aaatactattcacaatag

SEQ ID NO: 24308 - DNA, 18 bp, synthetic construct
  source 1..18: mol_type = other DNA
aaatagcactcactttag

SEQ ID NO: 24309 - DNA, 18 bp, synthetic construct
  source 1..18: mol_type = other DNA
aaatatgactatctatag

SEQ ID NO: 24310 - DNA, 18 bp, synthetic construct
  source 1..18: mol_type = other DNA
agataccagtcactatag

SEQ ID NO: 24311 - DNA, 18 bp, synthetic construct
  source 1..18: mol_type = other DNA
atatacgactctctgtag

SEQ ID NO: 24312 - DNA, 18 bp, synthetic construct
  source 1..18: mol_type = other DNA
caatacgtctcacttaag

SEQ ID NO: 24313 - DNA, 18 bp, synthetic construct
  source 1..18: mol_type = other DNA
ccatataactcactatag

SEQ ID NO: 24314 - DNA, 18 bp, synthetic construct
  source 1..18: mol_type = other DNA
taaaacatctcagtatag

SEQ ID NO: 24315 - DNA, 18 bp, synthetic construct
  source 1..18: mol_type = other DNA
taaaatgacttactttag

SEQ ID NO: 24316 - DNA, 18 bp, synthetic construct
  source 1..18: mol_type = other DNA
taacacaaatcactttag

SEQ ID NO: 24317 - DNA, 18 bp, synthetic construct
  source 1..18: mol_type = other DNA
taacactaatcactttag

SEQ ID NO: 24318 - DNA, 18 bp, synthetic construct
  source 1..18: mol_type = other DNA
taaccagacacactatag

SEQ ID NO: 24319 - DNA, 18 bp, synthetic construct
  source 1..18: mol_type = other DNA
taataagattcacttaag

SEQ ID NO: 24320 - DNA, 18 bp, synthetic construct
  source 1..18: mol_type = other DNA
taataatacttactctag

SEQ ID NO: 24321 - DNA, 18 bp, synthetic construct
  source 1..18: mol_type = other DNA
taatacatctcattaaag

SEQ ID NO: 24322 - DNA, 18 bp, synthetic construct
  source 1..18: mol_type = other DNA
taataccactcacatcag

SEQ ID NO: 24323 - DNA, 18 bp, synthetic construct
  source 1..18: mol_type = other DNA
taatacgaatcagattag

SEQ ID NO: 24324 - DNA, 18 bp, synthetic construct
  source 1..18: mol_type = other DNA
taatacgacacattgtgg

SEQ ID NO: 24325 - DNA, 18 bp, synthetic construct
  source 1..18: mol_type = other DNA
taatacgattgacttaag

SEQ ID NO: 24326 - DNA, 18 bp, synthetic construct
  source 1..18: mol_type = other DNA
taatactactcaacaaag

SEQ ID NO: 24327 - DNA, 18 bp, synthetic construct
  source 1..18: mol_type = other DNA
taatacttctcacaatcg

SEQ ID NO: 24328 - DNA, 18 bp, synthetic construct
  source 1..18: mol_type = other DNA
taataggaatctctctag

SEQ ID NO: 24329 - DNA, 18 bp, synthetic construct
  source 1..18: mol_type = other DNA
taataggacagactatgg

SEQ ID NO: 24330 - DNA, 18 bp, synthetic construct
  source 1..18: mol_type = other DNA
taatatcacttaatatag

SEQ ID NO: 24331 - DNA, 18 bp, synthetic construct
  source 1..18: mol_type = other DNA
taatatgtctcactttcg

SEQ ID NO: 24332 - DNA, 18 bp, synthetic construct
  source 1..18: mol_type = other DNA
taatcaaactcactacag

SEQ ID NO: 24333 - DNA, 18 bp, synthetic construct
  source 1..18: mol_type = other DNA
tactacaactctcaatag

SEQ ID NO: 24334 - DNA, 18 bp, synthetic construct
  source 1..18: mol_type = other DNA
tactacgattcaccaaag

SEQ ID NO: 24335 - DNA, 18 bp, synthetic construct
  source 1..18: mol_type = other DNA
tactacgattcagtaaag

SEQ ID NO: 24336 - DNA, 18 bp, synthetic construct
  source 1..18: mol_type = other DNA
tatcaagtctcactatag

SEQ ID NO: 24337 - DNA, 18 bp, synthetic construct
  source 1..18: mol_type = other DNA
tatcaccactcactatgg

SEQ ID NO: 24338 - DNA, 18 bp, synthetic construct
  source 1..18: mol_type = other DNA
tatcacgactcaatatcg

SEQ ID NO: 24339 - DNA, 18 bp, synthetic construct
  source 1..18: mol_type = other DNA
tattacgatccactttag

SEQ ID NO: 24340 - DNA, 18 bp, synthetic construct
  source 1..18: mol_type = other DNA
tattacgcctctctatgg

SEQ ID NO: 24341 - DNA, 18 bp, synthetic construct
  source 1..18: mol_type = other DNA
tattacggctgactttag

SEQ ID NO: 24342 - DNA, 18 bp, synthetic construct
  source 1..18: mol_type = other DNA
tattacgtctcactcaag

SEQ ID NO: 24343 - DNA, 18 bp, synthetic construct
  source 1..18: mol_type = other DNA
tattacgtctctctgtag

SEQ ID NO: 24344 - DNA, 18 bp, synthetic construct
  source 1..18: mol_type = other DNA
tattacgtttcattatag

SEQ ID NO: 24345 - DNA, 18 bp, synthetic construct
  source 1..18: mol_type = other DNA
tattactactcaataaag

SEQ ID NO: 24346 - DNA, 18 bp, synthetic construct
  source 1..18: mol_type = other DNA
tattatgactcattacag

SEQ ID NO: 24347 - DNA, 18 bp, synthetic construct
  source 1..18: mol_type = other DNA
tattccgattcactttag

SEQ ID NO: 24348 - DNA, 18 bp, synthetic construct
  source 1..18: mol_type = other DNA
tcaaacgtctcactacag

SEQ ID NO: 24349 - DNA, 18 bp, synthetic construct
  source 1..18: mol_type = other DNA
tcatacgactaacattag

SEQ ID NO: 24350 - DNA, 18 bp, synthetic construct
  source 1..18: mol_type = other DNA
tcatacgatttattatag

SEQ ID NO: 24351 - DNA, 18 bp, synthetic construct
  source 1..18: mol_type = other DNA
tcatactacacaatatag

SEQ ID NO: 24352 - DNA, 18 bp, synthetic construct
  source 1..18: mol_type = other DNA
tgttactactctctatag

SEQ ID NO: 24353 - DNA, 18 bp, synthetic construct
  source 1..18: mol_type = other DNA
ttatacaactcaacatag

SEQ ID NO: 24354 - DNA, 18 bp, synthetic construct
  source 1..18: mol_type = other DNA
ttatacgactaagtacag

SEQ ID NO: 24355 - DNA, 18 bp, synthetic construct
  source 1..18: mol_type = other DNA
ttatacgactcagtgcag

SEQ ID NO: 24356 - DNA, 18 bp, synthetic construct
  source 1..18: mol_type = other DNA
ttatacgagttactaaag

SEQ ID NO: 24357 - DNA, 18 bp, synthetic construct
  source 1..18: mol_type = other DNA
ttatgcgactaactaaag

SEQ ID NO: 24358 - DNA, 18 bp, synthetic construct
  source 1..18: mol_type = other DNA
ttctaggtctcactatag

SEQ ID NO: 24359 - DNA, 18 bp, synthetic construct
  source 1..18: mol_type = other DNA
ttgtacgatccactatag

SEQ ID NO: 24360 - DNA, 18 bp, synthetic construct
  source 1..18: mol_type = other DNA
ttttacgacccactttag

SEQ ID NO: 24361 - DNA, 18 bp, synthetic construct
  source 1..18: mol_type = other DNA
ttttatgacccactatag

SEQ ID NO: 24362 - DNA, 18 bp, synthetic construct
  source 1..18: mol_type = other DNA
taatacgtctcacttatg

SEQ ID NO: 24363 - DNA, 18 bp, synthetic construct
  source 1..18: mol_type = other DNA
taatatgcctcactaatg

SEQ ID NO: 24364 - DNA, 18 bp, synthetic construct
  source 1..18: mol_type = other DNA
atacacgactcactattg

SEQ ID NO: 24365 - DNA, 18 bp, synthetic construct
  source 1..18: mol_type = other DNA
taataagtctcaccattg

SEQ ID NO: 24366 - DNA, 18 bp, synthetic construct
  source 1..18: mol_type = other DNA
taatacatatcactattg

SEQ ID NO: 24367 - DNA, 18 bp, synthetic construct
  source 1..18: mol_type = other DNA
taatttgacactctatag

SEQ ID NO: 24368 - DNA, 18 bp, synthetic construct
  source 1..18: mol_type = other DNA
tactacgtctctctattg

SEQ ID NO: 24369 - DNA, 18 bp, synthetic construct
  source 1..18: mol_type = other DNA
tagttcgactcacaaaag

SEQ ID NO: 24370 - DNA, 18 bp, synthetic construct
  source 1..18: mol_type = other DNA
tgcttcgactctctatag

SEQ ID NO: 24371 - DNA, 18 bp, synthetic construct
  source 1..18: mol_type = other DNA
ttaatcgacacactatag

SEQ ID NO: 24372 - DNA, 18 bp, synthetic construct
  source 1..18: mol_type = other DNA
ttttatgactcactattg

SEQ ID NO: 24373 - DNA, 18 bp, synthetic construct
  source 1..18: mol_type = other DNA
ctatattactcactatag

SEQ ID NO: 24374 - DNA, 18 bp, synthetic construct
  source 1..18: mol_type = other DNA
taaaacgaatttctatag

SEQ ID NO: 24375 - DNA, 18 bp, synthetic construct
  source 1..18: mol_type = other DNA
taatacgtctaaccaaag

SEQ ID NO: 24376 - DNA, 18 bp, synthetic construct
  source 1..18: mol_type = other DNA
tattaagactcactgaag

SEQ ID NO: 24377 - DNA, 18 bp, synthetic construct
  source 1..18: mol_type = other DNA
ttataagtctcactaaag

SEQ ID NO: 24378 - DNA, 18 bp, synthetic construct
  source 1..18: mol_type = other DNA
ttatacgtctctctacag

SEQ ID NO: 24379 - DNA, 18 bp, synthetic construct
  source 1..18: mol_type = other DNA
ttatatgactcactaacg

SEQ ID NO: 24380 - DNA, 18 bp, synthetic construct
  source 1..18: mol_type = other DNA
ttatatgactcacttaag

SEQ ID NO: 24381 - DNA, 18 bp, synthetic construct
  source 1..18: mol_type = other DNA
ttttacgcctcactttag

SEQ ID NO: 24382 - DNA, 18 bp, synthetic construct
  source 1..18: mol_type = other DNA
aaattcgactctctaaag

SEQ ID NO: 24383 - DNA, 18 bp, synthetic construct
  source 1..18: mol_type = other DNA
atattcgactcactacag

SEQ ID NO: 24384 - DNA, 18 bp, synthetic construct
  source 1..18: mol_type = other DNA
tcttacgactctctttag

SEQ ID NO: 24385 - DNA, 18 bp, synthetic construct
  source 1..18: mol_type = other DNA
taattcgtcacacaatag

SEQ ID NO: 24386 - DNA, 18 bp, synthetic construct
  source 1..18: mol_type = other DNA
taattcaactaactattg

SEQ ID NO: 24387 - DNA, 18 bp, synthetic construct
  source 1..18: mol_type = other DNA
taattcaactcgctttag

SEQ ID NO: 24388 - DNA, 18 bp, synthetic construct
  source 1..18: mol_type = other DNA
taattcaacttactattg

SEQ ID NO: 24389 - DNA, 18 bp, synthetic construct
  source 1..18: mol_type = other DNA
taattcgactcagaattg

SEQ ID NO: 24390 - DNA, 18 bp, synthetic construct
  source 1..18: mol_type = other DNA
ttatatgactcgctattg

SEQ ID NO: 24391 - DNA, 18 bp, synthetic construct
  source 1..18: mol_type = other DNA
ctattcgtctcactatag

SEQ ID NO: 24392 - DNA, 18 bp, synthetic construct
  source 1..18: mol_type = other DNA
taaatcgactcattaaag

SEQ ID NO: 24393 - DNA, 18 bp, synthetic construct
  source 1..18: mol_type = other DNA
taatacgaaacacttttg

SEQ ID NO: 24394 - DNA, 18 bp, synthetic construct
  source 1..18: mol_type = other DNA
taatacgtctaactaatg

SEQ ID NO: 24395 - DNA, 18 bp, synthetic construct
  source 1..18: mol_type = other DNA
taattctacacaatatag

SEQ ID NO: 24396 - DNA, 18 bp, synthetic construct
  source 1..18: mol_type = other DNA
taatttgacgcactacag

SEQ ID NO: 24397 - DNA, 18 bp, synthetic construct
  source 1..18: mol_type = other DNA
tactacgtctcactaatg

SEQ ID NO: 24398 - DNA, 18 bp, synthetic construct
  source 1..18: mol_type = other DNA
tatttcaactcactacag

SEQ ID NO: 24399 - DNA, 18 bp, synthetic construct
  source 1..18: mol_type = other DNA
tatttctactcaccatag

SEQ ID NO: 24400 - DNA, 18 bp, synthetic construct
  source 1..18: mol_type = other DNA
taaaactacccacaatag

SEQ ID NO: 24401 - DNA, 18 bp, synthetic construct
  source 1..18: mol_type = other DNA
taatacgtctaaatttag

SEQ ID NO: 24402 - DNA, 18 bp, synthetic construct
  source 1..18: mol_type = other DNA
taatacgtctctgtaaag

SEQ ID NO: 24403 - DNA, 18 bp, synthetic construct
  source 1..18: mol_type = other DNA
tcatactacactctatag

SEQ ID NO: 24404 - DNA, 18 bp, synthetic construct
  source 1..18: mol_type = other DNA
ttataagtctcactctag

SEQ ID NO: 24405 - DNA, 18 bp, synthetic construct
  source 1..18: mol_type = other DNA
atattcgactcgctatag

SEQ ID NO: 24406 - DNA, 18 bp, synthetic construct
  source 1..18: mol_type = other DNA
caaatcgactcactattg

SEQ ID NO: 24407 - DNA, 18 bp, synthetic construct
  source 1..18: mol_type = other DNA
taataccactcgcttttg

SEQ ID NO: 24408 - DNA, 18 bp, synthetic construct
  source 1..18: mol_type = other DNA
taatacgactcgttactg

SEQ ID NO: 24409 - DNA, 18 bp, synthetic construct
  source 1..18: mol_type = other DNA
taattccactcgctaaag

SEQ ID NO: 24410 - DNA, 18 bp, synthetic construct
  source 1..18: mol_type = other DNA
taattcgactggctctag

SEQ ID NO: 24411 - DNA, 18 bp, synthetic construct
  source 1..18: mol_type = other DNA
taattcgcctctctattg

SEQ ID NO: 24412 - DNA, 18 bp, synthetic construct
  source 1..18: mol_type = other DNA
taattcggctctctattg

SEQ ID NO: 24413 - DNA, 18 bp, synthetic construct
  source 1..18: mol_type = other DNA
taattcgtctcgctttag

SEQ ID NO: 24414 - DNA, 18 bp, synthetic construct
  source 1..18: mol_type = other DNA
taatttgactcaatattg

SEQ ID NO: 24415 - DNA, 18 bp, synthetic construct
  source 1..18: mol_type = other DNA
tacttcgactcactactg

SEQ ID NO: 24416 - DNA, 18 bp, synthetic construct
  source 1..18: mol_type = other DNA
tcatacgtctcgctattg

SEQ ID NO: 24417 - DNA, 18 bp, synthetic construct
  source 1..18: mol_type = other DNA
tgatacgtctcgctattg

SEQ ID NO: 24418 - DNA, 18 bp, synthetic construct
  source 1..18: mol_type = other DNA
aaaatcgactcactacag

SEQ ID NO: 24419 - DNA, 18 bp, synthetic construct
  source 1..18: mol_type = other DNA
aaatacaacttactattg

SEQ ID NO: 24420 - DNA, 18 bp, synthetic construct
  source 1..18: mol_type = other DNA
aaatacgacacaccattg

SEQ ID NO: 24421 - DNA, 18 bp, synthetic construct
  source 1..18: mol_type = other DNA
aaatacgactaactactg

SEQ ID NO: 24422 - DNA, 18 bp, synthetic construct
  source 1..18: mol_type = other DNA
aaatacgactcaccgttg

SEQ ID NO: 24423 - DNA, 18 bp, synthetic construct
  source 1..18: mol_type = other DNA
aaatacgactcccaattg

SEQ ID NO: 24424 - DNA, 18 bp, synthetic construct
  source 1..18: mol_type = other DNA
aaatacgtcacgctatag

SEQ ID NO: 24425 - DNA, 18 bp, synthetic construct
  source 1..18: mol_type = other DNA
aaatacgtcttgctatag

SEQ ID NO: 24426 - DNA, 18 bp, synthetic construct
  source 1..18: mol_type = other DNA
aaatgagactcactattg

SEQ ID NO: 24427 - DNA, 18 bp, synthetic construct
  source 1..18: mol_type = other DNA
aaattcggctcactacag

SEQ ID NO: 24428 - DNA, 18 bp, synthetic construct
  source 1..18: mol_type = other DNA
aaattcgtcgcactatag

SEQ ID NO: 24429 - DNA, 18 bp, synthetic construct
  source 1..18: mol_type = other DNA
aaattggactctctatag

SEQ ID NO: 24430 - DNA, 18 bp, synthetic construct
  source 1..18: mol_type = other DNA
aaattttactcactatag

SEQ ID NO: 24431 - DNA, 18 bp, synthetic construct
  source 1..18: mol_type = other DNA
aactaagactcgctatag

SEQ ID NO: 24432 - DNA, 18 bp, synthetic construct
  source 1..18: mol_type = other DNA
aactacgactcgatatag

SEQ ID NO: 24433 - DNA, 18 bp, synthetic construct
  source 1..18: mol_type = other DNA
aacttcgaatcactatag

SEQ ID NO: 24434 - DNA, 18 bp, synthetic construct
  source 1..18: mol_type = other DNA
acattcgtctcactatag

SEQ ID NO: 24435 - DNA, 18 bp, synthetic construct
  source 1..18: mol_type = other DNA
caacacgactaactattg

SEQ ID NO: 24436 - DNA, 18 bp, synthetic construct
  source 1..18: mol_type = other DNA
caataccactctctattg

SEQ ID NO: 24437 - DNA, 18 bp, synthetic construct
  source 1..18: mol_type = other DNA
caatacgccacactattg

SEQ ID NO: 24438 - DNA, 18 bp, synthetic construct
  source 1..18: mol_type = other DNA
caatacggctcacaattg

SEQ ID NO: 24439 - DNA, 18 bp, synthetic construct
  source 1..18: mol_type = other DNA
caatccgactcacaattg

SEQ ID NO: 24440 - DNA, 18 bp, synthetic construct
  source 1..18: mol_type = other DNA
caatgagactcactattg

SEQ ID NO: 24441 - DNA, 18 bp, synthetic construct
  source 1..18: mol_type = other DNA
caattggattcactatag

SEQ ID NO: 24442 - DNA, 18 bp, synthetic construct
  source 1..18: mol_type = other DNA
cagtacgactcacttttg

SEQ ID NO: 24443 - DNA, 18 bp, synthetic construct
  source 1..18: mol_type = other DNA
catttcgaatcactatag

SEQ ID NO: 24444 - DNA, 18 bp, synthetic construct
  source 1..18: mol_type = other DNA
catttcgactaactatag

SEQ ID NO: 24445 - DNA, 18 bp, synthetic construct
  source 1..18: mol_type = other DNA
catttctactcactatag

SEQ ID NO: 24446 - DNA, 18 bp, synthetic construct
  source 1..18: mol_type = other DNA
cgatacgacacactattg

SEQ ID NO: 24447 - DNA, 18 bp, synthetic construct
  source 1..18: mol_type = other DNA
gagtaagactcactattg

SEQ ID NO: 24448 - DNA, 18 bp, synthetic construct
  source 1..18: mol_type = other DNA
taaaaagactcactaatg

SEQ ID NO: 24449 - DNA, 18 bp, synthetic construct
  source 1..18: mol_type = other DNA
taaaacaactcacttttg

SEQ ID NO: 24450 - DNA, 18 bp, synthetic construct
  source 1..18: mol_type = other DNA
taaaacgacgaactattg

SEQ ID NO: 24451 - DNA, 18 bp, synthetic construct
  source 1..18: mol_type = other DNA
taaaacgccttgctatag

SEQ ID NO: 24452 - DNA, 18 bp, synthetic construct
  source 1..18: mol_type = other DNA
taaagcgattcactattg

SEQ ID NO: 24453 - DNA, 18 bp, synthetic construct
  source 1..18: mol_type = other DNA
taaatagactcactgtag

SEQ ID NO: 24454 - DNA, 18 bp, synthetic construct
  source 1..18: mol_type = other DNA
taaatagactcattatag

SEQ ID NO: 24455 - DNA, 18 bp, synthetic construct
  source 1..18: mol_type = other DNA
taaatccactcaccatag

SEQ ID NO: 24456 - DNA, 18 bp, synthetic construct
  source 1..18: mol_type = other DNA
taacatgacacactattg

SEQ ID NO: 24457 - DNA, 18 bp, synthetic construct
  source 1..18: mol_type = other DNA
taactcgactctttatag

SEQ ID NO: 24458 - DNA, 18 bp, synthetic construct
  source 1..18: mol_type = other DNA
taagactactctctattg

SEQ ID NO: 24459 - DNA, 18 bp, synthetic construct
  source 1..18: mol_type = other DNA
taagtcgattcactaaag

SEQ ID NO: 24460 - DNA, 18 bp, synthetic construct
  source 1..18: mol_type = other DNA
taataacactcaccattg

SEQ ID NO: 24461 - DNA, 18 bp, synthetic construct
  source 1..18: mol_type = other DNA
taataagacaagctatag

SEQ ID NO: 24462 - DNA, 18 bp, synthetic construct
  source 1..18: mol_type = other DNA
taataagtctcgccatag

SEQ ID NO: 24463 - DNA, 18 bp, synthetic construct
  source 1..18: mol_type = other DNA
taatacaaatcgctaaag

SEQ ID NO: 24464 - DNA, 18 bp, synthetic construct
  source 1..18: mol_type = other DNA
taatacaaatcgctctag

SEQ ID NO: 24465 - DNA, 18 bp, synthetic construct
  source 1..18: mol_type = other DNA
taataccattcactactg

SEQ ID NO: 24466 - DNA, 18 bp, synthetic construct
  source 1..18: mol_type = other DNA
taatacgacacacatttg

SEQ ID NO: 24467 - DNA, 18 bp, synthetic construct
  source 1..18: mol_type = other DNA
taatacgacccgccttag

SEQ ID NO: 24468 - DNA, 18 bp, synthetic construct
  source 1..18: mol_type = other DNA
taatacgactcagtgatg

SEQ ID NO: 24469 - DNA, 18 bp, synthetic construct
  source 1..18: mol_type = other DNA
taatacgagccactagtg

SEQ ID NO: 24470 - DNA, 18 bp, synthetic construct
  source 1..18: mol_type = other DNA
taatacgattacctattg

SEQ ID NO: 24471 - DNA, 18 bp, synthetic construct
  source 1..18: mol_type = other DNA
taatacgcatcgctttag

SEQ ID NO: 24472 - DNA, 18 bp, synthetic construct
  source 1..18: mol_type = other DNA
taatacgcttcgcaatag

SEQ ID NO: 24473 - DNA, 18 bp, synthetic construct
  source 1..18: mol_type = other DNA
taatacggctcactggtg

SEQ ID NO: 24474 - DNA, 18 bp, synthetic construct
  source 1..18: mol_type = other DNA
taatacgtcacacgattg

SEQ ID NO: 24475 - DNA, 18 bp, synthetic construct
  source 1..18: mol_type = other DNA
taatacgtcacgcgatag

SEQ ID NO: 24476 - DNA, 18 bp, synthetic construct
  source 1..18: mol_type = other DNA
taatacgtctccttattg

SEQ ID NO: 24477 - DNA, 18 bp, synthetic construct
  source 1..18: mol_type = other DNA
taatacgtctcgcaaaag

SEQ ID NO: 24478 - DNA, 18 bp, synthetic construct
  source 1..18: mol_type = other DNA
taatacgtctcgctctcg

SEQ ID NO: 24479 - DNA, 18 bp, synthetic construct
  source 1..18: mol_type = other DNA
taatacgtctgactactg

SEQ ID NO: 24480 - DNA, 18 bp, synthetic construct
  source 1..18: mol_type = other DNA
taatacgtgtcactaatg

SEQ ID NO: 24481 - DNA, 18 bp, synthetic construct
  source 1..18: mol_type = other DNA
taatactactctctgttg

SEQ ID NO: 24482 - DNA, 18 bp, synthetic construct
  source 1..18: mol_type = other DNA
taatactagccactattg

SEQ ID NO: 24483 - DNA, 18 bp, synthetic construct
  source 1..18: mol_type = other DNA
taatactcctcactagtg

SEQ ID NO: 24484 - DNA, 18 bp, synthetic construct
  source 1..18: mol_type = other DNA
taatagaactcgccatag

SEQ ID NO: 24485 - DNA, 18 bp, synthetic construct
  source 1..18: mol_type = other DNA
taataggactcagcattg

SEQ ID NO: 24486 - DNA, 18 bp, synthetic construct
  source 1..18: mol_type = other DNA
taataggactcattgttg

SEQ ID NO: 24487 - DNA, 18 bp, synthetic construct
  source 1..18: mol_type = other DNA
taatataactcgctaaag

SEQ ID NO: 24488 - DNA, 18 bp, synthetic construct
  source 1..18: mol_type = other DNA
taatatgacttactagtg

SEQ ID NO: 24489 - DNA, 18 bp, synthetic construct
  source 1..18: mol_type = other DNA
taatatgcctcaccattg

SEQ ID NO: 24490 - DNA, 18 bp, synthetic construct
  source 1..18: mol_type = other DNA
taatatgtctcagtattg

SEQ ID NO: 24491 - DNA, 18 bp, synthetic construct
  source 1..18: mol_type = other DNA
taatccgacactctattg

SEQ ID NO: 24492 - DNA, 18 bp, synthetic construct
  source 1..18: mol_type = other DNA
taatccgactctccattg

SEQ ID NO: 24493 - DNA, 18 bp, synthetic construct
  source 1..18: mol_type = other DNA
taatccgactgactactg

SEQ ID NO: 24494 - DNA, 18 bp, synthetic construct
  source 1..18: mol_type = other DNA
taatccgagtcaatattg

SEQ ID NO: 24495 - DNA, 18 bp, synthetic construct
  source 1..18: mol_type = other DNA
taatccgattccctattg

SEQ ID NO: 24496 - DNA, 18 bp, synthetic construct
  source 1..18: mol_type = other DNA
taatccgtcccactattg

SEQ ID NO: 24497 - DNA, 18 bp, synthetic construct
  source 1..18: mol_type = other DNA
taatccgtcttactattg

SEQ ID NO: 24498 - DNA, 18 bp, synthetic construct
  source 1..18: mol_type = other DNA
taattagactaaatatag

SEQ ID NO: 24499 - DNA, 18 bp, synthetic construct
  source 1..18: mol_type = other DNA
taattagactcacgttag

SEQ ID NO: 24500 - DNA, 18 bp, synthetic construct
  source 1..18: mol_type = other DNA
taattagactcactaagg

SEQ ID NO: 24501 - DNA, 18 bp, synthetic construct
  source 1..18: mol_type = other DNA
taattatactcactgtag

SEQ ID NO: 24502 - DNA, 18 bp, synthetic construct
  source 1..18: mol_type = other DNA
taattcaactcacaatgg

SEQ ID NO: 24503 - DNA, 18 bp, synthetic construct
  source 1..18: mol_type = other DNA
taattcgaatctctatgg

SEQ ID NO: 24504 - DNA, 18 bp, synthetic construct
  source 1..18: mol_type = other DNA
taattcgacatcctatag

SEQ ID NO: 24505 - DNA, 18 bp, synthetic construct
  source 1..18: mol_type = other DNA
taattcgacccacaatcg

SEQ ID NO: 24506 - DNA, 18 bp, synthetic construct
  source 1..18: mol_type = other DNA
taattcgacgccctttag

SEQ ID NO: 24507 - DNA, 18 bp, synthetic construct
  source 1..18: mol_type = other DNA
taattcgactaacttcag

SEQ ID NO: 24508 - DNA, 18 bp, synthetic construct
  source 1..18: mol_type = other DNA
taattcgactcaacacag

SEQ ID NO: 24509 - DNA, 18 bp, synthetic construct
  source 1..18: mol_type = other DNA
taattcgactcaacatcg

SEQ ID NO: 24510 - DNA, 18 bp, synthetic construct
  source 1..18: mol_type = other DNA
taattcgactcataaaag

SEQ ID NO: 24511 - DNA, 18 bp, synthetic construct
  source 1..18: mol_type = other DNA
taattcgactctatctag

SEQ ID NO: 24512 - DNA, 18 bp, synthetic construct
  source 1..18: mol_type = other DNA
taattcgactgtctaaag

SEQ ID NO: 24513 - DNA, 18 bp, synthetic construct
  source 1..18: mol_type = other DNA
taattcgactgtctctag

SEQ ID NO: 24514 - DNA, 18 bp, synthetic construct
  source 1..18: mol_type = other DNA
taattcgcctcacaagag

SEQ ID NO: 24515 - DNA, 18 bp, synthetic construct
  source 1..18: mol_type = other DNA
taattcgcctccctagag

SEQ ID NO: 24516 - DNA, 18 bp, synthetic construct
  source 1..18: mol_type = other DNA
taattcgtgtctctatag

SEQ ID NO: 24517 - DNA, 18 bp, synthetic construct
  source 1..18: mol_type = other DNA
taattctaatcactatgg

SEQ ID NO: 24518 - DNA, 18 bp, synthetic construct
  source 1..18: mol_type = other DNA
taattggattcactgtag

SEQ ID NO: 24519 - DNA, 18 bp, synthetic construct
  source 1..18: mol_type = other DNA
taatttgacacactttag

SEQ ID NO: 24520 - DNA, 18 bp, synthetic construct
  source 1..18: mol_type = other DNA
tacatcgactgactatag

SEQ ID NO: 24521 - DNA, 18 bp, synthetic construct
  source 1..18: mol_type = other DNA
tacttagactcactatcg

SEQ ID NO: 24522 - DNA, 18 bp, synthetic construct
  source 1..18: mol_type = other DNA
tacttcgactcacactag

SEQ ID NO: 24523 - DNA, 18 bp, synthetic construct
  source 1..18: mol_type = other DNA
tacttcgactcactcaag

SEQ ID NO: 24524 - DNA, 18 bp, synthetic construct
  source 1..18: mol_type = other DNA
tacttcgacttaatatag

SEQ ID NO: 24525 - DNA, 18 bp, synthetic construct
  source 1..18: mol_type = other DNA
tagaacgactcattattg

SEQ ID NO: 24526 - DNA, 18 bp, synthetic construct
  source 1..18: mol_type = other DNA
tagtacgactaacaattg

SEQ ID NO: 24527 - DNA, 18 bp, synthetic construct
  source 1..18: mol_type = other DNA
tagtatgactcgatatag

SEQ ID NO: 24528 - DNA, 18 bp, synthetic construct
  source 1..18: mol_type = other DNA
tagttggtctcactatag

SEQ ID NO: 24529 - DNA, 18 bp, synthetic construct
  source 1..18: mol_type = other DNA
tatcacgactcgttatag

SEQ ID NO: 24530 - DNA, 18 bp, synthetic construct
  source 1..18: mol_type = other DNA
tatcacgactgactattg

SEQ ID NO: 24531 - DNA, 18 bp, synthetic construct
  source 1..18: mol_type = other DNA
tatcacgacttgctatag

SEQ ID NO: 24532 - DNA, 18 bp, synthetic construct
  source 1..18: mol_type = other DNA
tattacaaatcgctatag

SEQ ID NO: 24533 - DNA, 18 bp, synthetic construct
  source 1..18: mol_type = other DNA
tattaccactcgctttag

SEQ ID NO: 24534 - DNA, 18 bp, synthetic construct
  source 1..18: mol_type = other DNA
tattacgactcactgctg

SEQ ID NO: 24535 - DNA, 18 bp, synthetic construct
  source 1..18: mol_type = other DNA
tattacgattagctatag

SEQ ID NO: 24536 - DNA, 18 bp, synthetic construct
  source 1..18: mol_type = other DNA
tattacggcttactattg

SEQ ID NO: 24537 - DNA, 18 bp, synthetic construct
  source 1..18: mol_type = other DNA
tattattactcactattg

SEQ ID NO: 24538 - DNA, 18 bp, synthetic construct
  source 1..18: mol_type = other DNA
tattattactcgctatag

SEQ ID NO: 24539 - DNA, 18 bp, synthetic construct
  source 1..18: mol_type = other DNA
tattgcgacttactattg

SEQ ID NO: 24540 - DNA, 18 bp, synthetic construct
  source 1..18: mol_type = other DNA
tatttcaactcagtatag

SEQ ID NO: 24541 - DNA, 18 bp, synthetic construct
  source 1..18: mol_type = other DNA
tatttcgactcattatgg

SEQ ID NO: 24542 - DNA, 18 bp, synthetic construct
  source 1..18: mol_type = other DNA
tatttcgattcactacag

SEQ ID NO: 24543 - DNA, 18 bp, synthetic construct
  source 1..18: mol_type = other DNA
tattttgactcactctag

SEQ ID NO: 24544 - DNA, 18 bp, synthetic construct
  source 1..18: mol_type = other DNA
tcaaacgacccactattg

SEQ ID NO: 24545 - DNA, 18 bp, synthetic construct
  source 1..18: mol_type = other DNA
tcaaacgagtcactattg

SEQ ID NO: 24546 - DNA, 18 bp, synthetic construct
  source 1..18: mol_type = other DNA
tcaaatgactcactattg

SEQ ID NO: 24547 - DNA, 18 bp, synthetic construct
  source 1..18: mol_type = other DNA
tcaatagactcactatag

SEQ ID NO: 24548 - DNA, 18 bp, synthetic construct
  source 1..18: mol_type = other DNA
tcatacaactaactattg

SEQ ID NO: 24549 - DNA, 18 bp, synthetic construct
  source 1..18: mol_type = other DNA
tcatacgactcacacttg

SEQ ID NO: 24550 - DNA, 18 bp, synthetic construct
  source 1..18: mol_type = other DNA
tcatacgattctctattg

SEQ ID NO: 24551 - DNA, 18 bp, synthetic construct
  source 1..18: mol_type = other DNA
tcatacgcttcactattg

SEQ ID NO: 24552 - DNA, 18 bp, synthetic construct
  source 1..18: mol_type = other DNA
tcatacgtctcactaatg

SEQ ID NO: 24553 - DNA, 18 bp, synthetic construct
  source 1..18: mol_type = other DNA
tcatatgactcattattg

SEQ ID NO: 24554 - DNA, 18 bp, synthetic construct
  source 1..18: mol_type = other DNA
tcattccactccctatag

SEQ ID NO: 24555 - DNA, 18 bp, synthetic construct
  source 1..18: mol_type = other DNA
tcattcgattcactttag

SEQ ID NO: 24556 - DNA, 18 bp, synthetic construct
  source 1..18: mol_type = other DNA
tcattcgcctcagtatag

SEQ ID NO: 24557 - DNA, 18 bp, synthetic construct
  source 1..18: mol_type = other DNA
tcatttgtctcactatag

SEQ ID NO: 24558 - DNA, 18 bp, synthetic construct
  source 1..18: mol_type = other DNA
tctttcgactcaatatag

SEQ ID NO: 24559 - DNA, 18 bp, synthetic construct
  source 1..18: mol_type = other DNA
tgaaactactcactattg

SEQ ID NO: 24560 - DNA, 18 bp, synthetic construct
  source 1..18: mol_type = other DNA
tgacaagactcactattg

SEQ ID NO: 24561 - DNA, 18 bp, synthetic construct
  source 1..18: mol_type = other DNA
tgataagactcacgattg

SEQ ID NO: 24562 - DNA, 18 bp, synthetic construct
  source 1..18: mol_type = other DNA
tgataagacttactattg

SEQ ID NO: 24563 - DNA, 18 bp, synthetic construct
  source 1..18: mol_type = other DNA
tgatacgacttacaattg

SEQ ID NO: 24564 - DNA, 18 bp, synthetic construct
  source 1..18: mol_type = other DNA
tgatatgactcactgttg

SEQ ID NO: 24565 - DNA, 18 bp, synthetic construct
  source 1..18: mol_type = other DNA
tgatgcgacttgctatag

SEQ ID NO: 24566 - DNA, 18 bp, synthetic construct
  source 1..18: mol_type = other DNA
ttaaacgactggctatag

SEQ ID NO: 24567 - DNA, 18 bp, synthetic construct
  source 1..18: mol_type = other DNA
ttacacgacacactattg

SEQ ID NO: 24568 - DNA, 18 bp, synthetic construct
  source 1..18: mol_type = other DNA
ttatacgactccctatta

SEQ ID NO: 24569 - DNA, 18 bp, synthetic construct
  source 1..18: mol_type = other DNA
ttatacgactcgcattag

SEQ ID NO: 24570 - DNA, 18 bp, synthetic construct
  source 1..18: mol_type = other DNA
ttatacgactcgctgaag

SEQ ID NO: 24571 - DNA, 18 bp, synthetic construct
  source 1..18: mol_type = other DNA
ttatactactcactagtg

SEQ ID NO: 24572 - DNA, 18 bp, synthetic construct
  source 1..18: mol_type = other DNA
ttatactactcgctttag

SEQ ID NO: 24573 - DNA, 18 bp, synthetic construct
  source 1..18: mol_type = other DNA
ttataggaatcactattg

SEQ ID NO: 24574 - DNA, 18 bp, synthetic construct
  source 1..18: mol_type = other DNA
ttatgcgactcattattg

SEQ ID NO: 24575 - DNA, 18 bp, synthetic construct
  source 1..18: mol_type = other DNA
ttattcaactaactatag

SEQ ID NO: 24576 - DNA, 18 bp, synthetic construct
  source 1..18: mol_type = other DNA
ttattcgacttaccatag

SEQ ID NO: 24577 - DNA, 18 bp, synthetic construct
  source 1..18: mol_type = other DNA
aaaaacgactcactggag

SEQ ID NO: 24578 - DNA, 18 bp, synthetic construct
  source 1..18: mol_type = other DNA
aaaaacgactctctaaag

SEQ ID NO: 24579 - DNA, 18 bp, synthetic construct
  source 1..18: mol_type = other DNA
aaaaacgactctctctag

SEQ ID NO: 24580 - DNA, 18 bp, synthetic construct
  source 1..18: mol_type = other DNA
aaaaacgactgaccatag

SEQ ID NO: 24581 - DNA, 18 bp, synthetic construct
  source 1..18: mol_type = other DNA
aaaaacggctctctatag

SEQ ID NO: 24582 - DNA, 18 bp, synthetic construct
  source 1..18: mol_type = other DNA
aaaagcgacccactatag

SEQ ID NO: 24583 - DNA, 18 bp, synthetic construct
  source 1..18: mol_type = other DNA
aaacacgactatctatag

SEQ ID NO: 24584 - DNA, 18 bp, synthetic construct
  source 1..18: mol_type = other DNA
aaacacgtctcactatcg

SEQ ID NO: 24585 - DNA, 18 bp, synthetic construct
  source 1..18: mol_type = other DNA
aaacatgtctcactatag

SEQ ID NO: 24586 - DNA, 18 bp, synthetic construct
  source 1..18: mol_type = other DNA
aaataaaactcactatcg

SEQ ID NO: 24587 - DNA, 18 bp, synthetic construct
  source 1..18: mol_type = other DNA
aaataacactcacgatag

SEQ ID NO: 24588 - DNA, 18 bp, synthetic construct
  source 1..18: mol_type = other DNA
aaataagtctcactctag

SEQ ID NO: 24589 - DNA, 18 bp, synthetic construct
  source 1..18: mol_type = other DNA
aaataccagtcacaatag

SEQ ID NO: 24590 - DNA, 18 bp, synthetic construct
  source 1..18: mol_type = other DNA
aaatacgaaacaatatag

SEQ ID NO: 24591 - DNA, 18 bp, synthetic construct
  source 1..18: mol_type = other DNA
aaatacgaaccactatcg

SEQ ID NO: 24592 - DNA, 18 bp, synthetic construct
  source 1..18: mol_type = other DNA
aaatacgactcacagaag

SEQ ID NO: 24593 - DNA, 18 bp, synthetic construct
  source 1..18: mol_type = other DNA
aaatacgactccctcaag

SEQ ID NO: 24594 - DNA, 18 bp, synthetic construct
  source 1..18: mol_type = other DNA
aaatacgactccctttcg

SEQ ID NO: 24595 - DNA, 18 bp, synthetic construct
  source 1..18: mol_type = other DNA
aaatacgactctatgtag

SEQ ID NO: 24596 - DNA, 18 bp, synthetic construct
  source 1..18: mol_type = other DNA
aaatacgactctcagtag

SEQ ID NO: 24597 - DNA, 18 bp, synthetic construct
  source 1..18: mol_type = other DNA
aaatacgactctcttcag

SEQ ID NO: 24598 - DNA, 18 bp, synthetic construct
  source 1..18: mol_type = other DNA
aaatacgactcttcatag

SEQ ID NO: 24599 - DNA, 18 bp, synthetic construct
  source 1..18: mol_type = other DNA
aaatacgagtcacttaag

SEQ ID NO: 24600 - DNA, 18 bp, synthetic construct
  source 1..18: mol_type = other DNA
aaatacgatttactatcg

SEQ ID NO: 24601 - DNA, 18 bp, synthetic construct
  source 1..18: mol_type = other DNA
aaatacgcctctctaaag

SEQ ID NO: 24602 - DNA, 18 bp, synthetic construct
  source 1..18: mol_type = other DNA
aaatacgcttcacaatag

SEQ ID NO: 24603 - DNA, 18 bp, synthetic construct
  source 1..18: mol_type = other DNA
aaatacggctcacattag

SEQ ID NO: 24604 - DNA, 18 bp, synthetic construct
  source 1..18: mol_type = other DNA
aaatacgtctcacgaaag

SEQ ID NO: 24605 - DNA, 18 bp, synthetic construct
  source 1..18: mol_type = other DNA
aaatactattcactctag

SEQ ID NO: 24606 - DNA, 18 bp, synthetic construct
  source 1..18: mol_type = other DNA
aaatatgactaactacag

SEQ ID NO: 24607 - DNA, 18 bp, synthetic construct
  source 1..18: mol_type = other DNA
aaatatgactaattatag

SEQ ID NO: 24608 - DNA, 18 bp, synthetic construct
  source 1..18: mol_type = other DNA
aaatatgattcattatag

SEQ ID NO: 24609 - DNA, 18 bp, synthetic construct
  source 1..18: mol_type = other DNA
aaatcagactctctatag

SEQ ID NO: 24610 - DNA, 18 bp, synthetic construct
  source 1..18: mol_type = other DNA
aaatccgactaattatag

SEQ ID NO: 24611 - DNA, 18 bp, synthetic construct
  source 1..18: mol_type = other DNA
aaatccgactcacttgag

SEQ ID NO: 24612 - DNA, 18 bp, synthetic construct
  source 1..18: mol_type = other DNA
aaatgcgactctatatag

SEQ ID NO: 24613 - DNA, 18 bp, synthetic construct
  source 1..18: mol_type = other DNA
aaatgcgattcacaatag

SEQ ID NO: 24614 - DNA, 18 bp, synthetic construct
  source 1..18: mol_type = other DNA
aactacgacacaccatag

SEQ ID NO: 24615 - DNA, 18 bp, synthetic construct
  source 1..18: mol_type = other DNA
aactacgtctcactacag

SEQ ID NO: 24616 - DNA, 18 bp, synthetic construct
  source 1..18: mol_type = other DNA
aactacgtctcactatcg

SEQ ID NO: 24617 - DNA, 18 bp, synthetic construct
  source 1..18: mol_type = other DNA
aagtaagtctcactatag

SEQ ID NO: 24618 - DNA, 18 bp, synthetic construct
  source 1..18: mol_type = other DNA
aagtacgactaactaaag

SEQ ID NO: 24619 - DNA, 18 bp, synthetic construct
  source 1..18: mol_type = other DNA
aagtccgactaactatag

SEQ ID NO: 24620 - DNA, 18 bp, synthetic construct
  source 1..18: mol_type = other DNA
aagtccgtctcactatag

SEQ ID NO: 24621 - DNA, 18 bp, synthetic construct
  source 1..18: mol_type = other DNA
aagtcggactcactatag

SEQ ID NO: 24622 - DNA, 18 bp, synthetic construct
  source 1..18: mol_type = other DNA
aattacaactcaatatag

SEQ ID NO: 24623 - DNA, 18 bp, synthetic construct
  source 1..18: mol_type = other DNA
aattacgactcaagatag

SEQ ID NO: 24624 - DNA, 18 bp, synthetic construct
  source 1..18: mol_type = other DNA
aattacgagttactatag

SEQ ID NO: 24625 - DNA, 18 bp, synthetic construct
  source 1..18: mol_type = other DNA
aattacggctcactatgg

SEQ ID NO: 24626 - DNA, 18 bp, synthetic construct
  source 1..18: mol_type = other DNA
acacacgactcagtatag

SEQ ID NO: 24627 - DNA, 18 bp, synthetic construct
  source 1..18: mol_type = other DNA
acataccagtcactatag

SEQ ID NO: 24628 - DNA, 18 bp, synthetic construct
  source 1..18: mol_type = other DNA
acatgcgactcactttag

SEQ ID NO: 24629 - DNA, 18 bp, synthetic construct
  source 1..18: mol_type = other DNA
acgtacgactcacaatag

SEQ ID NO: 24630 - DNA, 18 bp, synthetic construct
  source 1..18: mol_type = other DNA
acgtactactcactatag

SEQ ID NO: 24631 - DNA, 18 bp, synthetic construct
  source 1..18: mol_type = other DNA
agatacaagtcactatag

SEQ ID NO: 24632 - DNA, 18 bp, synthetic construct
  source 1..18: mol_type = other DNA
agatacgaatcactttag

SEQ ID NO: 24633 - DNA, 18 bp, synthetic construct
  source 1..18: mol_type = other DNA
agatacgactctccatag

SEQ ID NO: 24634 - DNA, 18 bp, synthetic construct
  source 1..18: mol_type = other DNA
agatacgatacactatag

SEQ ID NO: 24635 - DNA, 18 bp, synthetic construct
  source 1..18: mol_type = other DNA
atatacaacccactatag

SEQ ID NO: 24636 - DNA, 18 bp, synthetic construct
  source 1..18: mol_type = other DNA
atatactactcactatcg

SEQ ID NO: 24637 - DNA, 18 bp, synthetic construct
  source 1..18: mol_type = other DNA
atatatggctcactatag

SEQ ID NO: 24638 - DNA, 18 bp, synthetic construct
  source 1..18: mol_type = other DNA
atatgcgacgcactatag

SEQ ID NO: 24639 - DNA, 18 bp, synthetic construct
  source 1..18: mol_type = other DNA
caaaacaaatcactatag

SEQ ID NO: 24640 - DNA, 18 bp, synthetic construct
  source 1..18: mol_type = other DNA
caaaacatctcactatag

SEQ ID NO: 24641 - DNA, 18 bp, synthetic construct
  source 1..18: mol_type = other DNA
caaaacccctcactatag

SEQ ID NO: 24642 - DNA, 18 bp, synthetic construct
  source 1..18: mol_type = other DNA
caaaccgactcagtatag

SEQ ID NO: 24643 - DNA, 18 bp, synthetic construct
  source 1..18: mol_type = other DNA
caatacaaaccactatag

SEQ ID NO: 24644 - DNA, 18 bp, synthetic construct
  source 1..18: mol_type = other DNA
caatacaattcactaaag

SEQ ID NO: 24645 - DNA, 18 bp, synthetic construct
  source 1..18: mol_type = other DNA
caatacgacacactctcg

SEQ ID NO: 24646 - DNA, 18 bp, synthetic construct
  source 1..18: mol_type = other DNA
caatacgactcaattaag

SEQ ID NO: 24647 - DNA, 18 bp, synthetic construct
  source 1..18: mol_type = other DNA
caatacgcaccactatag

SEQ ID NO: 24648 - DNA, 18 bp, synthetic construct
  source 1..18: mol_type = other DNA
caatacgcctcacaacag

SEQ ID NO: 24649 - DNA, 18 bp, synthetic construct
  source 1..18: mol_type = other DNA
caatactaatcactctag

SEQ ID NO: 24650 - DNA, 18 bp, synthetic construct
  source 1..18: mol_type = other DNA
caatactactcattaaag

SEQ ID NO: 24651 - DNA, 18 bp, synthetic construct
  source 1..18: mol_type = other DNA
caatactactcattacag

SEQ ID NO: 24652 - DNA, 18 bp, synthetic construct
  source 1..18: mol_type = other DNA
caatagtactcactgtag

SEQ ID NO: 24653 - DNA, 18 bp, synthetic construct
  source 1..18: mol_type = other DNA
caatagtactcactttag

SEQ ID NO: 24654 - DNA, 18 bp, synthetic construct
  source 1..18: mol_type = other DNA
caatgcgaaacactatag

SEQ ID NO: 24655 - DNA, 18 bp, synthetic construct
  source 1..18: mol_type = other DNA
cagtacgacgctctatag

SEQ ID NO: 24656 - DNA, 18 bp, synthetic construct
  source 1..18: mol_type = other DNA
cataacgaatcactatag

SEQ ID NO: 24657 - DNA, 18 bp, synthetic construct
  source 1..18: mol_type = other DNA
cataacgacacactatag

SEQ ID NO: 24658 - DNA, 18 bp, synthetic construct
  source 1..18: mol_type = other DNA
cattaaaactcactatag

SEQ ID NO: 24659 - DNA, 18 bp, synthetic construct
  source 1..18: mol_type = other DNA
cattaagactctctatag

SEQ ID NO: 24660 - DNA, 18 bp, synthetic construct
  source 1..18: mol_type = other DNA
cattacgattaactatag

SEQ ID NO: 24661 - DNA, 18 bp, synthetic construct
  source 1..18: mol_type = other DNA
cgctacgtctcactatag

SEQ ID NO: 24662 - DNA, 18 bp, synthetic construct
  source 1..18: mol_type = other DNA
ctatacgactcaatttag

SEQ ID NO: 24663 - DNA, 18 bp, synthetic construct
  source 1..18: mol_type = other DNA
ctatacgattcaccatag

SEQ ID NO: 24664 - DNA, 18 bp, synthetic construct
  source 1..18: mol_type = other DNA
ctttacgactgactatag

SEQ ID NO: 24665 - DNA, 18 bp, synthetic construct
  source 1..18: mol_type = other DNA
gaaaacgactctgtatag

SEQ ID NO: 24666 - DNA, 18 bp, synthetic construct
  source 1..18: mol_type = other DNA
gaatacgtctctctctag

SEQ ID NO: 24667 - DNA, 18 bp, synthetic construct
  source 1..18: mol_type = other DNA
gaatgcagctcactatag

SEQ ID NO: 24668 - DNA, 18 bp, synthetic construct
  source 1..18: mol_type = other DNA
gaatgcgactcaccttag

SEQ ID NO: 24669 - DNA, 18 bp, synthetic construct
  source 1..18: mol_type = other DNA
gactacgactcattttag

SEQ ID NO: 24670 - DNA, 18 bp, synthetic construct
  source 1..18: mol_type = other DNA
gattacgtctcactaaag

SEQ ID NO: 24671 - DNA, 18 bp, synthetic construct
  source 1..18: mol_type = other DNA
gtaaacaactcactatag

SEQ ID NO: 24672 - DNA, 18 bp, synthetic construct
  source 1..18: mol_type = other DNA
taaaaaaactcactaaag

SEQ ID NO: 24673 - DNA, 18 bp, synthetic construct
  source 1..18: mol_type = other DNA
taaaaagtctcactttag

SEQ ID NO: 24674 - DNA, 18 bp, synthetic construct
  source 1..18: mol_type = other DNA
taaaaagtctcagtatag

SEQ ID NO: 24675 - DNA, 18 bp, synthetic construct
  source 1..18: mol_type = other DNA
taaaacaaattactatag

SEQ ID NO: 24676 - DNA, 18 bp, synthetic construct
  source 1..18: mol_type = other DNA
taaaacaacacactctag

SEQ ID NO: 24677 - DNA, 18 bp, synthetic construct
  source 1..18: mol_type = other DNA
taaaacaattcactctag

SEQ ID NO: 24678 - DNA, 18 bp, synthetic construct
  source 1..18: mol_type = other DNA
taaaaccactcattaaag

SEQ ID NO: 24679 - DNA, 18 bp, synthetic construct
  source 1..18: mol_type = other DNA
taaaaccagtccctatag

SEQ ID NO: 24680 - DNA, 18 bp, synthetic construct
  source 1..18: mol_type = other DNA
taaaacgaatatctatag

SEQ ID NO: 24681 - DNA, 18 bp, synthetic construct
  source 1..18: mol_type = other DNA
taaaacgaatcaatgtag

SEQ ID NO: 24682 - DNA, 18 bp, synthetic construct
  source 1..18: mol_type = other DNA
taaaacgaatcacgaaag

SEQ ID NO: 24683 - DNA, 18 bp, synthetic construct
  source 1..18: mol_type = other DNA
taaaacgactatccatag

SEQ ID NO: 24684 - DNA, 18 bp, synthetic construct
  source 1..18: mol_type = other DNA
taaaacgccccacaatag

SEQ ID NO: 24685 - DNA, 18 bp, synthetic construct
  source 1..18: mol_type = other DNA
taaaacggttcaatatag

SEQ ID NO: 24686 - DNA, 18 bp, synthetic construct
  source 1..18: mol_type = other DNA
taaaactaataactatag

SEQ ID NO: 24687 - DNA, 18 bp, synthetic construct
  source 1..18: mol_type = other DNA
taaaactactcactttcg

SEQ ID NO: 24688 - DNA, 18 bp, synthetic construct
  source 1..18: mol_type = other DNA
taaaactacttacgatag

SEQ ID NO: 24689 - DNA, 18 bp, synthetic construct
  source 1..18: mol_type = other DNA
taaaaggacacacaatag

SEQ ID NO: 24690 - DNA, 18 bp, synthetic construct
  source 1..18: mol_type = other DNA
taaaatcactcactctag

SEQ ID NO: 24691 - DNA, 18 bp, synthetic construct
  source 1..18: mol_type = other DNA
taaaatgacacactatgg

SEQ ID NO: 24692 - DNA, 18 bp, synthetic construct
  source 1..18: mol_type = other DNA
taaaatgactaacaatag

SEQ ID NO: 24693 - DNA, 18 bp, synthetic construct
  source 1..18: mol_type = other DNA
taaaatgactcattttag

SEQ ID NO: 24694 - DNA, 18 bp, synthetic construct
  source 1..18: mol_type = other DNA
taaaatgacttactctag

SEQ ID NO: 24695 - DNA, 18 bp, synthetic construct
  source 1..18: mol_type = other DNA
taaaatgattcacgatag

SEQ ID NO: 24696 - DNA, 18 bp, synthetic construct
  source 1..18: mol_type = other DNA
taaaccgacacacgatag

SEQ ID NO: 24697 - DNA, 18 bp, synthetic construct
  source 1..18: mol_type = other DNA
taaaccgatacactatag

SEQ ID NO: 24698 - DNA, 18 bp, synthetic construct
  source 1..18: mol_type = other DNA
taaaccgcctcacaatag

SEQ ID NO: 24699 - DNA, 18 bp, synthetic construct
  source 1..18: mol_type = other DNA
taaaccgtctcactagag

SEQ ID NO: 24700 - DNA, 18 bp, synthetic construct
  source 1..18: mol_type = other DNA
taaaccgtctccctatag

SEQ ID NO: 24701 - DNA, 18 bp, synthetic construct
  source 1..18: mol_type = other DNA
taaagcgaatcactaaag

SEQ ID NO: 24702 - DNA, 18 bp, synthetic construct
  source 1..18: mol_type = other DNA
taaagcgactcagtatcg

SEQ ID NO: 24703 - DNA, 18 bp, synthetic construct
  source 1..18: mol_type = other DNA
taacaagacgcactacag

SEQ ID NO: 24704 - DNA, 18 bp, synthetic construct
  source 1..18: mol_type = other DNA
taacaagcgtcactatag

SEQ ID NO: 24705 - DNA, 18 bp, synthetic construct
  source 1..18: mol_type = other DNA
taacacaattcactatgg

SEQ ID NO: 24706 - DNA, 18 bp, synthetic construct
  source 1..18: mol_type = other DNA
taacacacttcactatag

SEQ ID NO: 24707 - DNA, 18 bp, synthetic construct
  source 1..18: mol_type = other DNA
taacacgaaccattatag

SEQ ID NO: 24708 - DNA, 18 bp, synthetic construct
  source 1..18: mol_type = other DNA
taacacgactcaacatcg

SEQ ID NO: 24709 - DNA, 18 bp, synthetic construct
  source 1..18: mol_type = other DNA
taacacgacttacagtag

SEQ ID NO: 24710 - DNA, 18 bp, synthetic construct
  source 1..18: mol_type = other DNA
taacacgagacactaaag

SEQ ID NO: 24711 - DNA, 18 bp, synthetic construct
  source 1..18: mol_type = other DNA
taacacgccacactaaag

SEQ ID NO: 24712 - DNA, 18 bp, synthetic construct
  source 1..18: mol_type = other DNA
taacacggctcaataaag

SEQ ID NO: 24713 - DNA, 18 bp, synthetic construct
  source 1..18: mol_type = other DNA
taacacgtccctctatag

SEQ ID NO: 24714 - DNA, 18 bp, synthetic construct
  source 1..18: mol_type = other DNA
taacacgtctcaccatcg

SEQ ID NO: 24715 - DNA, 18 bp, synthetic construct
  source 1..18: mol_type = other DNA
taacacgtctcattatcg

SEQ ID NO: 24716 - DNA, 18 bp, synthetic construct
  source 1..18: mol_type = other DNA
taacacgtctctgtatag

SEQ ID NO: 24717 - DNA, 18 bp, synthetic construct
  source 1..18: mol_type = other DNA
taacactactcactttgg

SEQ ID NO: 24718 - DNA, 18 bp, synthetic construct
  source 1..18: mol_type = other DNA
taacactcctctctatag

SEQ ID NO: 24719 - DNA, 18 bp, synthetic construct
  source 1..18: mol_type = other DNA
taacagtactcattatag

SEQ ID NO: 24720 - DNA, 18 bp, synthetic construct
  source 1..18: mol_type = other DNA
taacatcactcacaatag

SEQ ID NO: 24721 - DNA, 18 bp, synthetic construct
  source 1..18: mol_type = other DNA
taacatgaatcactagag

SEQ ID NO: 24722 - DNA, 18 bp, synthetic construct
  source 1..18: mol_type = other DNA
taacatgactcagtagag

SEQ ID NO: 24723 - DNA, 18 bp, synthetic construct
  source 1..18: mol_type = other DNA
taacatgtcacactatag

SEQ ID NO: 24724 - DNA, 18 bp, synthetic construct
  source 1..18: mol_type = other DNA
taacctgactcactatgg

SEQ ID NO: 24725 - DNA, 18 bp, synthetic construct
  source 1..18: mol_type = other DNA
taacgcgtctcacaatag

SEQ ID NO: 24726 - DNA, 18 bp, synthetic construct
  source 1..18: mol_type = other DNA
taagaagacactctatag

SEQ ID NO: 24727 - DNA, 18 bp, synthetic construct
  source 1..18: mol_type = other DNA
taagaccacgcactatgg

SEQ ID NO: 24728 - DNA, 18 bp, synthetic construct
  source 1..18: mol_type = other DNA
taagacgaatcagtgtag

SEQ ID NO: 24729 - DNA, 18 bp, synthetic construct
  source 1..18: mol_type = other DNA
taagacgctacactatag

SEQ ID NO: 24730 - DNA, 18 bp, synthetic construct
  source 1..18: mol_type = other DNA
taagacgtctcagtttag

SEQ ID NO: 24731 - DNA, 18 bp, synthetic construct
  source 1..18: mol_type = other DNA
taagacgtttcaatatag

SEQ ID NO: 24732 - DNA, 18 bp, synthetic construct
  source 1..18: mol_type = other DNA
taagccgacttactatgg

SEQ ID NO: 24733 - DNA, 18 bp, synthetic construct
  source 1..18: mol_type = other DNA
taataaaactcacattag

SEQ ID NO: 24734 - DNA, 18 bp, synthetic construct
  source 1..18: mol_type = other DNA
taataagacacaccaaag

SEQ ID NO: 24735 - DNA, 18 bp, synthetic construct
  source 1..18: mol_type = other DNA
taataagacacacttcag

SEQ ID NO: 24736 - DNA, 18 bp, synthetic construct
  source 1..18: mol_type = other DNA
taataagacgaactaaag

SEQ ID NO: 24737 - DNA, 18 bp, synthetic construct
  source 1..18: mol_type = other DNA
taataagacgaactttag

SEQ ID NO: 24738 - DNA, 18 bp, synthetic construct
  source 1..18: mol_type = other DNA
taataagacggacaatag

SEQ ID NO: 24739 - DNA, 18 bp, synthetic construct
  source 1..18: mol_type = other DNA
taataagactctcaatcg

SEQ ID NO: 24740 - DNA, 18 bp, synthetic construct
  source 1..18: mol_type = other DNA
taataagacttcctttag

SEQ ID NO: 24741 - DNA, 18 bp, synthetic construct
  source 1..18: mol_type = other DNA
taataagattaactaaag

SEQ ID NO: 24742 - DNA, 18 bp, synthetic construct
  source 1..18: mol_type = other DNA
taataagattcaacatag

SEQ ID NO: 24743 - DNA, 18 bp, synthetic construct
  source 1..18: mol_type = other DNA
taataagccaccctatag

SEQ ID NO: 24744 - DNA, 18 bp, synthetic construct
  source 1..18: mol_type = other DNA
taataagcctccttatag

SEQ ID NO: 24745 - DNA, 18 bp, synthetic construct
  source 1..18: mol_type = other DNA
taataagggccactatag

SEQ ID NO: 24746 - DNA, 18 bp, synthetic construct
  source 1..18: mol_type = other DNA
taataagtatcaatatag

SEQ ID NO: 24747 - DNA, 18 bp, synthetic construct
  source 1..18: mol_type = other DNA
taataagtctaacaatag

SEQ ID NO: 24748 - DNA, 18 bp, synthetic construct
  source 1..18: mol_type = other DNA
taataagtctcacactag

SEQ ID NO: 24749 - DNA, 18 bp, synthetic construct
  source 1..18: mol_type = other DNA
taataagtctcattagag

SEQ ID NO: 24750 - DNA, 18 bp, synthetic construct
  source 1..18: mol_type = other DNA
taataagtctcattatcg

SEQ ID NO: 24751 - DNA, 18 bp, synthetic construct
  source 1..18: mol_type = other DNA
taataatacacactatcg

SEQ ID NO: 24752 - DNA, 18 bp, synthetic construct
  source 1..18: mol_type = other DNA
taataatactaaccatag

SEQ ID NO: 24753 - DNA, 18 bp, synthetic construct
  source 1..18: mol_type = other DNA
taataatactcacgaaag

SEQ ID NO: 24754 - DNA, 18 bp, synthetic construct
  source 1..18: mol_type = other DNA
taatacaacgaactatcg

SEQ ID NO: 24755 - DNA, 18 bp, synthetic construct
  source 1..18: mol_type = other DNA
taatacaactaacaatgg

SEQ ID NO: 24756 - DNA, 18 bp, synthetic construct
  source 1..18: mol_type = other DNA
taatacaactcactccgg

SEQ ID NO: 24757 - DNA, 18 bp, synthetic construct
  source 1..18: mol_type = other DNA
taatacaagtcataatag

SEQ ID NO: 24758 - DNA, 18 bp, synthetic construct
  source 1..18: mol_type = other DNA
taatacaattaactgtag

SEQ ID NO: 24759 - DNA, 18 bp, synthetic construct
  source 1..18: mol_type = other DNA
taatacaattcaccaaag

SEQ ID NO: 24760 - DNA, 18 bp, synthetic construct
  source 1..18: mol_type = other DNA
taatacaattcactccag

SEQ ID NO: 24761 - DNA, 18 bp, synthetic construct
  source 1..18: mol_type = other DNA
taatacagctcacttaag

SEQ ID NO: 24762 - DNA, 18 bp, synthetic construct
  source 1..18: mol_type = other DNA
taatacagttcagtatag

SEQ ID NO: 24763 - DNA, 18 bp, synthetic construct
  source 1..18: mol_type = other DNA
taatacatgtaactatag

SEQ ID NO: 24764 - DNA, 18 bp, synthetic construct
  source 1..18: mol_type = other DNA
taataccaatcaatagag

SEQ ID NO: 24765 - DNA, 18 bp, synthetic construct
  source 1..18: mol_type = other DNA
taataccaatctatatag

SEQ ID NO: 24766 - DNA, 18 bp, synthetic construct
  source 1..18: mol_type = other DNA
taataccactcagcatcg

SEQ ID NO: 24767 - DNA, 18 bp, synthetic construct
  source 1..18: mol_type = other DNA
taataccactcatattag

SEQ ID NO: 24768 - DNA, 18 bp, synthetic construct
  source 1..18: mol_type = other DNA
taataccactcctaatag

SEQ ID NO: 24769 - DNA, 18 bp, synthetic construct
  source 1..18: mol_type = other DNA
taataccactgtatatag

SEQ ID NO: 24770 - DNA, 18 bp, synthetic construct
  source 1..18: mol_type = other DNA
taataccacttaataaag

SEQ ID NO: 24771 - DNA, 18 bp, synthetic construct
  source 1..18: mol_type = other DNA
taataccagtaaatatag

SEQ ID NO: 24772 - DNA, 18 bp, synthetic construct
  source 1..18: mol_type = other DNA
taatacccttcactttag

SEQ ID NO: 24773 - DNA, 18 bp, synthetic construct
  source 1..18: mol_type = other DNA
taatacctcgcactacag

SEQ ID NO: 24774 - DNA, 18 bp, synthetic construct
  source 1..18: mol_type = other DNA
taatacctctcagtatgg

SEQ ID NO: 24775 - DNA, 18 bp, synthetic construct
  source 1..18: mol_type = other DNA
taatacgaaagactgtag

SEQ ID NO: 24776 - DNA, 18 bp, synthetic construct
  source 1..18: mol_type = other DNA
taatacgaacaactttag

SEQ ID NO: 24777 - DNA, 18 bp, synthetic construct
  source 1..18: mol_type = other DNA
taatacgaatcaccccag

SEQ ID NO: 24778 - DNA, 18 bp, synthetic construct
  source 1..18: mol_type = other DNA
taatacgaatccatacag

SEQ ID NO: 24779 - DNA, 18 bp, synthetic construct
  source 1..18: mol_type = other DNA
taatacgaatgtctacag

SEQ ID NO: 24780 - DNA, 18 bp, synthetic construct
  source 1..18: mol_type = other DNA
taatacgaattccaatag

SEQ ID NO: 24781 - DNA, 18 bp, synthetic construct
  source 1..18: mol_type = other DNA
taatacgacaaaccttag

SEQ ID NO: 24782 - DNA, 18 bp, synthetic construct
  source 1..18: mol_type = other DNA
taatacgacacacctaag

SEQ ID NO: 24783 - DNA, 18 bp, synthetic construct
  source 1..18: mol_type = other DNA
taatacgacatactgtcg

SEQ ID NO: 24784 - DNA, 18 bp, synthetic construct
  source 1..18: mol_type = other DNA
taatacgaccatcaatag

SEQ ID NO: 24785 - DNA, 18 bp, synthetic construct
  source 1..18: mol_type = other DNA
taatacgaccctttaaag

SEQ ID NO: 24786 - DNA, 18 bp, synthetic construct
  source 1..18: mol_type = other DNA
taatacgactaaaaacag

SEQ ID NO: 24787 - DNA, 18 bp, synthetic construct
  source 1..18: mol_type = other DNA
taatacgacttattttcg

SEQ ID NO: 24788 - DNA, 18 bp, synthetic construct
  source 1..18: mol_type = other DNA
taatacgagacaatacag

SEQ ID NO: 24789 - DNA, 18 bp, synthetic construct
  source 1..18: mol_type = other DNA
taatacgaggctccatag

SEQ ID NO: 24790 - DNA, 18 bp, synthetic construct
  source 1..18: mol_type = other DNA
taatacgagttacaaaag

SEQ ID NO: 24791 - DNA, 18 bp, synthetic construct
  source 1..18: mol_type = other DNA
taatacgatacattctag

SEQ ID NO: 24792 - DNA, 18 bp, synthetic construct
  source 1..18: mol_type = other DNA
taatacgccacacttaag

SEQ ID NO: 24793 - DNA, 18 bp, synthetic construct
  source 1..18: mol_type = other DNA
taatacgcctcagattag

SEQ ID NO: 24794 - DNA, 18 bp, synthetic construct
  source 1..18: mol_type = other DNA
taatacggatcagaatag

SEQ ID NO: 24795 - DNA, 18 bp, synthetic construct
  source 1..18: mol_type = other DNA
taatacggcgcagcatag

SEQ ID NO: 24796 - DNA, 18 bp, synthetic construct
  source 1..18: mol_type = other DNA
taatacggctcatagtag

SEQ ID NO: 24797 - DNA, 18 bp, synthetic construct
  source 1..18: mol_type = other DNA
taatacggcttattatcg

SEQ ID NO: 24798 - DNA, 18 bp, synthetic construct
  source 1..18: mol_type = other DNA
taatacgtataattatag

SEQ ID NO: 24799 - DNA, 18 bp, synthetic construct
  source 1..18: mol_type = other DNA
taatacgtatctctatcg

SEQ ID NO: 24800 - DNA, 18 bp, synthetic construct
  source 1..18: mol_type = other DNA
taatacgtccctccatag

SEQ ID NO: 24801 - DNA, 18 bp, synthetic construct
  source 1..18: mol_type = other DNA
taatacgtccctctacag

SEQ ID NO: 24802 - DNA, 18 bp, synthetic construct
  source 1..18: mol_type = other DNA
taatacgtctcatttgag

SEQ ID NO: 24803 - DNA, 18 bp, synthetic construct
  source 1..18: mol_type = other DNA
taatacgtttaactacag

SEQ ID NO: 24804 - DNA, 18 bp, synthetic construct
  source 1..18: mol_type = other DNA
taatacgtttcactagcg

SEQ ID NO: 24805 - DNA, 18 bp, synthetic construct
  source 1..18: mol_type = other DNA
taatacgtttccctacag

SEQ ID NO: 24806 - DNA, 18 bp, synthetic construct
  source 1..18: mol_type = other DNA
taatactactctctcaag

SEQ ID NO: 24807 - DNA, 18 bp, synthetic construct
  source 1..18: mol_type = other DNA
taatactacttaaaatag

SEQ ID NO: 24808 - DNA, 18 bp, synthetic construct
  source 1..18: mol_type = other DNA
taatactagtcataatag

SEQ ID NO: 24809 - DNA, 18 bp, synthetic construct
  source 1..18: mol_type = other DNA
taatactattcataatag

SEQ ID NO: 24810 - DNA, 18 bp, synthetic construct
  source 1..18: mol_type = other DNA
taatactccttactttag

SEQ ID NO: 24811 - DNA, 18 bp, synthetic construct
  source 1..18: mol_type = other DNA
taatacttctaactatcg

SEQ ID NO: 24812 - DNA, 18 bp, synthetic construct
  source 1..18: mol_type = other DNA
taatacttctcaatgtag

SEQ ID NO: 24813 - DNA, 18 bp, synthetic construct
  source 1..18: mol_type = other DNA
taatacttctcagtatcg

SEQ ID NO: 24814 - DNA, 18 bp, synthetic construct
  source 1..18: mol_type = other DNA
taatacttctcattatcg

SEQ ID NO: 24815 - DNA, 18 bp, synthetic construct
  source 1..18: mol_type = other DNA
taatacttctccctatgg

SEQ ID NO: 24816 - DNA, 18 bp, synthetic construct
  source 1..18: mol_type = other DNA
taataggacctacaatag

SEQ ID NO: 24817 - DNA, 18 bp, synthetic construct
  source 1..18: mol_type = other DNA
taataggatctactatag

SEQ ID NO: 24818 - DNA, 18 bp, synthetic construct
  source 1..18: mol_type = other DNA
taataggattttctatag

SEQ ID NO: 24819 - DNA, 18 bp, synthetic construct
  source 1..18: mol_type = other DNA
taataggccactctatag

SEQ ID NO: 24820 - DNA, 18 bp, synthetic construct
  source 1..18: mol_type = other DNA
taatataactcattatgg

SEQ ID NO: 24821 - DNA, 18 bp, synthetic construct
  source 1..18: mol_type = other DNA
taatatcactctcaatag

SEQ ID NO: 24822 - DNA, 18 bp, synthetic construct
  source 1..18: mol_type = other DNA
taatatgaacctctatag

SEQ ID NO: 24823 - DNA, 18 bp, synthetic construct
  source 1..18: mol_type = other DNA
taatatgacaatctatag

SEQ ID NO: 24824 - DNA, 18 bp, synthetic construct
  source 1..18: mol_type = other DNA
taatatgactttctacag

SEQ ID NO: 24825 - DNA, 18 bp, synthetic construct
  source 1..18: mol_type = other DNA
taatatgcatctctatag

SEQ ID NO: 24826 - DNA, 18 bp, synthetic construct
  source 1..18: mol_type = other DNA
taatatgcctctccatag

SEQ ID NO: 24827 - DNA, 18 bp, synthetic construct
  source 1..18: mol_type = other DNA
taatatggttcacaatag

SEQ ID NO: 24828 - DNA, 18 bp, synthetic construct
  source 1..18: mol_type = other DNA
taatatgtatcactacag

SEQ ID NO: 24829 - DNA, 18 bp, synthetic construct
  source 1..18: mol_type = other DNA
taatatgtcacattatag

SEQ ID NO: 24830 - DNA, 18 bp, synthetic construct
  source 1..18: mol_type = other DNA
taatattactccccatag

SEQ ID NO: 24831 - DNA, 18 bp, synthetic construct
  source 1..18: mol_type = other DNA
taatattagtcattatag

SEQ ID NO: 24832 - DNA, 18 bp, synthetic construct
  source 1..18: mol_type = other DNA
taatcagtctctctatag

SEQ ID NO: 24833 - DNA, 18 bp, synthetic construct
  source 1..18: mol_type = other DNA
taatccaaaacactatag

SEQ ID NO: 24834 - DNA, 18 bp, synthetic construct
  source 1..18: mol_type = other DNA
taatccgaatctctgtag

SEQ ID NO: 24835 - DNA, 18 bp, synthetic construct
  source 1..18: mol_type = other DNA
taatccgactcttcatag

SEQ ID NO: 24836 - DNA, 18 bp, synthetic construct
  source 1..18: mol_type = other DNA
taatccgagttactttag

SEQ ID NO: 24837 - DNA, 18 bp, synthetic construct
  source 1..18: mol_type = other DNA
taatccgattcaataaag

SEQ ID NO: 24838 - DNA, 18 bp, synthetic construct
  source 1..18: mol_type = other DNA
taatccggctcacttaag

SEQ ID NO: 24839 - DNA, 18 bp, synthetic construct
  source 1..18: mol_type = other DNA
taatccgtctcactaccg

SEQ ID NO: 24840 - DNA, 18 bp, synthetic construct
  source 1..18: mol_type = other DNA
taatccgtctttctatag

SEQ ID NO: 24841 - DNA, 18 bp, synthetic construct
  source 1..18: mol_type = other DNA
taatctgacgcacaatag

SEQ ID NO: 24842 - DNA, 18 bp, synthetic construct
  source 1..18: mol_type = other DNA
taatctgtctcactatgg

SEQ ID NO: 24843 - DNA, 18 bp, synthetic construct
  source 1..18: mol_type = other DNA
taatgagactctctttag

SEQ ID NO: 24844 - DNA, 18 bp, synthetic construct
  source 1..18: mol_type = other DNA
taatgcaaatcactaaag

SEQ ID NO: 24845 - DNA, 18 bp, synthetic construct
  source 1..18: mol_type = other DNA
taatgcacctcactttag

SEQ ID NO: 24846 - DNA, 18 bp, synthetic construct
  source 1..18: mol_type = other DNA
taatgccactcattacag

SEQ ID NO: 24847 - DNA, 18 bp, synthetic construct
  source 1..18: mol_type = other DNA
taatgcgaatcactagcg

SEQ ID NO: 24848 - DNA, 18 bp, synthetic construct
  source 1..18: mol_type = other DNA
taatgcgaattactttag

SEQ ID NO: 24849 - DNA, 18 bp, synthetic construct
  source 1..18: mol_type = other DNA
taatgcgccacactaaag

SEQ ID NO: 24850 - DNA, 18 bp, synthetic construct
  source 1..18: mol_type = other DNA
taatgcggctcactggag

SEQ ID NO: 24851 - DNA, 18 bp, synthetic construct
  source 1..18: mol_type = other DNA
taatgcgtttcaatatag

SEQ ID NO: 24852 - DNA, 18 bp, synthetic construct
  source 1..18: mol_type = other DNA
taatgcgtttgactatag

SEQ ID NO: 24853 - DNA, 18 bp, synthetic construct
  source 1..18: mol_type = other DNA
taatgggactcacttaag

SEQ ID NO: 24854 - DNA, 18 bp, synthetic construct
  source 1..18: mol_type = other DNA
tacaacaactcactaaag

SEQ ID NO: 24855 - DNA, 18 bp, synthetic construct
  source 1..18: mol_type = other DNA
tacaacgactcaatttag

SEQ ID NO: 24856 - DNA, 18 bp, synthetic construct
  source 1..18: mol_type = other DNA
tacaacgactcacaatcg

SEQ ID NO: 24857 - DNA, 18 bp, synthetic construct
  source 1..18: mol_type = other DNA
taccacaactaactatag

SEQ ID NO: 24858 - DNA, 18 bp, synthetic construct
  source 1..18: mol_type = other DNA
taccacgtctctctatag

SEQ ID NO: 24859 - DNA, 18 bp, synthetic construct
  source 1..18: mol_type = other DNA
tacgacgactctccatag

SEQ ID NO: 24860 - DNA, 18 bp, synthetic construct
  source 1..18: mol_type = other DNA
tactaagacacactgtag

SEQ ID NO: 24861 - DNA, 18 bp, synthetic construct
  source 1..18: mol_type = other DNA
tactaagactcactaagg

SEQ ID NO: 24862 - DNA, 18 bp, synthetic construct
  source 1..18: mol_type = other DNA
tactaagactccctatgg

SEQ ID NO: 24863 - DNA, 18 bp, synthetic construct
  source 1..18: mol_type = other DNA
tactaagactctctaaag

SEQ ID NO: 24864 - DNA, 18 bp, synthetic construct
  source 1..18: mol_type = other DNA
tactaagtctcaatatag

SEQ ID NO: 24865 - DNA, 18 bp, synthetic construct
  source 1..18: mol_type = other DNA
tactacaaatcactttag

SEQ ID NO: 24866 - DNA, 18 bp, synthetic construct
  source 1..18: mol_type = other DNA
tactacaactccctatcg

SEQ ID NO: 24867 - DNA, 18 bp, synthetic construct
  source 1..18: mol_type = other DNA
tactacgacctactatcg

SEQ ID NO: 24868 - DNA, 18 bp, synthetic construct
  source 1..18: mol_type = other DNA
tactacgactctgaatag

SEQ ID NO: 24869 - DNA, 18 bp, synthetic construct
  source 1..18: mol_type = other DNA
tactacgattaacaatag

SEQ ID NO: 24870 - DNA, 18 bp, synthetic construct
  source 1..18: mol_type = other DNA
tactacgattctctgtag

SEQ ID NO: 24871 - DNA, 18 bp, synthetic construct
  source 1..18: mol_type = other DNA
tactacgcctcactagcg

SEQ ID NO: 24872 - DNA, 18 bp, synthetic construct
  source 1..18: mol_type = other DNA
tactacgtcatactatag

SEQ ID NO: 24873 - DNA, 18 bp, synthetic construct
  source 1..18: mol_type = other DNA
tactacgtctccctaaag

SEQ ID NO: 24874 - DNA, 18 bp, synthetic construct
  source 1..18: mol_type = other DNA
tactacgtttcaatatag

SEQ ID NO: 24875 - DNA, 18 bp, synthetic construct
  source 1..18: mol_type = other DNA
tactactaaacactatag

SEQ ID NO: 24876 - DNA, 18 bp, synthetic construct
  source 1..18: mol_type = other DNA
tactactactctccatag

SEQ ID NO: 24877 - DNA, 18 bp, synthetic construct
  source 1..18: mol_type = other DNA
tactaggaatcactagag

SEQ ID NO: 24878 - DNA, 18 bp, synthetic construct
  source 1..18: mol_type = other DNA
tactatgattcacaatag

SEQ ID NO: 24879 - DNA, 18 bp, synthetic construct
  source 1..18: mol_type = other DNA
tactccgactctcaatag

SEQ ID NO: 24880 - DNA, 18 bp, synthetic construct
  source 1..18: mol_type = other DNA
tagaacgacacattatag

SEQ ID NO: 24881 - DNA, 18 bp, synthetic construct
  source 1..18: mol_type = other DNA
tagaacgactcacttaag

SEQ ID NO: 24882 - DNA, 18 bp, synthetic construct
  source 1..18: mol_type = other DNA
tagtaagactctctatgg

SEQ ID NO: 24883 - DNA, 18 bp, synthetic construct
  source 1..18: mol_type = other DNA
tagtacagctcactatcg

SEQ ID NO: 24884 - DNA, 18 bp, synthetic construct
  source 1..18: mol_type = other DNA
tagtacgacccagtatcg

SEQ ID NO: 24885 - DNA, 18 bp, synthetic construct
  source 1..18: mol_type = other DNA
tagtacgactctcactag

SEQ ID NO: 24886 - DNA, 18 bp, synthetic construct
  source 1..18: mol_type = other DNA
tagtactactaactttag

SEQ ID NO: 24887 - DNA, 18 bp, synthetic construct
  source 1..18: mol_type = other DNA
tagtaggattcaatatag

SEQ ID NO: 24888 - DNA, 18 bp, synthetic construct
  source 1..18: mol_type = other DNA
tagtatccctcactatag

SEQ ID NO: 24889 - DNA, 18 bp, synthetic construct
  source 1..18: mol_type = other DNA
tagtccgattcagtatag

SEQ ID NO: 24890 - DNA, 18 bp, synthetic construct
  source 1..18: mol_type = other DNA
tataaagactaactatag

SEQ ID NO: 24891 - DNA, 18 bp, synthetic construct
  source 1..18: mol_type = other DNA
tataaggactaactatag

SEQ ID NO: 24892 - DNA, 18 bp, synthetic construct
  source 1..18: mol_type = other DNA
tataccgactcactctag

SEQ ID NO: 24893 - DNA, 18 bp, synthetic construct
  source 1..18: mol_type = other DNA
tatcatgacacactatag

SEQ ID NO: 24894 - DNA, 18 bp, synthetic construct
  source 1..18: mol_type = other DNA
tatcccggctcactatag

SEQ ID NO: 24895 - DNA, 18 bp, synthetic construct
  source 1..18: mol_type = other DNA
tatgactactctctatag

SEQ ID NO: 24896 - DNA, 18 bp, synthetic construct
  source 1..18: mol_type = other DNA
tattaaaacgcactatag

SEQ ID NO: 24897 - DNA, 18 bp, synthetic construct
  source 1..18: mol_type = other DNA
tattaagagccactatag

SEQ ID NO: 24898 - DNA, 18 bp, synthetic construct
  source 1..18: mol_type = other DNA
tattacaacgcactttag

SEQ ID NO: 24899 - DNA, 18 bp, synthetic construct
  source 1..18: mol_type = other DNA
tattacaactcccgatag

SEQ ID NO: 24900 - DNA, 18 bp, synthetic construct
  source 1..18: mol_type = other DNA
tattacaactgaatatag

SEQ ID NO: 24901 - DNA, 18 bp, synthetic construct
  source 1..18: mol_type = other DNA
tattacaactgactacag

SEQ ID NO: 24902 - DNA, 18 bp, synthetic construct
  source 1..18: mol_type = other DNA
tattacaactgtctatag

SEQ ID NO: 24903 - DNA, 18 bp, synthetic construct
  source 1..18: mol_type = other DNA
tattaccagtcactatgg

SEQ ID NO: 24904 - DNA, 18 bp, synthetic construct
  source 1..18: mol_type = other DNA
tattacgaatcaccacag

SEQ ID NO: 24905 - DNA, 18 bp, synthetic construct
  source 1..18: mol_type = other DNA
tattacgacactctagag

SEQ ID NO: 24906 - DNA, 18 bp, synthetic construct
  source 1..18: mol_type = other DNA
tattacgacgccctttag

SEQ ID NO: 24907 - DNA, 18 bp, synthetic construct
  source 1..18: mol_type = other DNA
tattacgactacttatag

SEQ ID NO: 24908 - DNA, 18 bp, synthetic construct
  source 1..18: mol_type = other DNA
tattacgactcacaccag

SEQ ID NO: 24909 - DNA, 18 bp, synthetic construct
  source 1..18: mol_type = other DNA
tattacgactctcaatgg

SEQ ID NO: 24910 - DNA, 18 bp, synthetic construct
  source 1..18: mol_type = other DNA
tattacgacttacactag

SEQ ID NO: 24911 - DNA, 18 bp, synthetic construct
  source 1..18: mol_type = other DNA
tattacgacttattctag

SEQ ID NO: 24912 - DNA, 18 bp, synthetic construct
  source 1..18: mol_type = other DNA
tattacgagacactagag

SEQ ID NO: 24913 - DNA, 18 bp, synthetic construct
  source 1..18: mol_type = other DNA
tattacgagccactaaag

SEQ ID NO: 24914 - DNA, 18 bp, synthetic construct
  source 1..18: mol_type = other DNA
tattacgcctcacaatgg

SEQ ID NO: 24915 - DNA, 18 bp, synthetic construct
  source 1..18: mol_type = other DNA
tattacgtaccactatag

SEQ ID NO: 24916 - DNA, 18 bp, synthetic construct
  source 1..18: mol_type = other DNA
tattactacatactatag

SEQ ID NO: 24917 - DNA, 18 bp, synthetic construct
  source 1..18: mol_type = other DNA
tattactactcacactag

SEQ ID NO: 24918 - DNA, 18 bp, synthetic construct
  source 1..18: mol_type = other DNA
tattactactcattagag

SEQ ID NO: 24919 - DNA, 18 bp, synthetic construct
  source 1..18: mol_type = other DNA
tattactactctccatag

SEQ ID NO: 24920 - DNA, 18 bp, synthetic construct
  source 1..18: mol_type = other DNA
tattaggaatcactaaag

SEQ ID NO: 24921 - DNA, 18 bp, synthetic construct
  source 1..18: mol_type = other DNA
tattaggactctctttag

SEQ ID NO: 24922 - DNA, 18 bp, synthetic construct
  source 1..18: mol_type = other DNA
tattaggacttactaaag

SEQ ID NO: 24923 - DNA, 18 bp, synthetic construct
  source 1..18: mol_type = other DNA
tattaggacttactttag

SEQ ID NO: 24924 - DNA, 18 bp, synthetic construct
  source 1..18: mol_type = other DNA
tattatgacacactagag

SEQ ID NO: 24925 - DNA, 18 bp, synthetic construct
  source 1..18: mol_type = other DNA
tattatgtgtcactatag

SEQ ID NO: 24926 - DNA, 18 bp, synthetic construct
  source 1..18: mol_type = other DNA
tattattactcactagag

SEQ ID NO: 24927 - DNA, 18 bp, synthetic construct
  source 1..18: mol_type = other DNA
tattccaactcattatag

SEQ ID NO: 24928 - DNA, 18 bp, synthetic construct
  source 1..18: mol_type = other DNA
tattcccactcacaatag

SEQ ID NO: 24929 - DNA, 18 bp, synthetic construct
  source 1..18: mol_type = other DNA
tattgcagctcactatag

SEQ ID NO: 24930 - DNA, 18 bp, synthetic construct
  source 1..18: mol_type = other DNA
tattgcgactaacgatag

SEQ ID NO: 24931 - DNA, 18 bp, synthetic construct
  source 1..18: mol_type = other DNA
tattgcgactcagtttag

SEQ ID NO: 24932 - DNA, 18 bp, synthetic construct
  source 1..18: mol_type = other DNA
tattgcgagacactatag

SEQ ID NO: 24933 - DNA, 18 bp, synthetic construct
  source 1..18: mol_type = other DNA
tcaaatgactcaatatag

SEQ ID NO: 24934 - DNA, 18 bp, synthetic construct
  source 1..18: mol_type = other DNA
tcacacgacccattatag

SEQ ID NO: 24935 - DNA, 18 bp, synthetic construct
  source 1..18: mol_type = other DNA
tcacacgattccctatag

SEQ ID NO: 24936 - DNA, 18 bp, synthetic construct
  source 1..18: mol_type = other DNA
tcacatgactctctatag

SEQ ID NO: 24937 - DNA, 18 bp, synthetic construct
  source 1..18: mol_type = other DNA
tcataagaatcactatcg

SEQ ID NO: 24938 - DNA, 18 bp, synthetic construct
  source 1..18: mol_type = other DNA
tcataagattcactaaag

SEQ ID NO: 24939 - DNA, 18 bp, synthetic construct
  source 1..18: mol_type = other DNA
tcatacaaatcaatatag

SEQ ID NO: 24940 - DNA, 18 bp, synthetic construct
  source 1..18: mol_type = other DNA
tcatacacctcactaaag

SEQ ID NO: 24941 - DNA, 18 bp, synthetic construct
  source 1..18: mol_type = other DNA
tcatacacctctctatag

SEQ ID NO: 24942 - DNA, 18 bp, synthetic construct
  source 1..18: mol_type = other DNA
tcatacgaataactatgg

SEQ ID NO: 24943 - DNA, 18 bp, synthetic construct
  source 1..18: mol_type = other DNA
tcatacgacactcaatag

SEQ ID NO: 24944 - DNA, 18 bp, synthetic construct
  source 1..18: mol_type = other DNA
tcatacgaccctctttag

SEQ ID NO: 24945 - DNA, 18 bp, synthetic construct
  source 1..18: mol_type = other DNA
tcatacgactaagtataa

SEQ ID NO: 24946 - DNA, 18 bp, synthetic construct
  source 1..18: mol_type = other DNA
tcatacgactctctcaag

SEQ ID NO: 24947 - DNA, 18 bp, synthetic construct
  source 1..18: mol_type = other DNA
tcatacgagtcaatgtag

SEQ ID NO: 24948 - DNA, 18 bp, synthetic construct
  source 1..18: mol_type = other DNA
tcatacgatccacaatag

SEQ ID NO: 24949 - DNA, 18 bp, synthetic construct
  source 1..18: mol_type = other DNA
tcatacgcatcactttag

SEQ ID NO: 24950 - DNA, 18 bp, synthetic construct
  source 1..18: mol_type = other DNA
tcatacggctcattaaag

SEQ ID NO: 24951 - DNA, 18 bp, synthetic construct
  source 1..18: mol_type = other DNA
tcatacgtctcacgttag

SEQ ID NO: 24952 - DNA, 18 bp, synthetic construct
  source 1..18: mol_type = other DNA
tcatacgtctctatatag

SEQ ID NO: 24953 - DNA, 18 bp, synthetic construct
  source 1..18: mol_type = other DNA
tcataggacacaatatag

SEQ ID NO: 24954 - DNA, 18 bp, synthetic construct
  source 1..18: mol_type = other DNA
tcataggtctcactttag

SEQ ID NO: 24955 - DNA, 18 bp, synthetic construct
  source 1..18: mol_type = other DNA
tcatatgacttattatag

SEQ ID NO: 24956 - DNA, 18 bp, synthetic construct
  source 1..18: mol_type = other DNA
tcatatgcctctctatag

SEQ ID NO: 24957 - DNA, 18 bp, synthetic construct
  source 1..18: mol_type = other DNA
tcatatgtcacactatag

SEQ ID NO: 24958 - DNA, 18 bp, synthetic construct
  source 1..18: mol_type = other DNA
tcatccgagtcattatag

SEQ ID NO: 24959 - DNA, 18 bp, synthetic construct
  source 1..18: mol_type = other DNA
tcatcctcctcactatag

SEQ ID NO: 24960 - DNA, 18 bp, synthetic construct
  source 1..18: mol_type = other DNA
tcctacgactctttatag

SEQ ID NO: 24961 - DNA, 18 bp, synthetic construct
  source 1..18: mol_type = other DNA
tcctaggactctctatag

SEQ ID NO: 24962 - DNA, 18 bp, synthetic construct
  source 1..18: mol_type = other DNA
tcttacgactcataatag

SEQ ID NO: 24963 - DNA, 18 bp, synthetic construct
  source 1..18: mol_type = other DNA
tcttacgactctttatag

SEQ ID NO: 24964 - DNA, 18 bp, synthetic construct
  source 1..18: mol_type = other DNA
tgaaccgactcactatcg

SEQ ID NO: 24965 - DNA, 18 bp, synthetic construct
  source 1..18: mol_type = other DNA
tgacaagactcattatag

SEQ ID NO: 24966 - DNA, 18 bp, synthetic construct
  source 1..18: mol_type = other DNA
tgacacgacttcctatag

SEQ ID NO: 24967 - DNA, 18 bp, synthetic construct
  source 1..18: mol_type = other DNA
tgacacgtctcaatatag

SEQ ID NO: 24968 - DNA, 18 bp, synthetic construct
  source 1..18: mol_type = other DNA
tgataagtctcagtatag

SEQ ID NO: 24969 - DNA, 18 bp, synthetic construct
  source 1..18: mol_type = other DNA
tgataagtctctctatag

SEQ ID NO: 24970 - DNA, 18 bp, synthetic construct
  source 1..18: mol_type = other DNA
tgatacatctcactagag

SEQ ID NO: 24971 - DNA, 18 bp, synthetic construct
  source 1..18: mol_type = other DNA
tgatacatctgactatag

SEQ ID NO: 24972 - DNA, 18 bp, synthetic construct
  source 1..18: mol_type = other DNA
tgataccattcactagag

SEQ ID NO: 24973 - DNA, 18 bp, synthetic construct
  source 1..18: mol_type = other DNA
tgatacgactctatatcg

SEQ ID NO: 24974 - DNA, 18 bp, synthetic construct
  source 1..18: mol_type = other DNA
tgatacgactctcttaag

SEQ ID NO: 24975 - DNA, 18 bp, synthetic construct
  source 1..18: mol_type = other DNA
tgatacgccttaccatag

SEQ ID NO: 24976 - DNA, 18 bp, synthetic construct
  source 1..18: mol_type = other DNA
tgatacggctcattttag

SEQ ID NO: 24977 - DNA, 18 bp, synthetic construct
  source 1..18: mol_type = other DNA
tgatacgtctcaatatcg

SEQ ID NO: 24978 - DNA, 18 bp, synthetic construct
  source 1..18: mol_type = other DNA
tgatacgtcttactacag

SEQ ID NO: 24979 - DNA, 18 bp, synthetic construct
  source 1..18: mol_type = other DNA
tgatactactcacattag

SEQ ID NO: 24980 - DNA, 18 bp, synthetic construct
  source 1..18: mol_type = other DNA
tgatagtaatcactatag

SEQ ID NO: 24981 - DNA, 18 bp, synthetic construct
  source 1..18: mol_type = other DNA
tgatatgactaaccatag

SEQ ID NO: 24982 - DNA, 18 bp, synthetic construct
  source 1..18: mol_type = other DNA
tgatcctacacactatag

SEQ ID NO: 24983 - DNA, 18 bp, synthetic construct
  source 1..18: mol_type = other DNA
tgctacgtctcacaatag

SEQ ID NO: 24984 - DNA, 18 bp, synthetic construct
  source 1..18: mol_type = other DNA
tggtacgacacactgtag

SEQ ID NO: 24985 - DNA, 18 bp, synthetic construct
  source 1..18: mol_type = other DNA
tggtacgcctctctatag

SEQ ID NO: 24986 - DNA, 18 bp, synthetic construct
  source 1..18: mol_type = other DNA
tgtaacgactccctatag

SEQ ID NO: 24987 - DNA, 18 bp, synthetic construct
  source 1..18: mol_type = other DNA
tgtcacgactcactatcg

SEQ ID NO: 24988 - DNA, 18 bp, synthetic construct
  source 1..18: mol_type = other DNA
tgttacgactaactttag

SEQ ID NO: 24989 - DNA, 18 bp, synthetic construct
  source 1..18: mol_type = other DNA
tgttacgactcactacgg

SEQ ID NO: 24990 - DNA, 18 bp, synthetic construct
  source 1..18: mol_type = other DNA
tgttacgactcattttag

SEQ ID NO: 24991 - DNA, 18 bp, synthetic construct
  source 1..18: mol_type = other DNA
tgttactactccctatag

SEQ ID NO: 24992 - DNA, 18 bp, synthetic construct
  source 1..18: mol_type = other DNA
tgttccgactcactacag

SEQ ID NO: 24993 - DNA, 18 bp, synthetic construct
  source 1..18: mol_type = other DNA
tgttgcgactcactttag

SEQ ID NO: 24994 - DNA, 18 bp, synthetic construct
  source 1..18: mol_type = other DNA
ttaaaagactccctatag

SEQ ID NO: 24995 - DNA, 18 bp, synthetic construct
  source 1..18: mol_type = other DNA
ttaaacgaatcacaatag

SEQ ID NO: 24996 - DNA, 18 bp, synthetic construct
  source 1..18: mol_type = other DNA
ttaaacgactctctagag

SEQ ID NO: 24997 - DNA, 18 bp, synthetic construct
  source 1..18: mol_type = other DNA
ttaaacgtctccctatag

SEQ ID NO: 24998 - DNA, 18 bp, synthetic construct
  source 1..18: mol_type = other DNA
ttaaatgcctcactatag

SEQ ID NO: 24999 - DNA, 18 bp, synthetic construct
  source 1..18: mol_type = other DNA
ttaagcgactcaccatag

SEQ ID NO: 25000 - DNA, 18 bp, synthetic construct
  source 1..18: mol_type = other DNA
ttacacgactcaataaag

SEQ ID NO: 25001 - DNA, 18 bp, synthetic construct
  source 1..18: mol_type = other DNA
ttataagaatctctatag

SEQ ID NO: 25002 - DNA, 18 bp, synthetic construct
  source 1..18: mol_type = other DNA
ttataagacgcactaaag

SEQ ID NO: 25003 - DNA, 18 bp, synthetic construct
  source 1..18: mol_type = other DNA
ttataagactcattgtag

SEQ ID NO: 25004 - DNA, 18 bp, synthetic construct
  source 1..18: mol_type = other DNA
ttataagtctcacgatag

SEQ ID NO: 25005 - DNA, 18 bp, synthetic construct
  source 1..18: mol_type = other DNA
ttataatactcactatgg

SEQ ID NO: 25006 - DNA, 18 bp, synthetic construct
  source 1..18: mol_type = other DNA
ttatacaactaactatgg

SEQ ID NO: 25007 - DNA, 18 bp, synthetic construct
  source 1..18: mol_type = other DNA
ttatacatctcactgtag

SEQ ID NO: 25008 - DNA, 18 bp, synthetic construct
  source 1..18: mol_type = other DNA
ttataccactcactgcag

SEQ ID NO: 25009 - DNA, 18 bp, synthetic construct
  source 1..18: mol_type = other DNA
ttatacgaatcaatctag

SEQ ID NO: 25010 - DNA, 18 bp, synthetic construct
  source 1..18: mol_type = other DNA
ttatacgaatcagaatag

SEQ ID NO: 25011 - DNA, 18 bp, synthetic construct
  source 1..18: mol_type = other DNA
ttatacgactcagcctag

SEQ ID NO: 25012 - DNA, 18 bp, synthetic construct
  source 1..18: mol_type = other DNA
ttatacgagtcagaatag

SEQ ID NO: 25013 - DNA, 18 bp, synthetic construct
  source 1..18: mol_type = other DNA
ttatacgatccaccatag

SEQ ID NO: 25014 - DNA, 18 bp, synthetic construct
  source 1..18: mol_type = other DNA
ttatacgattctgtatag

SEQ ID NO: 25015 - DNA, 18 bp, synthetic construct
  source 1..18: mol_type = other DNA
ttatacgatttactatgg

SEQ ID NO: 25016 - DNA, 18 bp, synthetic construct
  source 1..18: mol_type = other DNA
ttatacgcctgactaaag

SEQ ID NO: 25017 - DNA, 18 bp, synthetic construct
  source 1..18: mol_type = other DNA
ttatacggctccctttag

SEQ ID NO: 25018 - DNA, 18 bp, synthetic construct
  source 1..18: mol_type = other DNA
ttatacggctctccatag

SEQ ID NO: 25019 - DNA, 18 bp, synthetic construct
  source 1..18: mol_type = other DNA
ttatacgtctcagaatag

SEQ ID NO: 25020 - DNA, 18 bp, synthetic construct
  source 1..18: mol_type = other DNA
ttatactaatcactttag

SEQ ID NO: 25021 - DNA, 18 bp, synthetic construct
  source 1..18: mol_type = other DNA
ttatactacttactctag

SEQ ID NO: 25022 - DNA, 18 bp, synthetic construct
  source 1..18: mol_type = other DNA
ttatactagtcaatatag

SEQ ID NO: 25023 - DNA, 18 bp, synthetic construct
  source 1..18: mol_type = other DNA
ttataggaccaactatag

SEQ ID NO: 25024 - DNA, 18 bp, synthetic construct
  source 1..18: mol_type = other DNA
ttataggactcactcgag

SEQ ID NO: 25025 - DNA, 18 bp, synthetic construct
  source 1..18: mol_type = other DNA
ttataggatacactatag

SEQ ID NO: 25026 - DNA, 18 bp, synthetic construct
  source 1..18: mol_type = other DNA
ttatatgaattactatag

SEQ ID NO: 25027 - DNA, 18 bp, synthetic construct
  source 1..18: mol_type = other DNA
ttatatgactccctttag

SEQ ID NO: 25028 - DNA, 18 bp, synthetic construct
  source 1..18: mol_type = other DNA
ttatatgacttactgtag

SEQ ID NO: 25029 - DNA, 18 bp, synthetic construct
  source 1..18: mol_type = other DNA
ttatatgattcactagag

SEQ ID NO: 25030 - DNA, 18 bp, synthetic construct
  source 1..18: mol_type = other DNA
ttatatgcctcaccatag

SEQ ID NO: 25031 - DNA, 18 bp, synthetic construct
  source 1..18: mol_type = other DNA
ttatccgagttactatag

SEQ ID NO: 25032 - DNA, 18 bp, synthetic construct
  source 1..18: mol_type = other DNA
ttatcctactcacaatag

SEQ ID NO: 25033 - DNA, 18 bp, synthetic construct
  source 1..18: mol_type = other DNA
ttatgcgaatcactttag

SEQ ID NO: 25034 - DNA, 18 bp, synthetic construct
  source 1..18: mol_type = other DNA
ttatgcgactcacaacag

SEQ ID NO: 25035 - DNA, 18 bp, synthetic construct
  source 1..18: mol_type = other DNA
ttatgcgactcacactag

SEQ ID NO: 25036 - DNA, 18 bp, synthetic construct
  source 1..18: mol_type = other DNA
ttatgcgactgactaaag

SEQ ID NO: 25037 - DNA, 18 bp, synthetic construct
  source 1..18: mol_type = other DNA
ttccaagactcactatag

SEQ ID NO: 25038 - DNA, 18 bp, synthetic construct
  source 1..18: mol_type = other DNA
ttctaagattcactatag

SEQ ID NO: 25039 - DNA, 18 bp, synthetic construct
  source 1..18: mol_type = other DNA
ttgtaccactcagtatag

SEQ ID NO: 25040 - DNA, 18 bp, synthetic construct
  source 1..18: mol_type = other DNA
ttgtacgacttactatgg

SEQ ID NO: 25041 - DNA, 18 bp, synthetic construct
  source 1..18: mol_type = other DNA
ttgtacggttcactatag

SEQ ID NO: 25042 - DNA, 18 bp, synthetic construct
  source 1..18: mol_type = other DNA
ttttacgactcagtacag

SEQ ID NO: 25043 - DNA, 18 bp, synthetic construct
  source 1..18: mol_type = other DNA
ttttacgattcactctag

SEQ ID NO: 25044 - DNA, 18 bp, synthetic construct
  source 1..18: mol_type = other DNA
ttttagaactcactatag

SEQ ID NO: 25045 - DNA, 18 bp, synthetic construct
  source 1..18: mol_type = other DNA
ttttccaactcactatag

SEQ ID NO: 25046 - DNA, 18 bp, synthetic construct
  source 1..18: mol_type = other DNA
taattcaacacactaaag

SEQ ID NO: 25047 - DNA, 18 bp, synthetic construct
  source 1..18: mol_type = other DNA
taaaacgactcataattg

SEQ ID NO: 25048 - DNA, 18 bp, synthetic construct
  source 1..18: mol_type = other DNA
ttataccaatcactattg

SEQ ID NO: 25049 - DNA, 18 bp, synthetic construct
  source 1..18: mol_type = other DNA
aattacgcctcactaaag

SEQ ID NO: 25050 - DNA, 18 bp, synthetic construct
  source 1..18: mol_type = other DNA
tattacgaatctctttag

SEQ ID NO: 25051 - DNA, 18 bp, synthetic construct
  source 1..18: mol_type = other DNA
tcatacgactctctttcg

SEQ ID NO: 25052 - DNA, 18 bp, synthetic construct
  source 1..18: mol_type = other DNA
ttatacgacttaatttag

SEQ ID NO: 25053 - DNA, 18 bp, synthetic construct
  source 1..18: mol_type = other DNA
ttatacgtttcattatag

SEQ ID NO: 25054 - DNA, 18 bp, synthetic construct
  source 1..18: mol_type = other DNA
tattacgactagctattg

SEQ ID NO: 25055 - DNA, 18 bp, synthetic construct
  source 1..18: mol_type = other DNA
taataccaaacactattg

SEQ ID NO: 25056 - DNA, 18 bp, synthetic construct
  source 1..18: mol_type = other DNA
taatgcgactcacctttg

SEQ ID NO: 25057 - DNA, 18 bp, synthetic construct
  source 1..18: mol_type = other DNA
ttaaacgtctcgctatag

SEQ ID NO: 25058 - DNA, 18 bp, synthetic construct
  source 1..18: mol_type = other DNA
aaatacgactctcaaaag

SEQ ID NO: 25059 - DNA, 18 bp, synthetic construct
  source 1..18: mol_type = other DNA
atataggactcaatatag

SEQ ID NO: 25060 - DNA, 18 bp, synthetic construct
  source 1..18: mol_type = other DNA
taacacgactgtctttag

SEQ ID NO: 25061 - DNA, 18 bp, synthetic construct
  source 1..18: mol_type = other DNA
tattaagactctctctag

SEQ ID NO: 25062 - DNA, 18 bp, synthetic construct
  source 1..18: mol_type = other DNA
ttaaacgactaactttag

SEQ ID NO: 25063 - DNA, 18 bp, synthetic construct
  source 1..18: mol_type = other DNA
ttaaacgattcacaatag

SEQ ID NO: 25064 - DNA, 18 bp, synthetic construct
  source 1..18: mol_type = other DNA
ttatacgtctcactaacg

SEQ ID NO: 25065 - DNA, 18 bp, synthetic construct
  source 1..18: mol_type = other DNA
taatacgtctctttaaag

SEQ ID NO: 25066 - DNA, 18 bp, synthetic construct
  source 1..18: mol_type = other DNA
tattacgactctcactag

SEQ ID NO: 25067 - DNA, 18 bp, synthetic construct
  source 1..18: mol_type = other DNA
taattcgactcatcattg

SEQ ID NO: 25068 - DNA, 18 bp, synthetic construct
  source 1..18: mol_type = other DNA
tattttgactcactattg

SEQ ID NO: 25069 - DNA, 18 bp, synthetic construct
  source 1..18: mol_type = other DNA
tcattcgactcaatattg

SEQ ID NO: 25070 - DNA, 18 bp, synthetic construct
  source 1..18: mol_type = other DNA
aaatacgactctgtattg

SEQ ID NO: 25071 - DNA, 18 bp, synthetic construct
  source 1..18: mol_type = other DNA
aaattcgaataactatag

SEQ ID NO: 25072 - DNA, 18 bp, synthetic construct
  source 1..18: mol_type = other DNA
aaattcgtctcactatcg

SEQ ID NO: 25073 - DNA, 18 bp, synthetic construct
  source 1..18: mol_type = other DNA
atattcgactcactgtag

SEQ ID NO: 25074 - DNA, 18 bp, synthetic construct
  source 1..18: mol_type = other DNA
taaaaggattcactattg

SEQ ID NO: 25075 - DNA, 18 bp, synthetic construct
  source 1..18: mol_type = other DNA
taatacaactgagtattg

SEQ ID NO: 25076 - DNA, 18 bp, synthetic construct
  source 1..18: mol_type = other DNA
taatacgacactctcttg

SEQ ID NO: 25077 - DNA, 18 bp, synthetic construct
  source 1..18: mol_type = other DNA
taatcagactcacttttg

SEQ ID NO: 25078 - DNA, 18 bp, synthetic construct
  source 1..18: mol_type = other DNA
taattccactcacattag

SEQ ID NO: 25079 - DNA, 18 bp, synthetic construct
  source 1..18: mol_type = other DNA
tactacgactcacttctg

SEQ ID NO: 25080 - DNA, 18 bp, synthetic construct
  source 1..18: mol_type = other DNA
tatatcgactcattatag

SEQ ID NO: 25081 - DNA, 18 bp, synthetic construct
  source 1..18: mol_type = other DNA
tattacgcctcacttttg

SEQ ID NO: 25082 - DNA, 18 bp, synthetic construct
  source 1..18: mol_type = other DNA
tattacgtctcactagtg

SEQ ID NO: 25083 - DNA, 18 bp, synthetic construct
  source 1..18: mol_type = other DNA
tcaatcaactcactatag

SEQ ID NO: 25084 - DNA, 18 bp, synthetic construct
  source 1..18: mol_type = other DNA
tgagacgacacactattg

SEQ ID NO: 25085 - DNA, 18 bp, synthetic construct
  source 1..18: mol_type = other DNA
tgataagattcactattg

SEQ ID NO: 25086 - DNA, 18 bp, synthetic construct
  source 1..18: mol_type = other DNA
tggtacgactctctattg

SEQ ID NO: 25087 - DNA, 18 bp, synthetic construct
  source 1..18: mol_type = other DNA
ttaaacgcctcgctatag

SEQ ID NO: 25088 - DNA, 18 bp, synthetic construct
  source 1..18: mol_type = other DNA
ttatacgactctctagtg

SEQ ID NO: 25089 - DNA, 18 bp, synthetic construct
  source 1..18: mol_type = other DNA
ttatacgcctcattattg

SEQ ID NO: 25090 - DNA, 18 bp, synthetic construct
  source 1..18: mol_type = other DNA
ttataggacttactattg

SEQ ID NO: 25091 - DNA, 18 bp, synthetic construct
  source 1..18: mol_type = other DNA
ttattcgactcactcaag

SEQ ID NO: 25092 - DNA, 18 bp, synthetic construct
  source 1..18: mol_type = other DNA
ttattctactcaatatag

SEQ ID NO: 25093 - DNA, 18 bp, synthetic construct
  source 1..18: mol_type = other DNA
aaatacaactcacattag

SEQ ID NO: 25094 - DNA, 18 bp, synthetic construct
  source 1..18: mol_type = other DNA
aaatactacttaccatag

SEQ ID NO: 25095 - DNA, 18 bp, synthetic construct
  source 1..18: mol_type = other DNA
aattacgattaactatag

SEQ ID NO: 25096 - DNA, 18 bp, synthetic construct
  source 1..18: mol_type = other DNA
atatacaactccctatag

SEQ ID NO: 25097 - DNA, 18 bp, synthetic construct
  source 1..18: mol_type = other DNA
atatccgactcacaatag

SEQ ID NO: 25098 - DNA, 18 bp, synthetic construct
  source 1..18: mol_type = other DNA
caatacgactctgtaaag

SEQ ID NO: 25099 - DNA, 18 bp, synthetic construct
  source 1..18: mol_type = other DNA
caatacgatactctatag

SEQ ID NO: 25100 - DNA, 18 bp, synthetic construct
  source 1..18: mol_type = other DNA
cattaccactctctatag

SEQ ID NO: 25101 - DNA, 18 bp, synthetic construct
  source 1..18: mol_type = other DNA
ctatacgactcattttag

SEQ ID NO: 25102 - DNA, 18 bp, synthetic construct
  source 1..18: mol_type = other DNA
ctatacgacttactttag

SEQ ID NO: 25103 - DNA, 18 bp, synthetic construct
  source 1..18: mol_type = other DNA
ctttacgactaactatag

SEQ ID NO: 25104 - DNA, 18 bp, synthetic construct
  source 1..18: mol_type = other DNA
taaaacgaattactaaag

SEQ ID NO: 25105 - DNA, 18 bp, synthetic construct
  source 1..18: mol_type = other DNA
taaaacttctccctatag

SEQ ID NO: 25106 - DNA, 18 bp, synthetic construct
  source 1..18: mol_type = other DNA
taacacgagtcaatatcg

SEQ ID NO: 25107 - DNA, 18 bp, synthetic construct
  source 1..18: mol_type = other DNA
taataagactctcactag

SEQ ID NO: 25108 - DNA, 18 bp, synthetic construct
  source 1..18: mol_type = other DNA
taataataatcactttag

SEQ ID NO: 25109 - DNA, 18 bp, synthetic construct
  source 1..18: mol_type = other DNA
taatacaaatcacttaag

SEQ ID NO: 25110 - DNA, 18 bp, synthetic construct
  source 1..18: mol_type = other DNA
taatacaaatctctaaag

SEQ ID NO: 25111 - DNA, 18 bp, synthetic construct
  source 1..18: mol_type = other DNA
taatacaacactcaatag

SEQ ID NO: 25112 - DNA, 18 bp, synthetic construct
  source 1..18: mol_type = other DNA
taatacatctcagtaaag

SEQ ID NO: 25113 - DNA, 18 bp, synthetic construct
  source 1..18: mol_type = other DNA
taatacatctgactgtag

SEQ ID NO: 25114 - DNA, 18 bp, synthetic construct
  source 1..18: mol_type = other DNA
taatacgactaaacttag

SEQ ID NO: 25115 - DNA, 18 bp, synthetic construct
  source 1..18: mol_type = other DNA
taatacgactcatatcag

SEQ ID NO: 25116 - DNA, 18 bp, synthetic construct
  source 1..18: mol_type = other DNA
taatacgactctcactcg

SEQ ID NO: 25117 - DNA, 18 bp, synthetic construct
  source 1..18: mol_type = other DNA
taatacgattcacagaag

SEQ ID NO: 25118 - DNA, 18 bp, synthetic construct
  source 1..18: mol_type = other DNA
taatacggctctcactag

SEQ ID NO: 25119 - DNA, 18 bp, synthetic construct
  source 1..18: mol_type = other DNA
taatacgtattactacag

SEQ ID NO: 25120 - DNA, 18 bp, synthetic construct
  source 1..18: mol_type = other DNA
taatacgtcaaactagag

SEQ ID NO: 25121 - DNA, 18 bp, synthetic construct
  source 1..18: mol_type = other DNA
taatacgtttcaccaaag

SEQ ID NO: 25122 - DNA, 18 bp, synthetic construct
  source 1..18: mol_type = other DNA
taatactacactatatag

SEQ ID NO: 25123 - DNA, 18 bp, synthetic construct
  source 1..18: mol_type = other DNA
taatactatttactgtag

SEQ ID NO: 25124 - DNA, 18 bp, synthetic construct
  source 1..18: mol_type = other DNA
taatacttctatctatag

SEQ ID NO: 25125 - DNA, 18 bp, synthetic construct
  source 1..18: mol_type = other DNA
taatatgactaattctag

SEQ ID NO: 25126 - DNA, 18 bp, synthetic construct
  source 1..18: mol_type = other DNA
taatatgactgacaaaag

SEQ ID NO: 25127 - DNA, 18 bp, synthetic construct
  source 1..18: mol_type = other DNA
taatccgactatatatag

SEQ ID NO: 25128 - DNA, 18 bp, synthetic construct
  source 1..18: mol_type = other DNA
taatccgattcactcaag

SEQ ID NO: 25129 - DNA, 18 bp, synthetic construct
  source 1..18: mol_type = other DNA
taatctgcatcactatag

SEQ ID NO: 25130 - DNA, 18 bp, synthetic construct
  source 1..18: mol_type = other DNA
taatgcgtctcaccttag

SEQ ID NO: 25131 - DNA, 18 bp, synthetic construct
  source 1..18: mol_type = other DNA
tacaacgactcagtttag

SEQ ID NO: 25132 - DNA, 18 bp, synthetic construct
  source 1..18: mol_type = other DNA
tataacaactcacaatag

SEQ ID NO: 25133 - DNA, 18 bp, synthetic construct
  source 1..18: mol_type = other DNA
tattaagtctcaatatag

SEQ ID NO: 25134 - DNA, 18 bp, synthetic construct
  source 1..18: mol_type = other DNA
tattacgactcacaaacg

SEQ ID NO: 25135 - DNA, 18 bp, synthetic construct
  source 1..18: mol_type = other DNA
tattacgtgtcattatag

SEQ ID NO: 25136 - DNA, 18 bp, synthetic construct
  source 1..18: mol_type = other DNA
tattactactcagtaaag

SEQ ID NO: 25137 - DNA, 18 bp, synthetic construct
  source 1..18: mol_type = other DNA
tattatgtctcactgtag

SEQ ID NO: 25138 - DNA, 18 bp, synthetic construct
  source 1..18: mol_type = other DNA
tattgcgactcactttgg

SEQ ID NO: 25139 - DNA, 18 bp, synthetic construct
  source 1..18: mol_type = other DNA
tcatacaagtcactttag

SEQ ID NO: 25140 - DNA, 18 bp, synthetic construct
  source 1..18: mol_type = other DNA
tcatacaattcactttag

SEQ ID NO: 25141 - DNA, 18 bp, synthetic construct
  source 1..18: mol_type = other DNA
tcataccactcattaaag

SEQ ID NO: 25142 - DNA, 18 bp, synthetic construct
  source 1..18: mol_type = other DNA
ttacattactcactatag

SEQ ID NO: 25143 - DNA, 18 bp, synthetic construct
  source 1..18: mol_type = other DNA
ttatacgactaaccacag

SEQ ID NO: 25144 - DNA, 18 bp, synthetic construct
  source 1..18: mol_type = other DNA
ttatacgagtcactaacg

SEQ ID NO: 25145 - DNA, 18 bp, synthetic construct
  source 1..18: mol_type = other DNA
ttatacgagtctcaatag

SEQ ID NO: 25146 - DNA, 18 bp, synthetic construct
  source 1..18: mol_type = other DNA
ttatacggatcactatcg

SEQ ID NO: 25147 - DNA, 18 bp, synthetic construct
  source 1..18: mol_type = other DNA
ttatacggctctctttag

SEQ ID NO: 25148 - DNA, 18 bp, synthetic construct
  source 1..18: mol_type = other DNA
ttatacgtctaactctag

SEQ ID NO: 25149 - DNA, 18 bp, synthetic construct
  source 1..18: mol_type = other DNA
ttatacgtctcagtttag

SEQ ID NO: 25150 - DNA, 18 bp, synthetic construct
  source 1..18: mol_type = other DNA
ttatacgtctcattctag

SEQ ID NO: 25151 - DNA, 18 bp, synthetic construct
  source 1..18: mol_type = other DNA
ttatacgtttcactctag

SEQ ID NO: 25152 - DNA, 18 bp, synthetic construct
  source 1..18: mol_type = other DNA
ttatactacctactatag

SEQ ID NO: 25153 - DNA, 18 bp, synthetic construct
  source 1..18: mol_type = other DNA
ttatgcaactcactaaag

SEQ ID NO: 25154 - DNA, 18 bp, synthetic construct
  source 1..18: mol_type = other DNA
ttctacgactgacaatag

SEQ ID NO: 25155 - DNA, 18 bp, synthetic construct
  source 1..18: mol_type = other DNA
ttgtaccactcactttag

SEQ ID NO: 25156 - DNA, 18 bp, synthetic construct
  source 1..18: mol_type = other DNA
ttttacttctcactatag

SEQ ID NO: 25157 - DNA, 18 bp, synthetic construct
  source 1..18: mol_type = other DNA
ttatttgactctctatag

SEQ ID NO: 25158 - DNA, 18 bp, synthetic construct
  source 1..18: mol_type = other DNA
tataacgactctttatag

SEQ ID NO: 25159 - DNA, 18 bp, synthetic construct
  source 1..18: mol_type = other DNA
taaaaggactcacttttg

SEQ ID NO: 25160 - DNA, 18 bp, synthetic construct
  source 1..18: mol_type = other DNA
taatacgtctctatattg

SEQ ID NO: 25161 - DNA, 18 bp, synthetic construct
  source 1..18: mol_type = other DNA
taatactactcactgatg

SEQ ID NO: 25162 - DNA, 18 bp, synthetic construct
  source 1..18: mol_type = other DNA
taattagactctctatgg

SEQ ID NO: 25163 - DNA, 18 bp, synthetic construct
  source 1..18: mol_type = other DNA
tatgatgactcactattg

SEQ ID NO: 25164 - DNA, 18 bp, synthetic construct
  source 1..18: mol_type = other DNA
aattatgactcactttag

SEQ ID NO: 25165 - DNA, 18 bp, synthetic construct
  source 1..18: mol_type = other DNA
ctatacgactctctttag

SEQ ID NO: 25166 - DNA, 18 bp, synthetic construct
  source 1..18: mol_type = other DNA
taaaactacactctatag

SEQ ID NO: 25167 - DNA, 18 bp, synthetic construct
  source 1..18: mol_type = other DNA
tattacgaacctctatag

SEQ ID NO: 25168 - DNA, 18 bp, synthetic construct
  source 1..18: mol_type = other DNA
ttataggacttattatag

SEQ ID NO: 25169 - DNA, 18 bp, synthetic construct
  source 1..18: mol_type = other DNA
taaatagactctctatag

SEQ ID NO: 25170 - DNA, 18 bp, synthetic construct
  source 1..18: mol_type = other DNA
taaatcgacacaccatag

SEQ ID NO: 25171 - DNA, 18 bp, synthetic construct
  source 1..18: mol_type = other DNA
ttatacgtcaaactatag

SEQ ID NO: 25172 - DNA, 18 bp, synthetic construct
  source 1..18: mol_type = other DNA
ttatacgtctctctattg

SEQ ID NO: 25173 - DNA, 18 bp, synthetic construct
  source 1..18: mol_type = other DNA
ttataagactctctttag

SEQ ID NO: 25174 - DNA, 18 bp, synthetic construct
  source 1..18: mol_type = other DNA
tattacgattcacttaag

SEQ ID NO: 25175 - DNA, 18 bp, synthetic construct
  source 1..18: mol_type = other DNA
taattctactcactaatg

SEQ ID NO: 25176 - DNA, 18 bp, synthetic construct
  source 1..18: mol_type = other DNA
taaatcgacttactacag

SEQ ID NO: 25177 - DNA, 18 bp, synthetic construct
  source 1..18: mol_type = other DNA
taacacgattcacttttg

SEQ ID NO: 25178 - DNA, 18 bp, synthetic construct
  source 1..18: mol_type = other DNA
taatactattcacttttg

SEQ ID NO: 25179 - DNA, 18 bp, synthetic construct
  source 1..18: mol_type = other DNA
tattacgactcaataatg

SEQ ID NO: 25180 - DNA, 18 bp, synthetic construct
  source 1..18: mol_type = other DNA
tatttcaactcactctag

SEQ ID NO: 25181 - DNA, 18 bp, synthetic construct
  source 1..18: mol_type = other DNA
taaaacgatacactacag

SEQ ID NO: 25182 - DNA, 18 bp, synthetic construct
  source 1..18: mol_type = other DNA
taaaatgactctctaaag

SEQ ID NO: 25183 - DNA, 18 bp, synthetic construct
  source 1..18: mol_type = other DNA
taaaatgattcactttag

SEQ ID NO: 25184 - DNA, 18 bp, synthetic construct
  source 1..18: mol_type = other DNA
tataacgatttactatag

SEQ ID NO: 25185 - DNA, 18 bp, synthetic construct
  source 1..18: mol_type = other DNA
tattacatctcattatag

SEQ ID NO: 25186 - DNA, 18 bp, synthetic construct
  source 1..18: mol_type = other DNA
tcatacgactctcaaaag

SEQ ID NO: 25187 - DNA, 18 bp, synthetic construct
  source 1..18: mol_type = other DNA
ttatactactttctatag

SEQ ID NO: 25188 - DNA, 18 bp, synthetic construct
  source 1..18: mol_type = other DNA
caattcgactccctattg

SEQ ID NO: 25189 - DNA, 18 bp, synthetic construct
  source 1..18: mol_type = other DNA
taaatcgactcactgttg

SEQ ID NO: 25190 - DNA, 18 bp, synthetic construct
  source 1..18: mol_type = other DNA
taactcgactcaccattg

SEQ ID NO: 25191 - DNA, 18 bp, synthetic construct
  source 1..18: mol_type = other DNA
taatagaactcgctattg

SEQ ID NO: 25192 - DNA, 18 bp, synthetic construct
  source 1..18: mol_type = other DNA
taataggactcgctgttg

SEQ ID NO: 25193 - DNA, 18 bp, synthetic construct
  source 1..18: mol_type = other DNA
taattcgacacacgattg

SEQ ID NO: 25194 - DNA, 18 bp, synthetic construct
  source 1..18: mol_type = other DNA
taattcgacccattattg

SEQ ID NO: 25195 - DNA, 18 bp, synthetic construct
  source 1..18: mol_type = other DNA
taattcgactcaatagtg

SEQ ID NO: 25196 - DNA, 18 bp, synthetic construct
  source 1..18: mol_type = other DNA
taattcgactctctgttg

SEQ ID NO: 25197 - DNA, 18 bp, synthetic construct
  source 1..18: mol_type = other DNA
taattctacacgctatag

SEQ ID NO: 25198 - DNA, 18 bp, synthetic construct
  source 1..18: mol_type = other DNA
taattctactcacgattg

SEQ ID NO: 25199 - DNA, 18 bp, synthetic construct
  source 1..18: mol_type = other DNA
taattctactcactagtg

SEQ ID NO: 25200 - DNA, 18 bp, synthetic construct
  source 1..18: mol_type = other DNA
tatgacgactcgctattg

SEQ ID NO: 25201 - DNA, 18 bp, synthetic construct
  source 1..18: mol_type = other DNA
tatttcgactcaatattg

SEQ ID NO: 25202 - DNA, 18 bp, synthetic construct
  source 1..18: mol_type = other DNA
tcattcgactcactactg

SEQ ID NO: 25203 - DNA, 18 bp, synthetic construct
  source 1..18: mol_type = other DNA
aaactcgactcattatag

SEQ ID NO: 25204 - DNA, 18 bp, synthetic construct
  source 1..18: mol_type = other DNA
aaataagactcagtattg

SEQ ID NO: 25205 - DNA, 18 bp, synthetic construct
  source 1..18: mol_type = other DNA
aaatacgaatcactcttg

SEQ ID NO: 25206 - DNA, 18 bp, synthetic construct
  source 1..18: mol_type = other DNA
aaatacgacccactcttg

SEQ ID NO: 25207 - DNA, 18 bp, synthetic construct
  source 1..18: mol_type = other DNA
aaatacgactagctatgg

SEQ ID NO: 25208 - DNA, 18 bp, synthetic construct
  source 1..18: mol_type = other DNA
aaatacgtctcagtattg

SEQ ID NO: 25209 - DNA, 18 bp, synthetic construct
  source 1..18: mol_type = other DNA
aaatatcactcactattg

SEQ ID NO: 25210 - DNA, 18 bp, synthetic construct
  source 1..18: mol_type = other DNA
aattaggactcactattg

SEQ ID NO: 25211 - DNA, 18 bp, synthetic construct
  source 1..18: mol_type = other DNA
aatttagactcactatag

SEQ ID NO: 25212 - DNA, 18 bp, synthetic construct
  source 1..18: mol_type = other DNA
agatacgacttactattg

SEQ ID NO: 25213 - DNA, 18 bp, synthetic construct
  source 1..18: mol_type = other DNA
agattcgacacactatag

SEQ ID NO: 25214 - DNA, 18 bp, synthetic construct
  source 1..18: mol_type = other DNA
agattcgactctctatag

SEQ ID NO: 25215 - DNA, 18 bp, synthetic construct
  source 1..18: mol_type = other DNA
atataagactcgctatag

SEQ ID NO: 25216 - DNA, 18 bp, synthetic construct
  source 1..18: mol_type = other DNA
caacacaactcactattg

SEQ ID NO: 25217 - DNA, 18 bp, synthetic construct
  source 1..18: mol_type = other DNA
caataagtctcactattg

SEQ ID NO: 25218 - DNA, 18 bp, synthetic construct
  source 1..18: mol_type = other DNA
caatacgactcgttaaag

SEQ ID NO: 25219 - DNA, 18 bp, synthetic construct
  source 1..18: mol_type = other DNA
caatacgactctcaattg

SEQ ID NO: 25220 - DNA, 18 bp, synthetic construct
  source 1..18: mol_type = other DNA
caattagactcattatag

SEQ ID NO: 25221 - DNA, 18 bp, synthetic construct
  source 1..18: mol_type = other DNA
caattcgactcaaaatag

SEQ ID NO: 25222 - DNA, 18 bp, synthetic construct
  source 1..18: mol_type = other DNA
caattcgactctctctag

SEQ ID NO: 25223 - DNA, 18 bp, synthetic construct
  source 1..18: mol_type = other DNA
caattcgagacactatag

SEQ ID NO: 25224 - DNA, 18 bp, synthetic construct
  source 1..18: mol_type = other DNA
caattcgtctaactatag

SEQ ID NO: 25225 - DNA, 18 bp, synthetic construct
  source 1..18: mol_type = other DNA
ctactcgactcactatag

SEQ ID NO: 25226 - DNA, 18 bp, synthetic construct
  source 1..18: mol_type = other DNA
ctatacgactcactgttg

SEQ ID NO: 25227 - DNA, 18 bp, synthetic construct
  source 1..18: mol_type = other DNA
gaatacaactaactattg

SEQ ID NO: 25228 - DNA, 18 bp, synthetic construct
  source 1..18: mol_type = other DNA
gcatacgactcattattg

SEQ ID NO: 25229 - DNA, 18 bp, synthetic construct
  source 1..18: mol_type = other DNA
taaaacgaatcactaatg

SEQ ID NO: 25230 - DNA, 18 bp, synthetic construct
  source 1..18: mol_type = other DNA
taaaacgactcgatctag

SEQ ID NO: 25231 - DNA, 18 bp, synthetic construct
  source 1..18: mol_type = other DNA
taaaacgactcgctttcg

SEQ ID NO: 25232 - DNA, 18 bp, synthetic construct
  source 1..18: mol_type = other DNA
taaaacgactctcgattg

SEQ ID NO: 25233 - DNA, 18 bp, synthetic construct
  source 1..18: mol_type = other DNA
taaaaggaatcactattg

SEQ ID NO: 25234 - DNA, 18 bp, synthetic construct
  source 1..18: mol_type = other DNA
taaataggctcactatag

SEQ ID NO: 25235 - DNA, 18 bp, synthetic construct
  source 1..18: mol_type = other DNA
taaatccactcactagag

SEQ ID NO: 25236 - DNA, 18 bp, synthetic construct
  source 1..18: mol_type = other DNA
taaatctacgcactatag

SEQ ID NO: 25237 - DNA, 18 bp, synthetic construct
  source 1..18: mol_type = other DNA
taacacaactcacaattg

SEQ ID NO: 25238 - DNA, 18 bp, synthetic construct
  source 1..18: mol_type = other DNA
taacacgactatctattg

SEQ ID NO: 25239 - DNA, 18 bp, synthetic construct
  source 1..18: mol_type = other DNA
taacacgactttctattg

SEQ ID NO: 25240 - DNA, 18 bp, synthetic construct
  source 1..18: mol_type = other DNA
taacacgcctcgctctag

SEQ ID NO: 25241 - DNA, 18 bp, synthetic construct
  source 1..18: mol_type = other DNA
taactcaactcactctag

SEQ ID NO: 25242 - DNA, 18 bp, synthetic construct
  source 1..18: mol_type = other DNA
taacttgactctctatag

SEQ ID NO: 25243 - DNA, 18 bp, synthetic construct
  source 1..18: mol_type = other DNA
taacttgagtcactatag

SEQ ID NO: 25244 - DNA, 18 bp, synthetic construct
  source 1..18: mol_type = other DNA
taagactactcacaattg

SEQ ID NO: 25245 - DNA, 18 bp, synthetic construct
  source 1..18: mol_type = other DNA
taataacactaactattg

SEQ ID NO: 25246 - DNA, 18 bp, synthetic construct
  source 1..18: mol_type = other DNA
taataagacgcacttttg

SEQ ID NO: 25247 - DNA, 18 bp, synthetic construct
  source 1..18: mol_type = other DNA
taataagactaattattg

SEQ ID NO: 25248 - DNA, 18 bp, synthetic construct
  source 1..18: mol_type = other DNA
taataagacttactagtg

SEQ ID NO: 25249 - DNA, 18 bp, synthetic construct
  source 1..18: mol_type = other DNA
taatacaactaaatattg

SEQ ID NO: 25250 - DNA, 18 bp, synthetic construct
  source 1..18: mol_type = other DNA
taatacaacttaatattg

SEQ ID NO: 25251 - DNA, 18 bp, synthetic construct
  source 1..18: mol_type = other DNA
taatacaacttactcttg

SEQ ID NO: 25252 - DNA, 18 bp, synthetic construct
  source 1..18: mol_type = other DNA
taatacaattccctattg

SEQ ID NO: 25253 - DNA, 18 bp, synthetic construct
  source 1..18: mol_type = other DNA
taataccacaaactattg

SEQ ID NO: 25254 - DNA, 18 bp, synthetic construct
  source 1..18: mol_type = other DNA
taataccacactctattg

SEQ ID NO: 25255 - DNA, 18 bp, synthetic construct
  source 1..18: mol_type = other DNA
taataccacgcacttttg

SEQ ID NO: 25256 - DNA, 18 bp, synthetic construct
  source 1..18: mol_type = other DNA
taataccatacactattg

SEQ ID NO: 25257 - DNA, 18 bp, synthetic construct
  source 1..18: mol_type = other DNA
taataccatacgctatag

SEQ ID NO: 25258 - DNA, 18 bp, synthetic construct
  source 1..18: mol_type = other DNA
taataccattcaatattg

SEQ ID NO: 25259 - DNA, 18 bp, synthetic construct
  source 1..18: mol_type = other DNA
taatacgaagcactgttg

SEQ ID NO: 25260 - DNA, 18 bp, synthetic construct
  source 1..18: mol_type = other DNA
taatacgacccagaattg

SEQ ID NO: 25261 - DNA, 18 bp, synthetic construct
  source 1..18: mol_type = other DNA
taatacgacccatttttg

SEQ ID NO: 25262 - DNA, 18 bp, synthetic construct
  source 1..18: mol_type = other DNA
taatacgactaacctttg

SEQ ID NO: 25263 - DNA, 18 bp, synthetic construct
  source 1..18: mol_type = other DNA
taatacgactaacgaatg

SEQ ID NO: 25264 - DNA, 18 bp, synthetic construct
  source 1..18: mol_type = other DNA
taatacgactgtcaattg

SEQ ID NO: 25265 - DNA, 18 bp, synthetic construct
  source 1..18: mol_type = other DNA
taatacgactgtttattg

SEQ ID NO: 25266 - DNA, 18 bp, synthetic construct
  source 1..18: mol_type = other DNA
taatacgacttacgaatg

SEQ ID NO: 25267 - DNA, 18 bp, synthetic construct
  source 1..18: mol_type = other DNA
taatacgacttgatgtag

SEQ ID NO: 25268 - DNA, 18 bp, synthetic construct
  source 1..18: mol_type = other DNA
taatacgagacgcaatag

SEQ ID NO: 25269 - DNA, 18 bp, synthetic construct
  source 1..18: mol_type = other DNA
taatacgagtcactgatg

SEQ ID NO: 25270 - DNA, 18 bp, synthetic construct
  source 1..18: mol_type = other DNA
taatacgagtcgatttag

SEQ ID NO: 25271 - DNA, 18 bp, synthetic construct
  source 1..18: mol_type = other DNA
taatacgccacaatattg

SEQ ID NO: 25272 - DNA, 18 bp, synthetic construct
  source 1..18: mol_type = other DNA
taatacggatcagtattg

SEQ ID NO: 25273 - DNA, 18 bp, synthetic construct
  source 1..18: mol_type = other DNA
taatacgtctcgctaagg

SEQ ID NO: 25274 - DNA, 18 bp, synthetic construct
  source 1..18: mol_type = other DNA
taatacgtctgactaatg

SEQ ID NO: 25275 - DNA, 18 bp, synthetic construct
  source 1..18: mol_type = other DNA
taatacgttgcactattg

SEQ ID NO: 25276 - DNA, 18 bp, synthetic construct
  source 1..18: mol_type = other DNA
taatactacacgctttag

SEQ ID NO: 25277 - DNA, 18 bp, synthetic construct
  source 1..18: mol_type = other DNA
taatactactcatttttg

SEQ ID NO: 25278 - DNA, 18 bp, synthetic construct
  source 1..18: mol_type = other DNA
taatactactgactactg

SEQ ID NO: 25279 - DNA, 18 bp, synthetic construct
  source 1..18: mol_type = other DNA
taatactcctcaatattg

SEQ ID NO: 25280 - DNA, 18 bp, synthetic construct
  source 1..18: mol_type = other DNA
taatactgcacactattg

SEQ ID NO: 25281 - DNA, 18 bp, synthetic construct
  source 1..18: mol_type = other DNA
taataggactcactgctg

SEQ ID NO: 25282 - DNA, 18 bp, synthetic construct
  source 1..18: mol_type = other DNA
taataggactcggtaaag

SEQ ID NO: 25283 - DNA, 18 bp, synthetic construct
  source 1..18: mol_type = other DNA
taataggactctcgattg

SEQ ID NO: 25284 - DNA, 18 bp, synthetic construct
  source 1..18: mol_type = other DNA
taatagggcacactattg

SEQ ID NO: 25285 - DNA, 18 bp, synthetic construct
  source 1..18: mol_type = other DNA
taataggtctcaatattg

SEQ ID NO: 25286 - DNA, 18 bp, synthetic construct
  source 1..18: mol_type = other DNA
taatataactcactatta

SEQ ID NO: 25287 - DNA, 18 bp, synthetic construct
  source 1..18: mol_type = other DNA
taatatgaccaactattg

SEQ ID NO: 25288 - DNA, 18 bp, synthetic construct
  source 1..18: mol_type = other DNA
taatatggctaactattg

SEQ ID NO: 25289 - DNA, 18 bp, synthetic construct
  source 1..18: mol_type = other DNA
taatatggctcggtatag

SEQ ID NO: 25290 - DNA, 18 bp, synthetic construct
  source 1..18: mol_type = other DNA
taatatttctcactattg

SEQ ID NO: 25291 - DNA, 18 bp, synthetic construct
  source 1..18: mol_type = other DNA
taatccgaatcgctttag

SEQ ID NO: 25292 - DNA, 18 bp, synthetic construct
  source 1..18: mol_type = other DNA
taatccgactaactaatg

SEQ ID NO: 25293 - DNA, 18 bp, synthetic construct
  source 1..18: mol_type = other DNA
taatgcgacggactattg

SEQ ID NO: 25294 - DNA, 18 bp, synthetic construct
  source 1..18: mol_type = other DNA
taatgcgactaacttttg

SEQ ID NO: 25295 - DNA, 18 bp, synthetic construct
  source 1..18: mol_type = other DNA
taatgcgactcaataatg

SEQ ID NO: 25296 - DNA, 18 bp, synthetic construct
  source 1..18: mol_type = other DNA
taatgcgactctttattg

SEQ ID NO: 25297 - DNA, 18 bp, synthetic construct
  source 1..18: mol_type = other DNA
taatgtgactcgctaaag

SEQ ID NO: 25298 - DNA, 18 bp, synthetic construct
  source 1..18: mol_type = other DNA
taatgtgcctcactattg

SEQ ID NO: 25299 - DNA, 18 bp, synthetic construct
  source 1..18: mol_type = other DNA
taattagacacaatatag

SEQ ID NO: 25300 - DNA, 18 bp, synthetic construct
  source 1..18: mol_type = other DNA
taattagactcaatatcg

SEQ ID NO: 25301 - DNA, 18 bp, synthetic construct
  source 1..18: mol_type = other DNA
taattaggctcactttag

SEQ ID NO: 25302 - DNA, 18 bp, synthetic construct
  source 1..18: mol_type = other DNA
taattagtctcactgtag

SEQ ID NO: 25303 - DNA, 18 bp, synthetic construct
  source 1..18: mol_type = other DNA
taattcaacacactacag

SEQ ID NO: 25304 - DNA, 18 bp, synthetic construct
  source 1..18: mol_type = other DNA
taattccactctctaaag

SEQ ID NO: 25305 - DNA, 18 bp, synthetic construct
  source 1..18: mol_type = other DNA
taattcgaatatctatag

SEQ ID NO: 25306 - DNA, 18 bp, synthetic construct
  source 1..18: mol_type = other DNA
taattcgacacaagatag

SEQ ID NO: 25307 - DNA, 18 bp, synthetic construct
  source 1..18: mol_type = other DNA
taattcgacaccctttag

SEQ ID NO: 25308 - DNA, 18 bp, synthetic construct
  source 1..18: mol_type = other DNA
taattcgacccactttcg

SEQ ID NO: 25309 - DNA, 18 bp, synthetic construct
  source 1..18: mol_type = other DNA
taattcgactaaaaatag

SEQ ID NO: 25310 - DNA, 18 bp, synthetic construct
  source 1..18: mol_type = other DNA
taattcgactcactcgcg

SEQ ID NO: 25311 - DNA, 18 bp, synthetic construct
  source 1..18: mol_type = other DNA
taattcgactcacttccg

SEQ ID NO: 25312 - DNA, 18 bp, synthetic construct
  source 1..18: mol_type = other DNA
taattcgacttaatatcg

SEQ ID NO: 25313 - DNA, 18 bp, synthetic construct
  source 1..18: mol_type = other DNA
taattcgagttaatatag

SEQ ID NO: 25314 - DNA, 18 bp, synthetic construct
  source 1..18: mol_type = other DNA
taattcgattttctatag

SEQ ID NO: 25315 - DNA, 18 bp, synthetic construct
  source 1..18: mol_type = other DNA
taattctaataactatag

SEQ ID NO: 25316 - DNA, 18 bp, synthetic construct
  source 1..18: mol_type = other DNA
taattctacacattatag

SEQ ID NO: 25317 - DNA, 18 bp, synthetic construct
  source 1..18: mol_type = other DNA
taattctacccactaaag

SEQ ID NO: 25318 - DNA, 18 bp, synthetic construct
  source 1..18: mol_type = other DNA
taatttcactcactttag

SEQ ID NO: 25319 - DNA, 18 bp, synthetic construct
  source 1..18: mol_type = other DNA
taatttgactaactctag

SEQ ID NO: 25320 - DNA, 18 bp, synthetic construct
  source 1..18: mol_type = other DNA
taatttgactcaccacag

SEQ ID NO: 25321 - DNA, 18 bp, synthetic construct
  source 1..18: mol_type = other DNA
taatttgtctcactagag

SEQ ID NO: 25322 - DNA, 18 bp, synthetic construct
  source 1..18: mol_type = other DNA
taatttgtcttactatag

SEQ ID NO: 25323 - DNA, 18 bp, synthetic construct
  source 1..18: mol_type = other DNA
taattttactcagtatag

SEQ ID NO: 25324 - DNA, 18 bp, synthetic construct
  source 1..18: mol_type = other DNA
tacatcgactcattatag

SEQ ID NO: 25325 - DNA, 18 bp, synthetic construct
  source 1..18: mol_type = other DNA
tactacgactctctactg

SEQ ID NO: 25326 - DNA, 18 bp, synthetic construct
  source 1..18: mol_type = other DNA
tactacgcctcgctatgg

SEQ ID NO: 25327 - DNA, 18 bp, synthetic construct
  source 1..18: mol_type = other DNA
tactatgactcacaattg

SEQ ID NO: 25328 - DNA, 18 bp, synthetic construct
  source 1..18: mol_type = other DNA
tacttcgacacactaaag

SEQ ID NO: 25329 - DNA, 18 bp, synthetic construct
  source 1..18: mol_type = other DNA
tacttcgtatcactatag

SEQ ID NO: 25330 - DNA, 18 bp, synthetic construct
  source 1..18: mol_type = other DNA
tactttgactcactttag

SEQ ID NO: 25331 - DNA, 18 bp, synthetic construct
  source 1..18: mol_type = other DNA
tagaactactcactattg

SEQ ID NO: 25332 - DNA, 18 bp, synthetic construct
  source 1..18: mol_type = other DNA
tagtaagactccctattg

SEQ ID NO: 25333 - DNA, 18 bp, synthetic construct
  source 1..18: mol_type = other DNA
tagtaccactcgctatgg

SEQ ID NO: 25334 - DNA, 18 bp, synthetic construct
  source 1..18: mol_type = other DNA
tagtacgactcacttctg

SEQ ID NO: 25335 - DNA, 18 bp, synthetic construct
  source 1..18: mol_type = other DNA
tagtacgacttactactg

SEQ ID NO: 25336 - DNA, 18 bp, synthetic construct
  source 1..18: mol_type = other DNA
tagtacgattcaccattg

SEQ ID NO: 25337 - DNA, 18 bp, synthetic construct
  source 1..18: mol_type = other DNA
tagtactactcattattg

SEQ ID NO: 25338 - DNA, 18 bp, synthetic construct
  source 1..18: mol_type = other DNA
tagttcgactcacactag

SEQ ID NO: 25339 - DNA, 18 bp, synthetic construct
  source 1..18: mol_type = other DNA
tagttcgactcattctag

SEQ ID NO: 25340 - DNA, 18 bp, synthetic construct
  source 1..18: mol_type = other DNA
tagttcgagtaactatag

SEQ ID NO: 25341 - DNA, 18 bp, synthetic construct
  source 1..18: mol_type = other DNA
tagtttgaatcactatag

SEQ ID NO: 25342 - DNA, 18 bp, synthetic construct
  source 1..18: mol_type = other DNA
tagtttgtctcactatag

SEQ ID NO: 25343 - DNA, 18 bp, synthetic construct
  source 1..18: mol_type = other DNA
tataaagactcactattg

SEQ ID NO: 25344 - DNA, 18 bp, synthetic construct
  source 1..18: mol_type = other DNA
tatcacgaatcactattg

SEQ ID NO: 25345 - DNA, 18 bp, synthetic construct
  source 1..18: mol_type = other DNA
tatcacgactcactactg

SEQ ID NO: 25346 - DNA, 18 bp, synthetic construct
  source 1..18: mol_type = other DNA
tatcatgactcgctatag

SEQ ID NO: 25347 - DNA, 18 bp, synthetic construct
  source 1..18: mol_type = other DNA
tatgacgattcactattg

SEQ ID NO: 25348 - DNA, 18 bp, synthetic construct
  source 1..18: mol_type = other DNA
tattaagcctcactattg

SEQ ID NO: 25349 - DNA, 18 bp, synthetic construct
  source 1..18: mol_type = other DNA
tattacgactcgaaatag

SEQ ID NO: 25350 - DNA, 18 bp, synthetic construct
  source 1..18: mol_type = other DNA
tattacgactcgcaacag

SEQ ID NO: 25351 - DNA, 18 bp, synthetic construct
  source 1..18: mol_type = other DNA
tattacgccttactattg

SEQ ID NO: 25352 - DNA, 18 bp, synthetic construct
  source 1..18: mol_type = other DNA
tattacggctcaccattg

SEQ ID NO: 25353 - DNA, 18 bp, synthetic construct
  source 1..18: mol_type = other DNA
tattaggacacgctatag

SEQ ID NO: 25354 - DNA, 18 bp, synthetic construct
  source 1..18: mol_type = other DNA
tattaggactcacaattg

SEQ ID NO: 25355 - DNA, 18 bp, synthetic construct
  source 1..18: mol_type = other DNA
tattatgcctcactattg

SEQ ID NO: 25356 - DNA, 18 bp, synthetic construct
  source 1..18: mol_type = other DNA
tatttcgacgcactttag

SEQ ID NO: 25357 - DNA, 18 bp, synthetic construct
  source 1..18: mol_type = other DNA
tatttcgccacactatag

SEQ ID NO: 25358 - DNA, 18 bp, synthetic construct
  source 1..18: mol_type = other DNA
tcaaacgacacactattg

SEQ ID NO: 25359 - DNA, 18 bp, synthetic construct
  source 1..18: mol_type = other DNA
tcaatcgactcactttag

SEQ ID NO: 25360 - DNA, 18 bp, synthetic construct
  source 1..18: mol_type = other DNA
tcatacgaccctctattg

SEQ ID NO: 25361 - DNA, 18 bp, synthetic construct
  source 1..18: mol_type = other DNA
tcatacgtgtcactattg

SEQ ID NO: 25362 - DNA, 18 bp, synthetic construct
  source 1..18: mol_type = other DNA
tcattcaacccactatag

SEQ ID NO: 25363 - DNA, 18 bp, synthetic construct
  source 1..18: mol_type = other DNA
tcgtatgactcactattg

SEQ ID NO: 25364 - DNA, 18 bp, synthetic construct
  source 1..18: mol_type = other DNA
tcgttcgcctcactatag

SEQ ID NO: 25365 - DNA, 18 bp, synthetic construct
  source 1..18: mol_type = other DNA
tcttacgactcactcttg

SEQ ID NO: 25366 - DNA, 18 bp, synthetic construct
  source 1..18: mol_type = other DNA
tgaatcgactcactttag

SEQ ID NO: 25367 - DNA, 18 bp, synthetic construct
  source 1..18: mol_type = other DNA
tgagacgactgactattg

SEQ ID NO: 25368 - DNA, 18 bp, synthetic construct
  source 1..18: mol_type = other DNA
tgatacgactcacaaatg

SEQ ID NO: 25369 - DNA, 18 bp, synthetic construct
  source 1..18: mol_type = other DNA
tgatacgatttactattg

SEQ ID NO: 25370 - DNA, 18 bp, synthetic construct
  source 1..18: mol_type = other DNA
tgatccgactcattattg

SEQ ID NO: 25371 - DNA, 18 bp, synthetic construct
  source 1..18: mol_type = other DNA
tgattagactcactgtag

SEQ ID NO: 25372 - DNA, 18 bp, synthetic construct
  source 1..18: mol_type = other DNA
tgattcaactaactatag

SEQ ID NO: 25373 - DNA, 18 bp, synthetic construct
  source 1..18: mol_type = other DNA
tgattcaactcactttag

SEQ ID NO: 25374 - DNA, 18 bp, synthetic construct
  source 1..18: mol_type = other DNA
tgattcgactcaccatgg

SEQ ID NO: 25375 - DNA, 18 bp, synthetic construct
  source 1..18: mol_type = other DNA
tgattcgactcattttag

SEQ ID NO: 25376 - DNA, 18 bp, synthetic construct
  source 1..18: mol_type = other DNA
tgattcgccacactatag

SEQ ID NO: 25377 - DNA, 18 bp, synthetic construct
  source 1..18: mol_type = other DNA
ttaaacggctcactattg

SEQ ID NO: 25378 - DNA, 18 bp, synthetic construct
  source 1..18: mol_type = other DNA
ttacacgactaactattg

SEQ ID NO: 25379 - DNA, 18 bp, synthetic construct
  source 1..18: mol_type = other DNA
ttagccgactcactattg

SEQ ID NO: 25380 - DNA, 18 bp, synthetic construct
  source 1..18: mol_type = other DNA
ttatacaacccgctatag

SEQ ID NO: 25381 - DNA, 18 bp, synthetic construct
  source 1..18: mol_type = other DNA
ttatacaactcactgttg

SEQ ID NO: 25382 - DNA, 18 bp, synthetic construct
  source 1..18: mol_type = other DNA
ttatacgaagcactattg

SEQ ID NO: 25383 - DNA, 18 bp, synthetic construct
  source 1..18: mol_type = other DNA
ttatacgactcagtatta

SEQ ID NO: 25384 - DNA, 18 bp, synthetic construct
  source 1..18: mol_type = other DNA
ttatacgacttactactg

SEQ ID NO: 25385 - DNA, 18 bp, synthetic construct
  source 1..18: mol_type = other DNA
ttatacgattcgctgtag

SEQ ID NO: 25386 - DNA, 18 bp, synthetic construct
  source 1..18: mol_type = other DNA
ttatacggctcgctaaag

SEQ ID NO: 25387 - DNA, 18 bp, synthetic construct
  source 1..18: mol_type = other DNA
ttataggcctcactattg

SEQ ID NO: 25388 - DNA, 18 bp, synthetic construct
  source 1..18: mol_type = other DNA
ttatcccactcactattg

SEQ ID NO: 25389 - DNA, 18 bp, synthetic construct
  source 1..18: mol_type = other DNA
ttattcaactcactacag

SEQ ID NO: 25390 - DNA, 18 bp, synthetic construct
  source 1..18: mol_type = other DNA
ttattccactcacaatag

SEQ ID NO: 25391 - DNA, 18 bp, synthetic construct
  source 1..18: mol_type = other DNA
ttattcgacgcactttag

SEQ ID NO: 25392 - DNA, 18 bp, synthetic construct
  source 1..18: mol_type = other DNA
ttattcgattcagtatag

SEQ ID NO: 25393 - DNA, 18 bp, synthetic construct
  source 1..18: mol_type = other DNA
ttatttgactcactatcg

SEQ ID NO: 25394 - DNA, 18 bp, synthetic construct
  source 1..18: mol_type = other DNA
tttttcgactcactatgg

SEQ ID NO: 25395 - DNA, 18 bp, synthetic construct
  source 1..18: mol_type = other DNA
aaaaacgcctctctatag

SEQ ID NO: 25396 - DNA, 18 bp, synthetic construct
  source 1..18: mol_type = other DNA
aaaaatgaatcactatag

SEQ ID NO: 25397 - DNA, 18 bp, synthetic construct
  source 1..18: mol_type = other DNA
aaagatgacttactatag

SEQ ID NO: 25398 - DNA, 18 bp, synthetic construct
  source 1..18: mol_type = other DNA
aaatacaaataactatag

SEQ ID NO: 25399 - DNA, 18 bp, synthetic construct
  source 1..18: mol_type = other DNA
aaatacaacacactacag

SEQ ID NO: 25400 - DNA, 18 bp, synthetic construct
  source 1..18: mol_type = other DNA
aaatacgaataactatgg

SEQ ID NO: 25401 - DNA, 18 bp, synthetic construct
  source 1..18: mol_type = other DNA
aaatacgactaaatatcg

SEQ ID NO: 25402 - DNA, 18 bp, synthetic construct
  source 1..18: mol_type = other DNA
aaatacgattcactaccg

SEQ ID NO: 25403 - DNA, 18 bp, synthetic construct
  source 1..18: mol_type = other DNA
aaatacgattcattgtag

SEQ ID NO: 25404 - DNA, 18 bp, synthetic construct
  source 1..18: mol_type = other DNA
aaatacgatttaccatag

SEQ ID NO: 25405 - DNA, 18 bp, synthetic construct
  source 1..18: mol_type = other DNA
aaatacgcctcacaaaag

SEQ ID NO: 25406 - DNA, 18 bp, synthetic construct
  source 1..18: mol_type = other DNA
aaatacgccttactttag

SEQ ID NO: 25407 - DNA, 18 bp, synthetic construct
  source 1..18: mol_type = other DNA
aaatacgcttaactatag

SEQ ID NO: 25408 - DNA, 18 bp, synthetic construct
  source 1..18: mol_type = other DNA
aaatacgtctaaatatag

SEQ ID NO: 25409 - DNA, 18 bp, synthetic construct
  source 1..18: mol_type = other DNA
aaatactactccctaaag

SEQ ID NO: 25410 - DNA, 18 bp, synthetic construct
  source 1..18: mol_type = other DNA
aaatactactctgtatag

SEQ ID NO: 25411 - DNA, 18 bp, synthetic construct
  source 1..18: mol_type = other DNA
aaataggacacattatag

SEQ ID NO: 25412 - DNA, 18 bp, synthetic construct
  source 1..18: mol_type = other DNA
aaatatgacgaactatag

SEQ ID NO: 25413 - DNA, 18 bp, synthetic construct
  source 1..18: mol_type = other DNA
aaatatgactcaccaaag

SEQ ID NO: 25414 - DNA, 18 bp, synthetic construct
  source 1..18: mol_type = other DNA
aaatctgaatcactatag

SEQ ID NO: 25415 - DNA, 18 bp, synthetic construct
  source 1..18: mol_type = other DNA
aaatgcgactatctatag

SEQ ID NO: 25416 - DNA, 18 bp, synthetic construct
  source 1..18: mol_type = other DNA
aaccacgactcaccatag

SEQ ID NO: 25417 - DNA, 18 bp, synthetic construct
  source 1..18: mol_type = other DNA
aactaccaatcactatag

SEQ ID NO: 25418 - DNA, 18 bp, synthetic construct
  source 1..18: mol_type = other DNA
aactacgagtcagtatag

SEQ ID NO: 25419 - DNA, 18 bp, synthetic construct
  source 1..18: mol_type = other DNA
aactacggctaactatag

SEQ ID NO: 25420 - DNA, 18 bp, synthetic construct
  source 1..18: mol_type = other DNA
aagaacgactcaccatag

SEQ ID NO: 25421 - DNA, 18 bp, synthetic construct
  source 1..18: mol_type = other DNA
aagaaggactcactatag

SEQ ID NO: 25422 - DNA, 18 bp, synthetic construct
  source 1..18: mol_type = other DNA
aagtaggtctcactatag

SEQ ID NO: 25423 - DNA, 18 bp, synthetic construct
  source 1..18: mol_type = other DNA
aattacgactaactacag

SEQ ID NO: 25424 - DNA, 18 bp, synthetic construct
  source 1..18: mol_type = other DNA
acacatgactcactatag

SEQ ID NO: 25425 - DNA, 18 bp, synthetic construct
  source 1..18: mol_type = other DNA
acagacgactcactatcg

SEQ ID NO: 25426 - DNA, 18 bp, synthetic construct
  source 1..18: mol_type = other DNA
acatacgactctctatcg

SEQ ID NO: 25427 - DNA, 18 bp, synthetic construct
  source 1..18: mol_type = other DNA
acatgcgactctctatag

SEQ ID NO: 25428 - DNA, 18 bp, synthetic construct
  source 1..18: mol_type = other DNA
acgtacgactcaatatag

SEQ ID NO: 25429 - DNA, 18 bp, synthetic construct
  source 1..18: mol_type = other DNA
atataagcctcactatag

SEQ ID NO: 25430 - DNA, 18 bp, synthetic construct
  source 1..18: mol_type = other DNA
atatacgcttcactatag

SEQ ID NO: 25431 - DNA, 18 bp, synthetic construct
  source 1..18: mol_type = other DNA
atatacggctcactatgg

SEQ ID NO: 25432 - DNA, 18 bp, synthetic construct
  source 1..18: mol_type = other DNA
atatacggttcactatag

SEQ ID NO: 25433 - DNA, 18 bp, synthetic construct
  source 1..18: mol_type = other DNA
atatccgactcaccatag

SEQ ID NO: 25434 - DNA, 18 bp, synthetic construct
  source 1..18: mol_type = other DNA
atatccgactcactttag

SEQ ID NO: 25435 - DNA, 18 bp, synthetic construct
  source 1..18: mol_type = other DNA
caaaaaaactcactatag

SEQ ID NO: 25436 - DNA, 18 bp, synthetic construct
  source 1..18: mol_type = other DNA
caaaacgactttctatag

SEQ ID NO: 25437 - DNA, 18 bp, synthetic construct
  source 1..18: mol_type = other DNA
caagacgacccactctag

SEQ ID NO: 25438 - DNA, 18 bp, synthetic construct
  source 1..18: mol_type = other DNA
caaggctactcactatag

SEQ ID NO: 25439 - DNA, 18 bp, synthetic construct
  source 1..18: mol_type = other DNA
caatacaactcacttaag

SEQ ID NO: 25440 - DNA, 18 bp, synthetic construct
  source 1..18: mol_type = other DNA
caatacaactgaatatag

SEQ ID NO: 25441 - DNA, 18 bp, synthetic construct
  source 1..18: mol_type = other DNA
caatacatcttactatag

SEQ ID NO: 25442 - DNA, 18 bp, synthetic construct
  source 1..18: mol_type = other DNA
caataccacacactgtag

SEQ ID NO: 25443 - DNA, 18 bp, synthetic construct
  source 1..18: mol_type = other DNA
caatacgacatactaaag

SEQ ID NO: 25444 - DNA, 18 bp, synthetic construct
  source 1..18: mol_type = other DNA
caatacgattctcaatag

SEQ ID NO: 25445 - DNA, 18 bp, synthetic construct
  source 1..18: mol_type = other DNA
caatacgtatcacaatag

SEQ ID NO: 25446 - DNA, 18 bp, synthetic construct
  source 1..18: mol_type = other DNA
caatactacccacaatag

SEQ ID NO: 25447 - DNA, 18 bp, synthetic construct
  source 1..18: mol_type = other DNA
caatactacgctctatag

SEQ ID NO: 25448 - DNA, 18 bp, synthetic construct
  source 1..18: mol_type = other DNA
caataggactctctttag

SEQ ID NO: 25449 - DNA, 18 bp, synthetic construct
  source 1..18: mol_type = other DNA
caatccggctctctatag

SEQ ID NO: 25450 - DNA, 18 bp, synthetic construct
  source 1..18: mol_type = other DNA
caatgcgactccatatag

SEQ ID NO: 25451 - DNA, 18 bp, synthetic construct
  source 1..18: mol_type = other DNA
catcacgacttactatag

SEQ ID NO: 25452 - DNA, 18 bp, synthetic construct
  source 1..18: mol_type = other DNA
cattacaaatcactatag

SEQ ID NO: 25453 - DNA, 18 bp, synthetic construct
  source 1..18: mol_type = other DNA
cattacgaatctctatag

SEQ ID NO: 25454 - DNA, 18 bp, synthetic construct
  source 1..18: mol_type = other DNA
cattacgactgtctatag

SEQ ID NO: 25455 - DNA, 18 bp, synthetic construct
  source 1..18: mol_type = other DNA
cggaacgactcactatag

SEQ ID NO: 25456 - DNA, 18 bp, synthetic construct
  source 1..18: mol_type = other DNA
ctacacgacacactatag

SEQ ID NO: 25457 - DNA, 18 bp, synthetic construct
  source 1..18: mol_type = other DNA
ctatacgaatcactatcg

SEQ ID NO: 25458 - DNA, 18 bp, synthetic construct
  source 1..18: mol_type = other DNA
ctatacgacccactttag

SEQ ID NO: 25459 - DNA, 18 bp, synthetic construct
  source 1..18: mol_type = other DNA
ctatatgactcacgatag

SEQ ID NO: 25460 - DNA, 18 bp, synthetic construct
  source 1..18: mol_type = other DNA
gaaaacgacacacaatag

SEQ ID NO: 25461 - DNA, 18 bp, synthetic construct
  source 1..18: mol_type = other DNA
gaacacgtctcaatatag

SEQ ID NO: 25462 - DNA, 18 bp, synthetic construct
  source 1..18: mol_type = other DNA
gaatatgacatactatag

SEQ ID NO: 25463 - DNA, 18 bp, synthetic construct
  source 1..18: mol_type = other DNA
gtatgcgactcaatatag

SEQ ID NO: 25464 - DNA, 18 bp, synthetic construct
  source 1..18: mol_type = other DNA
taaaaagtctcaatatag

SEQ ID NO: 25465 - DNA, 18 bp, synthetic construct
  source 1..18: mol_type = other DNA
taaaaatacacactatag

SEQ ID NO: 25466 - DNA, 18 bp, synthetic construct
  source 1..18: mol_type = other DNA
taaaaatactcacaatag

SEQ ID NO: 25467 - DNA, 18 bp, synthetic construct
  source 1..18: mol_type = other DNA
taaaacaactcactgaag

SEQ ID NO: 25468 - DNA, 18 bp, synthetic construct
  source 1..18: mol_type = other DNA
taaaacgaatcagtacag

SEQ ID NO: 25469 - DNA, 18 bp, synthetic construct
  source 1..18: mol_type = other DNA
taaaacgacaatctatag

SEQ ID NO: 25470 - DNA, 18 bp, synthetic construct
  source 1..18: mol_type = other DNA
taaaacgacacattatcg

SEQ ID NO: 25471 - DNA, 18 bp, synthetic construct
  source 1..18: mol_type = other DNA
taaaacgacccacaaaag

SEQ ID NO: 25472 - DNA, 18 bp, synthetic construct
  source 1..18: mol_type = other DNA
taaaacgactcaaggtag

SEQ ID NO: 25473 - DNA, 18 bp, synthetic construct
  source 1..18: mol_type = other DNA
taaaacgactcaataaaa

SEQ ID NO: 25474 - DNA, 18 bp, synthetic construct
  source 1..18: mol_type = other DNA
taaaacgactgtttatag

SEQ ID NO: 25475 - DNA, 18 bp, synthetic construct
  source 1..18: mol_type = other DNA
taaaacgacttacaacag

SEQ ID NO: 25476 - DNA, 18 bp, synthetic construct
  source 1..18: mol_type = other DNA
taaaacgattcaataaag

SEQ ID NO: 25477 - DNA, 18 bp, synthetic construct
  source 1..18: mol_type = other DNA
taaaacgattcaccatcg

SEQ ID NO: 25478 - DNA, 18 bp, synthetic construct
  source 1..18: mol_type = other DNA
taaaacgattcattatgg

SEQ ID NO: 25479 - DNA, 18 bp, synthetic construct
  source 1..18: mol_type = other DNA
taaaacgcctcacttcag

SEQ ID NO: 25480 - DNA, 18 bp, synthetic construct
  source 1..18: mol_type = other DNA
taaaacgcctgacaatag

SEQ ID NO: 25481 - DNA, 18 bp, synthetic construct
  source 1..18: mol_type = other DNA
taaaacgcctgagtatag

SEQ ID NO: 25482 - DNA, 18 bp, synthetic construct
  source 1..18: mol_type = other DNA
taaaacggtccactatag

SEQ ID NO: 25483 - DNA, 18 bp, synthetic construct
  source 1..18: mol_type = other DNA
taaaacgtatcactatcg

SEQ ID NO: 25484 - DNA, 18 bp, synthetic construct
  source 1..18: mol_type = other DNA
taaaacgtctcacttcag

SEQ ID NO: 25485 - DNA, 18 bp, synthetic construct
  source 1..18: mol_type = other DNA
taaaacgtgtcacaatag

SEQ ID NO: 25486 - DNA, 18 bp, synthetic construct
  source 1..18: mol_type = other DNA
taaaactacacactctag

SEQ ID NO: 25487 - DNA, 18 bp, synthetic construct
  source 1..18: mol_type = other DNA
taaaagcactcactaaag

SEQ ID NO: 25488 - DNA, 18 bp, synthetic construct
  source 1..18: mol_type = other DNA
taaaaggacacaatatag

SEQ ID NO: 25489 - DNA, 18 bp, synthetic construct
  source 1..18: mol_type = other DNA
taaaaggactaactttag

SEQ ID NO: 25490 - DNA, 18 bp, synthetic construct
  source 1..18: mol_type = other DNA
taaaaggactgactctag

SEQ ID NO: 25491 - DNA, 18 bp, synthetic construct
  source 1..18: mol_type = other DNA
taaaatgactcactgaag

SEQ ID NO: 25492 - DNA, 18 bp, synthetic construct
  source 1..18: mol_type = other DNA
taaaatgactcattgtag

SEQ ID NO: 25493 - DNA, 18 bp, synthetic construct
  source 1..18: mol_type = other DNA
taaaatgacttactaaag

SEQ ID NO: 25494 - DNA, 18 bp, synthetic construct
  source 1..18: mol_type = other DNA
taaaatgtctcaccatag

SEQ ID NO: 25495 - DNA, 18 bp, synthetic construct
  source 1..18: mol_type = other DNA
taaaatgtctcactgtag

SEQ ID NO: 25496 - DNA, 18 bp, synthetic construct
  source 1..18: mol_type = other DNA
taaacccactcactttag

SEQ ID NO: 25497 - DNA, 18 bp, synthetic construct
  source 1..18: mol_type = other DNA
taaaccgactcaataaag

SEQ ID NO: 25498 - DNA, 18 bp, synthetic construct
  source 1..18: mol_type = other DNA
taaacggactaactatag

SEQ ID NO: 25499 - DNA, 18 bp, synthetic construct
  source 1..18: mol_type = other DNA
taaagcgactcaatatgg

SEQ ID NO: 25500 - DNA, 18 bp, synthetic construct
  source 1..18: mol_type = other DNA
taaagcgactcacactag

SEQ ID NO: 25501 - DNA, 18 bp, synthetic construct
  source 1..18: mol_type = other DNA
taaagctactcacgatag

SEQ ID NO: 25502 - DNA, 18 bp, synthetic construct
  source 1..18: mol_type = other DNA
taacaaaactcacgatag

SEQ ID NO: 25503 - DNA, 18 bp, synthetic construct
  source 1..18: mol_type = other DNA
taacaagactcaccatcg

SEQ ID NO: 25504 - DNA, 18 bp, synthetic construct
  source 1..18: mol_type = other DNA
taacaccacacactatcg

SEQ ID NO: 25505 - DNA, 18 bp, synthetic construct
  source 1..18: mol_type = other DNA
taacacctctcaatatag

SEQ ID NO: 25506 - DNA, 18 bp, synthetic construct
  source 1..18: mol_type = other DNA
taacacgaatcacattag

SEQ ID NO: 25507 - DNA, 18 bp, synthetic construct
  source 1..18: mol_type = other DNA
taacacgacaaaccatag

SEQ ID NO: 25508 - DNA, 18 bp, synthetic construct
  source 1..18: mol_type = other DNA
taacacgacccactgtcg

SEQ ID NO: 25509 - DNA, 18 bp, synthetic construct
  source 1..18: mol_type = other DNA
taacacgatacactttag

SEQ ID NO: 25510 - DNA, 18 bp, synthetic construct
  source 1..18: mol_type = other DNA
taacacgattctctaaag

SEQ ID NO: 25511 - DNA, 18 bp, synthetic construct
  source 1..18: mol_type = other DNA
taacacgccttacaatag

SEQ ID NO: 25512 - DNA, 18 bp, synthetic construct
  source 1..18: mol_type = other DNA
taacactacacactatcg

SEQ ID NO: 25513 - DNA, 18 bp, synthetic construct
  source 1..18: mol_type = other DNA
taacatgacacactttag

SEQ ID NO: 25514 - DNA, 18 bp, synthetic construct
  source 1..18: mol_type = other DNA
taacatgtctcactttag

SEQ ID NO: 25515 - DNA, 18 bp, synthetic construct
  source 1..18: mol_type = other DNA
taagaagtctcactatcg

SEQ ID NO: 25516 - DNA, 18 bp, synthetic construct
  source 1..18: mol_type = other DNA
taagacgacccaatgtag

SEQ ID NO: 25517 - DNA, 18 bp, synthetic construct
  source 1..18: mol_type = other DNA
taagacgattcataatag

SEQ ID NO: 25518 - DNA, 18 bp, synthetic construct
  source 1..18: mol_type = other DNA
taagacgtctcactaacg

SEQ ID NO: 25519 - DNA, 18 bp, synthetic construct
  source 1..18: mol_type = other DNA
taagacgtctcataatag

SEQ ID NO: 25520 - DNA, 18 bp, synthetic construct
  source 1..18: mol_type = other DNA
taataaaactctctgtag

SEQ ID NO: 25521 - DNA, 18 bp, synthetic construct
  source 1..18: mol_type = other DNA
taataaaattcactgtag

SEQ ID NO: 25522 - DNA, 18 bp, synthetic construct
  source 1..18: mol_type = other DNA
taataacactctatatag

SEQ ID NO: 25523 - DNA, 18 bp, synthetic construct
  source 1..18: mol_type = other DNA
taataagacacaatctag

SEQ ID NO: 25524 - DNA, 18 bp, synthetic construct
  source 1..18: mol_type = other DNA
taataagacactctatcg

SEQ ID NO: 25525 - DNA, 18 bp, synthetic construct
  source 1..18: mol_type = other DNA
taataagacccattttag

SEQ ID NO: 25526 - DNA, 18 bp, synthetic construct
  source 1..18: mol_type = other DNA
taataagactctgtagag

SEQ ID NO: 25527 - DNA, 18 bp, synthetic construct
  source 1..18: mol_type = other DNA
taataagactgtctgtag

SEQ ID NO: 25528 - DNA, 18 bp, synthetic construct
  source 1..18: mol_type = other DNA
taataagattcacaatgg

SEQ ID NO: 25529 - DNA, 18 bp, synthetic construct
  source 1..18: mol_type = other DNA
taataagattcactacgg

SEQ ID NO: 25530 - DNA, 18 bp, synthetic construct
  source 1..18: mol_type = other DNA
taataaggctcacttaag

SEQ ID NO: 25531 - DNA, 18 bp, synthetic construct
  source 1..18: mol_type = other DNA
taataagtctcactcgag

SEQ ID NO: 25532 - DNA, 18 bp, synthetic construct
  source 1..18: mol_type = other DNA
taataagtctcagaatag

SEQ ID NO: 25533 - DNA, 18 bp, synthetic construct
  source 1..18: mol_type = other DNA
taatacaaatcactgaag

SEQ ID NO: 25534 - DNA, 18 bp, synthetic construct
  source 1..18: mol_type = other DNA
taatacaacaaaccatag

SEQ ID NO: 25535 - DNA, 18 bp, synthetic construct
  source 1..18: mol_type = other DNA
taatacaacaaactctag

SEQ ID NO: 25536 - DNA, 18 bp, synthetic construct
  source 1..18: mol_type = other DNA
taatacaacgaactttag

SEQ ID NO: 25537 - DNA, 18 bp, synthetic construct
  source 1..18: mol_type = other DNA
taatacaacgcacttcag

SEQ ID NO: 25538 - DNA, 18 bp, synthetic construct
  source 1..18: mol_type = other DNA
taatacaacgtactacag

SEQ ID NO: 25539 - DNA, 18 bp, synthetic construct
  source 1..18: mol_type = other DNA
taatacaactctgtatgg

SEQ ID NO: 25540 - DNA, 18 bp, synthetic construct
  source 1..18: mol_type = other DNA
taatacaatgctctatag

SEQ ID NO: 25541 - DNA, 18 bp, synthetic construct
  source 1..18: mol_type = other DNA
taatacagcatactatag

SEQ ID NO: 25542 - DNA, 18 bp, synthetic construct
  source 1..18: mol_type = other DNA
taatacatctaaatatag

SEQ ID NO: 25543 - DNA, 18 bp, synthetic construct
  source 1..18: mol_type = other DNA
taatacatctccctgtag

SEQ ID NO: 25544 - DNA, 18 bp, synthetic construct
  source 1..18: mol_type = other DNA
taatacattccactatag

SEQ ID NO: 25545 - DNA, 18 bp, synthetic construct
  source 1..18: mol_type = other DNA
taataccaatcaccaaag

SEQ ID NO: 25546 - DNA, 18 bp, synthetic construct
  source 1..18: mol_type = other DNA
taataccaatcactaacg

SEQ ID NO: 25547 - DNA, 18 bp, synthetic construct
  source 1..18: mol_type = other DNA
taataccaatctcaatag

SEQ ID NO: 25548 - DNA, 18 bp, synthetic construct
  source 1..18: mol_type = other DNA
taataccaatctctgtag

SEQ ID NO: 25549 - DNA, 18 bp, synthetic construct
  source 1..18: mol_type = other DNA
taataccactaataatag

SEQ ID NO: 25550 - DNA, 18 bp, synthetic construct
  source 1..18: mol_type = other DNA
taataccactatatatag

SEQ ID NO: 25551 - DNA, 18 bp, synthetic construct
  source 1..18: mol_type = other DNA
taataccactatcaatag

SEQ ID NO: 25552 - DNA, 18 bp, synthetic construct
  source 1..18: mol_type = other DNA
taataccactcagcagag

SEQ ID NO: 25553 - DNA, 18 bp, synthetic construct
  source 1..18: mol_type = other DNA
taataccattcaatttag

SEQ ID NO: 25554 - DNA, 18 bp, synthetic construct
  source 1..18: mol_type = other DNA
taataccgttctctatag

SEQ ID NO: 25555 - DNA, 18 bp, synthetic construct
  source 1..18: mol_type = other DNA
taatacgaatgactgaag

SEQ ID NO: 25556 - DNA, 18 bp, synthetic construct
  source 1..18: mol_type = other DNA
taatacgaattagtaaag

SEQ ID NO: 25557 - DNA, 18 bp, synthetic construct
  source 1..18: mol_type = other DNA
taatacgacaaacttcag

SEQ ID NO: 25558 - DNA, 18 bp, synthetic construct
  source 1..18: mol_type = other DNA
taatacgacaacttatag

SEQ ID NO: 25559 - DNA, 18 bp, synthetic construct
  source 1..18: mol_type = other DNA
taatacgacacaataaaa

SEQ ID NO: 25560 - DNA, 18 bp, synthetic construct
  source 1..18: mol_type = other DNA
taatacgacacaccaacg

SEQ ID NO: 25561 - DNA, 18 bp, synthetic construct
  source 1..18: mol_type = other DNA
taatacgacacatagtag

SEQ ID NO: 25562 - DNA, 18 bp, synthetic construct
  source 1..18: mol_type = other DNA
taatacgacacattttgg

SEQ ID NO: 25563 - DNA, 18 bp, synthetic construct
  source 1..18: mol_type = other DNA
taatacgaccacctaaag

SEQ ID NO: 25564 - DNA, 18 bp, synthetic construct
  source 1..18: mol_type = other DNA
taatacgacccaacaaag

SEQ ID NO: 25565 - DNA, 18 bp, synthetic construct
  source 1..18: mol_type = other DNA
taatacgacgctctttcg

SEQ ID NO: 25566 - DNA, 18 bp, synthetic construct
  source 1..18: mol_type = other DNA
taatacgacggtctctag

SEQ ID NO: 25567 - DNA, 18 bp, synthetic construct
  source 1..18: mol_type = other DNA
taatacgactaattagcg

SEQ ID NO: 25568 - DNA, 18 bp, synthetic construct
  source 1..18: mol_type = other DNA
taatacgactatatgtag

SEQ ID NO: 25569 - DNA, 18 bp, synthetic construct
  source 1..18: mol_type = other DNA
taatacgactatttctag

SEQ ID NO: 25570 - DNA, 18 bp, synthetic construct
  source 1..18: mol_type = other DNA
taatacgacttatagtag

SEQ ID NO: 25571 - DNA, 18 bp, synthetic construct
  source 1..18: mol_type = other DNA
taatacgacttcttagag

SEQ ID NO: 25572 - DNA, 18 bp, synthetic construct
  source 1..18: mol_type = other DNA
taatacgactttcaacag

SEQ ID NO: 25573 - DNA, 18 bp, synthetic construct
  source 1..18: mol_type = other DNA
taatacgagctactaaag

SEQ ID NO: 25574 - DNA, 18 bp, synthetic construct
  source 1..18: mol_type = other DNA
taatacgagtcatcatcg

SEQ ID NO: 25575 - DNA, 18 bp, synthetic construct
  source 1..18: mol_type = other DNA
taatacgatacaggatag

SEQ ID NO: 25576 - DNA, 18 bp, synthetic construct
  source 1..18: mol_type = other DNA
taatacgatatactatgg

SEQ ID NO: 25577 - DNA, 18 bp, synthetic construct
  source 1..18: mol_type = other DNA
taatacgatccaccttag

SEQ ID NO: 25578 - DNA, 18 bp, synthetic construct
  source 1..18: mol_type = other DNA
taatacgattcaatggag

SEQ ID NO: 25579 - DNA, 18 bp, synthetic construct
  source 1..18: mol_type = other DNA
taatacgattcaatttgg

SEQ ID NO: 25580 - DNA, 18 bp, synthetic construct
  source 1..18: mol_type = other DNA
taatacgattcataaaag

SEQ ID NO: 25581 - DNA, 18 bp, synthetic construct
  source 1..18: mol_type = other DNA
taatacgattccccaaag

SEQ ID NO: 25582 - DNA, 18 bp, synthetic construct
  source 1..18: mol_type = other DNA
taatacgattctatatgg

SEQ ID NO: 25583 - DNA, 18 bp, synthetic construct
  source 1..18: mol_type = other DNA
taatacgatttaaaatag

SEQ ID NO: 25584 - DNA, 18 bp, synthetic construct
  source 1..18: mol_type = other DNA
taatacgcatcacactag

SEQ ID NO: 25585 - DNA, 18 bp, synthetic construct
  source 1..18: mol_type = other DNA
taatacgcatcagtagag

SEQ ID NO: 25586 - DNA, 18 bp, synthetic construct
  source 1..18: mol_type = other DNA
taatacgccacattaaag

SEQ ID NO: 25587 - DNA, 18 bp, synthetic construct
  source 1..18: mol_type = other DNA
taatacgccttattttag

SEQ ID NO: 25588 - DNA, 18 bp, synthetic construct
  source 1..18: mol_type = other DNA
taatacggcgctctctag

SEQ ID NO: 25589 - DNA, 18 bp, synthetic construct
  source 1..18: mol_type = other DNA
taatacgggacactaaag

SEQ ID NO: 25590 - DNA, 18 bp, synthetic construct
  source 1..18: mol_type = other DNA
taatacggtttactttag

SEQ ID NO: 25591 - DNA, 18 bp, synthetic construct
  source 1..18: mol_type = other DNA
taatacgtatctctgtag

SEQ ID NO: 25592 - DNA, 18 bp, synthetic construct
  source 1..18: mol_type = other DNA
taatacgtcccacttcag

SEQ ID NO: 25593 - DNA, 18 bp, synthetic construct
  source 1..18: mol_type = other DNA
taatacgtctctgtctag

SEQ ID NO: 25594 - DNA, 18 bp, synthetic construct
  source 1..18: mol_type = other DNA
taatacgtcttcatatag

SEQ ID NO: 25595 - DNA, 18 bp, synthetic construct
  source 1..18: mol_type = other DNA
taatacgtcttcctacag

SEQ ID NO: 25596 - DNA, 18 bp, synthetic construct
  source 1..18: mol_type = other DNA
taatactaatcactaacg

SEQ ID NO: 25597 - DNA, 18 bp, synthetic construct
  source 1..18: mol_type = other DNA
taatactacacattatgg

SEQ ID NO: 25598 - DNA, 18 bp, synthetic construct
  source 1..18: mol_type = other DNA
taatactactcaaaatcg

SEQ ID NO: 25599 - DNA, 18 bp, synthetic construct
  source 1..18: mol_type = other DNA
taatactactcattaacg

SEQ ID NO: 25600 - DNA, 18 bp, synthetic construct
  source 1..18: mol_type = other DNA
taatactagacattatag

SEQ ID NO: 25601 - DNA, 18 bp, synthetic construct
  source 1..18: mol_type = other DNA
taatactagtcaataaag

SEQ ID NO: 25602 - DNA, 18 bp, synthetic construct
  source 1..18: mol_type = other DNA
taatactattctctaaag

SEQ ID NO: 25603 - DNA, 18 bp, synthetic construct
  source 1..18: mol_type = other DNA
taatactcctccctaaag

SEQ ID NO: 25604 - DNA, 18 bp, synthetic construct
  source 1..18: mol_type = other DNA
taatactgcacactatcg

SEQ ID NO: 25605 - DNA, 18 bp, synthetic construct
  source 1..18: mol_type = other DNA
taatagaactatctatag

SEQ ID NO: 25606 - DNA, 18 bp, synthetic construct
  source 1..18: mol_type = other DNA
taatagaactccctttag

SEQ ID NO: 25607 - DNA, 18 bp, synthetic construct
  source 1..18: mol_type = other DNA
taataggactcatattag

SEQ ID NO: 25608 - DNA, 18 bp, synthetic construct
  source 1..18: mol_type = other DNA
taataggattcaccttag

SEQ ID NO: 25609 - DNA, 18 bp, synthetic construct
  source 1..18: mol_type = other DNA
taataggtctcacactag

SEQ ID NO: 25610 - DNA, 18 bp, synthetic construct
  source 1..18: mol_type = other DNA
taataggtctcactaacg

SEQ ID NO: 25611 - DNA, 18 bp, synthetic construct
  source 1..18: mol_type = other DNA
taataggtctcagtaaag

SEQ ID NO: 25612 - DNA, 18 bp, synthetic construct
  source 1..18: mol_type = other DNA
taatagttctctctatag

SEQ ID NO: 25613 - DNA, 18 bp, synthetic construct
  source 1..18: mol_type = other DNA
taatataactcacggtag

SEQ ID NO: 25614 - DNA, 18 bp, synthetic construct
  source 1..18: mol_type = other DNA
taatatgacataatatag

SEQ ID NO: 25615 - DNA, 18 bp, synthetic construct
  source 1..18: mol_type = other DNA
taatatgacttagaatag

SEQ ID NO: 25616 - DNA, 18 bp, synthetic construct
  source 1..18: mol_type = other DNA
taatatgactttctatcg

SEQ ID NO: 25617 - DNA, 18 bp, synthetic construct
  source 1..18: mol_type = other DNA
taatatgagtcaccaaag

SEQ ID NO: 25618 - DNA, 18 bp, synthetic construct
  source 1..18: mol_type = other DNA
taatatgagtcattaaag

SEQ ID NO: 25619 - DNA, 18 bp, synthetic construct
  source 1..18: mol_type = other DNA
taatatgcctccatatag

SEQ ID NO: 25620 - DNA, 18 bp, synthetic construct
  source 1..18: mol_type = other DNA
taatatgtgtcactatgg

SEQ ID NO: 25621 - DNA, 18 bp, synthetic construct
  source 1..18: mol_type = other DNA
taatattactgactaaag

SEQ ID NO: 25622 - DNA, 18 bp, synthetic construct
  source 1..18: mol_type = other DNA
taatatttctcactgtag

SEQ ID NO: 25623 - DNA, 18 bp, synthetic construct
  source 1..18: mol_type = other DNA
taatcagactaactacag

SEQ ID NO: 25624 - DNA, 18 bp, synthetic construct
  source 1..18: mol_type = other DNA
taatcagtctcactttag

SEQ ID NO: 25625 - DNA, 18 bp, synthetic construct
  source 1..18: mol_type = other DNA
taatcagtctcattatag

SEQ ID NO: 25626 - DNA, 18 bp, synthetic construct
  source 1..18: mol_type = other DNA
taatccaattcactctag

SEQ ID NO: 25627 - DNA, 18 bp, synthetic construct
  source 1..18: mol_type = other DNA
taatccatctcacaatag

SEQ ID NO: 25628 - DNA, 18 bp, synthetic construct
  source 1..18: mol_type = other DNA
taatccgacgcacaaaag

SEQ ID NO: 25629 - DNA, 18 bp, synthetic construct
  source 1..18: mol_type = other DNA
taatccgactcactgtcc

SEQ ID NO: 25630 - DNA, 18 bp, synthetic construct
  source 1..18: mol_type = other DNA
taatccgactgattttag

SEQ ID NO: 25631 - DNA, 18 bp, synthetic construct
  source 1..18: mol_type = other DNA
taatccggctacctatag

SEQ ID NO: 25632 - DNA, 18 bp, synthetic construct
  source 1..18: mol_type = other DNA
taatccgtctaactaaag

SEQ ID NO: 25633 - DNA, 18 bp, synthetic construct
  source 1..18: mol_type = other DNA
taatcctactaacaatag

SEQ ID NO: 25634 - DNA, 18 bp, synthetic construct
  source 1..18: mol_type = other DNA
taatcctattcactatcg

SEQ ID NO: 25635 - DNA, 18 bp, synthetic construct
  source 1..18: mol_type = other DNA
taatctcactcactttag

SEQ ID NO: 25636 - DNA, 18 bp, synthetic construct
  source 1..18: mol_type = other DNA
taatctgactaactaaag

SEQ ID NO: 25637 - DNA, 18 bp, synthetic construct
  source 1..18: mol_type = other DNA
taatctgtcacactatag

SEQ ID NO: 25638 - DNA, 18 bp, synthetic construct
  source 1..18: mol_type = other DNA
taatgagactgaatatag

SEQ ID NO: 25639 - DNA, 18 bp, synthetic construct
  source 1..18: mol_type = other DNA
taatgagattcactaaag

SEQ ID NO: 25640 - DNA, 18 bp, synthetic construct
  source 1..18: mol_type = other DNA
taatgcctctcactgtag

SEQ ID NO: 25641 - DNA, 18 bp, synthetic construct
  source 1..18: mol_type = other DNA
taatgcgacaaactttag

SEQ ID NO: 25642 - DNA, 18 bp, synthetic construct
  source 1..18: mol_type = other DNA
taatgcgacgcactaagg

SEQ ID NO: 25643 - DNA, 18 bp, synthetic construct
  source 1..18: mol_type = other DNA
taatgcgactcactacct

SEQ ID NO: 25644 - DNA, 18 bp, synthetic construct
  source 1..18: mol_type = other DNA
taatgcgagtcaatatcg

SEQ ID NO: 25645 - DNA, 18 bp, synthetic construct
  source 1..18: mol_type = other DNA
taatgcgattaattatag

SEQ ID NO: 25646 - DNA, 18 bp, synthetic construct
  source 1..18: mol_type = other DNA
taatgcgtagcactatag

SEQ ID NO: 25647 - DNA, 18 bp, synthetic construct
  source 1..18: mol_type = other DNA
taatgggacactctatag

SEQ ID NO: 25648 - DNA, 18 bp, synthetic construct
  source 1..18: mol_type = other DNA
taatgggcctcacaatag

SEQ ID NO: 25649 - DNA, 18 bp, synthetic construct
  source 1..18: mol_type = other DNA
taatgtcactcattatag

SEQ ID NO: 25650 - DNA, 18 bp, synthetic construct
  source 1..18: mol_type = other DNA
taatgtgtctcactaaag

SEQ ID NO: 25651 - DNA, 18 bp, synthetic construct
  source 1..18: mol_type = other DNA
tacaacgtcttactatag

SEQ ID NO: 25652 - DNA, 18 bp, synthetic construct
  source 1..18: mol_type = other DNA
tacaactactcacaatag

SEQ ID NO: 25653 - DNA, 18 bp, synthetic construct
  source 1..18: mol_type = other DNA
tacaaggactcacgatag

SEQ ID NO: 25654 - DNA, 18 bp, synthetic construct
  source 1..18: mol_type = other DNA
tacgacgactcactctcg

SEQ ID NO: 25655 - DNA, 18 bp, synthetic construct
  source 1..18: mol_type = other DNA
tactaagacacactttag

SEQ ID NO: 25656 - DNA, 18 bp, synthetic construct
  source 1..18: mol_type = other DNA
tactaagactaactctag

SEQ ID NO: 25657 - DNA, 18 bp, synthetic construct
  source 1..18: mol_type = other DNA
tactacaactcacaagag

SEQ ID NO: 25658 - DNA, 18 bp, synthetic construct
  source 1..18: mol_type = other DNA
tactaccacacactatgg

SEQ ID NO: 25659 - DNA, 18 bp, synthetic construct
  source 1..18: mol_type = other DNA
tactacgactaaatttag

SEQ ID NO: 25660 - DNA, 18 bp, synthetic construct
  source 1..18: mol_type = other DNA
tactacgattcaatttag

SEQ ID NO: 25661 - DNA, 18 bp, synthetic construct
  source 1..18: mol_type = other DNA
tactacgtcacaatatag

SEQ ID NO: 25662 - DNA, 18 bp, synthetic construct
  source 1..18: mol_type = other DNA
tactacttctcattatag

SEQ ID NO: 25663 - DNA, 18 bp, synthetic construct
  source 1..18: mol_type = other DNA
tactacttttcactatag

SEQ ID NO: 25664 - DNA, 18 bp, synthetic construct
  source 1..18: mol_type = other DNA
tactataacacactatag

SEQ ID NO: 25665 - DNA, 18 bp, synthetic construct
  source 1..18: mol_type = other DNA
tactataactcactaaag

SEQ ID NO: 25666 - DNA, 18 bp, synthetic construct
  source 1..18: mol_type = other DNA
tactatgactgacaatag

SEQ ID NO: 25667 - DNA, 18 bp, synthetic construct
  source 1..18: mol_type = other DNA
tactccgacacaccatag

SEQ ID NO: 25668 - DNA, 18 bp, synthetic construct
  source 1..18: mol_type = other DNA
tactccgactttctatag

SEQ ID NO: 25669 - DNA, 18 bp, synthetic construct
  source 1..18: mol_type = other DNA
tactccgtctctctatag

SEQ ID NO: 25670 - DNA, 18 bp, synthetic construct
  source 1..18: mol_type = other DNA
tactgcgacacactatcg

SEQ ID NO: 25671 - DNA, 18 bp, synthetic construct
  source 1..18: mol_type = other DNA
tagaaagactgactatag

SEQ ID NO: 25672 - DNA, 18 bp, synthetic construct
  source 1..18: mol_type = other DNA
tagagcgactcactctag

SEQ ID NO: 25673 - DNA, 18 bp, synthetic construct
  source 1..18: mol_type = other DNA
tagcacgactcagtaaag

SEQ ID NO: 25674 - DNA, 18 bp, synthetic construct
  source 1..18: mol_type = other DNA
tagcactactcagtatag

SEQ ID NO: 25675 - DNA, 18 bp, synthetic construct
  source 1..18: mol_type = other DNA
tagcccgactcaccatag

SEQ ID NO: 25676 - DNA, 18 bp, synthetic construct
  source 1..18: mol_type = other DNA
tagtacaactctctaaag

SEQ ID NO: 25677 - DNA, 18 bp, synthetic construct
  source 1..18: mol_type = other DNA
tagtacagctcaatatag

SEQ ID NO: 25678 - DNA, 18 bp, synthetic construct
  source 1..18: mol_type = other DNA
tagtacgacccacaatcg

SEQ ID NO: 25679 - DNA, 18 bp, synthetic construct
  source 1..18: mol_type = other DNA
tagtacgactatcaatag

SEQ ID NO: 25680 - DNA, 18 bp, synthetic construct
  source 1..18: mol_type = other DNA
tagtacgattctctaaag

SEQ ID NO: 25681 - DNA, 18 bp, synthetic construct
  source 1..18: mol_type = other DNA
tagtacgcctcactcaag

SEQ ID NO: 25682 - DNA, 18 bp, synthetic construct
  source 1..18: mol_type = other DNA
tagtacgtctgactttag

SEQ ID NO: 25683 - DNA, 18 bp, synthetic construct
  source 1..18: mol_type = other DNA
tagtatgatacactatag

SEQ ID NO: 25684 - DNA, 18 bp, synthetic construct
  source 1..18: mol_type = other DNA
tataacaactgactatag

SEQ ID NO: 25685 - DNA, 18 bp, synthetic construct
  source 1..18: mol_type = other DNA
tataacgacctactatag

SEQ ID NO: 25686 - DNA, 18 bp, synthetic construct
  source 1..18: mol_type = other DNA
tataacgacgctctatag

SEQ ID NO: 25687 - DNA, 18 bp, synthetic construct
  source 1..18: mol_type = other DNA
tataacgactcattatcg

SEQ ID NO: 25688 - DNA, 18 bp, synthetic construct
  source 1..18: mol_type = other DNA
tataatgacttactatag

SEQ ID NO: 25689 - DNA, 18 bp, synthetic construct
  source 1..18: mol_type = other DNA
tatcacgactcaccttag

SEQ ID NO: 25690 - DNA, 18 bp, synthetic construct
  source 1..18: mol_type = other DNA
tatcacgtatcactatag

SEQ ID NO: 25691 - DNA, 18 bp, synthetic construct
  source 1..18: mol_type = other DNA
tatcgcggctcactatag

SEQ ID NO: 25692 - DNA, 18 bp, synthetic construct
  source 1..18: mol_type = other DNA
tatgacgactcaccttag

SEQ ID NO: 25693 - DNA, 18 bp, synthetic construct
  source 1..18: mol_type = other DNA
tatgacgattcagtatag

SEQ ID NO: 25694 - DNA, 18 bp, synthetic construct
  source 1..18: mol_type = other DNA
tatgactactcactatgg

SEQ ID NO: 25695 - DNA, 18 bp, synthetic construct
  source 1..18: mol_type = other DNA
tattaagacccactaaag

SEQ ID NO: 25696 - DNA, 18 bp, synthetic construct
  source 1..18: mol_type = other DNA
tattacatctgactatag

SEQ ID NO: 25697 - DNA, 18 bp, synthetic construct
  source 1..18: mol_type = other DNA
tattaccactaaccatag

SEQ ID NO: 25698 - DNA, 18 bp, synthetic construct
  source 1..18: mol_type = other DNA
tattacgacaaaccatag

SEQ ID NO: 25699 - DNA, 18 bp, synthetic construct
  source 1..18: mol_type = other DNA
tattacgacagactaaag

SEQ ID NO: 25700 - DNA, 18 bp, synthetic construct
  source 1..18: mol_type = other DNA
tattacgacgctccatag

SEQ ID NO: 25701 - DNA, 18 bp, synthetic construct
  source 1..18: mol_type = other DNA
tattacgactcagaaaag

SEQ ID NO: 25702 - DNA, 18 bp, synthetic construct
  source 1..18: mol_type = other DNA
tattacgactctctccag

SEQ ID NO: 25703 - DNA, 18 bp, synthetic construct
  source 1..18: mol_type = other DNA
tattacgagtcactaagg

SEQ ID NO: 25704 - DNA, 18 bp, synthetic construct
  source 1..18: mol_type = other DNA
tattacgcctccctctag

SEQ ID NO: 25705 - DNA, 18 bp, synthetic construct
  source 1..18: mol_type = other DNA
tattacggatcactatcg

SEQ ID NO: 25706 - DNA, 18 bp, synthetic construct
  source 1..18: mol_type = other DNA
tattacgtctaactgtag

SEQ ID NO: 25707 - DNA, 18 bp, synthetic construct
  source 1..18: mol_type = other DNA
tattacgtctcaatatgg

SEQ ID NO: 25708 - DNA, 18 bp, synthetic construct
  source 1..18: mol_type = other DNA
tattacgtctcactaacg

SEQ ID NO: 25709 - DNA, 18 bp, synthetic construct
  source 1..18: mol_type = other DNA
tattactactcacaacag

SEQ ID NO: 25710 - DNA, 18 bp, synthetic construct
  source 1..18: mol_type = other DNA
tattacttctcactatgg

SEQ ID NO: 25711 - DNA, 18 bp, synthetic construct
  source 1..18: mol_type = other DNA
tattaggacaaactatag

SEQ ID NO: 25712 - DNA, 18 bp, synthetic construct
  source 1..18: mol_type = other DNA
tattaggtctcattatag

SEQ ID NO: 25713 - DNA, 18 bp, synthetic construct
  source 1..18: mol_type = other DNA
tattatgagttactatag

SEQ ID NO: 25714 - DNA, 18 bp, synthetic construct
  source 1..18: mol_type = other DNA
tattatgtctcaatatag

SEQ ID NO: 25715 - DNA, 18 bp, synthetic construct
  source 1..18: mol_type = other DNA
tcaaacgaatcactaaag

SEQ ID NO: 25716 - DNA, 18 bp, synthetic construct
  source 1..18: mol_type = other DNA
tcaaacgacacactaaag

SEQ ID NO: 25717 - DNA, 18 bp, synthetic construct
  source 1..18: mol_type = other DNA
tcaaactactgactatag

SEQ ID NO: 25718 - DNA, 18 bp, synthetic construct
  source 1..18: mol_type = other DNA
tcataacactcacaatag

SEQ ID NO: 25719 - DNA, 18 bp, synthetic construct
  source 1..18: mol_type = other DNA
tcataacactctctatag

SEQ ID NO: 25720 - DNA, 18 bp, synthetic construct
  source 1..18: mol_type = other DNA
tcataatcctcactatag

SEQ ID NO: 25721 - DNA, 18 bp, synthetic construct
  source 1..18: mol_type = other DNA
tcatacaactcacaacag

SEQ ID NO: 25722 - DNA, 18 bp, synthetic construct
  source 1..18: mol_type = other DNA
tcatacgaatcaccgtag

SEQ ID NO: 25723 - DNA, 18 bp, synthetic construct
  source 1..18: mol_type = other DNA
tcatacgactccctcgag

SEQ ID NO: 25724 - DNA, 18 bp, synthetic construct
  source 1..18: mol_type = other DNA
tcatacgattaaccatag

SEQ ID NO: 25725 - DNA, 18 bp, synthetic construct
  source 1..18: mol_type = other DNA
tcatacggatcactaaag

SEQ ID NO: 25726 - DNA, 18 bp, synthetic construct
  source 1..18: mol_type = other DNA
tcatacgtatctctatag

SEQ ID NO: 25727 - DNA, 18 bp, synthetic construct
  source 1..18: mol_type = other DNA
tcatacgtctacctatag

SEQ ID NO: 25728 - DNA, 18 bp, synthetic construct
  source 1..18: mol_type = other DNA
tcatacgtctcactcaag

SEQ ID NO: 25729 - DNA, 18 bp, synthetic construct
  source 1..18: mol_type = other DNA
tcatacgtctctctagag

SEQ ID NO: 25730 - DNA, 18 bp, synthetic construct
  source 1..18: mol_type = other DNA
tcatactacacactctag

SEQ ID NO: 25731 - DNA, 18 bp, synthetic construct
  source 1..18: mol_type = other DNA
tcatagcactcactacag

SEQ ID NO: 25732 - DNA, 18 bp, synthetic construct
  source 1..18: mol_type = other DNA
tcatatcactcacaatag

SEQ ID NO: 25733 - DNA, 18 bp, synthetic construct
  source 1..18: mol_type = other DNA
tcatccgactaacaatag

SEQ ID NO: 25734 - DNA, 18 bp, synthetic construct
  source 1..18: mol_type = other DNA
tcatccgtctcactttag

SEQ ID NO: 25735 - DNA, 18 bp, synthetic construct
  source 1..18: mol_type = other DNA
tcatgagactcactaaag

SEQ ID NO: 25736 - DNA, 18 bp, synthetic construct
  source 1..18: mol_type = other DNA
tcatgcgattcactaaag

SEQ ID NO: 25737 - DNA, 18 bp, synthetic construct
  source 1..18: mol_type = other DNA
tcatgcgcctcattatag

SEQ ID NO: 25738 - DNA, 18 bp, synthetic construct
  source 1..18: mol_type = other DNA
tcatgggactcactttag

SEQ ID NO: 25739 - DNA, 18 bp, synthetic construct
  source 1..18: mol_type = other DNA
tcctacgacacattatag

SEQ ID NO: 25740 - DNA, 18 bp, synthetic construct
  source 1..18: mol_type = other DNA
tcctacgactctctaaag

SEQ ID NO: 25741 - DNA, 18 bp, synthetic construct
  source 1..18: mol_type = other DNA
tcctacgattcacaatag

SEQ ID NO: 25742 - DNA, 18 bp, synthetic construct
  source 1..18: mol_type = other DNA
tcgtacgtctgactatag

SEQ ID NO: 25743 - DNA, 18 bp, synthetic construct
  source 1..18: mol_type = other DNA
tcttaccactcactatgg

SEQ ID NO: 25744 - DNA, 18 bp, synthetic construct
  source 1..18: mol_type = other DNA
tcttacctctcactatag

SEQ ID NO: 25745 - DNA, 18 bp, synthetic construct
  source 1..18: mol_type = other DNA
tcttacgacacaccatag

SEQ ID NO: 25746 - DNA, 18 bp, synthetic construct
  source 1..18: mol_type = other DNA
tcttacgactcactaacg

SEQ ID NO: 25747 - DNA, 18 bp, synthetic construct
  source 1..18: mol_type = other DNA
tcttacgattcactttag

SEQ ID NO: 25748 - DNA, 18 bp, synthetic construct
  source 1..18: mol_type = other DNA
tgaaaatactcactatag

SEQ ID NO: 25749 - DNA, 18 bp, synthetic construct
  source 1..18: mol_type = other DNA
tgaaacaactcactaaag

SEQ ID NO: 25750 - DNA, 18 bp, synthetic construct
  source 1..18: mol_type = other DNA
tgaaacgacacactctag

SEQ ID NO: 25751 - DNA, 18 bp, synthetic construct
  source 1..18: mol_type = other DNA
tgaaacgactaacaatag

SEQ ID NO: 25752 - DNA, 18 bp, synthetic construct
  source 1..18: mol_type = other DNA
tgaaacgatccactatag

SEQ ID NO: 25753 - DNA, 18 bp, synthetic construct
  source 1..18: mol_type = other DNA
tgaaacggctcattatag

SEQ ID NO: 25754 - DNA, 18 bp, synthetic construct
  source 1..18: mol_type = other DNA
tgacacgacgcactaaag

SEQ ID NO: 25755 - DNA, 18 bp, synthetic construct
  source 1..18: mol_type = other DNA
tgacgcgactcactagag

SEQ ID NO: 25756 - DNA, 18 bp, synthetic construct
  source 1..18: mol_type = other DNA
tgatacaaaacactatag

SEQ ID NO: 25757 - DNA, 18 bp, synthetic construct
  source 1..18: mol_type = other DNA
tgatacaactctctatgg

SEQ ID NO: 25758 - DNA, 18 bp, synthetic construct
  source 1..18: mol_type = other DNA
tgatacgacttacttaag

SEQ ID NO: 25759 - DNA, 18 bp, synthetic construct
  source 1..18: mol_type = other DNA
tgatacgcctctctttag

SEQ ID NO: 25760 - DNA, 18 bp, synthetic construct
  source 1..18: mol_type = other DNA
tgatacgtatcattatag

SEQ ID NO: 25761 - DNA, 18 bp, synthetic construct
  source 1..18: mol_type = other DNA
tgatacgtctcacttgag

SEQ ID NO: 25762 - DNA, 18 bp, synthetic construct
  source 1..18: mol_type = other DNA
tgatactactctgtatag

SEQ ID NO: 25763 - DNA, 18 bp, synthetic construct
  source 1..18: mol_type = other DNA
tgatccgactacctatag

SEQ ID NO: 25764 - DNA, 18 bp, synthetic construct
  source 1..18: mol_type = other DNA
tgatcgcactcactatag

SEQ ID NO: 25765 - DNA, 18 bp, synthetic construct
  source 1..18: mol_type = other DNA
tgcaacgactcattatag

SEQ ID NO: 25766 - DNA, 18 bp, synthetic construct
  source 1..18: mol_type = other DNA
tgttacgaattactatag

SEQ ID NO: 25767 - DNA, 18 bp, synthetic construct
  source 1..18: mol_type = other DNA
tgttacgactgactctag

SEQ ID NO: 25768 - DNA, 18 bp, synthetic construct
  source 1..18: mol_type = other DNA
tgttacgattcagtatag

SEQ ID NO: 25769 - DNA, 18 bp, synthetic construct
  source 1..18: mol_type = other DNA
ttaaaagaatcactatag

SEQ ID NO: 25770 - DNA, 18 bp, synthetic construct
  source 1..18: mol_type = other DNA
ttaaacgaatcaccatag

SEQ ID NO: 25771 - DNA, 18 bp, synthetic construct
  source 1..18: mol_type = other DNA
ttaaacgactcagtctag

SEQ ID NO: 25772 - DNA, 18 bp, synthetic construct
  source 1..18: mol_type = other DNA
ttaaacgactctctatgg

SEQ ID NO: 25773 - DNA, 18 bp, synthetic construct
  source 1..18: mol_type = other DNA
ttaaacgactctctgtag

SEQ ID NO: 25774 - DNA, 18 bp, synthetic construct
  source 1..18: mol_type = other DNA
ttaaacgattcactatgg

SEQ ID NO: 25775 - DNA, 18 bp, synthetic construct
  source 1..18: mol_type = other DNA
ttaacccactcactatag

SEQ ID NO: 25776 - DNA, 18 bp, synthetic construct
  source 1..18: mol_type = other DNA
ttaagcgattcactatag

SEQ ID NO: 25777 - DNA, 18 bp, synthetic construct
  source 1..18: mol_type = other DNA
ttacacgacacacaatag

SEQ ID NO: 25778 - DNA, 18 bp, synthetic construct
  source 1..18: mol_type = other DNA
ttacacgactctctatcg

SEQ ID NO: 25779 - DNA, 18 bp, synthetic construct
  source 1..18: mol_type = other DNA
ttacgcgactgactatag

SEQ ID NO: 25780 - DNA, 18 bp, synthetic construct
  source 1..18: mol_type = other DNA
ttataagacccactaaag

SEQ ID NO: 25781 - DNA, 18 bp, synthetic construct
  source 1..18: mol_type = other DNA
ttataagactcacaaaag

SEQ ID NO: 25782 - DNA, 18 bp, synthetic construct
  source 1..18: mol_type = other DNA
ttatacaaatccctatag

SEQ ID NO: 25783 - DNA, 18 bp, synthetic construct
  source 1..18: mol_type = other DNA
ttataccactccctaaag

SEQ ID NO: 25784 - DNA, 18 bp, synthetic construct
  source 1..18: mol_type = other DNA
ttatacgaatccctaaag

SEQ ID NO: 25785 - DNA, 18 bp, synthetic construct
  source 1..18: mol_type = other DNA
ttatacgacaacctatag

SEQ ID NO: 25786 - DNA, 18 bp, synthetic construct
  source 1..18: mol_type = other DNA
ttatacgacacaatatcg

SEQ ID NO: 25787 - DNA, 18 bp, synthetic construct
  source 1..18: mol_type = other DNA
ttatacgacacactaccg

SEQ ID NO: 25788 - DNA, 18 bp, synthetic construct
  source 1..18: mol_type = other DNA
ttatacgacccagaatag

SEQ ID NO: 25789 - DNA, 18 bp, synthetic construct
  source 1..18: mol_type = other DNA
ttatacgaccttctatag

SEQ ID NO: 25790 - DNA, 18 bp, synthetic construct
  source 1..18: mol_type = other DNA
ttatacgactaaccaaag

SEQ ID NO: 25791 - DNA, 18 bp, synthetic construct
  source 1..18: mol_type = other DNA
ttatacgactaactccag

SEQ ID NO: 25792 - DNA, 18 bp, synthetic construct
  source 1..18: mol_type = other DNA
ttatacgactcaacaaag

SEQ ID NO: 25793 - DNA, 18 bp, synthetic construct
  source 1..18: mol_type = other DNA
ttatacgacttacgatcg

SEQ ID NO: 25794 - DNA, 18 bp, synthetic construct
  source 1..18: mol_type = other DNA
ttatacgacttactttgg

SEQ ID NO: 25795 - DNA, 18 bp, synthetic construct
  source 1..18: mol_type = other DNA
ttatacgattccatatag

SEQ ID NO: 25796 - DNA, 18 bp, synthetic construct
  source 1..18: mol_type = other DNA
ttatacgcctgcctatag

SEQ ID NO: 25797 - DNA, 18 bp, synthetic construct
  source 1..18: mol_type = other DNA
ttatacggccgactatag

SEQ ID NO: 25798 - DNA, 18 bp, synthetic construct
  source 1..18: mol_type = other DNA
ttatacgtcacagtatag

SEQ ID NO: 25799 - DNA, 18 bp, synthetic construct
  source 1..18: mol_type = other DNA
ttatacgtctcactttgg

SEQ ID NO: 25800 - DNA, 18 bp, synthetic construct
  source 1..18: mol_type = other DNA
ttatacgtcttacgatag

SEQ ID NO: 25801 - DNA, 18 bp, synthetic construct
  source 1..18: mol_type = other DNA
ttatacgtttcactagag

SEQ ID NO: 25802 - DNA, 18 bp, synthetic construct
  source 1..18: mol_type = other DNA
ttatactactcatcatag

SEQ ID NO: 25803 - DNA, 18 bp, synthetic construct
  source 1..18: mol_type = other DNA
ttatactattcactacag

SEQ ID NO: 25804 - DNA, 18 bp, synthetic construct
  source 1..18: mol_type = other DNA
ttatagcactcacaatag

SEQ ID NO: 25805 - DNA, 18 bp, synthetic construct
  source 1..18: mol_type = other DNA
ttataggacgctctatag

SEQ ID NO: 25806 - DNA, 18 bp, synthetic construct
  source 1..18: mol_type = other DNA
ttatagtactcattatag

SEQ ID NO: 25807 - DNA, 18 bp, synthetic construct
  source 1..18: mol_type = other DNA
ttatatgactctttatag

SEQ ID NO: 25808 - DNA, 18 bp, synthetic construct
  source 1..18: mol_type = other DNA
ttatattacccactatag

SEQ ID NO: 25809 - DNA, 18 bp, synthetic construct
  source 1..18: mol_type = other DNA
ttatccgactccttatag

SEQ ID NO: 25810 - DNA, 18 bp, synthetic construct
  source 1..18: mol_type = other DNA
ttatcctactcaatatag

SEQ ID NO: 25811 - DNA, 18 bp, synthetic construct
  source 1..18: mol_type = other DNA
ttatctgactcactttag

SEQ ID NO: 25812 - DNA, 18 bp, synthetic construct
  source 1..18: mol_type = other DNA
ttatgccactcactttag

SEQ ID NO: 25813 - DNA, 18 bp, synthetic construct
  source 1..18: mol_type = other DNA
ttccacgactcactgtag

SEQ ID NO: 25814 - DNA, 18 bp, synthetic construct
  source 1..18: mol_type = other DNA
ttctacgaatcactttag

SEQ ID NO: 25815 - DNA, 18 bp, synthetic construct
  source 1..18: mol_type = other DNA
ttctactaatcactatag

SEQ ID NO: 25816 - DNA, 18 bp, synthetic construct
  source 1..18: mol_type = other DNA
ttctccgactcagtatag

SEQ ID NO: 25817 - DNA, 18 bp, synthetic construct
  source 1..18: mol_type = other DNA
ttgtacatctcactatag

SEQ ID NO: 25818 - DNA, 18 bp, synthetic construct
  source 1..18: mol_type = other DNA
ttgtacgactcaatacag

SEQ ID NO: 25819 - DNA, 18 bp, synthetic construct
  source 1..18: mol_type = other DNA
ttgtatgactctctatag

SEQ ID NO: 25820 - DNA, 18 bp, synthetic construct
  source 1..18: mol_type = other DNA
ttgtgcaactcactatag

SEQ ID NO: 25821 - DNA, 18 bp, synthetic construct
  source 1..18: mol_type = other DNA
tttaacgagtcactatag

SEQ ID NO: 25822 - DNA, 18 bp, synthetic construct
  source 1..18: mol_type = other DNA
ttttacgactcacaatcg

SEQ ID NO: 25823 - DNA, 18 bp, synthetic construct
  source 1..18: mol_type = other DNA
ttttacgactctctatgg

SEQ ID NO: 25824 - DNA, 18 bp, synthetic construct
  source 1..18: mol_type = other DNA
taatacgactctcttatg

SEQ ID NO: 25825 - DNA, 18 bp, synthetic construct
  source 1..18: mol_type = other DNA
taattagactcactaatg

SEQ ID NO: 25826 - DNA, 18 bp, synthetic construct
  source 1..18: mol_type = other DNA
taattcgactcaccaatg

SEQ ID NO: 25827 - DNA, 18 bp, synthetic construct
  source 1..18: mol_type = other DNA
aaataccactcacaattg

SEQ ID NO: 25828 - DNA, 18 bp, synthetic construct
  source 1..18: mol_type = other DNA
ctattcgacacactatag

SEQ ID NO: 25829 - DNA, 18 bp, synthetic construct
  source 1..18: mol_type = other DNA
taaatctactccctatag

SEQ ID NO: 25830 - DNA, 18 bp, synthetic construct
  source 1..18: mol_type = other DNA
taatacatctcagtattg

SEQ ID NO: 25831 - DNA, 18 bp, synthetic construct
  source 1..18: mol_type = other DNA
taatacgaatcatttttg

SEQ ID NO: 25832 - DNA, 18 bp, synthetic construct
  source 1..18: mol_type = other DNA
taatacgatccactaatg

SEQ ID NO: 25833 - DNA, 18 bp, synthetic construct
  source 1..18: mol_type = other DNA
taattcgtcttactaaag

SEQ ID NO: 25834 - DNA, 18 bp, synthetic construct
  source 1..18: mol_type = other DNA
tataacgaatcactattg

SEQ ID NO: 25835 - DNA, 18 bp, synthetic construct
  source 1..18: mol_type = other DNA
tatttcgattcacaatag

SEQ ID NO: 25836 - DNA, 18 bp, synthetic construct
  source 1..18: mol_type = other DNA
atatacgactcaccaaag

SEQ ID NO: 25837 - DNA, 18 bp, synthetic construct
  source 1..18: mol_type = other DNA
atatacgagtcactgtag

SEQ ID NO: 25838 - DNA, 18 bp, synthetic construct
  source 1..18: mol_type = other DNA
ctatacgtctctctatag

SEQ ID NO: 25839 - DNA, 18 bp, synthetic construct
  source 1..18: mol_type = other DNA
taatacatcaaactatag

SEQ ID NO: 25840 - DNA, 18 bp, synthetic construct
  source 1..18: mol_type = other DNA
taatacgacaaacattag

SEQ ID NO: 25841 - DNA, 18 bp, synthetic construct
  source 1..18: mol_type = other DNA
taatacgtttcaataaag

SEQ ID NO: 25842 - DNA, 18 bp, synthetic construct
  source 1..18: mol_type = other DNA
tatcacgactctctttag

SEQ ID NO: 25843 - DNA, 18 bp, synthetic construct
  source 1..18: mol_type = other DNA
tattactactccctaaag

SEQ ID NO: 25844 - DNA, 18 bp, synthetic construct
  source 1..18: mol_type = other DNA
ttatacgactcaaattag

SEQ ID NO: 25845 - DNA, 18 bp, synthetic construct
  source 1..18: mol_type = other DNA
taatacgtcactctattg

SEQ ID NO: 25846 - DNA, 18 bp, synthetic construct
  source 1..18: mol_type = other DNA
taattcgactcgttaaag

SEQ ID NO: 25847 - DNA, 18 bp, synthetic construct
  source 1..18: mol_type = other DNA
taattcgactgtctattg

SEQ ID NO: 25848 - DNA, 18 bp, synthetic construct
  source 1..18: mol_type = other DNA
taattcgagtctctattg

SEQ ID NO: 25849 - DNA, 18 bp, synthetic construct
  source 1..18: mol_type = other DNA
aaatattactcactattg

SEQ ID NO: 25850 - DNA, 18 bp, synthetic construct
  source 1..18: mol_type = other DNA
caatacgaatcacaattg

SEQ ID NO: 25851 - DNA, 18 bp, synthetic construct
  source 1..18: mol_type = other DNA
ctatacgattcgctatag

SEQ ID NO: 25852 - DNA, 18 bp, synthetic construct
  source 1..18: mol_type = other DNA
taaaacgagtcattattg

SEQ ID NO: 25853 - DNA, 18 bp, synthetic construct
  source 1..18: mol_type = other DNA
taataccaatcactgttg

SEQ ID NO: 25854 - DNA, 18 bp, synthetic construct
  source 1..18: mol_type = other DNA
taatacgacttataattg

SEQ ID NO: 25855 - DNA, 18 bp, synthetic construct
  source 1..18: mol_type = other DNA
taataggtctctctattg

SEQ ID NO: 25856 - DNA, 18 bp, synthetic construct
  source 1..18: mol_type = other DNA
taattcgaatcacttcag

SEQ ID NO: 25857 - DNA, 18 bp, synthetic construct
  source 1..18: mol_type = other DNA
taattcgaatctatatag

SEQ ID NO: 25858 - DNA, 18 bp, synthetic construct
  source 1..18: mol_type = other DNA
taattcgactcacaaacg

SEQ ID NO: 25859 - DNA, 18 bp, synthetic construct
  source 1..18: mol_type = other DNA
taattcgattcactgaag

SEQ ID NO: 25860 - DNA, 18 bp, synthetic construct
  source 1..18: mol_type = other DNA
taattcgtctcacaatgg

SEQ ID NO: 25861 - DNA, 18 bp, synthetic construct
  source 1..18: mol_type = other DNA
tacatcgactctctatag

SEQ ID NO: 25862 - DNA, 18 bp, synthetic construct
  source 1..18: mol_type = other DNA
tactaagattcactattg

SEQ ID NO: 25863 - DNA, 18 bp, synthetic construct
  source 1..18: mol_type = other DNA
tataacgacccactattg

SEQ ID NO: 25864 - DNA, 18 bp, synthetic construct
  source 1..18: mol_type = other DNA
tattacgacacacttttg

SEQ ID NO: 25865 - DNA, 18 bp, synthetic construct
  source 1..18: mol_type = other DNA
tattttgacttactatag

SEQ ID NO: 25866 - DNA, 18 bp, synthetic construct
  source 1..18: mol_type = other DNA
ttaaacgaatcactattg

SEQ ID NO: 25867 - DNA, 18 bp, synthetic construct
  source 1..18: mol_type = other DNA
ttatacgacacgttatag

SEQ ID NO: 25868 - DNA, 18 bp, synthetic construct
  source 1..18: mol_type = other DNA
ttattcaacacactatag

SEQ ID NO: 25869 - DNA, 18 bp, synthetic construct
  source 1..18: mol_type = other DNA
ttattcgactcataatag

SEQ ID NO: 25870 - DNA, 18 bp, synthetic construct
  source 1..18: mol_type = other DNA
ttctacgactcactagtg

SEQ ID NO: 25871 - DNA, 18 bp, synthetic construct
  source 1..18: mol_type = other DNA
aaaaaagattcactatag

SEQ ID NO: 25872 - DNA, 18 bp, synthetic construct
  source 1..18: mol_type = other DNA
aaatacatctcactttag

SEQ ID NO: 25873 - DNA, 18 bp, synthetic construct
  source 1..18: mol_type = other DNA
aaatacgaccctttatag

SEQ ID NO: 25874 - DNA, 18 bp, synthetic construct
  source 1..18: mol_type = other DNA
aaatactcctcacaatag

SEQ ID NO: 25875 - DNA, 18 bp, synthetic construct
  source 1..18: mol_type = other DNA
aactaggactcactatcg

SEQ ID NO: 25876 - DNA, 18 bp, synthetic construct
  source 1..18: mol_type = other DNA
acatacgactcagtacag

SEQ ID NO: 25877 - DNA, 18 bp, synthetic construct
  source 1..18: mol_type = other DNA
ataaacgactccctatag

SEQ ID NO: 25878 - DNA, 18 bp, synthetic construct
  source 1..18: mol_type = other DNA
atatacaaatcactatag

SEQ ID NO: 25879 - DNA, 18 bp, synthetic construct
  source 1..18: mol_type = other DNA
atatatgacacactatag

SEQ ID NO: 25880 - DNA, 18 bp, synthetic construct
  source 1..18: mol_type = other DNA
caaaacaactcattatag

SEQ ID NO: 25881 - DNA, 18 bp, synthetic construct
  source 1..18: mol_type = other DNA
caatacgaatcacaacag

SEQ ID NO: 25882 - DNA, 18 bp, synthetic construct
  source 1..18: mol_type = other DNA
ctatacgacacacaatag

SEQ ID NO: 25883 - DNA, 18 bp, synthetic construct
  source 1..18: mol_type = other DNA
taaaacgactgaatctag

SEQ ID NO: 25884 - DNA, 18 bp, synthetic construct
  source 1..18: mol_type = other DNA
taaaacgtctcccaatag

SEQ ID NO: 25885 - DNA, 18 bp, synthetic construct
  source 1..18: mol_type = other DNA
taaaactattcactttag

SEQ ID NO: 25886 - DNA, 18 bp, synthetic construct
  source 1..18: mol_type = other DNA
taataagtcacactaaag

SEQ ID NO: 25887 - DNA, 18 bp, synthetic construct
  source 1..18: mol_type = other DNA
taataagtctctcaatag

SEQ ID NO: 25888 - DNA, 18 bp, synthetic construct
  source 1..18: mol_type = other DNA
taataagtcttactaaag

SEQ ID NO: 25889 - DNA, 18 bp, synthetic construct
  source 1..18: mol_type = other DNA
taatacaacagactgtag

SEQ ID NO: 25890 - DNA, 18 bp, synthetic construct
  source 1..18: mol_type = other DNA
taatacaactaaatttag

SEQ ID NO: 25891 - DNA, 18 bp, synthetic construct
  source 1..18: mol_type = other DNA
taatacatctcactttcg

SEQ ID NO: 25892 - DNA, 18 bp, synthetic construct
  source 1..18: mol_type = other DNA
taataccattctctctag

SEQ ID NO: 25893 - DNA, 18 bp, synthetic construct
  source 1..18: mol_type = other DNA
taatacctcacaatatag

SEQ ID NO: 25894 - DNA, 18 bp, synthetic construct
  source 1..18: mol_type = other DNA
taatacgacacataatcg

SEQ ID NO: 25895 - DNA, 18 bp, synthetic construct
  source 1..18: mol_type = other DNA
taatacgagtcataaaag

SEQ ID NO: 25896 - DNA, 18 bp, synthetic construct
  source 1..18: mol_type = other DNA
taatacgattcccagtag

SEQ ID NO: 25897 - DNA, 18 bp, synthetic construct
  source 1..18: mol_type = other DNA
taatacgctccactttag

SEQ ID NO: 25898 - DNA, 18 bp, synthetic construct
  source 1..18: mol_type = other DNA
taatacgtgtcaaaatag

SEQ ID NO: 25899 - DNA, 18 bp, synthetic construct
  source 1..18: mol_type = other DNA
taatacttctcattttag

SEQ ID NO: 25900 - DNA, 18 bp, synthetic construct
  source 1..18: mol_type = other DNA
taatacttgtctctatag

SEQ ID NO: 25901 - DNA, 18 bp, synthetic construct
  source 1..18: mol_type = other DNA
taatatgactaattaaag

SEQ ID NO: 25902 - DNA, 18 bp, synthetic construct
  source 1..18: mol_type = other DNA
taccatgactcactaaag

SEQ ID NO: 25903 - DNA, 18 bp, synthetic construct
  source 1..18: mol_type = other DNA
tagaacgtatcactatag

SEQ ID NO: 25904 - DNA, 18 bp, synthetic construct
  source 1..18: mol_type = other DNA
tagtacgacacacattag

SEQ ID NO: 25905 - DNA, 18 bp, synthetic construct
  source 1..18: mol_type = other DNA
tataccgacacactatag

SEQ ID NO: 25906 - DNA, 18 bp, synthetic construct
  source 1..18: mol_type = other DNA
tattacaactcaatttag

SEQ ID NO: 25907 - DNA, 18 bp, synthetic construct
  source 1..18: mol_type = other DNA
tattaccactttctatag

SEQ ID NO: 25908 - DNA, 18 bp, synthetic construct
  source 1..18: mol_type = other DNA
tattacgactaactaagg

SEQ ID NO: 25909 - DNA, 18 bp, synthetic construct
  source 1..18: mol_type = other DNA
tattacgactcaccaagg

SEQ ID NO: 25910 - DNA, 18 bp, synthetic construct
  source 1..18: mol_type = other DNA
tattacggcatactatag

SEQ ID NO: 25911 - DNA, 18 bp, synthetic construct
  source 1..18: mol_type = other DNA
tattgctactcactaaag

SEQ ID NO: 25912 - DNA, 18 bp, synthetic construct
  source 1..18: mol_type = other DNA
tgatgcgacccactttag

SEQ ID NO: 25913 - DNA, 18 bp, synthetic construct
  source 1..18: mol_type = other DNA
tgatgcgactaattatag

SEQ ID NO: 25914 - DNA, 18 bp, synthetic construct
  source 1..18: mol_type = other DNA
tgtaacgactcattatag

SEQ ID NO: 25915 - DNA, 18 bp, synthetic construct
  source 1..18: mol_type = other DNA
ttaaacaaatcactatag

SEQ ID NO: 25916 - DNA, 18 bp, synthetic construct
  source 1..18: mol_type = other DNA
ttatacgtctcagtaaag

SEQ ID NO: 25917 - DNA, 18 bp, synthetic construct
  source 1..18: mol_type = other DNA
ttatacgtctccttatag

SEQ ID NO: 25918 - DNA, 18 bp, synthetic construct
  source 1..18: mol_type = other DNA
ttatactactctctctag

SEQ ID NO: 25919 - DNA, 18 bp, synthetic construct
  source 1..18: mol_type = other DNA
ttataggacacactaaag

SEQ ID NO: 25920 - DNA, 18 bp, synthetic construct
  source 1..18: mol_type = other DNA
ttatatgactaacaatag

SEQ ID NO: 25921 - DNA, 18 bp, synthetic construct
  source 1..18: mol_type = other DNA
ttatatgactccctaaag

SEQ ID NO: 25922 - DNA, 18 bp, synthetic construct
  source 1..18: mol_type = other DNA
ttatatgcctcacaatag

SEQ ID NO: 25923 - DNA, 18 bp, synthetic construct
  source 1..18: mol_type = other DNA
ttttccgagtcactatag

SEQ ID NO: 25924 - DNA, 18 bp, synthetic construct
  source 1..18: mol_type = other DNA
tttaacgactcactaaag

SEQ ID NO: 25925 - DNA, 18 bp, synthetic construct
  source 1..18: mol_type = other DNA
taattcgtctcactaatg

SEQ ID NO: 25926 - DNA, 18 bp, synthetic construct
  source 1..18: mol_type = other DNA
agatacgtctcactattg

SEQ ID NO: 25927 - DNA, 18 bp, synthetic construct
  source 1..18: mol_type = other DNA
tatcaagactcgctatag

SEQ ID NO: 25928 - DNA, 18 bp, synthetic construct
  source 1..18: mol_type = other DNA
aattacgactcacttaag

SEQ ID NO: 25929 - DNA, 18 bp, synthetic construct
  source 1..18: mol_type = other DNA
ataaaggactcactatag

SEQ ID NO: 25930 - DNA, 18 bp, synthetic construct
  source 1..18: mol_type = other DNA
taatacgacactataaag

SEQ ID NO: 25931 - DNA, 18 bp, synthetic construct
  source 1..18: mol_type = other DNA
taatcagactcactcaag

SEQ ID NO: 25932 - DNA, 18 bp, synthetic construct
  source 1..18: mol_type = other DNA
tattatgactctcaatag

SEQ ID NO: 25933 - DNA, 18 bp, synthetic construct
  source 1..18: mol_type = other DNA
ttatacgtcttacaatag

SEQ ID NO: 25934 - DNA, 18 bp, synthetic construct
  source 1..18: mol_type = other DNA
aaatacaactcaatttag

SEQ ID NO: 25935 - DNA, 18 bp, synthetic construct
  source 1..18: mol_type = other DNA
aaatacgactttctttag

SEQ ID NO: 25936 - DNA, 18 bp, synthetic construct
  source 1..18: mol_type = other DNA
taatacttcttactttag

SEQ ID NO: 25937 - DNA, 18 bp, synthetic construct
  source 1..18: mol_type = other DNA
atatacgactcataatag

SEQ ID NO: 25938 - DNA, 18 bp, synthetic construct
  source 1..18: mol_type = other DNA
atttacgactctctatag

SEQ ID NO: 25939 - DNA, 18 bp, synthetic construct
  source 1..18: mol_type = other DNA
taatacgtctctcttaag

SEQ ID NO: 25940 - DNA, 18 bp, synthetic construct
  source 1..18: mol_type = other DNA
ttatacgactctatttag

SEQ ID NO: 25941 - DNA, 18 bp, synthetic construct
  source 1..18: mol_type = other DNA
atatacgacttacaatag

SEQ ID NO: 25942 - DNA, 18 bp, synthetic construct
  source 1..18: mol_type = other DNA
aaattcgactagctatag

SEQ ID NO: 25943 - DNA, 18 bp, synthetic construct
  source 1..18: mol_type = other DNA
taaattgactcgctatag

SEQ ID NO: 25944 - DNA, 18 bp, synthetic construct
  source 1..18: mol_type = other DNA
taattagcctcactattg

SEQ ID NO: 25945 - DNA, 18 bp, synthetic construct
  source 1..18: mol_type = other DNA
taattcaactcacaattg

SEQ ID NO: 25946 - DNA, 18 bp, synthetic construct
  source 1..18: mol_type = other DNA
taattcgaatcacttttg

SEQ ID NO: 25947 - DNA, 18 bp, synthetic construct
  source 1..18: mol_type = other DNA
taattcgactcagtcttg

SEQ ID NO: 25948 - DNA, 18 bp, synthetic construct
  source 1..18: mol_type = other DNA
taattcgactcattgttg

SEQ ID NO: 25949 - DNA, 18 bp, synthetic construct
  source 1..18: mol_type = other DNA
taattcgactcgaaatag

SEQ ID NO: 25950 - DNA, 18 bp, synthetic construct
  source 1..18: mol_type = other DNA
taattcgactcgcattag

SEQ ID NO: 25951 - DNA, 18 bp, synthetic construct
  source 1..18: mol_type = other DNA
taattcgacttaatattg

SEQ ID NO: 25952 - DNA, 18 bp, synthetic construct
  source 1..18: mol_type = other DNA
taattcgacttactactg

SEQ ID NO: 25953 - DNA, 18 bp, synthetic construct
  source 1..18: mol_type = other DNA
taattcgcctccctattg

SEQ ID NO: 25954 - DNA, 18 bp, synthetic construct
  source 1..18: mol_type = other DNA
tagctcgactcactattg

SEQ ID NO: 25955 - DNA, 18 bp, synthetic construct
  source 1..18: mol_type = other DNA
ttatactactcgctattg

SEQ ID NO: 25956 - DNA, 18 bp, synthetic construct
  source 1..18: mol_type = other DNA
aaataagacacgctatag

SEQ ID NO: 25957 - DNA, 18 bp, synthetic construct
  source 1..18: mol_type = other DNA
aaataagactcattattg

SEQ ID NO: 25958 - DNA, 18 bp, synthetic construct
  source 1..18: mol_type = other DNA
aaataagactcgctaaag

SEQ ID NO: 25959 - DNA, 18 bp, synthetic construct
  source 1..18: mol_type = other DNA
aaataccactcacgattg

SEQ ID NO: 25960 - DNA, 18 bp, synthetic construct
  source 1..18: mol_type = other DNA
aaatacgactatctattg

SEQ ID NO: 25961 - DNA, 18 bp, synthetic construct
  source 1..18: mol_type = other DNA
aaatacgactcacgtttg

SEQ ID NO: 25962 - DNA, 18 bp, synthetic construct
  source 1..18: mol_type = other DNA
aaatacgtctcgctttag

SEQ ID NO: 25963 - DNA, 18 bp, synthetic construct
  source 1..18: mol_type = other DNA
aaattagtctcactatag

SEQ ID NO: 25964 - DNA, 18 bp, synthetic construct
  source 1..18: mol_type = other DNA
aaattccactaactatag

SEQ ID NO: 25965 - DNA, 18 bp, synthetic construct
  source 1..18: mol_type = other DNA
aaattccactcacaatag

SEQ ID NO: 25966 - DNA, 18 bp, synthetic construct
  source 1..18: mol_type = other DNA
aaattcggttcactatag

SEQ ID NO: 25967 - DNA, 18 bp, synthetic construct
  source 1..18: mol_type = other DNA
aattacgactagctatag

SEQ ID NO: 25968 - DNA, 18 bp, synthetic construct
  source 1..18: mol_type = other DNA
acatgcgactcgctatag

SEQ ID NO: 25969 - DNA, 18 bp, synthetic construct
  source 1..18: mol_type = other DNA
agattcgactcaatatag

SEQ ID NO: 25970 - DNA, 18 bp, synthetic construct
  source 1..18: mol_type = other DNA
caactagactcactatag

SEQ ID NO: 25971 - DNA, 18 bp, synthetic construct
  source 1..18: mol_type = other DNA
caatacgacatgctatag

SEQ ID NO: 25972 - DNA, 18 bp, synthetic construct
  source 1..18: mol_type = other DNA
caattcaactcactaaag

SEQ ID NO: 25973 - DNA, 18 bp, synthetic construct
  source 1..18: mol_type = other DNA
caattcgaaacactatag

SEQ ID NO: 25974 - DNA, 18 bp, synthetic construct
  source 1..18: mol_type = other DNA
caattcgatacactatag

SEQ ID NO: 25975 - DNA, 18 bp, synthetic construct
  source 1..18: mol_type = other DNA
caattcgtctctctatag

SEQ ID NO: 25976 - DNA, 18 bp, synthetic construct
  source 1..18: mol_type = other DNA
caattctactaactatag

SEQ ID NO: 25977 - DNA, 18 bp, synthetic construct
  source 1..18: mol_type = other DNA
cacttcgtctcactatag

SEQ ID NO: 25978 - DNA, 18 bp, synthetic construct
  source 1..18: mol_type = other DNA
cgatacgactcgccatag

SEQ ID NO: 25979 - DNA, 18 bp, synthetic construct
  source 1..18: mol_type = other DNA
ctataggactcactattg

SEQ ID NO: 25980 - DNA, 18 bp, synthetic construct
  source 1..18: mol_type = other DNA
taaaaagactcacaattg

SEQ ID NO: 25981 - DNA, 18 bp, synthetic construct
  source 1..18: mol_type = other DNA
taaaaccacacactattg

SEQ ID NO: 25982 - DNA, 18 bp, synthetic construct
  source 1..18: mol_type = other DNA
taaaacggctcgctacag

SEQ ID NO: 25983 - DNA, 18 bp, synthetic construct
  source 1..18: mol_type = other DNA
taaatccactcacaatag

SEQ ID NO: 25984 - DNA, 18 bp, synthetic construct
  source 1..18: mol_type = other DNA
taaatcgactcacaatgg

SEQ ID NO: 25985 - DNA, 18 bp, synthetic construct
  source 1..18: mol_type = other DNA
taaatcgtctcaatatag

SEQ ID NO: 25986 - DNA, 18 bp, synthetic construct
  source 1..18: mol_type = other DNA
taacacgaaacgctatag

SEQ ID NO: 25987 - DNA, 18 bp, synthetic construct
  source 1..18: mol_type = other DNA
taactagaatcactatag

SEQ ID NO: 25988 - DNA, 18 bp, synthetic construct
  source 1..18: mol_type = other DNA
taactcatctcactatag

SEQ ID NO: 25989 - DNA, 18 bp, synthetic construct
  source 1..18: mol_type = other DNA
taactcgactgactttag

SEQ ID NO: 25990 - DNA, 18 bp, synthetic construct
  source 1..18: mol_type = other DNA
taagacgacccgctttag

SEQ ID NO: 25991 - DNA, 18 bp, synthetic construct
  source 1..18: mol_type = other DNA
taagtggacacactatag

SEQ ID NO: 25992 - DNA, 18 bp, synthetic construct
  source 1..18: mol_type = other DNA
taataagacgcacaattg

SEQ ID NO: 25993 - DNA, 18 bp, synthetic construct
  source 1..18: mol_type = other DNA
taataagactctcgattg

SEQ ID NO: 25994 - DNA, 18 bp, synthetic construct
  source 1..18: mol_type = other DNA
taatacaactatctattg

SEQ ID NO: 25995 - DNA, 18 bp, synthetic construct
  source 1..18: mol_type = other DNA
taatacagctcacttttg

SEQ ID NO: 25996 - DNA, 18 bp, synthetic construct
  source 1..18: mol_type = other DNA
taataccactcacaagtg

SEQ ID NO: 25997 - DNA, 18 bp, synthetic construct
  source 1..18: mol_type = other DNA
taataccagtcaatattg

SEQ ID NO: 25998 - DNA, 18 bp, synthetic construct
  source 1..18: mol_type = other DNA
taataccgctcattattg

SEQ ID NO: 25999 - DNA, 18 bp, synthetic construct
  source 1..18: mol_type = other DNA
taatacgaaatactattg

SEQ ID NO: 26000 - DNA, 18 bp, synthetic construct
  source 1..18: mol_type = other DNA
taatacgaatcacttctg

SEQ ID NO: 26001 - DNA, 18 bp, synthetic construct
  source 1..18: mol_type = other DNA
taatacgactcattcctg

SEQ ID NO: 26002 - DNA, 18 bp, synthetic construct
  source 1..18: mol_type = other DNA
taatacgactcgcatgag

SEQ ID NO: 26003 - DNA, 18 bp, synthetic construct
  source 1..18: mol_type = other DNA
taatacgacttaatagtg

SEQ ID NO: 26004 - DNA, 18 bp, synthetic construct
  source 1..18: mol_type = other DNA
taatacgacttatcattg

SEQ ID NO: 26005 - DNA, 18 bp, synthetic construct
  source 1..18: mol_type = other DNA
taatacgacttccttttg

SEQ ID NO: 26006 - DNA, 18 bp, synthetic construct
  source 1..18: mol_type = other DNA
taatacgagtctctgttg

SEQ ID NO: 26007 - DNA, 18 bp, synthetic construct
  source 1..18: mol_type = other DNA
taatacgcataactattg

SEQ ID NO: 26008 - DNA, 18 bp, synthetic construct
  source 1..18: mol_type = other DNA
taatacgccacactcttg

SEQ ID NO: 26009 - DNA, 18 bp, synthetic construct
  source 1..18: mol_type = other DNA
taatacgcctcaataatg

SEQ ID NO: 26010 - DNA, 18 bp, synthetic construct
  source 1..18: mol_type = other DNA
taatacgcttcacttttg

SEQ ID NO: 26011 - DNA, 18 bp, synthetic construct
  source 1..18: mol_type = other DNA
taatacgcttctctattg

SEQ ID NO: 26012 - DNA, 18 bp, synthetic construct
  source 1..18: mol_type = other DNA
taatacgtctagcaatag

SEQ ID NO: 26013 - DNA, 18 bp, synthetic construct
  source 1..18: mol_type = other DNA
taatactacccacttttg

SEQ ID NO: 26014 - DNA, 18 bp, synthetic construct
  source 1..18: mol_type = other DNA
taatactactctgtattg

SEQ ID NO: 26015 - DNA, 18 bp, synthetic construct
  source 1..18: mol_type = other DNA
taatactcctcaccattg

SEQ ID NO: 26016 - DNA, 18 bp, synthetic construct
  source 1..18: mol_type = other DNA
taataggtcacactattg

SEQ ID NO: 26017 - DNA, 18 bp, synthetic construct
  source 1..18: mol_type = other DNA
taatagtactctctattg

SEQ ID NO: 26018 - DNA, 18 bp, synthetic construct
  source 1..18: mol_type = other DNA
taatatcactaactattg

SEQ ID NO: 26019 - DNA, 18 bp, synthetic construct
  source 1..18: mol_type = other DNA
taatatcacttactattg

SEQ ID NO: 26020 - DNA, 18 bp, synthetic construct
  source 1..18: mol_type = other DNA
taatatgactaactaatg

SEQ ID NO: 26021 - DNA, 18 bp, synthetic construct
  source 1..18: mol_type = other DNA
taatatgagtcactcttg

SEQ ID NO: 26022 - DNA, 18 bp, synthetic construct
  source 1..18: mol_type = other DNA
taatattacgcgctatag

SEQ ID NO: 26023 - DNA, 18 bp, synthetic construct
  source 1..18: mol_type = other DNA
taatattactaactattg

SEQ ID NO: 26024 - DNA, 18 bp, synthetic construct
  source 1..18: mol_type = other DNA
taatcagactcactcttg

SEQ ID NO: 26025 - DNA, 18 bp, synthetic construct
  source 1..18: mol_type = other DNA
taatcccacacactattg

SEQ ID NO: 26026 - DNA, 18 bp, synthetic construct
  source 1..18: mol_type = other DNA
taatccgactaacttttg

SEQ ID NO: 26027 - DNA, 18 bp, synthetic construct
  source 1..18: mol_type = other DNA
taatccgtctcgcaatag

SEQ ID NO: 26028 - DNA, 18 bp, synthetic construct
  source 1..18: mol_type = other DNA
taatctaactcactattg

SEQ ID NO: 26029 - DNA, 18 bp, synthetic construct
  source 1..18: mol_type = other DNA
taatgccactcgctctag

SEQ ID NO: 26030 - DNA, 18 bp, synthetic construct
  source 1..18: mol_type = other DNA
taatgcgattcacttttg

SEQ ID NO: 26031 - DNA, 18 bp, synthetic construct
  source 1..18: mol_type = other DNA
taatgctagtcgctatag

SEQ ID NO: 26032 - DNA, 18 bp, synthetic construct
  source 1..18: mol_type = other DNA
taattagactcacgatcg

SEQ ID NO: 26033 - DNA, 18 bp, synthetic construct
  source 1..18: mol_type = other DNA
taattagcatcactatag

SEQ ID NO: 26034 - DNA, 18 bp, synthetic construct
  source 1..18: mol_type = other DNA
taattagtctctctatag

SEQ ID NO: 26035 - DNA, 18 bp, synthetic construct
  source 1..18: mol_type = other DNA
taattcaactctctagag

SEQ ID NO: 26036 - DNA, 18 bp, synthetic construct
  source 1..18: mol_type = other DNA
taattcatcacactatag

SEQ ID NO: 26037 - DNA, 18 bp, synthetic construct
  source 1..18: mol_type = other DNA
taattccacacagtatag

SEQ ID NO: 26038 - DNA, 18 bp, synthetic construct
  source 1..18: mol_type = other DNA
taattcgaagcactaaag

SEQ ID NO: 26039 - DNA, 18 bp, synthetic construct
  source 1..18: mol_type = other DNA
taattcgaatcaataaag

SEQ ID NO: 26040 - DNA, 18 bp, synthetic construct
  source 1..18: mol_type = other DNA
taattcgacacccaatag

SEQ ID NO: 26041 - DNA, 18 bp, synthetic construct
  source 1..18: mol_type = other DNA
taattcgacccacttaag

SEQ ID NO: 26042 - DNA, 18 bp, synthetic construct
  source 1..18: mol_type = other DNA
taattcgacctactacag

SEQ ID NO: 26043 - DNA, 18 bp, synthetic construct
  source 1..18: mol_type = other DNA
taattcgactccatgtag

SEQ ID NO: 26044 - DNA, 18 bp, synthetic construct
  source 1..18: mol_type = other DNA
taattcgagacaatatag

SEQ ID NO: 26045 - DNA, 18 bp, synthetic construct
  source 1..18: mol_type = other DNA
taattcgattaactttag

SEQ ID NO: 26046 - DNA, 18 bp, synthetic construct
  source 1..18: mol_type = other DNA
taattcgattccatatag

SEQ ID NO: 26047 - DNA, 18 bp, synthetic construct
  source 1..18: mol_type = other DNA
taattcgattctccatag

SEQ ID NO: 26048 - DNA, 18 bp, synthetic construct
  source 1..18: mol_type = other DNA
taattcggctcacttcag

SEQ ID NO: 26049 - DNA, 18 bp, synthetic construct
  source 1..18: mol_type = other DNA
taattcgtctcactgtgg

SEQ ID NO: 26050 - DNA, 18 bp, synthetic construct
  source 1..18: mol_type = other DNA
taattcgtcttcctatag

SEQ ID NO: 26051 - DNA, 18 bp, synthetic construct
  source 1..18: mol_type = other DNA
taattctactcactgaag

SEQ ID NO: 26052 - DNA, 18 bp, synthetic construct
  source 1..18: mol_type = other DNA
taattctagtcattatag

SEQ ID NO: 26053 - DNA, 18 bp, synthetic construct
  source 1..18: mol_type = other DNA
taattctattcactgtag

SEQ ID NO: 26054 - DNA, 18 bp, synthetic construct
  source 1..18: mol_type = other DNA
taattggactcactaagg

SEQ ID NO: 26055 - DNA, 18 bp, synthetic construct
  source 1..18: mol_type = other DNA
tacaacgtctcgctatag

SEQ ID NO: 26056 - DNA, 18 bp, synthetic construct
  source 1..18: mol_type = other DNA
tactacacctcactattg

SEQ ID NO: 26057 - DNA, 18 bp, synthetic construct
  source 1..18: mol_type = other DNA
tactacgactcggtaaag

SEQ ID NO: 26058 - DNA, 18 bp, synthetic construct
  source 1..18: mol_type = other DNA
tacttcgacacaatatag

SEQ ID NO: 26059 - DNA, 18 bp, synthetic construct
  source 1..18: mol_type = other DNA
tacttcgacgaactatag

SEQ ID NO: 26060 - DNA, 18 bp, synthetic construct
  source 1..18: mol_type = other DNA
tacttcgactcaatttag

SEQ ID NO: 26061 - DNA, 18 bp, synthetic construct
  source 1..18: mol_type = other DNA
tacttcgactccttatag

SEQ ID NO: 26062 - DNA, 18 bp, synthetic construct
  source 1..18: mol_type = other DNA
tacttcgtctaactatag

SEQ ID NO: 26063 - DNA, 18 bp, synthetic construct
  source 1..18: mol_type = other DNA
tacttcgtctcacaatag

SEQ ID NO: 26064 - DNA, 18 bp, synthetic construct
  source 1..18: mol_type = other DNA
tagtacaactcactgttg

SEQ ID NO: 26065 - DNA, 18 bp, synthetic construct
  source 1..18: mol_type = other DNA
tagtacaactcacttttg

SEQ ID NO: 26066 - DNA, 18 bp, synthetic construct
  source 1..18: mol_type = other DNA
tagtacgactcatcattg

SEQ ID NO: 26067 - DNA, 18 bp, synthetic construct
  source 1..18: mol_type = other DNA
tagtacgactcgcttcag

SEQ ID NO: 26068 - DNA, 18 bp, synthetic construct
  source 1..18: mol_type = other DNA
tagtactactcgctctag

SEQ ID NO: 26069 - DNA, 18 bp, synthetic construct
  source 1..18: mol_type = other DNA
tagttcttctcactatag

SEQ ID NO: 26070 - DNA, 18 bp, synthetic construct
  source 1..18: mol_type = other DNA
tattacaactcgctagag

SEQ ID NO: 26071 - DNA, 18 bp, synthetic construct
  source 1..18: mol_type = other DNA
tattacaactgactattg

SEQ ID NO: 26072 - DNA, 18 bp, synthetic construct
  source 1..18: mol_type = other DNA
tattatgacccactattg

SEQ ID NO: 26073 - DNA, 18 bp, synthetic construct
  source 1..18: mol_type = other DNA
tattatgactcactcttg

SEQ ID NO: 26074 - DNA, 18 bp, synthetic construct
  source 1..18: mol_type = other DNA
tattccgactcactgttg

SEQ ID NO: 26075 - DNA, 18 bp, synthetic construct
  source 1..18: mol_type = other DNA
tatttccattcactatag

SEQ ID NO: 26076 - DNA, 18 bp, synthetic construct
  source 1..18: mol_type = other DNA
tatttcggctcactctag

SEQ ID NO: 26077 - DNA, 18 bp, synthetic construct
  source 1..18: mol_type = other DNA
tcatacgattcactcttg

SEQ ID NO: 26078 - DNA, 18 bp, synthetic construct
  source 1..18: mol_type = other DNA
tcatacgcctcgctttag

SEQ ID NO: 26079 - DNA, 18 bp, synthetic construct
  source 1..18: mol_type = other DNA
tcatacgtctcgcaatag

SEQ ID NO: 26080 - DNA, 18 bp, synthetic construct
  source 1..18: mol_type = other DNA
tgatacaacttactattg

SEQ ID NO: 26081 - DNA, 18 bp, synthetic construct
  source 1..18: mol_type = other DNA
tgatacgactcgcttaag

SEQ ID NO: 26082 - DNA, 18 bp, synthetic construct
  source 1..18: mol_type = other DNA
tgatacggctctctattg

SEQ ID NO: 26083 - DNA, 18 bp, synthetic construct
  source 1..18: mol_type = other DNA
tgatacgtctcactaatg

SEQ ID NO: 26084 - DNA, 18 bp, synthetic construct
  source 1..18: mol_type = other DNA
tgtttcgattcactatag

SEQ ID NO: 26085 - DNA, 18 bp, synthetic construct
  source 1..18: mol_type = other DNA
ttaatcgacttactatag

SEQ ID NO: 26086 - DNA, 18 bp, synthetic construct
  source 1..18: mol_type = other DNA
ttatacgactcaaaattg

SEQ ID NO: 26087 - DNA, 18 bp, synthetic construct
  source 1..18: mol_type = other DNA
ttatacgacttgcaatag

SEQ ID NO: 26088 - DNA, 18 bp, synthetic construct
  source 1..18: mol_type = other DNA
ttatacgattcgcaatag

SEQ ID NO: 26089 - DNA, 18 bp, synthetic construct
  source 1..18: mol_type = other DNA
ttatacggctccctattg

SEQ ID NO: 26090 - DNA, 18 bp, synthetic construct
  source 1..18: mol_type = other DNA
ttatacgtctcaatattg

SEQ ID NO: 26091 - DNA, 18 bp, synthetic construct
  source 1..18: mol_type = other DNA
ttatatgactcactactg

SEQ ID NO: 26092 - DNA, 18 bp, synthetic construct
  source 1..18: mol_type = other DNA
ttatatgtctcgctatag

SEQ ID NO: 26093 - DNA, 18 bp, synthetic construct
  source 1..18: mol_type = other DNA
ttatattactcactattg

SEQ ID NO: 26094 - DNA, 18 bp, synthetic construct
  source 1..18: mol_type = other DNA
ttatgcgactcactagtg

SEQ ID NO: 26095 - DNA, 18 bp, synthetic construct
  source 1..18: mol_type = other DNA
ttatgcgtctcgctatag

SEQ ID NO: 26096 - DNA, 18 bp, synthetic construct
  source 1..18: mol_type = other DNA
ttattcgactctctatcg

SEQ ID NO: 26097 - DNA, 18 bp, synthetic construct
  source 1..18: mol_type = other DNA
ttcaacgactcactattg

SEQ ID NO: 26098 - DNA, 18 bp, synthetic construct
  source 1..18: mol_type = other DNA
ttctacgactcattattg

SEQ ID NO: 26099 - DNA, 18 bp, synthetic construct
  source 1..18: mol_type = other DNA
aaaaaccactcactttag

SEQ ID NO: 26100 - DNA, 18 bp, synthetic construct
  source 1..18: mol_type = other DNA
aaaaacgactcaccagag

SEQ ID NO: 26101 - DNA, 18 bp, synthetic construct
  source 1..18: mol_type = other DNA
aaacacgactcaatctag

SEQ ID NO: 26102 - DNA, 18 bp, synthetic construct
  source 1..18: mol_type = other DNA
aaataagactcacttaag

SEQ ID NO: 26103 - DNA, 18 bp, synthetic construct
  source 1..18: mol_type = other DNA
aaataagactctgtatag

SEQ ID NO: 26104 - DNA, 18 bp, synthetic construct
  source 1..18: mol_type = other DNA
aaataagtctctctatag

SEQ ID NO: 26105 - DNA, 18 bp, synthetic construct
  source 1..18: mol_type = other DNA
aaataccactctcaatag

SEQ ID NO: 26106 - DNA, 18 bp, synthetic construct
  source 1..18: mol_type = other DNA
aaatacgaatgactatcg

SEQ ID NO: 26107 - DNA, 18 bp, synthetic construct
  source 1..18: mol_type = other DNA
aaatacgacacaccaaag

SEQ ID NO: 26108 - DNA, 18 bp, synthetic construct
  source 1..18: mol_type = other DNA
aaatacgacaccctttag

SEQ ID NO: 26109 - DNA, 18 bp, synthetic construct
  source 1..18: mol_type = other DNA
aaatacgacactctttag

SEQ ID NO: 26110 - DNA, 18 bp, synthetic construct
  source 1..18: mol_type = other DNA
aaatacgacccattaaag

SEQ ID NO: 26111 - DNA, 18 bp, synthetic construct
  source 1..18: mol_type = other DNA
aaatacgaccctatatag

SEQ ID NO: 26112 - DNA, 18 bp, synthetic construct
  source 1..18: mol_type = other DNA
aaatacgactcacgtaag

SEQ ID NO: 26113 - DNA, 18 bp, synthetic construct
  source 1..18: mol_type = other DNA
aaatacgactcattctgg

SEQ ID NO: 26114 - DNA, 18 bp, synthetic construct
  source 1..18: mol_type = other DNA
aaatacgactctttgtag

SEQ ID NO: 26115 - DNA, 18 bp, synthetic construct
  source 1..18: mol_type = other DNA
aaatacgacttacaatgg

SEQ ID NO: 26116 - DNA, 18 bp, synthetic construct
  source 1..18: mol_type = other DNA
aaatacgacttcctttag

SEQ ID NO: 26117 - DNA, 18 bp, synthetic construct
  source 1..18: mol_type = other DNA
aaatacgagacactaaag

SEQ ID NO: 26118 - DNA, 18 bp, synthetic construct
  source 1..18: mol_type = other DNA
aaatacgattcatcatag

SEQ ID NO: 26119 - DNA, 18 bp, synthetic construct
  source 1..18: mol_type = other DNA
aaatacgtctcaacatag

SEQ ID NO: 26120 - DNA, 18 bp, synthetic construct
  source 1..18: mol_type = other DNA
aaatactactcaatttag

SEQ ID NO: 26121 - DNA, 18 bp, synthetic construct
  source 1..18: mol_type = other DNA
aaatagaacacactatag

SEQ ID NO: 26122 - DNA, 18 bp, synthetic construct
  source 1..18: mol_type = other DNA
aaataggactcattaaag

SEQ ID NO: 26123 - DNA, 18 bp, synthetic construct
  source 1..18: mol_type = other DNA
aaataggattcaatatag

SEQ ID NO: 26124 - DNA, 18 bp, synthetic construct
  source 1..18: mol_type = other DNA
aaatatgtttcactatag

SEQ ID NO: 26125 - DNA, 18 bp, synthetic construct
  source 1..18: mol_type = other DNA
aaatattactcactatgg

SEQ ID NO: 26126 - DNA, 18 bp, synthetic construct
  source 1..18: mol_type = other DNA
aaatcagaatcactatag

SEQ ID NO: 26127 - DNA, 18 bp, synthetic construct
  source 1..18: mol_type = other DNA
aaatgcaactcactacag

SEQ ID NO: 26128 - DNA, 18 bp, synthetic construct
  source 1..18: mol_type = other DNA
aaatgcatctcactatag

SEQ ID NO: 26129 - DNA, 18 bp, synthetic construct
  source 1..18: mol_type = other DNA
aaatgcgactcaaaatag

SEQ ID NO: 26130 - DNA, 18 bp, synthetic construct
  source 1..18: mol_type = other DNA
aaatgcgcctcactttag

SEQ ID NO: 26131 - DNA, 18 bp, synthetic construct
  source 1..18: mol_type = other DNA
aaatgtgtctcactatag

SEQ ID NO: 26132 - DNA, 18 bp, synthetic construct
  source 1..18: mol_type = other DNA
aactatgactcattatag

SEQ ID NO: 26133 - DNA, 18 bp, synthetic construct
  source 1..18: mol_type = other DNA
aataacgactgactatag

SEQ ID NO: 26134 - DNA, 18 bp, synthetic construct
  source 1..18: mol_type = other DNA
aattaccactcactatcg

SEQ ID NO: 26135 - DNA, 18 bp, synthetic construct
  source 1..18: mol_type = other DNA
aattacgactcagtaaag

SEQ ID NO: 26136 - DNA, 18 bp, synthetic construct
  source 1..18: mol_type = other DNA
aattacggctctctatag

SEQ ID NO: 26137 - DNA, 18 bp, synthetic construct
  source 1..18: mol_type = other DNA
aattactactcacgatag

SEQ ID NO: 26138 - DNA, 18 bp, synthetic construct
  source 1..18: mol_type = other DNA
aattaggactcacaatag

SEQ ID NO: 26139 - DNA, 18 bp, synthetic construct
  source 1..18: mol_type = other DNA
acatactactcacaatag

SEQ ID NO: 26140 - DNA, 18 bp, synthetic construct
  source 1..18: mol_type = other DNA
agatacgacttaccatag

SEQ ID NO: 26141 - DNA, 18 bp, synthetic construct
  source 1..18: mol_type = other DNA
ataaacgactcactatcg

SEQ ID NO: 26142 - DNA, 18 bp, synthetic construct
  source 1..18: mol_type = other DNA
atacacgactcaatatag

SEQ ID NO: 26143 - DNA, 18 bp, synthetic construct
  source 1..18: mol_type = other DNA
atagacgactcactaaag

SEQ ID NO: 26144 - DNA, 18 bp, synthetic construct
  source 1..18: mol_type = other DNA
atataagactaactatag

SEQ ID NO: 26145 - DNA, 18 bp, synthetic construct
  source 1..18: mol_type = other DNA
atatacaactcagtatag

SEQ ID NO: 26146 - DNA, 18 bp, synthetic construct
  source 1..18: mol_type = other DNA
atgtacgattcactatag

SEQ ID NO: 26147 - DNA, 18 bp, synthetic construct
  source 1..18: mol_type = other DNA
atttacgcctcactatag

SEQ ID NO: 26148 - DNA, 18 bp, synthetic construct
  source 1..18: mol_type = other DNA
caaaacgacaccctatag

SEQ ID NO: 26149 - DNA, 18 bp, synthetic construct
  source 1..18: mol_type = other DNA
caacacgattaactatag

SEQ ID NO: 26150 - DNA, 18 bp, synthetic construct
  source 1..18: mol_type = other DNA
caataagtctctctatag

SEQ ID NO: 26151 - DNA, 18 bp, synthetic construct
  source 1..18: mol_type = other DNA
caatacaacccactctag

SEQ ID NO: 26152 - DNA, 18 bp, synthetic construct
  source 1..18: mol_type = other DNA
caatacaacgctctatag

SEQ ID NO: 26153 - DNA, 18 bp, synthetic construct
  source 1..18: mol_type = other DNA
caatacgacttaataaag

SEQ ID NO: 26154 - DNA, 18 bp, synthetic construct
  source 1..18: mol_type = other DNA
caatacgagttactttag

SEQ ID NO: 26155 - DNA, 18 bp, synthetic construct
  source 1..18: mol_type = other DNA
caatacgccttactttag

SEQ ID NO: 26156 - DNA, 18 bp, synthetic construct
  source 1..18: mol_type = other DNA
caatacgtatcactacag

SEQ ID NO: 26157 - DNA, 18 bp, synthetic construct
  source 1..18: mol_type = other DNA
caatacgtttcattatag

SEQ ID NO: 26158 - DNA, 18 bp, synthetic construct
  source 1..18: mol_type = other DNA
caataggacttactttag

SEQ ID NO: 26159 - DNA, 18 bp, synthetic construct
  source 1..18: mol_type = other DNA
caatataacttactatag

SEQ ID NO: 26160 - DNA, 18 bp, synthetic construct
  source 1..18: mol_type = other DNA
caatatgacacactgtag

SEQ ID NO: 26161 - DNA, 18 bp, synthetic construct
  source 1..18: mol_type = other DNA
cactacgattcattatag

SEQ ID NO: 26162 - DNA, 18 bp, synthetic construct
  source 1..18: mol_type = other DNA
cagtacgactcacaaaag

SEQ ID NO: 26163 - DNA, 18 bp, synthetic construct
  source 1..18: mol_type = other DNA
cctgacgactcactatag

SEQ ID NO: 26164 - DNA, 18 bp, synthetic construct
  source 1..18: mol_type = other DNA
ctataagacacactatag

SEQ ID NO: 26165 - DNA, 18 bp, synthetic construct
  source 1..18: mol_type = other DNA
ctatacgactcactaacg

SEQ ID NO: 26166 - DNA, 18 bp, synthetic construct
  source 1..18: mol_type = other DNA
ctatacgactccatatag

SEQ ID NO: 26167 - DNA, 18 bp, synthetic construct
  source 1..18: mol_type = other DNA
ctatacggatcactatag

SEQ ID NO: 26168 - DNA, 18 bp, synthetic construct
  source 1..18: mol_type = other DNA
ctatacgtatcactatag

SEQ ID NO: 26169 - DNA, 18 bp, synthetic construct
  source 1..18: mol_type = other DNA
gaatacatctcacaatag

SEQ ID NO: 26170 - DNA, 18 bp, synthetic construct
  source 1..18: mol_type = other DNA
gaatacgacacaaaatag

SEQ ID NO: 26171 - DNA, 18 bp, synthetic construct
  source 1..18: mol_type = other DNA
gaatatgactcacaacag

SEQ ID NO: 26172 - DNA, 18 bp, synthetic construct
  source 1..18: mol_type = other DNA
taaaaagacacactgtag

SEQ ID NO: 26173 - DNA, 18 bp, synthetic construct
  source 1..18: mol_type = other DNA
taaaaagactccctaaag

SEQ ID NO: 26174 - DNA, 18 bp, synthetic construct
  source 1..18: mol_type = other DNA
taaaaagattcacaatag

SEQ ID NO: 26175 - DNA, 18 bp, synthetic construct
  source 1..18: mol_type = other DNA
taaaacaacttattatag

SEQ ID NO: 26176 - DNA, 18 bp, synthetic construct
  source 1..18: mol_type = other DNA
taaaacccctcactagag

SEQ ID NO: 26177 - DNA, 18 bp, synthetic construct
  source 1..18: mol_type = other DNA
taaaacgacacattagag

SEQ ID NO: 26178 - DNA, 18 bp, synthetic construct
  source 1..18: mol_type = other DNA
taaaacgacagaccatag

SEQ ID NO: 26179 - DNA, 18 bp, synthetic construct
  source 1..18: mol_type = other DNA
taaaacgaccccccatag

SEQ ID NO: 26180 - DNA, 18 bp, synthetic construct
  source 1..18: mol_type = other DNA
taaaacgactcaatcaag

SEQ ID NO: 26181 - DNA, 18 bp, synthetic construct
  source 1..18: mol_type = other DNA
taaaacgactgacaaaag

SEQ ID NO: 26182 - DNA, 18 bp, synthetic construct
  source 1..18: mol_type = other DNA
taaaacgacttacgaaag

SEQ ID NO: 26183 - DNA, 18 bp, synthetic construct
  source 1..18: mol_type = other DNA
taaaacgactttctatgg

SEQ ID NO: 26184 - DNA, 18 bp, synthetic construct
  source 1..18: mol_type = other DNA
taaaacgcctcactgtcg

SEQ ID NO: 26185 - DNA, 18 bp, synthetic construct
  source 1..18: mol_type = other DNA
taaaacgcctctctgtag

SEQ ID NO: 26186 - DNA, 18 bp, synthetic construct
  source 1..18: mol_type = other DNA
taaaacggcacaatatag

SEQ ID NO: 26187 - DNA, 18 bp, synthetic construct
  source 1..18: mol_type = other DNA
taaaacgtatcactgtag

SEQ ID NO: 26188 - DNA, 18 bp, synthetic construct
  source 1..18: mol_type = other DNA
taaaacgtctccatatag

SEQ ID NO: 26189 - DNA, 18 bp, synthetic construct
  source 1..18: mol_type = other DNA
taaaactattcactaaag

SEQ ID NO: 26190 - DNA, 18 bp, synthetic construct
  source 1..18: mol_type = other DNA
taaaagcactcattatag

SEQ ID NO: 26191 - DNA, 18 bp, synthetic construct
  source 1..18: mol_type = other DNA
taaaataactcacaatag

SEQ ID NO: 26192 - DNA, 18 bp, synthetic construct
  source 1..18: mol_type = other DNA
taaaatgacagactatag

SEQ ID NO: 26193 - DNA, 18 bp, synthetic construct
  source 1..18: mol_type = other DNA
taaaccgactcacgttag

SEQ ID NO: 26194 - DNA, 18 bp, synthetic construct
  source 1..18: mol_type = other DNA
taaaccgactcacttaag

SEQ ID NO: 26195 - DNA, 18 bp, synthetic construct
  source 1..18: mol_type = other DNA
taaaccgattcactatcg

SEQ ID NO: 26196 - DNA, 18 bp, synthetic construct
  source 1..18: mol_type = other DNA
taaaccgattcactctag

SEQ ID NO: 26197 - DNA, 18 bp, synthetic construct
  source 1..18: mol_type = other DNA
taaaccgatttactatag

SEQ ID NO: 26198 - DNA, 18 bp, synthetic construct
  source 1..18: mol_type = other DNA
taaacctactcaccatag

SEQ ID NO: 26199 - DNA, 18 bp, synthetic construct
  source 1..18: mol_type = other DNA
taaaccttctcactatag

SEQ ID NO: 26200 - DNA, 18 bp, synthetic construct
  source 1..18: mol_type = other DNA
taaagcgtctcactttag

SEQ ID NO: 26201 - DNA, 18 bp, synthetic construct
  source 1..18: mol_type = other DNA
taacacaactcacttcag

SEQ ID NO: 26202 - DNA, 18 bp, synthetic construct
  source 1..18: mol_type = other DNA
taacacatcttactatag

SEQ ID NO: 26203 - DNA, 18 bp, synthetic construct
  source 1..18: mol_type = other DNA
taacacgacccacttaag

SEQ ID NO: 26204 - DNA, 18 bp, synthetic construct
  source 1..18: mol_type = other DNA
taacacgactaaccatgg

SEQ ID NO: 26205 - DNA, 18 bp, synthetic construct
  source 1..18: mol_type = other DNA
taacacgactaacttgag

SEQ ID NO: 26206 - DNA, 18 bp, synthetic construct
  source 1..18: mol_type = other DNA
taacacgattcacaatgg

SEQ ID NO: 26207 - DNA, 18 bp, synthetic construct
  source 1..18: mol_type = other DNA
taacacgtatcacaatag

SEQ ID NO: 26208 - DNA, 18 bp, synthetic construct
  source 1..18: mol_type = other DNA
taacacgtctcacaatcg

SEQ ID NO: 26209 - DNA, 18 bp, synthetic construct
  source 1..18: mol_type = other DNA
taacacgtcttactttag

SEQ ID NO: 26210 - DNA, 18 bp, synthetic construct
  source 1..18: mol_type = other DNA
taacatgacttacaatag

SEQ ID NO: 26211 - DNA, 18 bp, synthetic construct
  source 1..18: mol_type = other DNA
taacgcgactctctgtag

SEQ ID NO: 26212 - DNA, 18 bp, synthetic construct
  source 1..18: mol_type = other DNA
taacgcgattgactatag

SEQ ID NO: 26213 - DNA, 18 bp, synthetic construct
  source 1..18: mol_type = other DNA
taagaagtctcattatag

SEQ ID NO: 26214 - DNA, 18 bp, synthetic construct
  source 1..18: mol_type = other DNA
taagacgccacactagag

SEQ ID NO: 26215 - DNA, 18 bp, synthetic construct
  source 1..18: mol_type = other DNA
taagctgactctctatag

SEQ ID NO: 26216 - DNA, 18 bp, synthetic construct
  source 1..18: mol_type = other DNA
taataaaacaaactatag

SEQ ID NO: 26217 - DNA, 18 bp, synthetic construct
  source 1..18: mol_type = other DNA
taataacattcattatag

SEQ ID NO: 26218 - DNA, 18 bp, synthetic construct
  source 1..18: mol_type = other DNA
taataagactcaataacg

SEQ ID NO: 26219 - DNA, 18 bp, synthetic construct
  source 1..18: mol_type = other DNA
taataagactcccaaaag

SEQ ID NO: 26220 - DNA, 18 bp, synthetic construct
  source 1..18: mol_type = other DNA
taataagactctttagag

SEQ ID NO: 26221 - DNA, 18 bp, synthetic construct
  source 1..18: mol_type = other DNA
taataagacttaatttag

SEQ ID NO: 26222 - DNA, 18 bp, synthetic construct
  source 1..18: mol_type = other DNA
taataagacttacgttag

SEQ ID NO: 26223 - DNA, 18 bp, synthetic construct
  source 1..18: mol_type = other DNA
taataagattaactttag

SEQ ID NO: 26224 - DNA, 18 bp, synthetic construct
  source 1..18: mol_type = other DNA
taataagattccctttag

SEQ ID NO: 26225 - DNA, 18 bp, synthetic construct
  source 1..18: mol_type = other DNA
taataaggctctcaatag

SEQ ID NO: 26226 - DNA, 18 bp, synthetic construct
  source 1..18: mol_type = other DNA
taatacaactcagattag

SEQ ID NO: 26227 - DNA, 18 bp, synthetic construct
  source 1..18: mol_type = other DNA
taatacaactcattttgg

SEQ ID NO: 26228 - DNA, 18 bp, synthetic construct
  source 1..18: mol_type = other DNA
taatacaactctatttag

SEQ ID NO: 26229 - DNA, 18 bp, synthetic construct
  source 1..18: mol_type = other DNA
taatacaatagactatag

SEQ ID NO: 26230 - DNA, 18 bp, synthetic construct
  source 1..18: mol_type = other DNA
taatacaattttctatag

SEQ ID NO: 26231 - DNA, 18 bp, synthetic construct
  source 1..18: mol_type = other DNA
taatacatatctctatag

SEQ ID NO: 26232 - DNA, 18 bp, synthetic construct
  source 1..18: mol_type = other DNA
taataccaataaatatag

SEQ ID NO: 26233 - DNA, 18 bp, synthetic construct
  source 1..18: mol_type = other DNA
taataccacataatatag

SEQ ID NO: 26234 - DNA, 18 bp, synthetic construct
  source 1..18: mol_type = other DNA
taataccactccatttag

SEQ ID NO: 26235 - DNA, 18 bp, synthetic construct
  source 1..18: mol_type = other DNA
taataccattaactaaag

SEQ ID NO: 26236 - DNA, 18 bp, synthetic construct
  source 1..18: mol_type = other DNA
taataccgcactctatag

SEQ ID NO: 26237 - DNA, 18 bp, synthetic construct
  source 1..18: mol_type = other DNA
taatacctatcactttag

SEQ ID NO: 26238 - DNA, 18 bp, synthetic construct
  source 1..18: mol_type = other DNA
taatacgaagcaccatgg

SEQ ID NO: 26239 - DNA, 18 bp, synthetic construct
  source 1..18: mol_type = other DNA
taatacgaatccttttag

SEQ ID NO: 26240 - DNA, 18 bp, synthetic construct
  source 1..18: mol_type = other DNA
taatacgaattcttatag

SEQ ID NO: 26241 - DNA, 18 bp, synthetic construct
  source 1..18: mol_type = other DNA
taatacgacaaactgtgg

SEQ ID NO: 26242 - DNA, 18 bp, synthetic construct
  source 1..18: mol_type = other DNA
taatacgacacacaaacg

SEQ ID NO: 26243 - DNA, 18 bp, synthetic construct
  source 1..18: mol_type = other DNA
taatacgacacaccttgg

SEQ ID NO: 26244 - DNA, 18 bp, synthetic construct
  source 1..18: mol_type = other DNA
taatacgacacagtctgg

SEQ ID NO: 26245 - DNA, 18 bp, synthetic construct
  source 1..18: mol_type = other DNA
taatacgacaccctgaag

SEQ ID NO: 26246 - DNA, 18 bp, synthetic construct
  source 1..18: mol_type = other DNA
taatacgacattctatgg

SEQ ID NO: 26247 - DNA, 18 bp, synthetic construct
  source 1..18: mol_type = other DNA
taatacgacccagagtag

SEQ ID NO: 26248 - DNA, 18 bp, synthetic construct
  source 1..18: mol_type = other DNA
taatacgactatttaaag

SEQ ID NO: 26249 - DNA, 18 bp, synthetic construct
  source 1..18: mol_type = other DNA
taatacgactctatttcg

SEQ ID NO: 26250 - DNA, 18 bp, synthetic construct
  source 1..18: mol_type = other DNA
taatacgacttcataaag

SEQ ID NO: 26251 - DNA, 18 bp, synthetic construct
  source 1..18: mol_type = other DNA
taatacgagacacttaag

SEQ ID NO: 26252 - DNA, 18 bp, synthetic construct
  source 1..18: mol_type = other DNA
taatacgagtcacttagg

SEQ ID NO: 26253 - DNA, 18 bp, synthetic construct
  source 1..18: mol_type = other DNA
taatacgagtcatcaaag

SEQ ID NO: 26254 - DNA, 18 bp, synthetic construct
  source 1..18: mol_type = other DNA
taatacgagttacttaag

SEQ ID NO: 26255 - DNA, 18 bp, synthetic construct
  source 1..18: mol_type = other DNA
taatacgataaagtatag

SEQ ID NO: 26256 - DNA, 18 bp, synthetic construct
  source 1..18: mol_type = other DNA
taatacgatcaactctag

SEQ ID NO: 26257 - DNA, 18 bp, synthetic construct
  source 1..18: mol_type = other DNA
taatacgattctatatcg

SEQ ID NO: 26258 - DNA, 18 bp, synthetic construct
  source 1..18: mol_type = other DNA
taatacgattctcagtag

SEQ ID NO: 26259 - DNA, 18 bp, synthetic construct
  source 1..18: mol_type = other DNA
taatacgatttaataaag

SEQ ID NO: 26260 - DNA, 18 bp, synthetic construct
  source 1..18: mol_type = other DNA
taatacgccacaccaaag

SEQ ID NO: 26261 - DNA, 18 bp, synthetic construct
  source 1..18: mol_type = other DNA
taatacgcctcaaattag

SEQ ID NO: 26262 - DNA, 18 bp, synthetic construct
  source 1..18: mol_type = other DNA
taatacggatcacgagag

SEQ ID NO: 26263 - DNA, 18 bp, synthetic construct
  source 1..18: mol_type = other DNA
taatacggcactttatag

SEQ ID NO: 26264 - DNA, 18 bp, synthetic construct
  source 1..18: mol_type = other DNA
taatacgggtaacaatag

SEQ ID NO: 26265 - DNA, 18 bp, synthetic construct
  source 1..18: mol_type = other DNA
taatacgtaacacaatag

SEQ ID NO: 26266 - DNA, 18 bp, synthetic construct
  source 1..18: mol_type = other DNA
taatacgtatcaataaag

SEQ ID NO: 26267 - DNA, 18 bp, synthetic construct
  source 1..18: mol_type = other DNA
taatacgtatccgtatag

SEQ ID NO: 26268 - DNA, 18 bp, synthetic construct
  source 1..18: mol_type = other DNA
taatacgtcgcaacatag

SEQ ID NO: 26269 - DNA, 18 bp, synthetic construct
  source 1..18: mol_type = other DNA
taatacgtctcacaaacg

SEQ ID NO: 26270 - DNA, 18 bp, synthetic construct
  source 1..18: mol_type = other DNA
taatacgtctcactcacg

SEQ ID NO: 26271 - DNA, 18 bp, synthetic construct
  source 1..18: mol_type = other DNA
taatacgtctctcaagag

SEQ ID NO: 26272 - DNA, 18 bp, synthetic construct
  source 1..18: mol_type = other DNA
taatacgtctgtctttag

SEQ ID NO: 26273 - DNA, 18 bp, synthetic construct
  source 1..18: mol_type = other DNA
taatacgtgtcacattag

SEQ ID NO: 26274 - DNA, 18 bp, synthetic construct
  source 1..18: mol_type = other DNA
taatacgtgtcaccaaag

SEQ ID NO: 26275 - DNA, 18 bp, synthetic construct
  source 1..18: mol_type = other DNA
taatacgtttcacaacag

SEQ ID NO: 26276 - DNA, 18 bp, synthetic construct
  source 1..18: mol_type = other DNA
taatactacacacgttag

SEQ ID NO: 26277 - DNA, 18 bp, synthetic construct
  source 1..18: mol_type = other DNA
taatactacagacgatag

SEQ ID NO: 26278 - DNA, 18 bp, synthetic construct
  source 1..18: mol_type = other DNA
taatactacagactaaag

SEQ ID NO: 26279 - DNA, 18 bp, synthetic construct
  source 1..18: mol_type = other DNA
taatactacgaactacag

SEQ ID NO: 26280 - DNA, 18 bp, synthetic construct
  source 1..18: mol_type = other DNA
taatactactcccaatcg

SEQ ID NO: 26281 - DNA, 18 bp, synthetic construct
  source 1..18: mol_type = other DNA
taatactactctaaatag

SEQ ID NO: 26282 - DNA, 18 bp, synthetic construct
  source 1..18: mol_type = other DNA
taatactactgataatag

SEQ ID NO: 26283 - DNA, 18 bp, synthetic construct
  source 1..18: mol_type = other DNA
taatactattaagtatag

SEQ ID NO: 26284 - DNA, 18 bp, synthetic construct
  source 1..18: mol_type = other DNA
taatactattcaatacag

SEQ ID NO: 26285 - DNA, 18 bp, synthetic construct
  source 1..18: mol_type = other DNA
taatactgctcagtacag

SEQ ID NO: 26286 - DNA, 18 bp, synthetic construct
  source 1..18: mol_type = other DNA
taatacttcacacgatag

SEQ ID NO: 26287 - DNA, 18 bp, synthetic construct
  source 1..18: mol_type = other DNA
taatacttcccactctag

SEQ ID NO: 26288 - DNA, 18 bp, synthetic construct
  source 1..18: mol_type = other DNA
taatacttctccctctag

SEQ ID NO: 26289 - DNA, 18 bp, synthetic construct
  source 1..18: mol_type = other DNA
taataggactcacgttcg

SEQ ID NO: 26290 - DNA, 18 bp, synthetic construct
  source 1..18: mol_type = other DNA
taataggccacactacag

SEQ ID NO: 26291 - DNA, 18 bp, synthetic construct
  source 1..18: mol_type = other DNA
taatataactgtctatag

SEQ ID NO: 26292 - DNA, 18 bp, synthetic construct
  source 1..18: mol_type = other DNA
taatataattctctatag

SEQ ID NO: 26293 - DNA, 18 bp, synthetic construct
  source 1..18: mol_type = other DNA
taatatcattcactaaag

SEQ ID NO: 26294 - DNA, 18 bp, synthetic construct
  source 1..18: mol_type = other DNA
taatatgacatacgatag

SEQ ID NO: 26295 - DNA, 18 bp, synthetic construct
  source 1..18: mol_type = other DNA
taatatgactcataatgg

SEQ ID NO: 26296 - DNA, 18 bp, synthetic construct
  source 1..18: mol_type = other DNA
taatatgactctcattag

SEQ ID NO: 26297 - DNA, 18 bp, synthetic construct
  source 1..18: mol_type = other DNA
taatatgagacactaaag

SEQ ID NO: 26298 - DNA, 18 bp, synthetic construct
  source 1..18: mol_type = other DNA
taatatggcttaatatag

SEQ ID NO: 26299 - DNA, 18 bp, synthetic construct
  source 1..18: mol_type = other DNA
taatatggttcactgtag

SEQ ID NO: 26300 - DNA, 18 bp, synthetic construct
  source 1..18: mol_type = other DNA
taatatgtctcattatcg

SEQ ID NO: 26301 - DNA, 18 bp, synthetic construct
  source 1..18: mol_type = other DNA
taatattactaaatatag

SEQ ID NO: 26302 - DNA, 18 bp, synthetic construct
  source 1..18: mol_type = other DNA
taatattgctaactatag

SEQ ID NO: 26303 - DNA, 18 bp, synthetic construct
  source 1..18: mol_type = other DNA
taatcagacacaccatag

SEQ ID NO: 26304 - DNA, 18 bp, synthetic construct
  source 1..18: mol_type = other DNA
taatcaggctcacaatag

SEQ ID NO: 26305 - DNA, 18 bp, synthetic construct
  source 1..18: mol_type = other DNA
taatccaactaaatatag

SEQ ID NO: 26306 - DNA, 18 bp, synthetic construct
  source 1..18: mol_type = other DNA
taatccaattcactttag

SEQ ID NO: 26307 - DNA, 18 bp, synthetic construct
  source 1..18: mol_type = other DNA
taatccgacttaacatag

SEQ ID NO: 26308 - DNA, 18 bp, synthetic construct
  source 1..18: mol_type = other DNA
taatccgtctctctctag

SEQ ID NO: 26309 - DNA, 18 bp, synthetic construct
  source 1..18: mol_type = other DNA
taatccgtttcacgatag

SEQ ID NO: 26310 - DNA, 18 bp, synthetic construct
  source 1..18: mol_type = other DNA
taatcggatttactatag

SEQ ID NO: 26311 - DNA, 18 bp, synthetic construct
  source 1..18: mol_type = other DNA
taatctgactccctatcg

SEQ ID NO: 26312 - DNA, 18 bp, synthetic construct
  source 1..18: mol_type = other DNA
taatcttactcacaatag

SEQ ID NO: 26313 - DNA, 18 bp, synthetic construct
  source 1..18: mol_type = other DNA
taatgcaactcagaatag

SEQ ID NO: 26314 - DNA, 18 bp, synthetic construct
  source 1..18: mol_type = other DNA
taatgcaagtcattatag

SEQ ID NO: 26315 - DNA, 18 bp, synthetic construct
  source 1..18: mol_type = other DNA
taatgcgaatcactttcg

SEQ ID NO: 26316 - DNA, 18 bp, synthetic construct
  source 1..18: mol_type = other DNA
taatgcgactcaattaag

SEQ ID NO: 26317 - DNA, 18 bp, synthetic construct
  source 1..18: mol_type = other DNA
taatgcgactcacaaacg

SEQ ID NO: 26318 - DNA, 18 bp, synthetic construct
  source 1..18: mol_type = other DNA
taatgcgactcacatgag

SEQ ID NO: 26319 - DNA, 18 bp, synthetic construct
  source 1..18: mol_type = other DNA
taatgcgactcccgttag

SEQ ID NO: 26320 - DNA, 18 bp, synthetic construct
  source 1..18: mol_type = other DNA
taatgcgattcaatctag

SEQ ID NO: 26321 - DNA, 18 bp, synthetic construct
  source 1..18: mol_type = other DNA
taatgcgattcaccgtag

SEQ ID NO: 26322 - DNA, 18 bp, synthetic construct
  source 1..18: mol_type = other DNA
taatgcgcctctctatgg

SEQ ID NO: 26323 - DNA, 18 bp, synthetic construct
  source 1..18: mol_type = other DNA
taatgctacagactatag

SEQ ID NO: 26324 - DNA, 18 bp, synthetic construct
  source 1..18: mol_type = other DNA
tactaagacacacaatag

SEQ ID NO: 26325 - DNA, 18 bp, synthetic construct
  source 1..18: mol_type = other DNA
tactaagtcttactatag

SEQ ID NO: 26326 - DNA, 18 bp, synthetic construct
  source 1..18: mol_type = other DNA
tactacgaatcattgtag

SEQ ID NO: 26327 - DNA, 18 bp, synthetic construct
  source 1..18: mol_type = other DNA
tactacgacacactaagg

SEQ ID NO: 26328 - DNA, 18 bp, synthetic construct
  source 1..18: mol_type = other DNA
tactacgacacactaccg

SEQ ID NO: 26329 - DNA, 18 bp, synthetic construct
  source 1..18: mol_type = other DNA
tactacgaccctatatag

SEQ ID NO: 26330 - DNA, 18 bp, synthetic construct
  source 1..18: mol_type = other DNA
tactacgactgtatatag

SEQ ID NO: 26331 - DNA, 18 bp, synthetic construct
  source 1..18: mol_type = other DNA
tactacgatacaccatag

SEQ ID NO: 26332 - DNA, 18 bp, synthetic construct
  source 1..18: mol_type = other DNA
tactacgcctctctaaag

SEQ ID NO: 26333 - DNA, 18 bp, synthetic construct
  source 1..18: mol_type = other DNA
tactacgtcacactttag

SEQ ID NO: 26334 - DNA, 18 bp, synthetic construct
  source 1..18: mol_type = other DNA
tactacgtctgagtatag

SEQ ID NO: 26335 - DNA, 18 bp, synthetic construct
  source 1..18: mol_type = other DNA
tactatcacttactatag

SEQ ID NO: 26336 - DNA, 18 bp, synthetic construct
  source 1..18: mol_type = other DNA
tactatgattcactaaag

SEQ ID NO: 26337 - DNA, 18 bp, synthetic construct
  source 1..18: mol_type = other DNA
tactatgattctctatag

SEQ ID NO: 26338 - DNA, 18 bp, synthetic construct
  source 1..18: mol_type = other DNA
tactgtgactcactagag

SEQ ID NO: 26339 - DNA, 18 bp, synthetic construct
  source 1..18: mol_type = other DNA
tagagcgactcactatgg

SEQ ID NO: 26340 - DNA, 18 bp, synthetic construct
  source 1..18: mol_type = other DNA
tagtaccactcacttaag

SEQ ID NO: 26341 - DNA, 18 bp, synthetic construct
  source 1..18: mol_type = other DNA
tagtacgaatcaccctag

SEQ ID NO: 26342 - DNA, 18 bp, synthetic construct
  source 1..18: mol_type = other DNA
tagtacgacaaattatag

SEQ ID NO: 26343 - DNA, 18 bp, synthetic construct
  source 1..18: mol_type = other DNA
tagtacgactcacattgg

SEQ ID NO: 26344 - DNA, 18 bp, synthetic construct
  source 1..18: mol_type = other DNA
tagtacgactctccttag

SEQ ID NO: 26345 - DNA, 18 bp, synthetic construct
  source 1..18: mol_type = other DNA
tagtacgagtcagtacag

SEQ ID NO: 26346 - DNA, 18 bp, synthetic construct
  source 1..18: mol_type = other DNA
tagtacgatacagtatag

SEQ ID NO: 26347 - DNA, 18 bp, synthetic construct
  source 1..18: mol_type = other DNA
tagtacgcctcacaaaag

SEQ ID NO: 26348 - DNA, 18 bp, synthetic construct
  source 1..18: mol_type = other DNA
tagtacgtttcactttag

SEQ ID NO: 26349 - DNA, 18 bp, synthetic construct
  source 1..18: mol_type = other DNA
tagtactactcataatag

SEQ ID NO: 26350 - DNA, 18 bp, synthetic construct
  source 1..18: mol_type = other DNA
tagtactactctatatag

SEQ ID NO: 26351 - DNA, 18 bp, synthetic construct
  source 1..18: mol_type = other DNA
tagtatgtctcactatcg

SEQ ID NO: 26352 - DNA, 18 bp, synthetic construct
  source 1..18: mol_type = other DNA
tagtctggctcactatag

SEQ ID NO: 26353 - DNA, 18 bp, synthetic construct
  source 1..18: mol_type = other DNA
tagtgcgactcactcgag

SEQ ID NO: 26354 - DNA, 18 bp, synthetic construct
  source 1..18: mol_type = other DNA
tagtgcgcctcactatcg

SEQ ID NO: 26355 - DNA, 18 bp, synthetic construct
  source 1..18: mol_type = other DNA
tataaccactcattatag

SEQ ID NO: 26356 - DNA, 18 bp, synthetic construct
  source 1..18: mol_type = other DNA
tataacgacagactatag

SEQ ID NO: 26357 - DNA, 18 bp, synthetic construct
  source 1..18: mol_type = other DNA
tataacgaccaactatag

SEQ ID NO: 26358 - DNA, 18 bp, synthetic construct
  source 1..18: mol_type = other DNA
tataacgactaactatcg

SEQ ID NO: 26359 - DNA, 18 bp, synthetic construct
  source 1..18: mol_type = other DNA
tataacgactcactaagg

SEQ ID NO: 26360 - DNA, 18 bp, synthetic construct
  source 1..18: mol_type = other DNA
tataacgcctcactctag

SEQ ID NO: 26361 - DNA, 18 bp, synthetic construct
  source 1..18: mol_type = other DNA
tataacgcctcactttag

SEQ ID NO: 26362 - DNA, 18 bp, synthetic construct
  source 1..18: mol_type = other DNA
tatcacgactcactttcg

SEQ ID NO: 26363 - DNA, 18 bp, synthetic construct
  source 1..18: mol_type = other DNA
tatcacgactctctaaag

SEQ ID NO: 26364 - DNA, 18 bp, synthetic construct
  source 1..18: mol_type = other DNA
tatgaccattcactatag

SEQ ID NO: 26365 - DNA, 18 bp, synthetic construct
  source 1..18: mol_type = other DNA
tatgattactcactatag

SEQ ID NO: 26366 - DNA, 18 bp, synthetic construct
  source 1..18: mol_type = other DNA
tattaagactcaatttag

SEQ ID NO: 26367 - DNA, 18 bp, synthetic construct
  source 1..18: mol_type = other DNA
tattaagactcactttcg

SEQ ID NO: 26368 - DNA, 18 bp, synthetic construct
  source 1..18: mol_type = other DNA
tattaagacttaatatag

SEQ ID NO: 26369 - DNA, 18 bp, synthetic construct
  source 1..18: mol_type = other DNA
tattaagtctcactatcg

SEQ ID NO: 26370 - DNA, 18 bp, synthetic construct
  source 1..18: mol_type = other DNA
tattaccacactctatag

SEQ ID NO: 26371 - DNA, 18 bp, synthetic construct
  source 1..18: mol_type = other DNA
tattaccactctctaaag

SEQ ID NO: 26372 - DNA, 18 bp, synthetic construct
  source 1..18: mol_type = other DNA
tattacccctcactttag

SEQ ID NO: 26373 - DNA, 18 bp, synthetic construct
  source 1..18: mol_type = other DNA
tattacgaataactatcg

SEQ ID NO: 26374 - DNA, 18 bp, synthetic construct
  source 1..18: mol_type = other DNA
tattacgacacattaaag

SEQ ID NO: 26375 - DNA, 18 bp, synthetic construct
  source 1..18: mol_type = other DNA
tattacgacgcacaaaag

SEQ ID NO: 26376 - DNA, 18 bp, synthetic construct
  source 1..18: mol_type = other DNA
tattacgactaacaatcg

SEQ ID NO: 26377 - DNA, 18 bp, synthetic construct
  source 1..18: mol_type = other DNA
tattacgactatctgtag

SEQ ID NO: 26378 - DNA, 18 bp, synthetic construct
  source 1..18: mol_type = other DNA
tattacgactcaccagcg

SEQ ID NO: 26379 - DNA, 18 bp, synthetic construct
  source 1..18: mol_type = other DNA
tattacgactctccttag

SEQ ID NO: 26380 - DNA, 18 bp, synthetic construct
  source 1..18: mol_type = other DNA
tattacgactctctctcg

SEQ ID NO: 26381 - DNA, 18 bp, synthetic construct
  source 1..18: mol_type = other DNA
tattacgagtcataatag

SEQ ID NO: 26382 - DNA, 18 bp, synthetic construct
  source 1..18: mol_type = other DNA
tattacgccccactttag

SEQ ID NO: 26383 - DNA, 18 bp, synthetic construct
  source 1..18: mol_type = other DNA
tattacggcacactagag

SEQ ID NO: 26384 - DNA, 18 bp, synthetic construct
  source 1..18: mol_type = other DNA
tattacggttcacaatag

SEQ ID NO: 26385 - DNA, 18 bp, synthetic construct
  source 1..18: mol_type = other DNA
tattacgtatctctatag

SEQ ID NO: 26386 - DNA, 18 bp, synthetic construct
  source 1..18: mol_type = other DNA
tattactaatcaatatag

SEQ ID NO: 26387 - DNA, 18 bp, synthetic construct
  source 1..18: mol_type = other DNA
tattacttcccactatag

SEQ ID NO: 26388 - DNA, 18 bp, synthetic construct
  source 1..18: mol_type = other DNA
tattagaactctctatag

SEQ ID NO: 26389 - DNA, 18 bp, synthetic construct
  source 1..18: mol_type = other DNA
tattaggactctccatag

SEQ ID NO: 26390 - DNA, 18 bp, synthetic construct
  source 1..18: mol_type = other DNA
tattagtactctctatag

SEQ ID NO: 26391 - DNA, 18 bp, synthetic construct
  source 1..18: mol_type = other DNA
tattatggcacactatag

SEQ ID NO: 26392 - DNA, 18 bp, synthetic construct
  source 1..18: mol_type = other DNA
tattcagactcaccatag

SEQ ID NO: 26393 - DNA, 18 bp, synthetic construct
  source 1..18: mol_type = other DNA
tattccaactcactttag

SEQ ID NO: 26394 - DNA, 18 bp, synthetic construct
  source 1..18: mol_type = other DNA
tattccgacttaatatag

SEQ ID NO: 26395 - DNA, 18 bp, synthetic construct
  source 1..18: mol_type = other DNA
tattccgacttactatgg

SEQ ID NO: 26396 - DNA, 18 bp, synthetic construct
  source 1..18: mol_type = other DNA
tattgcgactctccatag

SEQ ID NO: 26397 - DNA, 18 bp, synthetic construct
  source 1..18: mol_type = other DNA
tcaaactactcattatag

SEQ ID NO: 26398 - DNA, 18 bp, synthetic construct
  source 1..18: mol_type = other DNA
tcatacaactatctatag

SEQ ID NO: 26399 - DNA, 18 bp, synthetic construct
  source 1..18: mol_type = other DNA
tcatacaactctatatag

SEQ ID NO: 26400 - DNA, 18 bp, synthetic construct
  source 1..18: mol_type = other DNA
tcatacatctctctatag

SEQ ID NO: 26401 - DNA, 18 bp, synthetic construct
  source 1..18: mol_type = other DNA
tcatacgaaacacaatag

SEQ ID NO: 26402 - DNA, 18 bp, synthetic construct
  source 1..18: mol_type = other DNA
tcatacgaatctttatag

SEQ ID NO: 26403 - DNA, 18 bp, synthetic construct
  source 1..18: mol_type = other DNA
tcatacgacttaccaaag

SEQ ID NO: 26404 - DNA, 18 bp, synthetic construct
  source 1..18: mol_type = other DNA
tcatacgattcaccttag

SEQ ID NO: 26405 - DNA, 18 bp, synthetic construct
  source 1..18: mol_type = other DNA
tcatacgcctccctaaag

SEQ ID NO: 26406 - DNA, 18 bp, synthetic construct
  source 1..18: mol_type = other DNA
tcatacgtcaccctatag

SEQ ID NO: 26407 - DNA, 18 bp, synthetic construct
  source 1..18: mol_type = other DNA
tcatacgtctaacaatag

SEQ ID NO: 26408 - DNA, 18 bp, synthetic construct
  source 1..18: mol_type = other DNA
tcatacgtctcaatctag

SEQ ID NO: 26409 - DNA, 18 bp, synthetic construct
  source 1..18: mol_type = other DNA
tcatattcctcactatag

SEQ ID NO: 26410 - DNA, 18 bp, synthetic construct
  source 1..18: mol_type = other DNA
tcatccgactctttatag

SEQ ID NO: 26411 - DNA, 18 bp, synthetic construct
  source 1..18: mol_type = other DNA
tcatgcgacacactatgg

SEQ ID NO: 26412 - DNA, 18 bp, synthetic construct
  source 1..18: mol_type = other DNA
tcatgcgacccaccatag

SEQ ID NO: 26413 - DNA, 18 bp, synthetic construct
  source 1..18: mol_type = other DNA
tcatgcgactctctttag

SEQ ID NO: 26414 - DNA, 18 bp, synthetic construct
  source 1..18: mol_type = other DNA
tcatgctactcactctag

SEQ ID NO: 26415 - DNA, 18 bp, synthetic construct
  source 1..18: mol_type = other DNA
tcatgcttctcactatag

SEQ ID NO: 26416 - DNA, 18 bp, synthetic construct
  source 1..18: mol_type = other DNA
tcttaagacttactatag

SEQ ID NO: 26417 - DNA, 18 bp, synthetic construct
  source 1..18: mol_type = other DNA
tgaaacgattcattatag

SEQ ID NO: 26418 - DNA, 18 bp, synthetic construct
  source 1..18: mol_type = other DNA
tgacacgactcacttcag

SEQ ID NO: 26419 - DNA, 18 bp, synthetic construct
  source 1..18: mol_type = other DNA
tgataagagtcacaatag

SEQ ID NO: 26420 - DNA, 18 bp, synthetic construct
  source 1..18: mol_type = other DNA
tgatacgacacactttcg

SEQ ID NO: 26421 - DNA, 18 bp, synthetic construct
  source 1..18: mol_type = other DNA
tgatacgccaaactatag

SEQ ID NO: 26422 - DNA, 18 bp, synthetic construct
  source 1..18: mol_type = other DNA
tgatacggctcaatacag

SEQ ID NO: 26423 - DNA, 18 bp, synthetic construct
  source 1..18: mol_type = other DNA
tgatacgtctctccatag

SEQ ID NO: 26424 - DNA, 18 bp, synthetic construct
  source 1..18: mol_type = other DNA
tgatacgtctgattatag

SEQ ID NO: 26425 - DNA, 18 bp, synthetic construct
  source 1..18: mol_type = other DNA
tgatatgacacactatcg

SEQ ID NO: 26426 - DNA, 18 bp, synthetic construct
  source 1..18: mol_type = other DNA
tgatatgtctcagtatag

SEQ ID NO: 26427 - DNA, 18 bp, synthetic construct
  source 1..18: mol_type = other DNA
tgatgagacttactatag

SEQ ID NO: 26428 - DNA, 18 bp, synthetic construct
  source 1..18: mol_type = other DNA
tgatgcgacacactatgg

SEQ ID NO: 26429 - DNA, 18 bp, synthetic construct
  source 1..18: mol_type = other DNA
tgatgcgtctcactagag

SEQ ID NO: 26430 - DNA, 18 bp, synthetic construct
  source 1..18: mol_type = other DNA
tgctaaaactcactatag

SEQ ID NO: 26431 - DNA, 18 bp, synthetic construct
  source 1..18: mol_type = other DNA
tggtacgagtcactatcg

SEQ ID NO: 26432 - DNA, 18 bp, synthetic construct
  source 1..18: mol_type = other DNA
tgtaacaactcactatag

SEQ ID NO: 26433 - DNA, 18 bp, synthetic construct
  source 1..18: mol_type = other DNA
tgtaacgacttactatag

SEQ ID NO: 26434 - DNA, 18 bp, synthetic construct
  source 1..18: mol_type = other DNA
tgttacgacgcacgatag

SEQ ID NO: 26435 - DNA, 18 bp, synthetic construct
  source 1..18: mol_type = other DNA
ttaaaccactcactaaag

SEQ ID NO: 26436 - DNA, 18 bp, synthetic construct
  source 1..18: mol_type = other DNA
ttaaacgaatcagtatag

SEQ ID NO: 26437 - DNA, 18 bp, synthetic construct
  source 1..18: mol_type = other DNA
ttaaacgaatcattatag

SEQ ID NO: 26438 - DNA, 18 bp, synthetic construct
  source 1..18: mol_type = other DNA
ttaaacgactgacaatag

SEQ ID NO: 26439 - DNA, 18 bp, synthetic construct
  source 1..18: mol_type = other DNA
ttaaacgacttattatag

SEQ ID NO: 26440 - DNA, 18 bp, synthetic construct
  source 1..18: mol_type = other DNA
ttaaaggactctctatag

SEQ ID NO: 26441 - DNA, 18 bp, synthetic construct
  source 1..18: mol_type = other DNA
ttacacgactcacactag

SEQ ID NO: 26442 - DNA, 18 bp, synthetic construct
  source 1..18: mol_type = other DNA
ttacactactcaccatag

SEQ ID NO: 26443 - DNA, 18 bp, synthetic construct
  source 1..18: mol_type = other DNA
ttacactactccctatag

SEQ ID NO: 26444 - DNA, 18 bp, synthetic construct
  source 1..18: mol_type = other DNA
ttagacgacttactataa

SEQ ID NO: 26445 - DNA, 18 bp, synthetic construct
  source 1..18: mol_type = other DNA
ttataagattcaatatag

SEQ ID NO: 26446 - DNA, 18 bp, synthetic construct
  source 1..18: mol_type = other DNA
ttataatactcattatag

SEQ ID NO: 26447 - DNA, 18 bp, synthetic construct
  source 1..18: mol_type = other DNA
ttataccactaaccatag

SEQ ID NO: 26448 - DNA, 18 bp, synthetic construct
  source 1..18: mol_type = other DNA
ttatacgaattactaaag

SEQ ID NO: 26449 - DNA, 18 bp, synthetic construct
  source 1..18: mol_type = other DNA
ttatacgactaactcaag

SEQ ID NO: 26450 - DNA, 18 bp, synthetic construct
  source 1..18: mol_type = other DNA
ttatacgactatcgatag

SEQ ID NO: 26451 - DNA, 18 bp, synthetic construct
  source 1..18: mol_type = other DNA
ttatacgactcacagaag

SEQ ID NO: 26452 - DNA, 18 bp, synthetic construct
  source 1..18: mol_type = other DNA
ttatacgacttcatatag

SEQ ID NO: 26453 - DNA, 18 bp, synthetic construct
  source 1..18: mol_type = other DNA
ttatacgagtcacttaag

SEQ ID NO: 26454 - DNA, 18 bp, synthetic construct
  source 1..18: mol_type = other DNA
ttatacgagtctctagag

SEQ ID NO: 26455 - DNA, 18 bp, synthetic construct
  source 1..18: mol_type = other DNA
ttatacgatcaactatag

SEQ ID NO: 26456 - DNA, 18 bp, synthetic construct
  source 1..18: mol_type = other DNA
ttatacgattatctatag

SEQ ID NO: 26457 - DNA, 18 bp, synthetic construct
  source 1..18: mol_type = other DNA
ttatacgattcactaacg

SEQ ID NO: 26458 - DNA, 18 bp, synthetic construct
  source 1..18: mol_type = other DNA
ttatacgcatcactgtag

SEQ ID NO: 26459 - DNA, 18 bp, synthetic construct
  source 1..18: mol_type = other DNA
ttatacgtctcacaatgg

SEQ ID NO: 26460 - DNA, 18 bp, synthetic construct
  source 1..18: mol_type = other DNA
ttatactccttactatag

SEQ ID NO: 26461 - DNA, 18 bp, synthetic construct
  source 1..18: mol_type = other DNA
ttatacttctgactatag

SEQ ID NO: 26462 - DNA, 18 bp, synthetic construct
  source 1..18: mol_type = other DNA
ttatagggctcactatcg

SEQ ID NO: 26463 - DNA, 18 bp, synthetic construct
  source 1..18: mol_type = other DNA
ttatagggcttactatag

SEQ ID NO: 26464 - DNA, 18 bp, synthetic construct
  source 1..18: mol_type = other DNA
ttatcccactcactaaag

SEQ ID NO: 26465 - DNA, 18 bp, synthetic construct
  source 1..18: mol_type = other DNA
ttatccccctcactatag

SEQ ID NO: 26466 - DNA, 18 bp, synthetic construct
  source 1..18: mol_type = other DNA
ttatcctacttactatag

SEQ ID NO: 26467 - DNA, 18 bp, synthetic construct
  source 1..18: mol_type = other DNA
ttatgcgactccatatag

SEQ ID NO: 26468 - DNA, 18 bp, synthetic construct
  source 1..18: mol_type = other DNA
ttatgcgtctcactatcg

SEQ ID NO: 26469 - DNA, 18 bp, synthetic construct
  source 1..18: mol_type = other DNA
ttctatgactcagtatag

SEQ ID NO: 26470 - DNA, 18 bp, synthetic construct
  source 1..18: mol_type = other DNA
ttgaaagactcactatag

SEQ ID NO: 26471 - DNA, 18 bp, synthetic construct
  source 1..18: mol_type = other DNA
ttgtaaaactcactatag

SEQ ID NO: 26472 - DNA, 18 bp, synthetic construct
  source 1..18: mol_type = other DNA
ttgtaagattcactatag

SEQ ID NO: 26473 - DNA, 18 bp, synthetic construct
  source 1..18: mol_type = other DNA
ttgtacgactatctatag

SEQ ID NO: 26474 - DNA, 18 bp, synthetic construct
  source 1..18: mol_type = other DNA
ttgtacgattcactctag

SEQ ID NO: 26475 - DNA, 18 bp, synthetic construct
  source 1..18: mol_type = other DNA
tttaacgactaactatag

SEQ ID NO: 26476 - DNA, 18 bp, synthetic construct
  source 1..18: mol_type = other DNA
ttttaagactcaatatag

SEQ ID NO: 26477 - DNA, 18 bp, synthetic construct
  source 1..18: mol_type = other DNA
ttttacaactcactagag

SEQ ID NO: 26478 - DNA, 18 bp, synthetic construct
  source 1..18: mol_type = other DNA
ttttacaactgactatag

SEQ ID NO: 26479 - DNA, 18 bp, synthetic construct
  source 1..18: mol_type = other DNA
ttttacgactccctacag

SEQ ID NO: 26480 - DNA, 18 bp, synthetic construct
  source 1..18: mol_type = other DNA
ttttatgacttactatag

SEQ ID NO: 26481 - DNA, 18 bp, synthetic construct
  source 1..18: mol_type = other DNA
taacactacacactattg

SEQ ID NO: 26482 - DNA, 18 bp, synthetic construct
  source 1..18: mol_type = other DNA
taatacatctcattattg

SEQ ID NO: 26483 - DNA, 18 bp, synthetic construct
  source 1..18: mol_type = other DNA
taatacgatacacaattg

SEQ ID NO: 26484 - DNA, 18 bp, synthetic construct
  source 1..18: mol_type = other DNA
taatccaactcactaatg

SEQ ID NO: 26485 - DNA, 18 bp, synthetic construct
  source 1..18: mol_type = other DNA
taattcgaatcacattag

SEQ ID NO: 26486 - DNA, 18 bp, synthetic construct
  source 1..18: mol_type = other DNA
taattcgtttcactaaag

SEQ ID NO: 26487 - DNA, 18 bp, synthetic construct
  source 1..18: mol_type = other DNA
tagtacgactgacttttg

SEQ ID NO: 26488 - DNA, 18 bp, synthetic construct
  source 1..18: mol_type = other DNA
tataacgactcattattg

SEQ ID NO: 26489 - DNA, 18 bp, synthetic construct
  source 1..18: mol_type = other DNA
tataacgactcgctaaag

SEQ ID NO: 26490 - DNA, 18 bp, synthetic construct
  source 1..18: mol_type = other DNA
tataacgattcactattg

SEQ ID NO: 26491 - DNA, 18 bp, synthetic construct
  source 1..18: mol_type = other DNA
tatttcgactcactcaag

SEQ ID NO: 26492 - DNA, 18 bp, synthetic construct
  source 1..18: mol_type = other DNA
atatactattcactatag

SEQ ID NO: 26493 - DNA, 18 bp, synthetic construct
  source 1..18: mol_type = other DNA
taatatgacactatatag

SEQ ID NO: 26494 - DNA, 18 bp, synthetic construct
  source 1..18: mol_type = other DNA
tataacgtttcactatag

SEQ ID NO: 26495 - DNA, 18 bp, synthetic construct
  source 1..18: mol_type = other DNA
tattaaaactcactaaag

SEQ ID NO: 26496 - DNA, 18 bp, synthetic construct
  source 1..18: mol_type = other DNA
tattacgtctctcaatag

SEQ ID NO: 26497 - DNA, 18 bp, synthetic construct
  source 1..18: mol_type = other DNA
tctaacgtctcactatag

SEQ ID NO: 26498 - DNA, 18 bp, synthetic construct
  source 1..18: mol_type = other DNA
ttatacatctctctatag

SEQ ID NO: 26499 - DNA, 18 bp, synthetic construct
  source 1..18: mol_type = other DNA
ttatacgaatatctatag

SEQ ID NO: 26500 - DNA, 18 bp, synthetic construct
  source 1..18: mol_type = other DNA
ttatacgacttacattag

SEQ ID NO: 26501 - DNA, 18 bp, synthetic construct
  source 1..18: mol_type = other DNA
ttatacgtctcacaatcg

SEQ ID NO: 26502 - DNA, 18 bp, synthetic construct
  source 1..18: mol_type = other DNA
taatacaactctcaaaag

SEQ ID NO: 26503 - DNA, 18 bp, synthetic construct
  source 1..18: mol_type = other DNA
tatatcgactcactttag

SEQ ID NO: 26504 - DNA, 18 bp, synthetic construct
  source 1..18: mol_type = other DNA
taattagtctcacaatag

SEQ ID NO: 26505 - DNA, 18 bp, synthetic construct
  source 1..18: mol_type = other DNA
tatttcgtctccctatag

SEQ ID NO: 26506 - DNA, 18 bp, synthetic construct
  source 1..18: mol_type = other DNA
tataacgtctcattatag

SEQ ID NO: 26507 - DNA, 18 bp, synthetic construct
  source 1..18: mol_type = other DNA
ttatccgtctcactaaag

SEQ ID NO: 26508 - DNA, 18 bp, synthetic construct
  source 1..18: mol_type = other DNA
aaatacgactctcttttg

SEQ ID NO: 26509 - DNA, 18 bp, synthetic construct
  source 1..18: mol_type = other DNA
taataggaatcacaattg

SEQ ID NO: 26510 - DNA, 18 bp, synthetic construct
  source 1..18: mol_type = other DNA
aaatactagtaactatag

SEQ ID NO: 26511 - DNA, 18 bp, synthetic construct
  source 1..18: mol_type = other DNA
taaaacgtctctctgtag

SEQ ID NO: 26512 - DNA, 18 bp, synthetic construct
  source 1..18: mol_type = other DNA
taataccactcagttaag

SEQ ID NO: 26513 - DNA, 18 bp, synthetic construct
  source 1..18: mol_type = other DNA
tataacgactccctaaag

SEQ ID NO: 26514 - DNA, 18 bp, synthetic construct
  source 1..18: mol_type = other DNA
aaatacgtcccactattg

SEQ ID NO: 26515 - DNA, 18 bp, synthetic construct
  source 1..18: mol_type = other DNA
taaatcgactcaatttag

SEQ ID NO: 26516 - DNA, 18 bp, synthetic construct
  source 1..18: mol_type = other DNA
taataaaactcaatattg

SEQ ID NO: 26517 - DNA, 18 bp, synthetic construct
  source 1..18: mol_type = other DNA
taataaaattcactattg

SEQ ID NO: 26518 - DNA, 18 bp, synthetic construct
  source 1..18: mol_type = other DNA
taataagactcacttctg

SEQ ID NO: 26519 - DNA, 18 bp, synthetic construct
  source 1..18: mol_type = other DNA
taataatactcattattg

SEQ ID NO: 26520 - DNA, 18 bp, synthetic construct
  source 1..18: mol_type = other DNA
taatacgacacatttttg

SEQ ID NO: 26521 - DNA, 18 bp, synthetic construct
  source 1..18: mol_type = other DNA
taatacgacttacatttg

SEQ ID NO: 26522 - DNA, 18 bp, synthetic construct
  source 1..18: mol_type = other DNA
taatatgattctctattg

SEQ ID NO: 26523 - DNA, 18 bp, synthetic construct
  source 1..18: mol_type = other DNA
taatcaaactcactattg

SEQ ID NO: 26524 - DNA, 18 bp, synthetic construct
  source 1..18: mol_type = other DNA
taattcgaaacactaaag

SEQ ID NO: 26525 - DNA, 18 bp, synthetic construct
  source 1..18: mol_type = other DNA
taattcgacaaactgtag

SEQ ID NO: 26526 - DNA, 18 bp, synthetic construct
  source 1..18: mol_type = other DNA
taattcgactaattaaag

SEQ ID NO: 26527 - DNA, 18 bp, synthetic construct
  source 1..18: mol_type = other DNA
taattctacaccctatag

SEQ ID NO: 26528 - DNA, 18 bp, synthetic construct
  source 1..18: mol_type = other DNA
taatttctctcactatag

SEQ ID NO: 26529 - DNA, 18 bp, synthetic construct
  source 1..18: mol_type = other DNA
tattacgactcacagttg

SEQ ID NO: 26530 - DNA, 18 bp, synthetic construct
  source 1..18: mol_type = other DNA
tatttctactcactaaag

SEQ ID NO: 26531 - DNA, 18 bp, synthetic construct
  source 1..18: mol_type = other DNA
tattttgactcaatatag

SEQ ID NO: 26532 - DNA, 18 bp, synthetic construct
  source 1..18: mol_type = other DNA
ttattcgtctaactatag

SEQ ID NO: 26533 - DNA, 18 bp, synthetic construct
  source 1..18: mol_type = other DNA
ttttactactcactattg

SEQ ID NO: 26534 - DNA, 18 bp, synthetic construct
  source 1..18: mol_type = other DNA
aaatacgactctctaacg

SEQ ID NO: 26535 - DNA, 18 bp, synthetic construct
  source 1..18: mol_type = other DNA
aaatacgcatcactaaag

SEQ ID NO: 26536 - DNA, 18 bp, synthetic construct
  source 1..18: mol_type = other DNA
atataccacacactatag

SEQ ID NO: 26537 - DNA, 18 bp, synthetic construct
  source 1..18: mol_type = other DNA
atatactactcactctag

SEQ ID NO: 26538 - DNA, 18 bp, synthetic construct
  source 1..18: mol_type = other DNA
atatatgactctctatag

SEQ ID NO: 26539 - DNA, 18 bp, synthetic construct
  source 1..18: mol_type = other DNA
taaaacgaatcactccag

SEQ ID NO: 26540 - DNA, 18 bp, synthetic construct
  source 1..18: mol_type = other DNA
taaaacgacacacttcag

SEQ ID NO: 26541 - DNA, 18 bp, synthetic construct
  source 1..18: mol_type = other DNA
taaaacgaccaactaaag

SEQ ID NO: 26542 - DNA, 18 bp, synthetic construct
  source 1..18: mol_type = other DNA
taacacgattcccaatag

SEQ ID NO: 26543 - DNA, 18 bp, synthetic construct
  source 1..18: mol_type = other DNA
taatacatatcacaatag

SEQ ID NO: 26544 - DNA, 18 bp, synthetic construct
  source 1..18: mol_type = other DNA
taataccactctcattag

SEQ ID NO: 26545 - DNA, 18 bp, synthetic construct
  source 1..18: mol_type = other DNA
taatacgaatctcaatcg

SEQ ID NO: 26546 - DNA, 18 bp, synthetic construct
  source 1..18: mol_type = other DNA
taatacgactcaattacg

SEQ ID NO: 26547 - DNA, 18 bp, synthetic construct
  source 1..18: mol_type = other DNA
taatacgactgaccgtcg

SEQ ID NO: 26548 - DNA, 18 bp, synthetic construct
  source 1..18: mol_type = other DNA
taatacgacttatttaag

SEQ ID NO: 26549 - DNA, 18 bp, synthetic construct
  source 1..18: mol_type = other DNA
taatatctctcacaatag

SEQ ID NO: 26550 - DNA, 18 bp, synthetic construct
  source 1..18: mol_type = other DNA
taatatgaatctctacag

SEQ ID NO: 26551 - DNA, 18 bp, synthetic construct
  source 1..18: mol_type = other DNA
taatatgacgtacaatag

SEQ ID NO: 26552 - DNA, 18 bp, synthetic construct
  source 1..18: mol_type = other DNA
taatgcaacccactaaag

SEQ ID NO: 26553 - DNA, 18 bp, synthetic construct
  source 1..18: mol_type = other DNA
tacaatgactcacaatag

SEQ ID NO: 26554 - DNA, 18 bp, synthetic construct
  source 1..18: mol_type = other DNA
tagaacgactcattgtag

SEQ ID NO: 26555 - DNA, 18 bp, synthetic construct
  source 1..18: mol_type = other DNA
tatgacgattcactaaag

SEQ ID NO: 26556 - DNA, 18 bp, synthetic construct
  source 1..18: mol_type = other DNA
tattacgactcttaatag

SEQ ID NO: 26557 - DNA, 18 bp, synthetic construct
  source 1..18: mol_type = other DNA
tattacgcctctatatag

SEQ ID NO: 26558 - DNA, 18 bp, synthetic construct
  source 1..18: mol_type = other DNA
tattacgtcatactatag

SEQ ID NO: 26559 - DNA, 18 bp, synthetic construct
  source 1..18: mol_type = other DNA
tattacgtgacactatag

SEQ ID NO: 26560 - DNA, 18 bp, synthetic construct
  source 1..18: mol_type = other DNA
tattagcactcacaatag

SEQ ID NO: 26561 - DNA, 18 bp, synthetic construct
  source 1..18: mol_type = other DNA
tattccgattcactaaag

SEQ ID NO: 26562 - DNA, 18 bp, synthetic construct
  source 1..18: mol_type = other DNA
tgttacgactcagtttag

SEQ ID NO: 26563 - DNA, 18 bp, synthetic construct
  source 1..18: mol_type = other DNA
ttaaacgacccactttag

SEQ ID NO: 26564 - DNA, 18 bp, synthetic construct
  source 1..18: mol_type = other DNA
ttatacatctcactatcg

SEQ ID NO: 26565 - DNA, 18 bp, synthetic construct
  source 1..18: mol_type = other DNA
ttatactactcattatcg

SEQ ID NO: 26566 - DNA, 18 bp, synthetic construct
  source 1..18: mol_type = other DNA
ttatacttcccactatag

SEQ ID NO: 26567 - DNA, 18 bp, synthetic construct
  source 1..18: mol_type = other DNA
ttataggactctcaatag

SEQ ID NO: 26568 - DNA, 18 bp, synthetic construct
  source 1..18: mol_type = other DNA
ttatgcgactaactatgg

SEQ ID NO: 26569 - DNA, 18 bp, synthetic construct
  source 1..18: mol_type = other DNA
ttctaccactcactagag

SEQ ID NO: 26570 - DNA, 18 bp, synthetic construct
  source 1..18: mol_type = other DNA
tttaaggactcactatag

SEQ ID NO: 26571 - DNA, 18 bp, synthetic construct
  source 1..18: mol_type = other DNA
ttttacaacgcactatag

SEQ ID NO: 26572 - DNA, 18 bp, synthetic construct
  source 1..18: mol_type = other DNA
ttttcctactcactatag

SEQ ID NO: 26573 - DNA, 18 bp, synthetic construct
  source 1..18: mol_type = other DNA
ttaaacgaatcactaaag

SEQ ID NO: 26574 - DNA, 18 bp, synthetic construct
  source 1..18: mol_type = other DNA
ttcaacgactcactaaag

SEQ ID NO: 26575 - DNA, 18 bp, synthetic construct
  source 1..18: mol_type = other DNA
taattcgtctcacaatcg

SEQ ID NO: 26576 - DNA, 18 bp, synthetic construct
  source 1..18: mol_type = other DNA
ttaaacgactcgcaatag

SEQ ID NO: 26577 - DNA, 18 bp, synthetic construct
  source 1..18: mol_type = other DNA
ttatacgtctccctattg

SEQ ID NO: 26578 - DNA, 18 bp, synthetic construct
  source 1..18: mol_type = other DNA
taatatcactctatatag

SEQ ID NO: 26579 - DNA, 18 bp, synthetic construct
  source 1..18: mol_type = other DNA
tattaatactcactttag

SEQ ID NO: 26580 - DNA, 18 bp, synthetic construct
  source 1..18: mol_type = other DNA
tattatgtctctctatag

SEQ ID NO: 26581 - DNA, 18 bp, synthetic construct
  source 1..18: mol_type = other DNA
ttatatgactcataatag

SEQ ID NO: 26582 - DNA, 18 bp, synthetic construct
  source 1..18: mol_type = other DNA
ttatatgtttcactatag

SEQ ID NO: 26583 - DNA, 18 bp, synthetic construct
  source 1..18: mol_type = other DNA
aaattcgtctcacaatag

SEQ ID NO: 26584 - DNA, 18 bp, synthetic construct
  source 1..18: mol_type = other DNA
taaaacttctctctatag

SEQ ID NO: 26585 - DNA, 18 bp, synthetic construct
  source 1..18: mol_type = other DNA
ttataagactctcaatag

SEQ ID NO: 26586 - DNA, 18 bp, synthetic construct
  source 1..18: mol_type = other DNA
ttatacgactcaaaatcg

SEQ ID NO: 26587 - DNA, 18 bp, synthetic construct
  source 1..18: mol_type = other DNA
caatacgtctcacattag

SEQ ID NO: 26588 - DNA, 18 bp, synthetic construct
  source 1..18: mol_type = other DNA
taaaactactcgctattg

SEQ ID NO: 26589 - DNA, 18 bp, synthetic construct
  source 1..18: mol_type = other DNA
taattcgaatagctatag

SEQ ID NO: 26590 - DNA, 18 bp, synthetic construct
  source 1..18: mol_type = other DNA
taattcgacccaatattg

SEQ ID NO: 26591 - DNA, 18 bp, synthetic construct
  source 1..18: mol_type = other DNA
taattcgacccactgttg

SEQ ID NO: 26592 - DNA, 18 bp, synthetic construct
  source 1..18: mol_type = other DNA
taattcgactagatatag

SEQ ID NO: 26593 - DNA, 18 bp, synthetic construct
  source 1..18: mol_type = other DNA
taattcggctcactcttg

SEQ ID NO: 26594 - DNA, 18 bp, synthetic construct
  source 1..18: mol_type = other DNA
taattcgtctcgccatag

SEQ ID NO: 26595 - DNA, 18 bp, synthetic construct
  source 1..18: mol_type = other DNA
taattggtctcactattg

SEQ ID NO: 26596 - DNA, 18 bp, synthetic construct
  source 1..18: mol_type = other DNA
taatttgactcgcgatag

SEQ ID NO: 26597 - DNA, 18 bp, synthetic construct
  source 1..18: mol_type = other DNA
tagttctactcactattg

SEQ ID NO: 26598 - DNA, 18 bp, synthetic construct
  source 1..18: mol_type = other DNA
tatttcgactgactattg

SEQ ID NO: 26599 - DNA, 18 bp, synthetic construct
  source 1..18: mol_type = other DNA
tcaatcgactcgctatag

SEQ ID NO: 26600 - DNA, 18 bp, synthetic construct
  source 1..18: mol_type = other DNA
tcatttgactcactattg

SEQ ID NO: 26601 - DNA, 18 bp, synthetic construct
  source 1..18: mol_type = other DNA
aaataagactcgctctag

SEQ ID NO: 26602 - DNA, 18 bp, synthetic construct
  source 1..18: mol_type = other DNA
aaatacgacacactgttg

SEQ ID NO: 26603 - DNA, 18 bp, synthetic construct
  source 1..18: mol_type = other DNA
aaatacgactagctctag

SEQ ID NO: 26604 - DNA, 18 bp, synthetic construct
  source 1..18: mol_type = other DNA
aaatacgactcaattttg

SEQ ID NO: 26605 - DNA, 18 bp, synthetic construct
  source 1..18: mol_type = other DNA
aaatacgactcacaaatg

SEQ ID NO: 26606 - DNA, 18 bp, synthetic construct
  source 1..18: mol_type = other DNA
aaatacgtatcgctatag

SEQ ID NO: 26607 - DNA, 18 bp, synthetic construct
  source 1..18: mol_type = other DNA
aaatatgactcactaatg

SEQ ID NO: 26608 - DNA, 18 bp, synthetic construct
  source 1..18: mol_type = other DNA
aaatatgactggctatag

SEQ ID NO: 26609 - DNA, 18 bp, synthetic construct
  source 1..18: mol_type = other DNA
aaatgcgactcacaattg

SEQ ID NO: 26610 - DNA, 18 bp, synthetic construct
  source 1..18: mol_type = other DNA
aaattagacacactatag

SEQ ID NO: 26611 - DNA, 18 bp, synthetic construct
  source 1..18: mol_type = other DNA
aaattcaactaactatag

SEQ ID NO: 26612 - DNA, 18 bp, synthetic construct
  source 1..18: mol_type = other DNA
aaattccactcaccatag

SEQ ID NO: 26613 - DNA, 18 bp, synthetic construct
  source 1..18: mol_type = other DNA
aaattcgaaacactatag

SEQ ID NO: 26614 - DNA, 18 bp, synthetic construct
  source 1..18: mol_type = other DNA
acatacgactaactattg

SEQ ID NO: 26615 - DNA, 18 bp, synthetic construct
  source 1..18: mol_type = other DNA
agattagactcactatag

SEQ ID NO: 26616 - DNA, 18 bp, synthetic construct
  source 1..18: mol_type = other DNA
aggtacgactcactattg

SEQ ID NO: 26617 - DNA, 18 bp, synthetic construct
  source 1..18: mol_type = other DNA
atttacgactcgctatag

SEQ ID NO: 26618 - DNA, 18 bp, synthetic construct
  source 1..18: mol_type = other DNA
caatacgaataactattg

SEQ ID NO: 26619 - DNA, 18 bp, synthetic construct
  source 1..18: mol_type = other DNA
caatacgacacattattg

SEQ ID NO: 26620 - DNA, 18 bp, synthetic construct
  source 1..18: mol_type = other DNA
caatacgtcacgctatag

SEQ ID NO: 26621 - DNA, 18 bp, synthetic construct
  source 1..18: mol_type = other DNA
caatccgacttactattg

SEQ ID NO: 26622 - DNA, 18 bp, synthetic construct
  source 1..18: mol_type = other DNA
caattagactcacaatag

SEQ ID NO: 26623 - DNA, 18 bp, synthetic construct
  source 1..18: mol_type = other DNA
catttcgactcactatcg

SEQ ID NO: 26624 - DNA, 18 bp, synthetic construct
  source 1..18: mol_type = other DNA
gaatacgactaattattg

SEQ ID NO: 26625 - DNA, 18 bp, synthetic construct
  source 1..18: mol_type = other DNA
gaatactactcaccattg

SEQ ID NO: 26626 - DNA, 18 bp, synthetic construct
  source 1..18: mol_type = other DNA
gaatgcgtctcactattg

SEQ ID NO: 26627 - DNA, 18 bp, synthetic construct
  source 1..18: mol_type = other DNA
gaattcgactcaccttag

SEQ ID NO: 26628 - DNA, 18 bp, synthetic construct
  source 1..18: mol_type = other DNA
gatttcaactcactatag

SEQ ID NO: 26629 - DNA, 18 bp, synthetic construct
  source 1..18: mol_type = other DNA
taaaaagactcgctaaag

SEQ ID NO: 26630 - DNA, 18 bp, synthetic construct
  source 1..18: mol_type = other DNA
taaaaatactcactattg

SEQ ID NO: 26631 - DNA, 18 bp, synthetic construct
  source 1..18: mol_type = other DNA
taaaacgacttaccattg

SEQ ID NO: 26632 - DNA, 18 bp, synthetic construct
  source 1..18: mol_type = other DNA
taaaacgacttcctattg

SEQ ID NO: 26633 - DNA, 18 bp, synthetic construct
  source 1..18: mol_type = other DNA
taaaacgattaactattg

SEQ ID NO: 26634 - DNA, 18 bp, synthetic construct
  source 1..18: mol_type = other DNA
taaaacgatttactattg

SEQ ID NO: 26635 - DNA, 18 bp, synthetic construct
  source 1..18: mol_type = other DNA
taaaaggactcgctttag

SEQ ID NO: 26636 - DNA, 18 bp, synthetic construct
  source 1..18: mol_type = other DNA
taaatcgacacactagag

SEQ ID NO: 26637 - DNA, 18 bp, synthetic construct
  source 1..18: mol_type = other DNA
taaatcgactcacttgag

SEQ ID NO: 26638 - DNA, 18 bp, synthetic construct
  source 1..18: mol_type = other DNA
taaatcgattcactctag

SEQ ID NO: 26639 - DNA, 18 bp, synthetic construct
  source 1..18: mol_type = other DNA
taaatcggctctctatag

SEQ ID NO: 26640 - DNA, 18 bp, synthetic construct
  source 1..18: mol_type = other DNA
taaattgacttactatag

SEQ ID NO: 26641 - DNA, 18 bp, synthetic construct
  source 1..18: mol_type = other DNA
taacactactcaatattg

SEQ ID NO: 26642 - DNA, 18 bp, synthetic construct
  source 1..18: mol_type = other DNA
taactcgacttcctatag

SEQ ID NO: 26643 - DNA, 18 bp, synthetic construct
  source 1..18: mol_type = other DNA
taactcgtctccctatag

SEQ ID NO: 26644 - DNA, 18 bp, synthetic construct
  source 1..18: mol_type = other DNA
taactctattcactatag

SEQ ID NO: 26645 - DNA, 18 bp, synthetic construct
  source 1..18: mol_type = other DNA
taagacgactaaatattg

SEQ ID NO: 26646 - DNA, 18 bp, synthetic construct
  source 1..18: mol_type = other DNA
taataaaactcactatta

SEQ ID NO: 26647 - DNA, 18 bp, synthetic construct
  source 1..18: mol_type = other DNA
taataacacacactattg

SEQ ID NO: 26648 - DNA, 18 bp, synthetic construct
  source 1..18: mol_type = other DNA
taataacacttactattg

SEQ ID NO: 26649 - DNA, 18 bp, synthetic construct
  source 1..18: mol_type = other DNA
taataagactagctagag

SEQ ID NO: 26650 - DNA, 18 bp, synthetic construct
  source 1..18: mol_type = other DNA
taataagcctcgccatag

SEQ ID NO: 26651 - DNA, 18 bp, synthetic construct
  source 1..18: mol_type = other DNA
taataagtctcgctttag

SEQ ID NO: 26652 - DNA, 18 bp, synthetic construct
  source 1..18: mol_type = other DNA
taataagtttcactattg

SEQ ID NO: 26653 - DNA, 18 bp, synthetic construct
  source 1..18: mol_type = other DNA
taataatactcacttttg

SEQ ID NO: 26654 - DNA, 18 bp, synthetic construct
  source 1..18: mol_type = other DNA
taatacaaatcactcttg

SEQ ID NO: 26655 - DNA, 18 bp, synthetic construct
  source 1..18: mol_type = other DNA
taataccactcgatttag

SEQ ID NO: 26656 - DNA, 18 bp, synthetic construct
  source 1..18: mol_type = other DNA
taatacctctcaatattg

SEQ ID NO: 26657 - DNA, 18 bp, synthetic construct
  source 1..18: mol_type = other DNA
taatacgaatcactgatg

SEQ ID NO: 26658 - DNA, 18 bp, synthetic construct
  source 1..18: mol_type = other DNA
taatacgaatcacttgtg

SEQ ID NO: 26659 - DNA, 18 bp, synthetic construct
  source 1..18: mol_type = other DNA
taatacgaatctttattg

SEQ ID NO: 26660 - DNA, 18 bp, synthetic construct
  source 1..18: mol_type = other DNA
taatacgacacacccttg

SEQ ID NO: 26661 - DNA, 18 bp, synthetic construct
  source 1..18: mol_type = other DNA
taatacgacacgctaagg

SEQ ID NO: 26662 - DNA, 18 bp, synthetic construct
  source 1..18: mol_type = other DNA
taatacgacatgcaatag

SEQ ID NO: 26663 - DNA, 18 bp, synthetic construct
  source 1..18: mol_type = other DNA
taatacgacattctattg

SEQ ID NO: 26664 - DNA, 18 bp, synthetic construct
  source 1..18: mol_type = other DNA
taatacgactaacaactg

SEQ ID NO: 26665 - DNA, 18 bp, synthetic construct
  source 1..18: mol_type = other DNA
taatacgactatctgttg

SEQ ID NO: 26666 - DNA, 18 bp, synthetic construct
  source 1..18: mol_type = other DNA
taatacgactctatcttg

SEQ ID NO: 26667 - DNA, 18 bp, synthetic construct
  source 1..18: mol_type = other DNA
taatacgagtctttattg

SEQ ID NO: 26668 - DNA, 18 bp, synthetic construct
  source 1..18: mol_type = other DNA
taatacgattcacttgtg

SEQ ID NO: 26669 - DNA, 18 bp, synthetic construct
  source 1..18: mol_type = other DNA
taatacgccacgctgtag

SEQ ID NO: 26670 - DNA, 18 bp, synthetic construct
  source 1..18: mol_type = other DNA
taatacgcctcagtaatg

SEQ ID NO: 26671 - DNA, 18 bp, synthetic construct
  source 1..18: mol_type = other DNA
taatacggattactattg

SEQ ID NO: 26672 - DNA, 18 bp, synthetic construct
  source 1..18: mol_type = other DNA
taatactaatcagtattg

SEQ ID NO: 26673 - DNA, 18 bp, synthetic construct
  source 1..18: mol_type = other DNA
taatactaatcgttatag

SEQ ID NO: 26674 - DNA, 18 bp, synthetic construct
  source 1..18: mol_type = other DNA
taatactacttagtattg

SEQ ID NO: 26675 - DNA, 18 bp, synthetic construct
  source 1..18: mol_type = other DNA
taatagatctcgctatag

SEQ ID NO: 26676 - DNA, 18 bp, synthetic construct
  source 1..18: mol_type = other DNA
taataggattcaccattg

SEQ ID NO: 26677 - DNA, 18 bp, synthetic construct
  source 1..18: mol_type = other DNA
taatatgaatcattattg

SEQ ID NO: 26678 - DNA, 18 bp, synthetic construct
  source 1..18: mol_type = other DNA
taatatgacgcgcaatag

SEQ ID NO: 26679 - DNA, 18 bp, synthetic construct
  source 1..18: mol_type = other DNA
taatatgactcaagattg

SEQ ID NO: 26680 - DNA, 18 bp, synthetic construct
  source 1..18: mol_type = other DNA
taatatgactcactttta

SEQ ID NO: 26681 - DNA, 18 bp, synthetic construct
  source 1..18: mol_type = other DNA
taatatgagtctctattg

SEQ ID NO: 26682 - DNA, 18 bp, synthetic construct
  source 1..18: mol_type = other DNA
taatccaactcactagtg

SEQ ID NO: 26683 - DNA, 18 bp, synthetic construct
  source 1..18: mol_type = other DNA
taatccgagtctctattg

SEQ ID NO: 26684 - DNA, 18 bp, synthetic construct
  source 1..18: mol_type = other DNA
taatccgcctcaccattg

SEQ ID NO: 26685 - DNA, 18 bp, synthetic construct
  source 1..18: mol_type = other DNA
taatgagactcactaatg

SEQ ID NO: 26686 - DNA, 18 bp, synthetic construct
  source 1..18: mol_type = other DNA
taatgcgacacacaattg

SEQ ID NO: 26687 - DNA, 18 bp, synthetic construct
  source 1..18: mol_type = other DNA
taatgcgacccactcttg

SEQ ID NO: 26688 - DNA, 18 bp, synthetic construct
  source 1..18: mol_type = other DNA
taatgcgactaaatattg

SEQ ID NO: 26689 - DNA, 18 bp, synthetic construct
  source 1..18: mol_type = other DNA
taatgcgacttactactg

SEQ ID NO: 26690 - DNA, 18 bp, synthetic construct
  source 1..18: mol_type = other DNA
taatgcgcctcgctatgg

SEQ ID NO: 26691 - DNA, 18 bp, synthetic construct
  source 1..18: mol_type = other DNA
taattagactctcaatag

SEQ ID NO: 26692 - DNA, 18 bp, synthetic construct
  source 1..18: mol_type = other DNA
taattagcctcactgtag

SEQ ID NO: 26693 - DNA, 18 bp, synthetic construct
  source 1..18: mol_type = other DNA
taattaggctcactaaag

SEQ ID NO: 26694 - DNA, 18 bp, synthetic construct
  source 1..18: mol_type = other DNA
taattcaattccctatag

SEQ ID NO: 26695 - DNA, 18 bp, synthetic construct
  source 1..18: mol_type = other DNA
taattcagctcattatag

SEQ ID NO: 26696 - DNA, 18 bp, synthetic construct
  source 1..18: mol_type = other DNA
taattcatcccactatag

SEQ ID NO: 26697 - DNA, 18 bp, synthetic construct
  source 1..18: mol_type = other DNA
taattcatctcacgatag

SEQ ID NO: 26698 - DNA, 18 bp, synthetic construct
  source 1..18: mol_type = other DNA
taattcgaatcacaatgg

SEQ ID NO: 26699 - DNA, 18 bp, synthetic construct
  source 1..18: mol_type = other DNA
taattcgaatcattatcg

SEQ ID NO: 26700 - DNA, 18 bp, synthetic construct
  source 1..18: mol_type = other DNA
taattcgacacaacatag

SEQ ID NO: 26701 - DNA, 18 bp, synthetic construct
  source 1..18: mol_type = other DNA
taattcgactatctttag

SEQ ID NO: 26702 - DNA, 18 bp, synthetic construct
  source 1..18: mol_type = other DNA
taattcgactcaatttcg

SEQ ID NO: 26703 - DNA, 18 bp, synthetic construct
  source 1..18: mol_type = other DNA
taattcgactcacattac

SEQ ID NO: 26704 - DNA, 18 bp, synthetic construct
  source 1..18: mol_type = other DNA
taattcgactgtatatag

SEQ ID NO: 26705 - DNA, 18 bp, synthetic construct
  source 1..18: mol_type = other DNA
taattcgccacaatatag

SEQ ID NO: 26706 - DNA, 18 bp, synthetic construct
  source 1..18: mol_type = other DNA
taattcgcctcacaacag

SEQ ID NO: 26707 - DNA, 18 bp, synthetic construct
  source 1..18: mol_type = other DNA
taattcggctcacaaaag

SEQ ID NO: 26708 - DNA, 18 bp, synthetic construct
  source 1..18: mol_type = other DNA
taattcgtctgactttag

SEQ ID NO: 26709 - DNA, 18 bp, synthetic construct
  source 1..18: mol_type = other DNA
taattctactcactcaag

SEQ ID NO: 26710 - DNA, 18 bp, synthetic construct
  source 1..18: mol_type = other DNA
taattctactgactatgg

SEQ ID NO: 26711 - DNA, 18 bp, synthetic construct
  source 1..18: mol_type = other DNA
taattctatgcactatag

SEQ ID NO: 26712 - DNA, 18 bp, synthetic construct
  source 1..18: mol_type = other DNA
taatttgaatcattatag

SEQ ID NO: 26713 - DNA, 18 bp, synthetic construct
  source 1..18: mol_type = other DNA
tactacaactcagtattg

SEQ ID NO: 26714 - DNA, 18 bp, synthetic construct
  source 1..18: mol_type = other DNA
tactacgaatcacaattg

SEQ ID NO: 26715 - DNA, 18 bp, synthetic construct
  source 1..18: mol_type = other DNA
tactactactcacaattg

SEQ ID NO: 26716 - DNA, 18 bp, synthetic construct
  source 1..18: mol_type = other DNA
tacttcgactcacaagag

SEQ ID NO: 26717 - DNA, 18 bp, synthetic construct
  source 1..18: mol_type = other DNA
tacttcgactcccaatag

SEQ ID NO: 26718 - DNA, 18 bp, synthetic construct
  source 1..18: mol_type = other DNA
tagatcgactcactaaag

SEQ ID NO: 26719 - DNA, 18 bp, synthetic construct
  source 1..18: mol_type = other DNA
tagtacgtctcactaatg

SEQ ID NO: 26720 - DNA, 18 bp, synthetic construct
  source 1..18: mol_type = other DNA
tagtccgacacactattg

SEQ ID NO: 26721 - DNA, 18 bp, synthetic construct
  source 1..18: mol_type = other DNA
tagttcgtctaactatag

SEQ ID NO: 26722 - DNA, 18 bp, synthetic construct
  source 1..18: mol_type = other DNA
tatatcgactcaatatag

SEQ ID NO: 26723 - DNA, 18 bp, synthetic construct
  source 1..18: mol_type = other DNA
tatatcgactcactatgg

SEQ ID NO: 26724 - DNA, 18 bp, synthetic construct
  source 1..18: mol_type = other DNA
tatgtccactcactatag

SEQ ID NO: 26725 - DNA, 18 bp, synthetic construct
  source 1..18: mol_type = other DNA
tattaagactcggtatag

SEQ ID NO: 26726 - DNA, 18 bp, synthetic construct
  source 1..18: mol_type = other DNA
tattacaactcactatta

SEQ ID NO: 26727 - DNA, 18 bp, synthetic construct
  source 1..18: mol_type = other DNA
tattacgactccctaatg

SEQ ID NO: 26728 - DNA, 18 bp, synthetic construct
  source 1..18: mol_type = other DNA
tattacggctctctattg

SEQ ID NO: 26729 - DNA, 18 bp, synthetic construct
  source 1..18: mol_type = other DNA
tattgcgactctctattg

SEQ ID NO: 26730 - DNA, 18 bp, synthetic construct
  source 1..18: mol_type = other DNA
tatttcacctcactatag

SEQ ID NO: 26731 - DNA, 18 bp, synthetic construct
  source 1..18: mol_type = other DNA
tatttcgaaccactatag

SEQ ID NO: 26732 - DNA, 18 bp, synthetic construct
  source 1..18: mol_type = other DNA
tatttcgacacactatcg

SEQ ID NO: 26733 - DNA, 18 bp, synthetic construct
  source 1..18: mol_type = other DNA
tatttcgactcaccctag

SEQ ID NO: 26734 - DNA, 18 bp, synthetic construct
  source 1..18: mol_type = other DNA
tatttcgactccctttag

SEQ ID NO: 26735 - DNA, 18 bp, synthetic construct
  source 1..18: mol_type = other DNA
tatttggtctcactatag

SEQ ID NO: 26736 - DNA, 18 bp, synthetic construct
  source 1..18: mol_type = other DNA
tcaaacgcctcgctatag

SEQ ID NO: 26737 - DNA, 18 bp, synthetic construct
  source 1..18: mol_type = other DNA
tcaatcgactcactctag

SEQ ID NO: 26738 - DNA, 18 bp, synthetic construct
  source 1..18: mol_type = other DNA
tcaattgactcactatag

SEQ ID NO: 26739 - DNA, 18 bp, synthetic construct
  source 1..18: mol_type = other DNA
tcatacgacaccctattg

SEQ ID NO: 26740 - DNA, 18 bp, synthetic construct
  source 1..18: mol_type = other DNA
tcatacgactctttattg

SEQ ID NO: 26741 - DNA, 18 bp, synthetic construct
  source 1..18: mol_type = other DNA
tcatacgtctcactatta

SEQ ID NO: 26742 - DNA, 18 bp, synthetic construct
  source 1..18: mol_type = other DNA
tcatactgctcactattg

SEQ ID NO: 26743 - DNA, 18 bp, synthetic construct
  source 1..18: mol_type = other DNA
tcataggacacactattg

SEQ ID NO: 26744 - DNA, 18 bp, synthetic construct
  source 1..18: mol_type = other DNA
tcattcgtctcaccatag

SEQ ID NO: 26745 - DNA, 18 bp, synthetic construct
  source 1..18: mol_type = other DNA
tcgtacgactcagtattg

SEQ ID NO: 26746 - DNA, 18 bp, synthetic construct
  source 1..18: mol_type = other DNA
tcttacgactcaatattg

SEQ ID NO: 26747 - DNA, 18 bp, synthetic construct
  source 1..18: mol_type = other DNA
tgaaacgactcactagtg

SEQ ID NO: 26748 - DNA, 18 bp, synthetic construct
  source 1..18: mol_type = other DNA
tgaatcgactaactatag

SEQ ID NO: 26749 - DNA, 18 bp, synthetic construct
  source 1..18: mol_type = other DNA
tgacacgattcactattg

SEQ ID NO: 26750 - DNA, 18 bp, synthetic construct
  source 1..18: mol_type = other DNA
tgattagacacactatag

SEQ ID NO: 26751 - DNA, 18 bp, synthetic construct
  source 1..18: mol_type = other DNA
tgattcctctcactatag

SEQ ID NO: 26752 - DNA, 18 bp, synthetic construct
  source 1..18: mol_type = other DNA
tgttacgattcactattg

SEQ ID NO: 26753 - DNA, 18 bp, synthetic construct
  source 1..18: mol_type = other DNA
ttaaacgactaactattg

SEQ ID NO: 26754 - DNA, 18 bp, synthetic construct
  source 1..18: mol_type = other DNA
ttaatccactcactatag

SEQ ID NO: 26755 - DNA, 18 bp, synthetic construct
  source 1..18: mol_type = other DNA
ttacacgacttactattg

SEQ ID NO: 26756 - DNA, 18 bp, synthetic construct
  source 1..18: mol_type = other DNA
ttagacgactcattattg

SEQ ID NO: 26757 - DNA, 18 bp, synthetic construct
  source 1..18: mol_type = other DNA
ttatacaactcgttatag

SEQ ID NO: 26758 - DNA, 18 bp, synthetic construct
  source 1..18: mol_type = other DNA
ttatacgaattactattg

SEQ ID NO: 26759 - DNA, 18 bp, synthetic construct
  source 1..18: mol_type = other DNA
ttatacgactcagcattg

SEQ ID NO: 26760 - DNA, 18 bp, synthetic construct
  source 1..18: mol_type = other DNA
ttatacgagtcaatattg

SEQ ID NO: 26761 - DNA, 18 bp, synthetic construct
  source 1..18: mol_type = other DNA
ttataggacccactattg

SEQ ID NO: 26762 - DNA, 18 bp, synthetic construct
  source 1..18: mol_type = other DNA
ttattcgacccactaaag

SEQ ID NO: 26763 - DNA, 18 bp, synthetic construct
  source 1..18: mol_type = other DNA
ttattcgatacactatag

SEQ ID NO: 26764 - DNA, 18 bp, synthetic construct
  source 1..18: mol_type = other DNA
ttattgggctcactatag

SEQ ID NO: 26765 - DNA, 18 bp, synthetic construct
  source 1..18: mol_type = other DNA
ttgttcgaatcactatag

SEQ ID NO: 26766 - DNA, 18 bp, synthetic construct
  source 1..18: mol_type = other DNA
ttttacgattcgctatag

SEQ ID NO: 26767 - DNA, 18 bp, synthetic construct
  source 1..18: mol_type = other DNA
ttttccgactcgctatag

SEQ ID NO: 26768 - DNA, 18 bp, synthetic construct
  source 1..18: mol_type = other DNA
tttttcgactctctatag

SEQ ID NO: 26769 - DNA, 18 bp, synthetic construct
  source 1..18: mol_type = other DNA
aaaaacgaccaactatag

SEQ ID NO: 26770 - DNA, 18 bp, synthetic construct
  source 1..18: mol_type = other DNA
aaaaacgactaactgtag

SEQ ID NO: 26771 - DNA, 18 bp, synthetic construct
  source 1..18: mol_type = other DNA
aaaagcgtctcactatag

SEQ ID NO: 26772 - DNA, 18 bp, synthetic construct
  source 1..18: mol_type = other DNA
aaacacgactccttatag

SEQ ID NO: 26773 - DNA, 18 bp, synthetic construct
  source 1..18: mol_type = other DNA
aaacacgacttcctatag

SEQ ID NO: 26774 - DNA, 18 bp, synthetic construct
  source 1..18: mol_type = other DNA
aaacatgactcaatatag

SEQ ID NO: 26775 - DNA, 18 bp, synthetic construct
  source 1..18: mol_type = other DNA
aaagacgactcactgtcg

SEQ ID NO: 26776 - DNA, 18 bp, synthetic construct
  source 1..18: mol_type = other DNA
aaataaacctcactatag

SEQ ID NO: 26777 - DNA, 18 bp, synthetic construct
  source 1..18: mol_type = other DNA
aaatacaactcacactag

SEQ ID NO: 26778 - DNA, 18 bp, synthetic construct
  source 1..18: mol_type = other DNA
aaatacatctcacgatag

SEQ ID NO: 26779 - DNA, 18 bp, synthetic construct
  source 1..18: mol_type = other DNA
aaataccactatctatag

SEQ ID NO: 26780 - DNA, 18 bp, synthetic construct
  source 1..18: mol_type = other DNA
aaataccacttacaatag

SEQ ID NO: 26781 - DNA, 18 bp, synthetic construct
  source 1..18: mol_type = other DNA
aaatacgaaccaatatag

SEQ ID NO: 26782 - DNA, 18 bp, synthetic construct
  source 1..18: mol_type = other DNA
aaatacgacaaagtatag

SEQ ID NO: 26783 - DNA, 18 bp, synthetic construct
  source 1..18: mol_type = other DNA
aaatacgactacctttag

SEQ ID NO: 26784 - DNA, 18 bp, synthetic construct
  source 1..18: mol_type = other DNA
aaatacgacttaatttag

SEQ ID NO: 26785 - DNA, 18 bp, synthetic construct
  source 1..18: mol_type = other DNA
aaatacgattctcaatag

SEQ ID NO: 26786 - DNA, 18 bp, synthetic construct
  source 1..18: mol_type = other DNA
aaatacgcctccctatcg

SEQ ID NO: 26787 - DNA, 18 bp, synthetic construct
  source 1..18: mol_type = other DNA
aaatacgtcacactatgg

SEQ ID NO: 26788 - DNA, 18 bp, synthetic construct
  source 1..18: mol_type = other DNA
aaatacgtcctactatag

SEQ ID NO: 26789 - DNA, 18 bp, synthetic construct
  source 1..18: mol_type = other DNA
aaatacgtctaacgatag

SEQ ID NO: 26790 - DNA, 18 bp, synthetic construct
  source 1..18: mol_type = other DNA
aaatacgtctcactgaag

SEQ ID NO: 26791 - DNA, 18 bp, synthetic construct
  source 1..18: mol_type = other DNA
aaatacgtctcagtttag

SEQ ID NO: 26792 - DNA, 18 bp, synthetic construct
  source 1..18: mol_type = other DNA
aaatacgtgtcacaatag

SEQ ID NO: 26793 - DNA, 18 bp, synthetic construct
  source 1..18: mol_type = other DNA
aaatactactcaccagag

SEQ ID NO: 26794 - DNA, 18 bp, synthetic construct
  source 1..18: mol_type = other DNA
aaatactactgacaatag

SEQ ID NO: 26795 - DNA, 18 bp, synthetic construct
  source 1..18: mol_type = other DNA
aaatacttctaactatag

SEQ ID NO: 26796 - DNA, 18 bp, synthetic construct
  source 1..18: mol_type = other DNA
aaataggacacactacag

SEQ ID NO: 26797 - DNA, 18 bp, synthetic construct
  source 1..18: mol_type = other DNA
aaatatatctcactatag

SEQ ID NO: 26798 - DNA, 18 bp, synthetic construct
  source 1..18: mol_type = other DNA
aaatatgcctcactaaag

SEQ ID NO: 26799 - DNA, 18 bp, synthetic construct
  source 1..18: mol_type = other DNA
aaatccatctcactatag

SEQ ID NO: 26800 - DNA, 18 bp, synthetic construct
  source 1..18: mol_type = other DNA
aaatccgactcactagcg

SEQ ID NO: 26801 - DNA, 18 bp, synthetic construct
  source 1..18: mol_type = other DNA
aaatccgactcacttcag

SEQ ID NO: 26802 - DNA, 18 bp, synthetic construct
  source 1..18: mol_type = other DNA
aaatgcgacacactatcg

SEQ ID NO: 26803 - DNA, 18 bp, synthetic construct
  source 1..18: mol_type = other DNA
aaatgcgactcacttaag

SEQ ID NO: 26804 - DNA, 18 bp, synthetic construct
  source 1..18: mol_type = other DNA
aacaacgacccactatag

SEQ ID NO: 26805 - DNA, 18 bp, synthetic construct
  source 1..18: mol_type = other DNA
aactacgacacactaaag

SEQ ID NO: 26806 - DNA, 18 bp, synthetic construct
  source 1..18: mol_type = other DNA
aactacgactcaatacag

SEQ ID NO: 26807 - DNA, 18 bp, synthetic construct
  source 1..18: mol_type = other DNA
aactacgcatcactatag

SEQ ID NO: 26808 - DNA, 18 bp, synthetic construct
  source 1..18: mol_type = other DNA
aactacgtctcactctag

SEQ ID NO: 26809 - DNA, 18 bp, synthetic construct
  source 1..18: mol_type = other DNA
aactgcgactcacaatag

SEQ ID NO: 26810 - DNA, 18 bp, synthetic construct
  source 1..18: mol_type = other DNA
aagtacggctcacaatag

SEQ ID NO: 26811 - DNA, 18 bp, synthetic construct
  source 1..18: mol_type = other DNA
aataacaactcactatag

SEQ ID NO: 26812 - DNA, 18 bp, synthetic construct
  source 1..18: mol_type = other DNA
aattacgattcacgatag

SEQ ID NO: 26813 - DNA, 18 bp, synthetic construct
  source 1..18: mol_type = other DNA
aattacgattcactatgg

SEQ ID NO: 26814 - DNA, 18 bp, synthetic construct
  source 1..18: mol_type = other DNA
aattcctactcactatag

SEQ ID NO: 26815 - DNA, 18 bp, synthetic construct
  source 1..18: mol_type = other DNA
acatacgacgcattatag

SEQ ID NO: 26816 - DNA, 18 bp, synthetic construct
  source 1..18: mol_type = other DNA
acatactaatcactatag

SEQ ID NO: 26817 - DNA, 18 bp, synthetic construct
  source 1..18: mol_type = other DNA
acatataactcactatag

SEQ ID NO: 26818 - DNA, 18 bp, synthetic construct
  source 1..18: mol_type = other DNA
agaaacgactcactttag

SEQ ID NO: 26819 - DNA, 18 bp, synthetic construct
  source 1..18: mol_type = other DNA
agataagactcaccatag

SEQ ID NO: 26820 - DNA, 18 bp, synthetic construct
  source 1..18: mol_type = other DNA
agatacgactcaataaag

SEQ ID NO: 26821 - DNA, 18 bp, synthetic construct
  source 1..18: mol_type = other DNA
agatacgactcccaatag

SEQ ID NO: 26822 - DNA, 18 bp, synthetic construct
  source 1..18: mol_type = other DNA
atataatactcactatag

SEQ ID NO: 26823 - DNA, 18 bp, synthetic construct
  source 1..18: mol_type = other DNA
atataccactcattatag

SEQ ID NO: 26824 - DNA, 18 bp, synthetic construct
  source 1..18: mol_type = other DNA
atatacgactcaatctag

SEQ ID NO: 26825 - DNA, 18 bp, synthetic construct
  source 1..18: mol_type = other DNA
atatacgagtcactttag

SEQ ID NO: 26826 - DNA, 18 bp, synthetic construct
  source 1..18: mol_type = other DNA
atatgcggctcactatag

SEQ ID NO: 26827 - DNA, 18 bp, synthetic construct
  source 1..18: mol_type = other DNA
caaaacgactgaccatag

SEQ ID NO: 26828 - DNA, 18 bp, synthetic construct
  source 1..18: mol_type = other DNA
caaaacgtctcactatgg

SEQ ID NO: 26829 - DNA, 18 bp, synthetic construct
  source 1..18: mol_type = other DNA
caataagacatactatag

SEQ ID NO: 26830 - DNA, 18 bp, synthetic construct
  source 1..18: mol_type = other DNA
caatacaagacactatag

SEQ ID NO: 26831 - DNA, 18 bp, synthetic construct
  source 1..18: mol_type = other DNA
caatacgacacactcaag

SEQ ID NO: 26832 - DNA, 18 bp, synthetic construct
  source 1..18: mol_type = other DNA
caatacgacacattatgg

SEQ ID NO: 26833 - DNA, 18 bp, synthetic construct
  source 1..18: mol_type = other DNA
caatacgactctcagtag

SEQ ID NO: 26834 - DNA, 18 bp, synthetic construct
  source 1..18: mol_type = other DNA
caatacggctctctatcg

SEQ ID NO: 26835 - DNA, 18 bp, synthetic construct
  source 1..18: mol_type = other DNA
caatactacagactatag

SEQ ID NO: 26836 - DNA, 18 bp, synthetic construct
  source 1..18: mol_type = other DNA
caatactattcaatatag

SEQ ID NO: 26837 - DNA, 18 bp, synthetic construct
  source 1..18: mol_type = other DNA
caatactccccactatag

SEQ ID NO: 26838 - DNA, 18 bp, synthetic construct
  source 1..18: mol_type = other DNA
caatatgactgacaatag

SEQ ID NO: 26839 - DNA, 18 bp, synthetic construct
  source 1..18: mol_type = other DNA
caatatgacttacaatag

SEQ ID NO: 26840 - DNA, 18 bp, synthetic construct
  source 1..18: mol_type = other DNA
cactaagactaactatag

SEQ ID NO: 26841 - DNA, 18 bp, synthetic construct
  source 1..18: mol_type = other DNA
cattacgactccctacag

SEQ ID NO: 26842 - DNA, 18 bp, synthetic construct
  source 1..18: mol_type = other DNA
cattacgcctctctatag

SEQ ID NO: 26843 - DNA, 18 bp, synthetic construct
  source 1..18: mol_type = other DNA
cattacgtgtcactatag

SEQ ID NO: 26844 - DNA, 18 bp, synthetic construct
  source 1..18: mol_type = other DNA
cattactagtcactatag

SEQ ID NO: 26845 - DNA, 18 bp, synthetic construct
  source 1..18: mol_type = other DNA
cgatacgacagactatag

SEQ ID NO: 26846 - DNA, 18 bp, synthetic construct
  source 1..18: mol_type = other DNA
ctaaacgactcagtatag

SEQ ID NO: 26847 - DNA, 18 bp, synthetic construct
  source 1..18: mol_type = other DNA
ctagaccactcactatag

SEQ ID NO: 26848 - DNA, 18 bp, synthetic construct
  source 1..18: mol_type = other DNA
ctgtacaactcactatag

SEQ ID NO: 26849 - DNA, 18 bp, synthetic construct
  source 1..18: mol_type = other DNA
ctttacaactcactatag

SEQ ID NO: 26850 - DNA, 18 bp, synthetic construct
  source 1..18: mol_type = other DNA
ctttacgactcattatag

SEQ ID NO: 26851 - DNA, 18 bp, synthetic construct
  source 1..18: mol_type = other DNA
gaaaacgtctcacaatag

SEQ ID NO: 26852 - DNA, 18 bp, synthetic construct
  source 1..18: mol_type = other DNA
gaacacagctcactatag

SEQ ID NO: 26853 - DNA, 18 bp, synthetic construct
  source 1..18: mol_type = other DNA
gcatacgacacacaatag

SEQ ID NO: 26854 - DNA, 18 bp, synthetic construct
  source 1..18: mol_type = other DNA
gtataccactcacaatag

SEQ ID NO: 26855 - DNA, 18 bp, synthetic construct
  source 1..18: mol_type = other DNA
gtatatgattcactatag

SEQ ID NO: 26856 - DNA, 18 bp, synthetic construct
  source 1..18: mol_type = other DNA
taaaaacactaactatag

SEQ ID NO: 26857 - DNA, 18 bp, synthetic construct
  source 1..18: mol_type = other DNA
taaaaagattaactatag

SEQ ID NO: 26858 - DNA, 18 bp, synthetic construct
  source 1..18: mol_type = other DNA
taaaacaaatcactttag

SEQ ID NO: 26859 - DNA, 18 bp, synthetic construct
  source 1..18: mol_type = other DNA
taaaaccactcactgaag

SEQ ID NO: 26860 - DNA, 18 bp, synthetic construct
  source 1..18: mol_type = other DNA
taaaacgaatcacaagag

SEQ ID NO: 26861 - DNA, 18 bp, synthetic construct
  source 1..18: mol_type = other DNA
taaaacgactcagaatgg

SEQ ID NO: 26862 - DNA, 18 bp, synthetic construct
  source 1..18: mol_type = other DNA
taaaacgatacactaaag

SEQ ID NO: 26863 - DNA, 18 bp, synthetic construct
  source 1..18: mol_type = other DNA
taaaacgatactctatag

SEQ ID NO: 26864 - DNA, 18 bp, synthetic construct
  source 1..18: mol_type = other DNA
taaaacgtaacactatag

SEQ ID NO: 26865 - DNA, 18 bp, synthetic construct
  source 1..18: mol_type = other DNA
taaaacgtcgcactaaag

SEQ ID NO: 26866 - DNA, 18 bp, synthetic construct
  source 1..18: mol_type = other DNA
taaaacgtctcactaagg

SEQ ID NO: 26867 - DNA, 18 bp, synthetic construct
  source 1..18: mol_type = other DNA
taaaactactaacaatag

SEQ ID NO: 26868 - DNA, 18 bp, synthetic construct
  source 1..18: mol_type = other DNA
taaaatgtgtcactatag

SEQ ID NO: 26869 - DNA, 18 bp, synthetic construct
  source 1..18: mol_type = other DNA
taaacccattcactatag

SEQ ID NO: 26870 - DNA, 18 bp, synthetic construct
  source 1..18: mol_type = other DNA
taaaccgactcacattag

SEQ ID NO: 26871 - DNA, 18 bp, synthetic construct
  source 1..18: mol_type = other DNA
taaaccgactctctatgg

SEQ ID NO: 26872 - DNA, 18 bp, synthetic construct
  source 1..18: mol_type = other DNA
taaaccgtatcactatag

SEQ ID NO: 26873 - DNA, 18 bp, synthetic construct
  source 1..18: mol_type = other DNA
taaagcgactcagtctag

SEQ ID NO: 26874 - DNA, 18 bp, synthetic construct
  source 1..18: mol_type = other DNA
taaagcgtctcactatcg

SEQ ID NO: 26875 - DNA, 18 bp, synthetic construct
  source 1..18: mol_type = other DNA
taacaatactcactatgg

SEQ ID NO: 26876 - DNA, 18 bp, synthetic construct
  source 1..18: mol_type = other DNA
taacacgacacactttcg

SEQ ID NO: 26877 - DNA, 18 bp, synthetic construct
  source 1..18: mol_type = other DNA
taacacgattctctatgg

SEQ ID NO: 26878 - DNA, 18 bp, synthetic construct
  source 1..18: mol_type = other DNA
taacacgatttagtatag

SEQ ID NO: 26879 - DNA, 18 bp, synthetic construct
  source 1..18: mol_type = other DNA
taacacgtatcactctag

SEQ ID NO: 26880 - DNA, 18 bp, synthetic construct
  source 1..18: mol_type = other DNA
taacacgtctcactaacg

SEQ ID NO: 26881 - DNA, 18 bp, synthetic construct
  source 1..18: mol_type = other DNA
taacacgtctctctacag

SEQ ID NO: 26882 - DNA, 18 bp, synthetic construct
  source 1..18: mol_type = other DNA
taacacgtttccctatag

SEQ ID NO: 26883 - DNA, 18 bp, synthetic construct
  source 1..18: mol_type = other DNA
taacaggatccactatag

SEQ ID NO: 26884 - DNA, 18 bp, synthetic construct
  source 1..18: mol_type = other DNA
taacccgactcattaaag

SEQ ID NO: 26885 - DNA, 18 bp, synthetic construct
  source 1..18: mol_type = other DNA
taacccgactctctagag

SEQ ID NO: 26886 - DNA, 18 bp, synthetic construct
  source 1..18: mol_type = other DNA
taagacgtctcaccaaag

SEQ ID NO: 26887 - DNA, 18 bp, synthetic construct
  source 1..18: mol_type = other DNA
taagactactctctttag

SEQ ID NO: 26888 - DNA, 18 bp, synthetic construct
  source 1..18: mol_type = other DNA
taataaaatacactatag

SEQ ID NO: 26889 - DNA, 18 bp, synthetic construct
  source 1..18: mol_type = other DNA
taataagacacacattag

SEQ ID NO: 26890 - DNA, 18 bp, synthetic construct
  source 1..18: mol_type = other DNA
taataagacagtctatag

SEQ ID NO: 26891 - DNA, 18 bp, synthetic construct
  source 1..18: mol_type = other DNA
taataagacatattatag

SEQ ID NO: 26892 - DNA, 18 bp, synthetic construct
  source 1..18: mol_type = other DNA
taataagactcatactag

SEQ ID NO: 26893 - DNA, 18 bp, synthetic construct
  source 1..18: mol_type = other DNA
taataagactcccaacag

SEQ ID NO: 26894 - DNA, 18 bp, synthetic construct
  source 1..18: mol_type = other DNA
taataagatacacaatag

SEQ ID NO: 26895 - DNA, 18 bp, synthetic construct
  source 1..18: mol_type = other DNA
taataagattatctatag

SEQ ID NO: 26896 - DNA, 18 bp, synthetic construct
  source 1..18: mol_type = other DNA
taataagattctctagag

SEQ ID NO: 26897 - DNA, 18 bp, synthetic construct
  source 1..18: mol_type = other DNA
taataagtccccctatag

SEQ ID NO: 26898 - DNA, 18 bp, synthetic construct
  source 1..18: mol_type = other DNA
taataatacttactatgg

SEQ ID NO: 26899 - DNA, 18 bp, synthetic construct
  source 1..18: mol_type = other DNA
taatacaaaacactacag

SEQ ID NO: 26900 - DNA, 18 bp, synthetic construct
  source 1..18: mol_type = other DNA
taatacaaatcattaaag

SEQ ID NO: 26901 - DNA, 18 bp, synthetic construct
  source 1..18: mol_type = other DNA
taatacaactcacaaacg

SEQ ID NO: 26902 - DNA, 18 bp, synthetic construct
  source 1..18: mol_type = other DNA
taatacaatacactatcg

SEQ ID NO: 26903 - DNA, 18 bp, synthetic construct
  source 1..18: mol_type = other DNA
taatacaattaaatatag

SEQ ID NO: 26904 - DNA, 18 bp, synthetic construct
  source 1..18: mol_type = other DNA
taatacatgacactatag

SEQ ID NO: 26905 - DNA, 18 bp, synthetic construct
  source 1..18: mol_type = other DNA
taataccacacattttag

SEQ ID NO: 26906 - DNA, 18 bp, synthetic construct
  source 1..18: mol_type = other DNA
taataccacactttatag

SEQ ID NO: 26907 - DNA, 18 bp, synthetic construct
  source 1..18: mol_type = other DNA
taataccacataccatag

SEQ ID NO: 26908 - DNA, 18 bp, synthetic construct
  source 1..18: mol_type = other DNA
taataccactctctgaag

SEQ ID NO: 26909 - DNA, 18 bp, synthetic construct
  source 1..18: mol_type = other DNA
taataccactctgaatag

SEQ ID NO: 26910 - DNA, 18 bp, synthetic construct
  source 1..18: mol_type = other DNA
taataccacttactcaag

SEQ ID NO: 26911 - DNA, 18 bp, synthetic construct
  source 1..18: mol_type = other DNA
taatacctcaaactatag

SEQ ID NO: 26912 - DNA, 18 bp, synthetic construct
  source 1..18: mol_type = other DNA
taatacgaaacattgtag

SEQ ID NO: 26913 - DNA, 18 bp, synthetic construct
  source 1..18: mol_type = other DNA
taatacgaatcacattcg

SEQ ID NO: 26914 - DNA, 18 bp, synthetic construct
  source 1..18: mol_type = other DNA
taatacgacacacatcag

SEQ ID NO: 26915 - DNA, 18 bp, synthetic construct
  source 1..18: mol_type = other DNA
taatacgacacactgtcc

SEQ ID NO: 26916 - DNA, 18 bp, synthetic construct
  source 1..18: mol_type = other DNA
taatacgacactttaaag

SEQ ID NO: 26917 - DNA, 18 bp, synthetic construct
  source 1..18: mol_type = other DNA
taatacgaccatctatgg

SEQ ID NO: 26918 - DNA, 18 bp, synthetic construct
  source 1..18: mol_type = other DNA
taatacgactaaattgag

SEQ ID NO: 26919 - DNA, 18 bp, synthetic construct
  source 1..18: mol_type = other DNA
taatacgactaagaatcg

SEQ ID NO: 26920 - DNA, 18 bp, synthetic construct
  source 1..18: mol_type = other DNA
taatacgactatcttaag

SEQ ID NO: 26921 - DNA, 18 bp, synthetic construct
  source 1..18: mol_type = other DNA
taatacgactcagttacg

SEQ ID NO: 26922 - DNA, 18 bp, synthetic construct
  source 1..18: mol_type = other DNA
taatacgactcccagaag

SEQ ID NO: 26923 - DNA, 18 bp, synthetic construct
  source 1..18: mol_type = other DNA
taatacgactcctcaaag

SEQ ID NO: 26924 - DNA, 18 bp, synthetic construct
  source 1..18: mol_type = other DNA
taatacgactctcagcag

SEQ ID NO: 26925 - DNA, 18 bp, synthetic construct
  source 1..18: mol_type = other DNA
taatacgactctttttcg

SEQ ID NO: 26926 - DNA, 18 bp, synthetic construct
  source 1..18: mol_type = other DNA
taatacgactgattctcg

SEQ ID NO: 26927 - DNA, 18 bp, synthetic construct
  source 1..18: mol_type = other DNA
taatacgactgtccttag

SEQ ID NO: 26928 - DNA, 18 bp, synthetic construct
  source 1..18: mol_type = other DNA
taatacgagactttatag

SEQ ID NO: 26929 - DNA, 18 bp, synthetic construct
  source 1..18: mol_type = other DNA
taatacgagcctttatag

SEQ ID NO: 26930 - DNA, 18 bp, synthetic construct
  source 1..18: mol_type = other DNA
taatacgagtcatgaaag

SEQ ID NO: 26931 - DNA, 18 bp, synthetic construct
  source 1..18: mol_type = other DNA
taatacgagtctcttgag

SEQ ID NO: 26932 - DNA, 18 bp, synthetic construct
  source 1..18: mol_type = other DNA
taatacgatacagaatag

SEQ ID NO: 26933 - DNA, 18 bp, synthetic construct
  source 1..18: mol_type = other DNA
taatacgatgcataatag

SEQ ID NO: 26934 - DNA, 18 bp, synthetic construct
  source 1..18: mol_type = other DNA
taatacgattcacaccag

SEQ ID NO: 26935 - DNA, 18 bp, synthetic construct
  source 1..18: mol_type = other DNA
taatacgattgacaacag

SEQ ID NO: 26936 - DNA, 18 bp, synthetic construct
  source 1..18: mol_type = other DNA
taatacgcctaattaaag

SEQ ID NO: 26937 - DNA, 18 bp, synthetic construct
  source 1..18: mol_type = other DNA
taatacgcctcacagaag

SEQ ID NO: 26938 - DNA, 18 bp, synthetic construct
  source 1..18: mol_type = other DNA
taatacgcctcagtttcg

SEQ ID NO: 26939 - DNA, 18 bp, synthetic construct
  source 1..18: mol_type = other DNA
taatacgtattactgtag

SEQ ID NO: 26940 - DNA, 18 bp, synthetic construct
  source 1..18: mol_type = other DNA
taatacgtctcacctcag

SEQ ID NO: 26941 - DNA, 18 bp, synthetic construct
  source 1..18: mol_type = other DNA
taatacgtctcagtgtcg

SEQ ID NO: 26942 - DNA, 18 bp, synthetic construct
  source 1..18: mol_type = other DNA
taatacgtctgacaacag

SEQ ID NO: 26943 - DNA, 18 bp, synthetic construct
  source 1..18: mol_type = other DNA
taatacgtctgactttgg

SEQ ID NO: 26944 - DNA, 18 bp, synthetic construct
  source 1..18: mol_type = other DNA
taatacgtcttacagtag

SEQ ID NO: 26945 - DNA, 18 bp, synthetic construct
  source 1..18: mol_type = other DNA
taatacgtcttagtttag

SEQ ID NO: 26946 - DNA, 18 bp, synthetic construct
  source 1..18: mol_type = other DNA
taatacgtttaactatcg

SEQ ID NO: 26947 - DNA, 18 bp, synthetic construct
  source 1..18: mol_type = other DNA
taatactaatcaataaag

SEQ ID NO: 26948 - DNA, 18 bp, synthetic construct
  source 1..18: mol_type = other DNA
taatactaattactaaag

SEQ ID NO: 26949 - DNA, 18 bp, synthetic construct
  source 1..18: mol_type = other DNA
taatactacacaatacag

SEQ ID NO: 26950 - DNA, 18 bp, synthetic construct
  source 1..18: mol_type = other DNA
taatactacgtaccatag

SEQ ID NO: 26951 - DNA, 18 bp, synthetic construct
  source 1..18: mol_type = other DNA
taatactacgtactctag

SEQ ID NO: 26952 - DNA, 18 bp, synthetic construct
  source 1..18: mol_type = other DNA
taatactgcacactgtag

SEQ ID NO: 26953 - DNA, 18 bp, synthetic construct
  source 1..18: mol_type = other DNA
taatacttctcactttgg

SEQ ID NO: 26954 - DNA, 18 bp, synthetic construct
  source 1..18: mol_type = other DNA
taatagatctcactaaag

SEQ ID NO: 26955 - DNA, 18 bp, synthetic construct
  source 1..18: mol_type = other DNA
taataggaatttctatag

SEQ ID NO: 26956 - DNA, 18 bp, synthetic construct
  source 1..18: mol_type = other DNA
taataggactcatttcag

SEQ ID NO: 26957 - DNA, 18 bp, synthetic construct
  source 1..18: mol_type = other DNA
taataggactctctgaag

SEQ ID NO: 26958 - DNA, 18 bp, synthetic construct
  source 1..18: mol_type = other DNA
taataggacttaataaag

SEQ ID NO: 26959 - DNA, 18 bp, synthetic construct
  source 1..18: mol_type = other DNA
taataggatacattatag

SEQ ID NO: 26960 - DNA, 18 bp, synthetic construct
  source 1..18: mol_type = other DNA
taatagttttcactatag

SEQ ID NO: 26961 - DNA, 18 bp, synthetic construct
  source 1..18: mol_type = other DNA
taatatgaatcactacgg

SEQ ID NO: 26962 - DNA, 18 bp, synthetic construct
  source 1..18: mol_type = other DNA
taatatgaatctcaatag

SEQ ID NO: 26963 - DNA, 18 bp, synthetic construct
  source 1..18: mol_type = other DNA
taatatgacaaactacag

SEQ ID NO: 26964 - DNA, 18 bp, synthetic construct
  source 1..18: mol_type = other DNA
taatatgacattctatag

SEQ ID NO: 26965 - DNA, 18 bp, synthetic construct
  source 1..18: mol_type = other DNA
taatatgacccacattag

SEQ ID NO: 26966 - DNA, 18 bp, synthetic construct
  source 1..18: mol_type = other DNA
taatatgactcacttacg

SEQ ID NO: 26967 - DNA, 18 bp, synthetic construct
  source 1..18: mol_type = other DNA
taatatgactcatactag

SEQ ID NO: 26968 - DNA, 18 bp, synthetic construct
  source 1..18: mol_type = other DNA
taatatgactcattttcg

SEQ ID NO: 26969 - DNA, 18 bp, synthetic construct
  source 1..18: mol_type = other DNA
taatatgacttaatagag

SEQ ID NO: 26970 - DNA, 18 bp, synthetic construct
  source 1..18: mol_type = other DNA
taatatgatacactacag

SEQ ID NO: 26971 - DNA, 18 bp, synthetic construct
  source 1..18: mol_type = other DNA
taatatggcgcactttag

SEQ ID NO: 26972 - DNA, 18 bp, synthetic construct
  source 1..18: mol_type = other DNA
taatatgtatctctatag

SEQ ID NO: 26973 - DNA, 18 bp, synthetic construct
  source 1..18: mol_type = other DNA
taatatgtctcaatttag

SEQ ID NO: 26974 - DNA, 18 bp, synthetic construct
  source 1..18: mol_type = other DNA
taatatttcccactatag

SEQ ID NO: 26975 - DNA, 18 bp, synthetic construct
  source 1..18: mol_type = other DNA
taatcagacttcctatag

SEQ ID NO: 26976 - DNA, 18 bp, synthetic construct
  source 1..18: mol_type = other DNA
taatcagattcaatatag

SEQ ID NO: 26977 - DNA, 18 bp, synthetic construct
  source 1..18: mol_type = other DNA
taatcccacacactaaag

SEQ ID NO: 26978 - DNA, 18 bp, synthetic construct
  source 1..18: mol_type = other DNA
taatccgacacaccatgg

SEQ ID NO: 26979 - DNA, 18 bp, synthetic construct
  source 1..18: mol_type = other DNA
taatccgacgctcaatag

SEQ ID NO: 26980 - DNA, 18 bp, synthetic construct
  source 1..18: mol_type = other DNA
taatccgactaaatttag

SEQ ID NO: 26981 - DNA, 18 bp, synthetic construct
  source 1..18: mol_type = other DNA
taatccgactctcaagag

SEQ ID NO: 26982 - DNA, 18 bp, synthetic construct
  source 1..18: mol_type = other DNA
taatccgcctatctatag

SEQ ID NO: 26983 - DNA, 18 bp, synthetic construct
  source 1..18: mol_type = other DNA
taatccgtaccactatag

SEQ ID NO: 26984 - DNA, 18 bp, synthetic construct
  source 1..18: mol_type = other DNA
taatccgtctcactttcg

SEQ ID NO: 26985 - DNA, 18 bp, synthetic construct
  source 1..18: mol_type = other DNA
taatccgtttcacaatag

SEQ ID NO: 26986 - DNA, 18 bp, synthetic construct
  source 1..18: mol_type = other DNA
taatctgaatcaatatag

SEQ ID NO: 26987 - DNA, 18 bp, synthetic construct
  source 1..18: mol_type = other DNA
taatgcgacacacgaaag

SEQ ID NO: 26988 - DNA, 18 bp, synthetic construct
  source 1..18: mol_type = other DNA
taatgcgactcaatttgg

SEQ ID NO: 26989 - DNA, 18 bp, synthetic construct
  source 1..18: mol_type = other DNA
taatgcgactctcaagag

SEQ ID NO: 26990 - DNA, 18 bp, synthetic construct
  source 1..18: mol_type = other DNA
taatgcgactgtctatgg

SEQ ID NO: 26991 - DNA, 18 bp, synthetic construct
  source 1..18: mol_type = other DNA
taatgcgagtcactttcg

SEQ ID NO: 26992 - DNA, 18 bp, synthetic construct
  source 1..18: mol_type = other DNA
taatgcgtattactatag

SEQ ID NO: 26993 - DNA, 18 bp, synthetic construct
  source 1..18: mol_type = other DNA
taatgcgtctttctatag

SEQ ID NO: 26994 - DNA, 18 bp, synthetic construct
  source 1..18: mol_type = other DNA
taatgggactcacaatcg

SEQ ID NO: 26995 - DNA, 18 bp, synthetic construct
  source 1..18: mol_type = other DNA
taatgtgactctcgatag

SEQ ID NO: 26996 - DNA, 18 bp, synthetic construct
  source 1..18: mol_type = other DNA
taatgtgattcactacag

SEQ ID NO: 26997 - DNA, 18 bp, synthetic construct
  source 1..18: mol_type = other DNA
taatgtgtctcaccatag

SEQ ID NO: 26998 - DNA, 18 bp, synthetic construct
  source 1..18: mol_type = other DNA
tacaacgactcattctag

SEQ ID NO: 26999 - DNA, 18 bp, synthetic construct
  source 1..18: mol_type = other DNA
tacaacgactctctttag

SEQ ID NO: 27000 - DNA, 18 bp, synthetic construct
  source 1..18: mol_type = other DNA
tacaacgcttcactatag

SEQ ID NO: 27001 - DNA, 18 bp, synthetic construct
  source 1..18: mol_type = other DNA
tacaatgactcactatcg

SEQ ID NO: 27002 - DNA, 18 bp, synthetic construct
  source 1..18: mol_type = other DNA
taccgcgactcactaaag

SEQ ID NO: 27003 - DNA, 18 bp, synthetic construct
  source 1..18: mol_type = other DNA
tacgacaactcactaaag

SEQ ID NO: 27004 - DNA, 18 bp, synthetic construct
  source 1..18: mol_type = other DNA
tactacgaatcaccttag

SEQ ID NO: 27005 - DNA, 18 bp, synthetic construct
  source 1..18: mol_type = other DNA
tactacgactcacttccg

SEQ ID NO: 27006 - DNA, 18 bp, synthetic construct
  source 1..18: mol_type = other DNA
tactacggctacctatag

SEQ ID NO: 27007 - DNA, 18 bp, synthetic construct
  source 1..18: mol_type = other DNA
tactacgtctcagcatag

SEQ ID NO: 27008 - DNA, 18 bp, synthetic construct
  source 1..18: mol_type = other DNA
tactacgtctcattttag

SEQ ID NO: 27009 - DNA, 18 bp, synthetic construct
  source 1..18: mol_type = other DNA
tactactattctctatag

SEQ ID NO: 27010 - DNA, 18 bp, synthetic construct
  source 1..18: mol_type = other DNA
tactaggactcactttcg

SEQ ID NO: 27011 - DNA, 18 bp, synthetic construct
  source 1..18: mol_type = other DNA
tagaacgactcattatgg

SEQ ID NO: 27012 - DNA, 18 bp, synthetic construct
  source 1..18: mol_type = other DNA
tagaacgactctttatag

SEQ ID NO: 27013 - DNA, 18 bp, synthetic construct
  source 1..18: mol_type = other DNA
tagaacgacttactatgg

SEQ ID NO: 27014 - DNA, 18 bp, synthetic construct
  source 1..18: mol_type = other DNA
tagaacgactttctatag

SEQ ID NO: 27015 - DNA, 18 bp, synthetic construct
  source 1..18: mol_type = other DNA
tagagcggctcactatag

SEQ ID NO: 27016 - DNA, 18 bp, synthetic construct
  source 1..18: mol_type = other DNA
tagcacgattcaatatag

SEQ ID NO: 27017 - DNA, 18 bp, synthetic construct
  source 1..18: mol_type = other DNA
tagtacaactaactttag

SEQ ID NO: 27018 - DNA, 18 bp, synthetic construct
  source 1..18: mol_type = other DNA
tagtacacctgactatag

SEQ ID NO: 27019 - DNA, 18 bp, synthetic construct
  source 1..18: mol_type = other DNA
tagtacgactaaccaaag

SEQ ID NO: 27020 - DNA, 18 bp, synthetic construct
  source 1..18: mol_type = other DNA
tagtacgactctacatag

SEQ ID NO: 27021 - DNA, 18 bp, synthetic construct
  source 1..18: mol_type = other DNA
tagtacgtctcaccctag

SEQ ID NO: 27022 - DNA, 18 bp, synthetic construct
  source 1..18: mol_type = other DNA
tagtacgtttcactacag

SEQ ID NO: 27023 - DNA, 18 bp, synthetic construct
  source 1..18: mol_type = other DNA
tagtacttctcactaaag

SEQ ID NO: 27024 - DNA, 18 bp, synthetic construct
  source 1..18: mol_type = other DNA
tagtaggtctcactttag

SEQ ID NO: 27025 - DNA, 18 bp, synthetic construct
  source 1..18: mol_type = other DNA
tagtatgacactctatag

SEQ ID NO: 27026 - DNA, 18 bp, synthetic construct
  source 1..18: mol_type = other DNA
tagtatgacatactatag

SEQ ID NO: 27027 - DNA, 18 bp, synthetic construct
  source 1..18: mol_type = other DNA
tagtattacacactatag

SEQ ID NO: 27028 - DNA, 18 bp, synthetic construct
  source 1..18: mol_type = other DNA
tagtccgagtcactagag

SEQ ID NO: 27029 - DNA, 18 bp, synthetic construct
  source 1..18: mol_type = other DNA
tagtgcatctcactatag

SEQ ID NO: 27030 - DNA, 18 bp, synthetic construct
  source 1..18: mol_type = other DNA
tagtgcgtttcactatag

SEQ ID NO: 27031 - DNA, 18 bp, synthetic construct
  source 1..18: mol_type = other DNA
tataacaactcactacag

SEQ ID NO: 27032 - DNA, 18 bp, synthetic construct
  source 1..18: mol_type = other DNA
tataacaactcagtatag

SEQ ID NO: 27033 - DNA, 18 bp, synthetic construct
  source 1..18: mol_type = other DNA
tataacgattccctatag

SEQ ID NO: 27034 - DNA, 18 bp, synthetic construct
  source 1..18: mol_type = other DNA
tataatgactcactagag

SEQ ID NO: 27035 - DNA, 18 bp, synthetic construct
  source 1..18: mol_type = other DNA
tatagagactcactatag

SEQ ID NO: 27036 - DNA, 18 bp, synthetic construct
  source 1..18: mol_type = other DNA
tatcaagacttactatag

SEQ ID NO: 27037 - DNA, 18 bp, synthetic construct
  source 1..18: mol_type = other DNA
tatcacgactaacaatag

SEQ ID NO: 27038 - DNA, 18 bp, synthetic construct
  source 1..18: mol_type = other DNA
tatcacgactttctatag

SEQ ID NO: 27039 - DNA, 18 bp, synthetic construct
  source 1..18: mol_type = other DNA
tatcacgccttactatag

SEQ ID NO: 27040 - DNA, 18 bp, synthetic construct
  source 1..18: mol_type = other DNA
tatcactaatcactatag

SEQ ID NO: 27041 - DNA, 18 bp, synthetic construct
  source 1..18: mol_type = other DNA
tatgacgtctaactatag

SEQ ID NO: 27042 - DNA, 18 bp, synthetic construct
  source 1..18: mol_type = other DNA
tattaagacccattatag

SEQ ID NO: 27043 - DNA, 18 bp, synthetic construct
  source 1..18: mol_type = other DNA
tattaagactcattaaag

SEQ ID NO: 27044 - DNA, 18 bp, synthetic construct
  source 1..18: mol_type = other DNA
tattaagacttacaatag

SEQ ID NO: 27045 - DNA, 18 bp, synthetic construct
  source 1..18: mol_type = other DNA
tattacaacttactttag

SEQ ID NO: 27046 - DNA, 18 bp, synthetic construct
  source 1..18: mol_type = other DNA
tattacaacttcctatag

SEQ ID NO: 27047 - DNA, 18 bp, synthetic construct
  source 1..18: mol_type = other DNA
tattacagctgactatag

SEQ ID NO: 27048 - DNA, 18 bp, synthetic construct
  source 1..18: mol_type = other DNA
tattaccactcattaaag

SEQ ID NO: 27049 - DNA, 18 bp, synthetic construct
  source 1..18: mol_type = other DNA
tattacgaatcaatttag

SEQ ID NO: 27050 - DNA, 18 bp, synthetic construct
  source 1..18: mol_type = other DNA
tattacgaatcattatcg

SEQ ID NO: 27051 - DNA, 18 bp, synthetic construct
  source 1..18: mol_type = other DNA
tattacgaatgaccatag

SEQ ID NO: 27052 - DNA, 18 bp, synthetic construct
  source 1..18: mol_type = other DNA
tattacgacaaactatcg

SEQ ID NO: 27053 - DNA, 18 bp, synthetic construct
  source 1..18: mol_type = other DNA
tattacgacacacaagag

SEQ ID NO: 27054 - DNA, 18 bp, synthetic construct
  source 1..18: mol_type = other DNA
tattacgactcagtttcg

SEQ ID NO: 27055 - DNA, 18 bp, synthetic construct
  source 1..18: mol_type = other DNA
tattacgactctcaagag

SEQ ID NO: 27056 - DNA, 18 bp, synthetic construct
  source 1..18: mol_type = other DNA
tattacgattaactaaag

SEQ ID NO: 27057 - DNA, 18 bp, synthetic construct
  source 1..18: mol_type = other DNA
tattacgattcaatacag

SEQ ID NO: 27058 - DNA, 18 bp, synthetic construct
  source 1..18: mol_type = other DNA
tattacgccttactaaag

SEQ ID NO: 27059 - DNA, 18 bp, synthetic construct
  source 1..18: mol_type = other DNA
tattacgcttcactatgg

SEQ ID NO: 27060 - DNA, 18 bp, synthetic construct
  source 1..18: mol_type = other DNA
tattacgtataactatag

SEQ ID NO: 27061 - DNA, 18 bp, synthetic construct
  source 1..18: mol_type = other DNA
tattacgtcaccctatag

SEQ ID NO: 27062 - DNA, 18 bp, synthetic construct
  source 1..18: mol_type = other DNA
tattactcctcacaatag

SEQ ID NO: 27063 - DNA, 18 bp, synthetic construct
  source 1..18: mol_type = other DNA
tattaggacccacgatag

SEQ ID NO: 27064 - DNA, 18 bp, synthetic construct
  source 1..18: mol_type = other DNA
tattatctctcactatag

SEQ ID NO: 27065 - DNA, 18 bp, synthetic construct
  source 1..18: mol_type = other DNA
tattatgactcaatttag

SEQ ID NO: 27066 - DNA, 18 bp, synthetic construct
  source 1..18: mol_type = other DNA
tattatgtctaactatag

SEQ ID NO: 27067 - DNA, 18 bp, synthetic construct
  source 1..18: mol_type = other DNA
tattccgactgattatag

SEQ ID NO: 27068 - DNA, 18 bp, synthetic construct
  source 1..18: mol_type = other DNA
tattccgattcattatag

SEQ ID NO: 27069 - DNA, 18 bp, synthetic construct
  source 1..18: mol_type = other DNA
tattccgtcttactatag

SEQ ID NO: 27070 - DNA, 18 bp, synthetic construct
  source 1..18: mol_type = other DNA
tattcctactccctatag

SEQ ID NO: 27071 - DNA, 18 bp, synthetic construct
  source 1..18: mol_type = other DNA
tattctgactcaatatag

SEQ ID NO: 27072 - DNA, 18 bp, synthetic construct
  source 1..18: mol_type = other DNA
tattgtgattcactatag

SEQ ID NO: 27073 - DNA, 18 bp, synthetic construct
  source 1..18: mol_type = other DNA
tcaaactactcactaaag

SEQ ID NO: 27074 - DNA, 18 bp, synthetic construct
  source 1..18: mol_type = other DNA
tcaaatgtctcactatag

SEQ ID NO: 27075 - DNA, 18 bp, synthetic construct
  source 1..18: mol_type = other DNA
tcaaccgacacactatag

SEQ ID NO: 27076 - DNA, 18 bp, synthetic construct
  source 1..18: mol_type = other DNA
tcacacgactctcaatag

SEQ ID NO: 27077 - DNA, 18 bp, synthetic construct
  source 1..18: mol_type = other DNA
tcataagacttactttag

SEQ ID NO: 27078 - DNA, 18 bp, synthetic construct
  source 1..18: mol_type = other DNA
tcatacaacacacaatag

SEQ ID NO: 27079 - DNA, 18 bp, synthetic construct
  source 1..18: mol_type = other DNA
tcatacagctcacaatag

SEQ ID NO: 27080 - DNA, 18 bp, synthetic construct
  source 1..18: mol_type = other DNA
tcatacgaatcattgtag

SEQ ID NO: 27081 - DNA, 18 bp, synthetic construct
  source 1..18: mol_type = other DNA
tcatacggctgactgtag

SEQ ID NO: 27082 - DNA, 18 bp, synthetic construct
  source 1..18: mol_type = other DNA
tcatacgtcacactctag

SEQ ID NO: 27083 - DNA, 18 bp, synthetic construct
  source 1..18: mol_type = other DNA
tcatacgtttcactgtag

SEQ ID NO: 27084 - DNA, 18 bp, synthetic construct
  source 1..18: mol_type = other DNA
tcatacttatcactatag

SEQ ID NO: 27085 - DNA, 18 bp, synthetic construct
  source 1..18: mol_type = other DNA
tcatatgactcaatttag

SEQ ID NO: 27086 - DNA, 18 bp, synthetic construct
  source 1..18: mol_type = other DNA
tcatatgactcactttgg

SEQ ID NO: 27087 - DNA, 18 bp, synthetic construct
  source 1..18: mol_type = other DNA
tcatatgactgcctatag

SEQ ID NO: 27088 - DNA, 18 bp, synthetic construct
  source 1..18: mol_type = other DNA
tcatccgacacactatcg

SEQ ID NO: 27089 - DNA, 18 bp, synthetic construct
  source 1..18: mol_type = other DNA
tcatccgacccactatgg

SEQ ID NO: 27090 - DNA, 18 bp, synthetic construct
  source 1..18: mol_type = other DNA
tcatgcaactccctatag

SEQ ID NO: 27091 - DNA, 18 bp, synthetic construct
  source 1..18: mol_type = other DNA
tcttacaacacactatag

SEQ ID NO: 27092 - DNA, 18 bp, synthetic construct
  source 1..18: mol_type = other DNA
tcttacaactcactaaag

SEQ ID NO: 27093 - DNA, 18 bp, synthetic construct
  source 1..18: mol_type = other DNA
tcttagaactcactatag

SEQ ID NO: 27094 - DNA, 18 bp, synthetic construct
  source 1..18: mol_type = other DNA
tcttaggactcactttag

SEQ ID NO: 27095 - DNA, 18 bp, synthetic construct
  source 1..18: mol_type = other DNA
tcttcctactcactatag

SEQ ID NO: 27096 - DNA, 18 bp, synthetic construct
  source 1..18: mol_type = other DNA
tgaaaaaactcactatag

SEQ ID NO: 27097 - DNA, 18 bp, synthetic construct
  source 1..18: mol_type = other DNA
tgaaatgactcactttag

SEQ ID NO: 27098 - DNA, 18 bp, synthetic construct
  source 1..18: mol_type = other DNA
tgataaaactcactaaag

SEQ ID NO: 27099 - DNA, 18 bp, synthetic construct
  source 1..18: mol_type = other DNA
tgataagactcacaaaag

SEQ ID NO: 27100 - DNA, 18 bp, synthetic construct
  source 1..18: mol_type = other DNA
tgataatactcattatag

SEQ ID NO: 27101 - DNA, 18 bp, synthetic construct
  source 1..18: mol_type = other DNA
tgatacaactcagaatag

SEQ ID NO: 27102 - DNA, 18 bp, synthetic construct
  source 1..18: mol_type = other DNA
tgatacgactaactctcg

SEQ ID NO: 27103 - DNA, 18 bp, synthetic construct
  source 1..18: mol_type = other DNA
tgatacggcccagtatag

SEQ ID NO: 27104 - DNA, 18 bp, synthetic construct
  source 1..18: mol_type = other DNA
tgatacggcttactttag

SEQ ID NO: 27105 - DNA, 18 bp, synthetic construct
  source 1..18: mol_type = other DNA
tgatactaatcactttag

SEQ ID NO: 27106 - DNA, 18 bp, synthetic construct
  source 1..18: mol_type = other DNA
tgatgcgtctcaccatag

SEQ ID NO: 27107 - DNA, 18 bp, synthetic construct
  source 1..18: mol_type = other DNA
tggtacgacactctatag

SEQ ID NO: 27108 - DNA, 18 bp, synthetic construct
  source 1..18: mol_type = other DNA
tgttacgactcacgaaag

SEQ ID NO: 27109 - DNA, 18 bp, synthetic construct
  source 1..18: mol_type = other DNA
tgttacgtctgactatag

SEQ ID NO: 27110 - DNA, 18 bp, synthetic construct
  source 1..18: mol_type = other DNA
tgttactactcactttag

SEQ ID NO: 27111 - DNA, 18 bp, synthetic construct
  source 1..18: mol_type = other DNA
ttaaaagactcaccatag

SEQ ID NO: 27112 - DNA, 18 bp, synthetic construct
  source 1..18: mol_type = other DNA
ttaaacaactcactatcg

SEQ ID NO: 27113 - DNA, 18 bp, synthetic construct
  source 1..18: mol_type = other DNA
ttacaagacacactatag

SEQ ID NO: 27114 - DNA, 18 bp, synthetic construct
  source 1..18: mol_type = other DNA
ttacacgattcactttag

SEQ ID NO: 27115 - DNA, 18 bp, synthetic construct
  source 1..18: mol_type = other DNA
ttagaagacttactatag

SEQ ID NO: 27116 - DNA, 18 bp, synthetic construct
  source 1..18: mol_type = other DNA
ttagaccactcactaaag

SEQ ID NO: 27117 - DNA, 18 bp, synthetic construct
  source 1..18: mol_type = other DNA
ttagacgattcactatcg

SEQ ID NO: 27118 - DNA, 18 bp, synthetic construct
  source 1..18: mol_type = other DNA
ttataagacacactatcg

SEQ ID NO: 27119 - DNA, 18 bp, synthetic construct
  source 1..18: mol_type = other DNA
ttataagactatctatag

SEQ ID NO: 27120 - DNA, 18 bp, synthetic construct
  source 1..18: mol_type = other DNA
ttataagactcaatatcg

SEQ ID NO: 27121 - DNA, 18 bp, synthetic construct
  source 1..18: mol_type = other DNA
ttatacaaccaactatag

SEQ ID NO: 27122 - DNA, 18 bp, synthetic construct
  source 1..18: mol_type = other DNA
ttatacaattcagtatag

SEQ ID NO: 27123 - DNA, 18 bp, synthetic construct
  source 1..18: mol_type = other DNA
ttatacgaaacattatag

SEQ ID NO: 27124 - DNA, 18 bp, synthetic construct
  source 1..18: mol_type = other DNA
ttatacgaaaccctatag

SEQ ID NO: 27125 - DNA, 18 bp, synthetic construct
  source 1..18: mol_type = other DNA
ttatacgaaccacaatag

SEQ ID NO: 27126 - DNA, 18 bp, synthetic construct
  source 1..18: mol_type = other DNA
ttatacgacatactgtag

SEQ ID NO: 27127 - DNA, 18 bp, synthetic construct
  source 1..18: mol_type = other DNA
ttatacgactcacctaag

SEQ ID NO: 27128 - DNA, 18 bp, synthetic construct
  source 1..18: mol_type = other DNA
ttatacgactcccaatcg

SEQ ID NO: 27129 - DNA, 18 bp, synthetic construct
  source 1..18: mol_type = other DNA
ttatacgactctccatcg

SEQ ID NO: 27130 - DNA, 18 bp, synthetic construct
  source 1..18: mol_type = other DNA
ttatacgagacactacag

SEQ ID NO: 27131 - DNA, 18 bp, synthetic construct
  source 1..18: mol_type = other DNA
ttatacgagactctatag

SEQ ID NO: 27132 - DNA, 18 bp, synthetic construct
  source 1..18: mol_type = other DNA
ttatacgattcaacatag

SEQ ID NO: 27133 - DNA, 18 bp, synthetic construct
  source 1..18: mol_type = other DNA
ttatacgcctcactaagg

SEQ ID NO: 27134 - DNA, 18 bp, synthetic construct
  source 1..18: mol_type = other DNA
ttatacgcctcataatag

SEQ ID NO: 27135 - DNA, 18 bp, synthetic construct
  source 1..18: mol_type = other DNA
ttatacgtctttctatag

SEQ ID NO: 27136 - DNA, 18 bp, synthetic construct
  source 1..18: mol_type = other DNA
ttatactacacagtatag

SEQ ID NO: 27137 - DNA, 18 bp, synthetic construct
  source 1..18: mol_type = other DNA
ttatactgctcaccatag

SEQ ID NO: 27138 - DNA, 18 bp, synthetic construct
  source 1..18: mol_type = other DNA
ttataggactttctatag

SEQ ID NO: 27139 - DNA, 18 bp, synthetic construct
  source 1..18: mol_type = other DNA
ttatatcactcaatatag

SEQ ID NO: 27140 - DNA, 18 bp, synthetic construct
  source 1..18: mol_type = other DNA
ttatatcactcactgtag

SEQ ID NO: 27141 - DNA, 18 bp, synthetic construct
  source 1..18: mol_type = other DNA
ttatatgacacactacag

SEQ ID NO: 27142 - DNA, 18 bp, synthetic construct
  source 1..18: mol_type = other DNA
ttatatgacttactaaag

SEQ ID NO: 27143 - DNA, 18 bp, synthetic construct
  source 1..18: mol_type = other DNA
ttatatggctcacaatag

SEQ ID NO: 27144 - DNA, 18 bp, synthetic construct
  source 1..18: mol_type = other DNA
ttatctgactcagtatag

SEQ ID NO: 27145 - DNA, 18 bp, synthetic construct
  source 1..18: mol_type = other DNA
ttatgagactcactaaag

SEQ ID NO: 27146 - DNA, 18 bp, synthetic construct
  source 1..18: mol_type = other DNA
ttatgcgactcactacaa

SEQ ID NO: 27147 - DNA, 18 bp, synthetic construct
  source 1..18: mol_type = other DNA
ttcaacgactcagtatag

SEQ ID NO: 27148 - DNA, 18 bp, synthetic construct
  source 1..18: mol_type = other DNA
ttctacgtatcactatag

SEQ ID NO: 27149 - DNA, 18 bp, synthetic construct
  source 1..18: mol_type = other DNA
ttctactactcactttag

SEQ ID NO: 27150 - DNA, 18 bp, synthetic construct
  source 1..18: mol_type = other DNA
ttgaaccactcactatag

SEQ ID NO: 27151 - DNA, 18 bp, synthetic construct
  source 1..18: mol_type = other DNA
ttgtacgccacactatag

SEQ ID NO: 27152 - DNA, 18 bp, synthetic construct
  source 1..18: mol_type = other DNA
ttttacccctcactatag

SEQ ID NO: 27153 - DNA, 18 bp, synthetic construct
  source 1..18: mol_type = other DNA
ttttacgactcactggag

SEQ ID NO: 27154 - DNA, 18 bp, synthetic construct
  source 1..18: mol_type = other DNA
ttttacgcctcacaatag

SEQ ID NO: 27155 - DNA, 18 bp, synthetic construct
  source 1..18: mol_type = other DNA
tattacgacacactaatg

SEQ ID NO: 27156 - DNA, 18 bp, synthetic construct
  source 1..18: mol_type = other DNA
taatacgtttctctaaag

SEQ ID NO: 27157 - DNA, 18 bp, synthetic construct
  source 1..18: mol_type = other DNA
tattacgtctcagtattg

SEQ ID NO: 27158 - DNA, 18 bp, synthetic construct
  source 1..18: mol_type = other DNA
taatacgtctcacataag

SEQ ID NO: 27159 - DNA, 18 bp, synthetic construct
  source 1..18: mol_type = other DNA
aaatacgactaacttttg

SEQ ID NO: 27160 - DNA, 18 bp, synthetic construct
  source 1..18: mol_type = other DNA
caaatcgactctctatag

SEQ ID NO: 27161 - DNA, 18 bp, synthetic construct
  source 1..18: mol_type = other DNA
taatatgactcatttttg

SEQ ID NO: 27162 - DNA, 18 bp, synthetic construct
  source 1..18: mol_type = other DNA
taattcaaatctctatag

SEQ ID NO: 27163 - DNA, 18 bp, synthetic construct
  source 1..18: mol_type = other DNA
taatttgtctcactttag

SEQ ID NO: 27164 - DNA, 18 bp, synthetic construct
  source 1..18: mol_type = other DNA
tatatccactcactatag

SEQ ID NO: 27165 - DNA, 18 bp, synthetic construct
  source 1..18: mol_type = other DNA
tattacgacttactaatg

SEQ ID NO: 27166 - DNA, 18 bp, synthetic construct
  source 1..18: mol_type = other DNA
caatacgtctcacaaaag

SEQ ID NO: 27167 - DNA, 18 bp, synthetic construct
  source 1..18: mol_type = other DNA
taaaatgtctcacaatag

SEQ ID NO: 27168 - DNA, 18 bp, synthetic construct
  source 1..18: mol_type = other DNA
tattgcgactaacaatag

SEQ ID NO: 27169 - DNA, 18 bp, synthetic construct
  source 1..18: mol_type = other DNA
tattgcgactcacaaaag

SEQ ID NO: 27170 - DNA, 18 bp, synthetic construct
  source 1..18: mol_type = other DNA
ttatattactcacaatag

SEQ ID NO: 27171 - DNA, 18 bp, synthetic construct
  source 1..18: mol_type = other DNA
ttattcgtcacactatag

SEQ ID NO: 27172 - DNA, 18 bp, synthetic construct
  source 1..18: mol_type = other DNA
ttatttgactcactttag

SEQ ID NO: 27173 - DNA, 18 bp, synthetic construct
  source 1..18: mol_type = other DNA
taattcgactaacttttg

SEQ ID NO: 27174 - DNA, 18 bp, synthetic construct
  source 1..18: mol_type = other DNA
taattcggctcaatattg

SEQ ID NO: 27175 - DNA, 18 bp, synthetic construct
  source 1..18: mol_type = other DNA
tatttcgacttactattg

SEQ ID NO: 27176 - DNA, 18 bp, synthetic construct
  source 1..18: mol_type = other DNA
tcattcgactcactgttg

SEQ ID NO: 27177 - DNA, 18 bp, synthetic construct
  source 1..18: mol_type = other DNA
aaatacgactcacttatg

SEQ ID NO: 27178 - DNA, 18 bp, synthetic construct
  source 1..18: mol_type = other DNA
aaattcgacccaatatag

SEQ ID NO: 27179 - DNA, 18 bp, synthetic construct
  source 1..18: mol_type = other DNA
caaaaagactcactattg

SEQ ID NO: 27180 - DNA, 18 bp, synthetic construct
  source 1..18: mol_type = other DNA
catttagactcactatag

SEQ ID NO: 27181 - DNA, 18 bp, synthetic construct
  source 1..18: mol_type = other DNA
taatacgaaccgcaatag

SEQ ID NO: 27182 - DNA, 18 bp, synthetic construct
  source 1..18: mol_type = other DNA
taatacgactaatttttg

SEQ ID NO: 27183 - DNA, 18 bp, synthetic construct
  source 1..18: mol_type = other DNA
taatacgactcccttatg

SEQ ID NO: 27184 - DNA, 18 bp, synthetic construct
  source 1..18: mol_type = other DNA
taatacgtcttattattg

SEQ ID NO: 27185 - DNA, 18 bp, synthetic construct
  source 1..18: mol_type = other DNA
taatactattcacaattg

SEQ ID NO: 27186 - DNA, 18 bp, synthetic construct
  source 1..18: mol_type = other DNA
taatgcgactctctaatg

SEQ ID NO: 27187 - DNA, 18 bp, synthetic construct
  source 1..18: mol_type = other DNA
taattcagctaactatag

SEQ ID NO: 27188 - DNA, 18 bp, synthetic construct
  source 1..18: mol_type = other DNA
taattcgacacacaaaag

SEQ ID NO: 27189 - DNA, 18 bp, synthetic construct
  source 1..18: mol_type = other DNA
taattcgacttcctagag

SEQ ID NO: 27190 - DNA, 18 bp, synthetic construct
  source 1..18: mol_type = other DNA
taattcgagtcaatttag

SEQ ID NO: 27191 - DNA, 18 bp, synthetic construct
  source 1..18: mol_type = other DNA
taattcgtctcactaacg

SEQ ID NO: 27192 - DNA, 18 bp, synthetic construct
  source 1..18: mol_type = other DNA
taattctacacacaatag

SEQ ID NO: 27193 - DNA, 18 bp, synthetic construct
  source 1..18: mol_type = other DNA
taattctactctttatag

SEQ ID NO: 27194 - DNA, 18 bp, synthetic construct
  source 1..18: mol_type = other DNA
tacttctactctctatag

SEQ ID NO: 27195 - DNA, 18 bp, synthetic construct
  source 1..18: mol_type = other DNA
ttatacaacccactattg

SEQ ID NO: 27196 - DNA, 18 bp, synthetic construct
  source 1..18: mol_type = other DNA
aaatacgatttattatag

SEQ ID NO: 27197 - DNA, 18 bp, synthetic construct
  source 1..18: mol_type = other DNA
aaatactcctcactttag

SEQ ID NO: 27198 - DNA, 18 bp, synthetic construct
  source 1..18: mol_type = other DNA
aattacgacttaatatag

SEQ ID NO: 27199 - DNA, 18 bp, synthetic construct
  source 1..18: mol_type = other DNA
atacacgactcactaaag

SEQ ID NO: 27200 - DNA, 18 bp, synthetic construct
  source 1..18: mol_type = other DNA
atatacgattcagtatag

SEQ ID NO: 27201 - DNA, 18 bp, synthetic construct
  source 1..18: mol_type = other DNA
atataggactcactaaag

SEQ ID NO: 27202 - DNA, 18 bp, synthetic construct
  source 1..18: mol_type = other DNA
taaaacgactctccaaag

SEQ ID NO: 27203 - DNA, 18 bp, synthetic construct
  source 1..18: mol_type = other DNA
taaaacgactttctctag

SEQ ID NO: 27204 - DNA, 18 bp, synthetic construct
  source 1..18: mol_type = other DNA
taaaacgtctatctatag

SEQ ID NO: 27205 - DNA, 18 bp, synthetic construct
  source 1..18: mol_type = other DNA
taataagaaacactttag

SEQ ID NO: 27206 - DNA, 18 bp, synthetic construct
  source 1..18: mol_type = other DNA
taataatacacactttag

SEQ ID NO: 27207 - DNA, 18 bp, synthetic construct
  source 1..18: mol_type = other DNA
taatacgaaactctaaag

SEQ ID NO: 27208 - DNA, 18 bp, synthetic construct
  source 1..18: mol_type = other DNA
taatactattcacaaaag

SEQ ID NO: 27209 - DNA, 18 bp, synthetic construct
  source 1..18: mol_type = other DNA
taataggtctcacttaag

SEQ ID NO: 27210 - DNA, 18 bp, synthetic construct
  source 1..18: mol_type = other DNA
taatatgagactctatag

SEQ ID NO: 27211 - DNA, 18 bp, synthetic construct
  source 1..18: mol_type = other DNA
taatatgatacactaaag

SEQ ID NO: 27212 - DNA, 18 bp, synthetic construct
  source 1..18: mol_type = other DNA
taatgcgcctctcaatag

SEQ ID NO: 27213 - DNA, 18 bp, synthetic construct
  source 1..18: mol_type = other DNA
tagtacgactcacataag

SEQ ID NO: 27214 - DNA, 18 bp, synthetic construct
  source 1..18: mol_type = other DNA
tataacgaccctctatag

SEQ ID NO: 27215 - DNA, 18 bp, synthetic construct
  source 1..18: mol_type = other DNA
tattacaactcacaatgg

SEQ ID NO: 27216 - DNA, 18 bp, synthetic construct
  source 1..18: mol_type = other DNA
tattatgaatcactttag

SEQ ID NO: 27217 - DNA, 18 bp, synthetic construct
  source 1..18: mol_type = other DNA
tcatactactcactaacg

SEQ ID NO: 27218 - DNA, 18 bp, synthetic construct
  source 1..18: mol_type = other DNA
tcatatgactttctatag

SEQ ID NO: 27219 - DNA, 18 bp, synthetic construct
  source 1..18: mol_type = other DNA
tgataagtctcactaaag

SEQ ID NO: 27220 - DNA, 18 bp, synthetic construct
  source 1..18: mol_type = other DNA
ttataccactgacaatag

SEQ ID NO: 27221 - DNA, 18 bp, synthetic construct
  source 1..18: mol_type = other DNA
ttatacgaattactttag

SEQ ID NO: 27222 - DNA, 18 bp, synthetic construct
  source 1..18: mol_type = other DNA
ttatactacccactaaag

SEQ ID NO: 27223 - DNA, 18 bp, synthetic construct
  source 1..18: mol_type = other DNA
ttatatgactcaaaatag

SEQ ID NO: 27224 - DNA, 18 bp, synthetic construct
  source 1..18: mol_type = other DNA
ttatgtgacttactatag

SEQ ID NO: 27225 - DNA, 18 bp, synthetic construct
  source 1..18: mol_type = other DNA
ttcaacgactcactctag

SEQ ID NO: 27226 - DNA, 18 bp, synthetic construct
  source 1..18: mol_type = other DNA
ttctacgacatactatag

SEQ ID NO: 27227 - DNA, 18 bp, synthetic construct
  source 1..18: mol_type = other DNA
ttgtacgacttactctag

SEQ ID NO: 27228 - DNA, 18 bp, synthetic construct
  source 1..18: mol_type = other DNA
tttcacgactcattatag

SEQ ID NO: 27229 - DNA, 18 bp, synthetic construct
  source 1..18: mol_type = other DNA
tttcacgactctctatag

SEQ ID NO: 27230 - DNA, 18 bp, synthetic construct
  source 1..18: mol_type = other DNA
ttttacgattcaccatag

SEQ ID NO: 27231 - DNA, 18 bp, synthetic construct
  source 1..18: mol_type = other DNA
ttatacgacacactaatg

SEQ ID NO: 27232 - DNA, 18 bp, synthetic construct
  source 1..18: mol_type = other DNA
ttaaacaactcacaatag

SEQ ID NO: 27233 - DNA, 18 bp, synthetic construct
  source 1..18: mol_type = other DNA
taattcgtctcacaattg

SEQ ID NO: 27234 - DNA, 18 bp, synthetic construct
  source 1..18: mol_type = other DNA
taatacaactcattaatg

SEQ ID NO: 27235 - DNA, 18 bp, synthetic construct
  source 1..18: mol_type = other DNA
taatacgtctcaccaatg

SEQ ID NO: 27236 - DNA, 18 bp, synthetic construct
  source 1..18: mol_type = other DNA
taattagactctctttag

SEQ ID NO: 27237 - DNA, 18 bp, synthetic construct
  source 1..18: mol_type = other DNA
tataacgcctcgctatag

SEQ ID NO: 27238 - DNA, 18 bp, synthetic construct
  source 1..18: mol_type = other DNA
taatacgtttctctttag

SEQ ID NO: 27239 - DNA, 18 bp, synthetic construct
  source 1..18: mol_type = other DNA
ttatacgtctctatatag

SEQ ID NO: 27240 - DNA, 18 bp, synthetic construct
  source 1..18: mol_type = other DNA
ttcaacgactctctatag

SEQ ID NO: 27241 - DNA, 18 bp, synthetic construct
  source 1..18: mol_type = other DNA
ttttacgacttactttag

SEQ ID NO: 27242 - DNA, 18 bp, synthetic construct
  source 1..18: mol_type = other DNA
taattcttctcacaatag

SEQ ID NO: 27243 - DNA, 18 bp, synthetic construct
  source 1..18: mol_type = other DNA
caattggactcactattg

SEQ ID NO: 27244 - DNA, 18 bp, synthetic construct
  source 1..18: mol_type = other DNA
gaattcaactcactattg

SEQ ID NO: 27245 - DNA, 18 bp, synthetic construct
  source 1..18: mol_type = other DNA
taatacgacttgcaattg

SEQ ID NO: 27246 - DNA, 18 bp, synthetic construct
  source 1..18: mol_type = other DNA
taattagactcagtattg

SEQ ID NO: 27247 - DNA, 18 bp, synthetic construct
  source 1..18: mol_type = other DNA
taattccacacgctatag

SEQ ID NO: 27248 - DNA, 18 bp, synthetic construct
  source 1..18: mol_type = other DNA
taattcgaatctctattg

SEQ ID NO: 27249 - DNA, 18 bp, synthetic construct
  source 1..18: mol_type = other DNA
taattcgacacactagtg

SEQ ID NO: 27250 - DNA, 18 bp, synthetic construct
  source 1..18: mol_type = other DNA
taattcgactcacctttg

SEQ ID NO: 27251 - DNA, 18 bp, synthetic construct
  source 1..18: mol_type = other DNA
taattcgacttgctttag

SEQ ID NO: 27252 - DNA, 18 bp, synthetic construct
  source 1..18: mol_type = other DNA
taattcgagttgctatag

SEQ ID NO: 27253 - DNA, 18 bp, synthetic construct
  source 1..18: mol_type = other DNA
taattcgtctcactagtg

SEQ ID NO: 27254 - DNA, 18 bp, synthetic construct
  source 1..18: mol_type = other DNA
taattctactcaatattg

SEQ ID NO: 27255 - DNA, 18 bp, synthetic construct
  source 1..18: mol_type = other DNA
taattggactctctattg

SEQ ID NO: 27256 - DNA, 18 bp, synthetic construct
  source 1..18: mol_type = other DNA
tacttcgactcactaatg

SEQ ID NO: 27257 - DNA, 18 bp, synthetic construct
  source 1..18: mol_type = other DNA
tatttcgactcactactg

SEQ ID NO: 27258 - DNA, 18 bp, synthetic construct
  source 1..18: mol_type = other DNA
ttatacgacttgctattg

SEQ ID NO: 27259 - DNA, 18 bp, synthetic construct
  source 1..18: mol_type = other DNA
aaaaacgactctctattg

SEQ ID NO: 27260 - DNA, 18 bp, synthetic construct
  source 1..18: mol_type = other DNA
aaaaactactcactattg

SEQ ID NO: 27261 - DNA, 18 bp, synthetic construct
  source 1..18: mol_type = other DNA
aaaatcgactcaccatag

SEQ ID NO: 27262 - DNA, 18 bp, synthetic construct
  source 1..18: mol_type = other DNA
aaacactactcactattg

SEQ ID NO: 27263 - DNA, 18 bp, synthetic construct
  source 1..18: mol_type = other DNA
aaactcgacttactatag

SEQ ID NO: 27264 - DNA, 18 bp, synthetic construct
  source 1..18: mol_type = other DNA
aaagaggactcactattg

SEQ ID NO: 27265 - DNA, 18 bp, synthetic construct
  source 1..18: mol_type = other DNA
aaataagactcactcttg

SEQ ID NO: 27266 - DNA, 18 bp, synthetic construct
  source 1..18: mol_type = other DNA
aaataggactcaatattg

SEQ ID NO: 27267 - DNA, 18 bp, synthetic construct
  source 1..18: mol_type = other DNA
aaatatgactcgctaaag

SEQ ID NO: 27268 - DNA, 18 bp, synthetic construct
  source 1..18: mol_type = other DNA
aaatatgtctcgctatag

SEQ ID NO: 27269 - DNA, 18 bp, synthetic construct
  source 1..18: mol_type = other DNA
aaatgcgactaactattg

SEQ ID NO: 27270 - DNA, 18 bp, synthetic construct
  source 1..18: mol_type = other DNA
aaattcaactcactagag

SEQ ID NO: 27271 - DNA, 18 bp, synthetic construct
  source 1..18: mol_type = other DNA
aacttcgactcacaatag

SEQ ID NO: 27272 - DNA, 18 bp, synthetic construct
  source 1..18: mol_type = other DNA
aattaagactcactattg

SEQ ID NO: 27273 - DNA, 18 bp, synthetic construct
  source 1..18: mol_type = other DNA
agattcgactcactaaag

SEQ ID NO: 27274 - DNA, 18 bp, synthetic construct
  source 1..18: mol_type = other DNA
caaaacgactaactattg

SEQ ID NO: 27275 - DNA, 18 bp, synthetic construct
  source 1..18: mol_type = other DNA
caatacgactcacaaatg

SEQ ID NO: 27276 - DNA, 18 bp, synthetic construct
  source 1..18: mol_type = other DNA
caatacgattaactattg

SEQ ID NO: 27277 - DNA, 18 bp, synthetic construct
  source 1..18: mol_type = other DNA
caatacgtctcgcaatag

SEQ ID NO: 27278 - DNA, 18 bp, synthetic construct
  source 1..18: mol_type = other DNA
caattcgacactctatag

SEQ ID NO: 27279 - DNA, 18 bp, synthetic construct
  source 1..18: mol_type = other DNA
caattcgacttaatatag

SEQ ID NO: 27280 - DNA, 18 bp, synthetic construct
  source 1..18: mol_type = other DNA
caatttgactctctatag

SEQ ID NO: 27281 - DNA, 18 bp, synthetic construct
  source 1..18: mol_type = other DNA
ccatacgactcagtattg

SEQ ID NO: 27282 - DNA, 18 bp, synthetic construct
  source 1..18: mol_type = other DNA
ctattcgagtcactatag

SEQ ID NO: 27283 - DNA, 18 bp, synthetic construct
  source 1..18: mol_type = other DNA
gaatacgactctctaatg

SEQ ID NO: 27284 - DNA, 18 bp, synthetic construct
  source 1..18: mol_type = other DNA
taaaaagactcgttatag

SEQ ID NO: 27285 - DNA, 18 bp, synthetic construct
  source 1..18: mol_type = other DNA
taaaacaactcaatattg

SEQ ID NO: 27286 - DNA, 18 bp, synthetic construct
  source 1..18: mol_type = other DNA
taaaacgacgcgctacag

SEQ ID NO: 27287 - DNA, 18 bp, synthetic construct
  source 1..18: mol_type = other DNA
taaaacgagtctctattg

SEQ ID NO: 27288 - DNA, 18 bp, synthetic construct
  source 1..18: mol_type = other DNA
taaaacgtcgcactattg

SEQ ID NO: 27289 - DNA, 18 bp, synthetic construct
  source 1..18: mol_type = other DNA
taaaacgtctcgccatag

SEQ ID NO: 27290 - DNA, 18 bp, synthetic construct
  source 1..18: mol_type = other DNA
taaaccgacacactattg

SEQ ID NO: 27291 - DNA, 18 bp, synthetic construct
  source 1..18: mol_type = other DNA
taaaccgacacgctatag

SEQ ID NO: 27292 - DNA, 18 bp, synthetic construct
  source 1..18: mol_type = other DNA
taaagcgactcattattg

SEQ ID NO: 27293 - DNA, 18 bp, synthetic construct
  source 1..18: mol_type = other DNA
taaatcaactctctatag

SEQ ID NO: 27294 - DNA, 18 bp, synthetic construct
  source 1..18: mol_type = other DNA
taaatcgacgcagtatag

SEQ ID NO: 27295 - DNA, 18 bp, synthetic construct
  source 1..18: mol_type = other DNA
taaatcgactcataatag

SEQ ID NO: 27296 - DNA, 18 bp, synthetic construct
  source 1..18: mol_type = other DNA
taacaccactcacaattg

SEQ ID NO: 27297 - DNA, 18 bp, synthetic construct
  source 1..18: mol_type = other DNA
taacacgactcgttttag

SEQ ID NO: 27298 - DNA, 18 bp, synthetic construct
  source 1..18: mol_type = other DNA
taacacgagacactattg

SEQ ID NO: 27299 - DNA, 18 bp, synthetic construct
  source 1..18: mol_type = other DNA
taacacgtatcactattg

SEQ ID NO: 27300 - DNA, 18 bp, synthetic construct
  source 1..18: mol_type = other DNA
taacacgtctcattattg

SEQ ID NO: 27301 - DNA, 18 bp, synthetic construct
  source 1..18: mol_type = other DNA
taacccgactcactaatg

SEQ ID NO: 27302 - DNA, 18 bp, synthetic construct
  source 1..18: mol_type = other DNA
taactagactcactagag

SEQ ID NO: 27303 - DNA, 18 bp, synthetic construct
  source 1..18: mol_type = other DNA
taactcgagtctctatag

SEQ ID NO: 27304 - DNA, 18 bp, synthetic construct
  source 1..18: mol_type = other DNA
taataagactgacttttg

SEQ ID NO: 27305 - DNA, 18 bp, synthetic construct
  source 1..18: mol_type = other DNA
taatacaacacacttttg

SEQ ID NO: 27306 - DNA, 18 bp, synthetic construct
  source 1..18: mol_type = other DNA
taatacaatttactattg

SEQ ID NO: 27307 - DNA, 18 bp, synthetic construct
  source 1..18: mol_type = other DNA
taataccacttattattg

SEQ ID NO: 27308 - DNA, 18 bp, synthetic construct
  source 1..18: mol_type = other DNA
taatacctctcacaattg

SEQ ID NO: 27309 - DNA, 18 bp, synthetic construct
  source 1..18: mol_type = other DNA
taatacgaataattattg

SEQ ID NO: 27310 - DNA, 18 bp, synthetic construct
  source 1..18: mol_type = other DNA
taatacgaatcattaatg

SEQ ID NO: 27311 - DNA, 18 bp, synthetic construct
  source 1..18: mol_type = other DNA
taatacgaatctgtattg

SEQ ID NO: 27312 - DNA, 18 bp, synthetic construct
  source 1..18: mol_type = other DNA
taatacgactctttactg

SEQ ID NO: 27313 - DNA, 18 bp, synthetic construct
  source 1..18: mol_type = other DNA
taatacgatcctctattg

SEQ ID NO: 27314 - DNA, 18 bp, synthetic construct
  source 1..18: mol_type = other DNA
taatacgatctactattg

SEQ ID NO: 27315 - DNA, 18 bp, synthetic construct
  source 1..18: mol_type = other DNA
taatacgtatcaatattg

SEQ ID NO: 27316 - DNA, 18 bp, synthetic construct
  source 1..18: mol_type = other DNA
taatacgtatcgctctag

SEQ ID NO: 27317 - DNA, 18 bp, synthetic construct
  source 1..18: mol_type = other DNA
taatacgtctaactgttg

SEQ ID NO: 27318 - DNA, 18 bp, synthetic construct
  source 1..18: mol_type = other DNA
taatacgtctcattgttg

SEQ ID NO: 27319 - DNA, 18 bp, synthetic construct
  source 1..18: mol_type = other DNA
taatactacacgctatgg

SEQ ID NO: 27320 - DNA, 18 bp, synthetic construct
  source 1..18: mol_type = other DNA
taatactactgacttttg

SEQ ID NO: 27321 - DNA, 18 bp, synthetic construct
  source 1..18: mol_type = other DNA
taatactacttaatattg

SEQ ID NO: 27322 - DNA, 18 bp, synthetic construct
  source 1..18: mol_type = other DNA
taataggactcgctttcg

SEQ ID NO: 27323 - DNA, 18 bp, synthetic construct
  source 1..18: mol_type = other DNA
taatatcactcggtatag

SEQ ID NO: 27324 - DNA, 18 bp, synthetic construct
  source 1..18: mol_type = other DNA
taatccgattcaatattg

SEQ ID NO: 27325 - DNA, 18 bp, synthetic construct
  source 1..18: mol_type = other DNA
taatccgattcaccattg

SEQ ID NO: 27326 - DNA, 18 bp, synthetic construct
  source 1..18: mol_type = other DNA
taatgcgacttgctctag

SEQ ID NO: 27327 - DNA, 18 bp, synthetic construct
  source 1..18: mol_type = other DNA
taatgcgtatcactattg

SEQ ID NO: 27328 - DNA, 18 bp, synthetic construct
  source 1..18: mol_type = other DNA
taattcaactgactatcg

SEQ ID NO: 27329 - DNA, 18 bp, synthetic construct
  source 1..18: mol_type = other DNA
taattcaacttagtatag

SEQ ID NO: 27330 - DNA, 18 bp, synthetic construct
  source 1..18: mol_type = other DNA
taattcacctcacaatag

SEQ ID NO: 27331 - DNA, 18 bp, synthetic construct
  source 1..18: mol_type = other DNA
taattccaataactatag

SEQ ID NO: 27332 - DNA, 18 bp, synthetic construct
  source 1..18: mol_type = other DNA
taattccaatccctatag

SEQ ID NO: 27333 - DNA, 18 bp, synthetic construct
  source 1..18: mol_type = other DNA
taattccacttcctatag

SEQ ID NO: 27334 - DNA, 18 bp, synthetic construct
  source 1..18: mol_type = other DNA
taattcgaattactaaag

SEQ ID NO: 27335 - DNA, 18 bp, synthetic construct
  source 1..18: mol_type = other DNA
taattcgacactctagag

SEQ ID NO: 27336 - DNA, 18 bp, synthetic construct
  source 1..18: mol_type = other DNA
taattcgacagaatatag

SEQ ID NO: 27337 - DNA, 18 bp, synthetic construct
  source 1..18: mol_type = other DNA
taattcgactcattacgg

SEQ ID NO: 27338 - DNA, 18 bp, synthetic construct
  source 1..18: mol_type = other DNA
taattcgactcccattag

SEQ ID NO: 27339 - DNA, 18 bp, synthetic construct
  source 1..18: mol_type = other DNA
taattcgactgtctttag

SEQ ID NO: 27340 - DNA, 18 bp, synthetic construct
  source 1..18: mol_type = other DNA
taattcgatacacgatag

SEQ ID NO: 27341 - DNA, 18 bp, synthetic construct
  source 1..18: mol_type = other DNA
taattcgtcacacgatag

SEQ ID NO: 27342 - DNA, 18 bp, synthetic construct
  source 1..18: mol_type = other DNA
taattcgtcccactatcg

SEQ ID NO: 27343 - DNA, 18 bp, synthetic construct
  source 1..18: mol_type = other DNA
taattcgtctacctatag

SEQ ID NO: 27344 - DNA, 18 bp, synthetic construct
  source 1..18: mol_type = other DNA
taattcgtctcattatgg

SEQ ID NO: 27345 - DNA, 18 bp, synthetic construct
  source 1..18: mol_type = other DNA
taattcgtttctctatag

SEQ ID NO: 27346 - DNA, 18 bp, synthetic construct
  source 1..18: mol_type = other DNA
taattctattcactaaag

SEQ ID NO: 27347 - DNA, 18 bp, synthetic construct
  source 1..18: mol_type = other DNA
taattggactctcaatag

SEQ ID NO: 27348 - DNA, 18 bp, synthetic construct
  source 1..18: mol_type = other DNA
taattgtactcactatcg

SEQ ID NO: 27349 - DNA, 18 bp, synthetic construct
  source 1..18: mol_type = other DNA
taatttgacacaatatag

SEQ ID NO: 27350 - DNA, 18 bp, synthetic construct
  source 1..18: mol_type = other DNA
taatttgactctccatag

SEQ ID NO: 27351 - DNA, 18 bp, synthetic construct
  source 1..18: mol_type = other DNA
tactaggactcacaattg

SEQ ID NO: 27352 - DNA, 18 bp, synthetic construct
  source 1..18: mol_type = other DNA
tacttcgactcattatcg

SEQ ID NO: 27353 - DNA, 18 bp, synthetic construct
  source 1..18: mol_type = other DNA
tacttcgtctcactaaag

SEQ ID NO: 27354 - DNA, 18 bp, synthetic construct
  source 1..18: mol_type = other DNA
tagaacgacacactattg

SEQ ID NO: 27355 - DNA, 18 bp, synthetic construct
  source 1..18: mol_type = other DNA
tagtacaactctctattg

SEQ ID NO: 27356 - DNA, 18 bp, synthetic construct
  source 1..18: mol_type = other DNA
tagtacgaatcactaatg

SEQ ID NO: 27357 - DNA, 18 bp, synthetic construct
  source 1..18: mol_type = other DNA
tagtacgactatctattg

SEQ ID NO: 27358 - DNA, 18 bp, synthetic construct
  source 1..18: mol_type = other DNA
tagtacgactcatttttg

SEQ ID NO: 27359 - DNA, 18 bp, synthetic construct
  source 1..18: mol_type = other DNA
tagttggactcaatatag

SEQ ID NO: 27360 - DNA, 18 bp, synthetic construct
  source 1..18: mol_type = other DNA
tataacgactaactattg

SEQ ID NO: 27361 - DNA, 18 bp, synthetic construct
  source 1..18: mol_type = other DNA
tatatcgtctcactatag

SEQ ID NO: 27362 - DNA, 18 bp, synthetic construct
  source 1..18: mol_type = other DNA
tattaagaatcactattg

SEQ ID NO: 27363 - DNA, 18 bp, synthetic construct
  source 1..18: mol_type = other DNA
tattacgactcgttaaag

SEQ ID NO: 27364 - DNA, 18 bp, synthetic construct
  source 1..18: mol_type = other DNA
tattacgtctcgatatag

SEQ ID NO: 27365 - DNA, 18 bp, synthetic construct
  source 1..18: mol_type = other DNA
tatttcggcttactatag

SEQ ID NO: 27366 - DNA, 18 bp, synthetic construct
  source 1..18: mol_type = other DNA
tatttcgtctgactatag

SEQ ID NO: 27367 - DNA, 18 bp, synthetic construct
  source 1..18: mol_type = other DNA
tattttcactcactatag

SEQ ID NO: 27368 - DNA, 18 bp, synthetic construct
  source 1..18: mol_type = other DNA
tattttgacacactatag

SEQ ID NO: 27369 - DNA, 18 bp, synthetic construct
  source 1..18: mol_type = other DNA
tattttgactcacaatag

SEQ ID NO: 27370 - DNA, 18 bp, synthetic construct
  source 1..18: mol_type = other DNA
tattttgactcattatag

SEQ ID NO: 27371 - DNA, 18 bp, synthetic construct
  source 1..18: mol_type = other DNA
tcaaacgactcactgttg

SEQ ID NO: 27372 - DNA, 18 bp, synthetic construct
  source 1..18: mol_type = other DNA
tcattagaatcactatag

SEQ ID NO: 27373 - DNA, 18 bp, synthetic construct
  source 1..18: mol_type = other DNA
tcttccgactcactattg

SEQ ID NO: 27374 - DNA, 18 bp, synthetic construct
  source 1..18: mol_type = other DNA
tgaaatgactcgctatag

SEQ ID NO: 27375 - DNA, 18 bp, synthetic construct
  source 1..18: mol_type = other DNA
tgatacaactccctattg

SEQ ID NO: 27376 - DNA, 18 bp, synthetic construct
  source 1..18: mol_type = other DNA
tgatacgacatactattg

SEQ ID NO: 27377 - DNA, 18 bp, synthetic construct
  source 1..18: mol_type = other DNA
tgatacgactctctaatg

SEQ ID NO: 27378 - DNA, 18 bp, synthetic construct
  source 1..18: mol_type = other DNA
tgattcgacagactatag

SEQ ID NO: 27379 - DNA, 18 bp, synthetic construct
  source 1..18: mol_type = other DNA
tgattcgactaaatatag

SEQ ID NO: 27380 - DNA, 18 bp, synthetic construct
  source 1..18: mol_type = other DNA
tgattcgactctctaaag

SEQ ID NO: 27381 - DNA, 18 bp, synthetic construct
  source 1..18: mol_type = other DNA
tgattctattcactatag

SEQ ID NO: 27382 - DNA, 18 bp, synthetic construct
  source 1..18: mol_type = other DNA
ttaaacgactcagtattg

SEQ ID NO: 27383 - DNA, 18 bp, synthetic construct
  source 1..18: mol_type = other DNA
ttatacgaatcaatattg

SEQ ID NO: 27384 - DNA, 18 bp, synthetic construct
  source 1..18: mol_type = other DNA
ttatacgacacgctttag

SEQ ID NO: 27385 - DNA, 18 bp, synthetic construct
  source 1..18: mol_type = other DNA
ttatacgactcgctcgag

SEQ ID NO: 27386 - DNA, 18 bp, synthetic construct
  source 1..18: mol_type = other DNA
ttattcaacttactatag

SEQ ID NO: 27387 - DNA, 18 bp, synthetic construct
  source 1..18: mol_type = other DNA
ttatttgactcactgtag

SEQ ID NO: 27388 - DNA, 18 bp, synthetic construct
  source 1..18: mol_type = other DNA
ttcttcgactctctatag

SEQ ID NO: 27389 - DNA, 18 bp, synthetic construct
  source 1..18: mol_type = other DNA
ttgtacgactagctatag

SEQ ID NO: 27390 - DNA, 18 bp, synthetic construct
  source 1..18: mol_type = other DNA
aaaaacaactcactttag

SEQ ID NO: 27391 - DNA, 18 bp, synthetic construct
  source 1..18: mol_type = other DNA
aaaaacgaatcattatag

SEQ ID NO: 27392 - DNA, 18 bp, synthetic construct
  source 1..18: mol_type = other DNA
aaaaacgacaaactatag

SEQ ID NO: 27393 - DNA, 18 bp, synthetic construct
  source 1..18: mol_type = other DNA
aaaaacgactatctatag

SEQ ID NO: 27394 - DNA, 18 bp, synthetic construct
  source 1..18: mol_type = other DNA
aaaaacgcctcactaaag

SEQ ID NO: 27395 - DNA, 18 bp, synthetic construct
  source 1..18: mol_type = other DNA
aaacacgacacactttag

SEQ ID NO: 27396 - DNA, 18 bp, synthetic construct
  source 1..18: mol_type = other DNA
aaacacgtctctctatag

SEQ ID NO: 27397 - DNA, 18 bp, synthetic construct
  source 1..18: mol_type = other DNA
aaataagactaaccatag

SEQ ID NO: 27398 - DNA, 18 bp, synthetic construct
  source 1..18: mol_type = other DNA
aaataagactaactacag

SEQ ID NO: 27399 - DNA, 18 bp, synthetic construct
  source 1..18: mol_type = other DNA
aaataagactcattaaag

SEQ ID NO: 27400 - DNA, 18 bp, synthetic construct
  source 1..18: mol_type = other DNA
aaatacatctaactatag

SEQ ID NO: 27401 - DNA, 18 bp, synthetic construct
  source 1..18: mol_type = other DNA
aaatacgaatcacttcag

SEQ ID NO: 27402 - DNA, 18 bp, synthetic construct
  source 1..18: mol_type = other DNA
aaatacgaatttctatag

SEQ ID NO: 27403 - DNA, 18 bp, synthetic construct
  source 1..18: mol_type = other DNA
aaatacgactatatatag

SEQ ID NO: 27404 - DNA, 18 bp, synthetic construct
  source 1..18: mol_type = other DNA
aaatacgccccactttag

SEQ ID NO: 27405 - DNA, 18 bp, synthetic construct
  source 1..18: mol_type = other DNA
aaatacgtcacattatag

SEQ ID NO: 27406 - DNA, 18 bp, synthetic construct
  source 1..18: mol_type = other DNA
aaatacgtctcaccgtag

SEQ ID NO: 27407 - DNA, 18 bp, synthetic construct
  source 1..18: mol_type = other DNA
aaatacgtctgacaatag

SEQ ID NO: 27408 - DNA, 18 bp, synthetic construct
  source 1..18: mol_type = other DNA
aaatactactacctatag

SEQ ID NO: 27409 - DNA, 18 bp, synthetic construct
  source 1..18: mol_type = other DNA
aaataggacacactatgg

SEQ ID NO: 27410 - DNA, 18 bp, synthetic construct
  source 1..18: mol_type = other DNA
aaatatgaatctctatag

SEQ ID NO: 27411 - DNA, 18 bp, synthetic construct
  source 1..18: mol_type = other DNA
aaatgcgactcactaggg

SEQ ID NO: 27412 - DNA, 18 bp, synthetic construct
  source 1..18: mol_type = other DNA
aaatgcgactcattaaag

SEQ ID NO: 27413 - DNA, 18 bp, synthetic construct
  source 1..18: mol_type = other DNA
aactacgactctctctag

SEQ ID NO: 27414 - DNA, 18 bp, synthetic construct
  source 1..18: mol_type = other DNA
aagtaccactcacaatag

SEQ ID NO: 27415 - DNA, 18 bp, synthetic construct
  source 1..18: mol_type = other DNA
aagtaccactcattatag

SEQ ID NO: 27416 - DNA, 18 bp, synthetic construct
  source 1..18: mol_type = other DNA
aagtacgactctgtatag

SEQ ID NO: 27417 - DNA, 18 bp, synthetic construct
  source 1..18: mol_type = other DNA
aagtacgtctctctatag

SEQ ID NO: 27418 - DNA, 18 bp, synthetic construct
  source 1..18: mol_type = other DNA
aatgacgactcactaaag

SEQ ID NO: 27419 - DNA, 18 bp, synthetic construct
  source 1..18: mol_type = other DNA
aattacgaatcactatgg

SEQ ID NO: 27420 - DNA, 18 bp, synthetic construct
  source 1..18: mol_type = other DNA
aattacgactctctacag

SEQ ID NO: 27421 - DNA, 18 bp, synthetic construct
  source 1..18: mol_type = other DNA
aattacgccacactatag

SEQ ID NO: 27422 - DNA, 18 bp, synthetic construct
  source 1..18: mol_type = other DNA
acaaacgactcactgtag

SEQ ID NO: 27423 - DNA, 18 bp, synthetic construct
  source 1..18: mol_type = other DNA
acatacaactcattatag

SEQ ID NO: 27424 - DNA, 18 bp, synthetic construct
  source 1..18: mol_type = other DNA
acatactagtcactatag

SEQ ID NO: 27425 - DNA, 18 bp, synthetic construct
  source 1..18: mol_type = other DNA
acataggactcactaaag

SEQ ID NO: 27426 - DNA, 18 bp, synthetic construct
  source 1..18: mol_type = other DNA
agaaacgactcattatag

SEQ ID NO: 27427 - DNA, 18 bp, synthetic construct
  source 1..18: mol_type = other DNA
agatacatctcactatag

SEQ ID NO: 27428 - DNA, 18 bp, synthetic construct
  source 1..18: mol_type = other DNA
agatacgactcacagtag

SEQ ID NO: 27429 - DNA, 18 bp, synthetic construct
  source 1..18: mol_type = other DNA
ataaatgactcactatag

SEQ ID NO: 27430 - DNA, 18 bp, synthetic construct
  source 1..18: mol_type = other DNA
atacgcgactcactatag

SEQ ID NO: 27431 - DNA, 18 bp, synthetic construct
  source 1..18: mol_type = other DNA
atatacgactcaccagag

SEQ ID NO: 27432 - DNA, 18 bp, synthetic construct
  source 1..18: mol_type = other DNA
atatacgagtcaatatag

SEQ ID NO: 27433 - DNA, 18 bp, synthetic construct
  source 1..18: mol_type = other DNA
atatacgtctcagtatag

SEQ ID NO: 27434 - DNA, 18 bp, synthetic construct
  source 1..18: mol_type = other DNA
atatatgactcactctag

SEQ ID NO: 27435 - DNA, 18 bp, synthetic construct
  source 1..18: mol_type = other DNA
atatgcgacacactatag

SEQ ID NO: 27436 - DNA, 18 bp, synthetic construct
  source 1..18: mol_type = other DNA
atatgcgactcattatag

SEQ ID NO: 27437 - DNA, 18 bp, synthetic construct
  source 1..18: mol_type = other DNA
atctacgtctcactatag

SEQ ID NO: 27438 - DNA, 18 bp, synthetic construct
  source 1..18: mol_type = other DNA
atgtacgacttactatag

SEQ ID NO: 27439 - DNA, 18 bp, synthetic construct
  source 1..18: mol_type = other DNA
caaaacgtctcactttag

SEQ ID NO: 27440 - DNA, 18 bp, synthetic construct
  source 1..18: mol_type = other DNA
caatacgaaacacaatag

SEQ ID NO: 27441 - DNA, 18 bp, synthetic construct
  source 1..18: mol_type = other DNA
caatacgacacacttcag

SEQ ID NO: 27442 - DNA, 18 bp, synthetic construct
  source 1..18: mol_type = other DNA
caatacgactaaatctag

SEQ ID NO: 27443 - DNA, 18 bp, synthetic construct
  source 1..18: mol_type = other DNA
caatacgactccgtaaag

SEQ ID NO: 27444 - DNA, 18 bp, synthetic construct
  source 1..18: mol_type = other DNA
caatacgactttctaaag

SEQ ID NO: 27445 - DNA, 18 bp, synthetic construct
  source 1..18: mol_type = other DNA
caatacgagacacaatag

SEQ ID NO: 27446 - DNA, 18 bp, synthetic construct
  source 1..18: mol_type = other DNA
caatacgattcacaacag

SEQ ID NO: 27447 - DNA, 18 bp, synthetic construct
  source 1..18: mol_type = other DNA
caatacggcacactatgg

SEQ ID NO: 27448 - DNA, 18 bp, synthetic construct
  source 1..18: mol_type = other DNA
caatacggctcacttaag

SEQ ID NO: 27449 - DNA, 18 bp, synthetic construct
  source 1..18: mol_type = other DNA
caatacgtatcactttag

SEQ ID NO: 27450 - DNA, 18 bp, synthetic construct
  source 1..18: mol_type = other DNA
caatacgtcgcaatatag

SEQ ID NO: 27451 - DNA, 18 bp, synthetic construct
  source 1..18: mol_type = other DNA
caatactcatcactatag

SEQ ID NO: 27452 - DNA, 18 bp, synthetic construct
  source 1..18: mol_type = other DNA
cagaacgacacactatag

SEQ ID NO: 27453 - DNA, 18 bp, synthetic construct
  source 1..18: mol_type = other DNA
cataactactcactatag

SEQ ID NO: 27454 - DNA, 18 bp, synthetic construct
  source 1..18: mol_type = other DNA
cattacgactcactttgg

SEQ ID NO: 27455 - DNA, 18 bp, synthetic construct
  source 1..18: mol_type = other DNA
cattatgactcactatcg

SEQ ID NO: 27456 - DNA, 18 bp, synthetic construct
  source 1..18: mol_type = other DNA
ccataccaatcactatag

SEQ ID NO: 27457 - DNA, 18 bp, synthetic construct
  source 1..18: mol_type = other DNA
ctatacaactcattatag

SEQ ID NO: 27458 - DNA, 18 bp, synthetic construct
  source 1..18: mol_type = other DNA
ctatacgagtaactatag

SEQ ID NO: 27459 - DNA, 18 bp, synthetic construct
  source 1..18: mol_type = other DNA
ctttacgactcactatgg

SEQ ID NO: 27460 - DNA, 18 bp, synthetic construct
  source 1..18: mol_type = other DNA
gaatacgaatcattacag

SEQ ID NO: 27461 - DNA, 18 bp, synthetic construct
  source 1..18: mol_type = other DNA
gaatactacatactatag

SEQ ID NO: 27462 - DNA, 18 bp, synthetic construct
  source 1..18: mol_type = other DNA
gacaacgactaactatag

SEQ ID NO: 27463 - DNA, 18 bp, synthetic construct
  source 1..18: mol_type = other DNA
gagaacgactcactacag

SEQ ID NO: 27464 - DNA, 18 bp, synthetic construct
  source 1..18: mol_type = other DNA
ggttacgactcactaaag

SEQ ID NO: 27465 - DNA, 18 bp, synthetic construct
  source 1..18: mol_type = other DNA
taaaaacactcactttag

SEQ ID NO: 27466 - DNA, 18 bp, synthetic construct
  source 1..18: mol_type = other DNA
taaaaagcctcactaaag

SEQ ID NO: 27467 - DNA, 18 bp, synthetic construct
  source 1..18: mol_type = other DNA
taaaacaattgactatag

SEQ ID NO: 27468 - DNA, 18 bp, synthetic construct
  source 1..18: mol_type = other DNA
taaaaccacttacaatag

SEQ ID NO: 27469 - DNA, 18 bp, synthetic construct
  source 1..18: mol_type = other DNA
taaaacgaaccactaaag

SEQ ID NO: 27470 - DNA, 18 bp, synthetic construct
  source 1..18: mol_type = other DNA
taaaacgacaaagtatag

SEQ ID NO: 27471 - DNA, 18 bp, synthetic construct
  source 1..18: mol_type = other DNA
taaaacgacacaataaag

SEQ ID NO: 27472 - DNA, 18 bp, synthetic construct
  source 1..18: mol_type = other DNA
taaaacgacactctaaag

SEQ ID NO: 27473 - DNA, 18 bp, synthetic construct
  source 1..18: mol_type = other DNA
taaaacgactaaatacag

SEQ ID NO: 27474 - DNA, 18 bp, synthetic construct
  source 1..18: mol_type = other DNA
taaaacgactacctatcg

SEQ ID NO: 27475 - DNA, 18 bp, synthetic construct
  source 1..18: mol_type = other DNA
taaaacgactcagaaaag

SEQ ID NO: 27476 - DNA, 18 bp, synthetic construct
  source 1..18: mol_type = other DNA
taaaacgactcatagtag

SEQ ID NO: 27477 - DNA, 18 bp, synthetic construct
  source 1..18: mol_type = other DNA
taaaacgactctagatag

SEQ ID NO: 27478 - DNA, 18 bp, synthetic construct
  source 1..18: mol_type = other DNA
taaaacgactctcaacag

SEQ ID NO: 27479 - DNA, 18 bp, synthetic construct
  source 1..18: mol_type = other DNA
taaaacgagttattatag

SEQ ID NO: 27480 - DNA, 18 bp, synthetic construct
  source 1..18: mol_type = other DNA
taaaacggcttactaaag

SEQ ID NO: 27481 - DNA, 18 bp, synthetic construct
  source 1..18: mol_type = other DNA
taaaacgtcccactttag

SEQ ID NO: 27482 - DNA, 18 bp, synthetic construct
  source 1..18: mol_type = other DNA
taaaacgtccgactatag

SEQ ID NO: 27483 - DNA, 18 bp, synthetic construct
  source 1..18: mol_type = other DNA
taaaacgtttaactatag

SEQ ID NO: 27484 - DNA, 18 bp, synthetic construct
  source 1..18: mol_type = other DNA
taaaactattcacaatag

SEQ ID NO: 27485 - DNA, 18 bp, synthetic construct
  source 1..18: mol_type = other DNA
taaaatcacacactatag

SEQ ID NO: 27486 - DNA, 18 bp, synthetic construct
  source 1..18: mol_type = other DNA
taaaccatctcactatag

SEQ ID NO: 27487 - DNA, 18 bp, synthetic construct
  source 1..18: mol_type = other DNA
taacaagacttactaaag

SEQ ID NO: 27488 - DNA, 18 bp, synthetic construct
  source 1..18: mol_type = other DNA
taacacgacttaccttag

SEQ ID NO: 27489 - DNA, 18 bp, synthetic construct
  source 1..18: mol_type = other DNA
taacacgagacaccatag

SEQ ID NO: 27490 - DNA, 18 bp, synthetic construct
  source 1..18: mol_type = other DNA
taacacgattcacagtag

SEQ ID NO: 27491 - DNA, 18 bp, synthetic construct
  source 1..18: mol_type = other DNA
taacactactcactaccg

SEQ ID NO: 27492 - DNA, 18 bp, synthetic construct
  source 1..18: mol_type = other DNA
taacactactcattaaag

SEQ ID NO: 27493 - DNA, 18 bp, synthetic construct
  source 1..18: mol_type = other DNA
taacactactctttatag

SEQ ID NO: 27494 - DNA, 18 bp, synthetic construct
  source 1..18: mol_type = other DNA
taacactattcattatag

SEQ ID NO: 27495 - DNA, 18 bp, synthetic construct
  source 1..18: mol_type = other DNA
taacaggtatcactatag

SEQ ID NO: 27496 - DNA, 18 bp, synthetic construct
  source 1..18: mol_type = other DNA
taacatgatacactatag

SEQ ID NO: 27497 - DNA, 18 bp, synthetic construct
  source 1..18: mol_type = other DNA
taacatggttcactatag

SEQ ID NO: 27498 - DNA, 18 bp, synthetic construct
  source 1..18: mol_type = other DNA
taacgcgacccactaaag

SEQ ID NO: 27499 - DNA, 18 bp, synthetic construct
  source 1..18: mol_type = other DNA
taacgcgtctcactttag

SEQ ID NO: 27500 - DNA, 18 bp, synthetic construct
  source 1..18: mol_type = other DNA
taagacggttctctatag

SEQ ID NO: 27501 - DNA, 18 bp, synthetic construct
  source 1..18: mol_type = other DNA
taagcctactcactaaag

SEQ ID NO: 27502 - DNA, 18 bp, synthetic construct
  source 1..18: mol_type = other DNA
taataaaactcaaaatag

SEQ ID NO: 27503 - DNA, 18 bp, synthetic construct
  source 1..18: mol_type = other DNA
taataaaactccctttag

SEQ ID NO: 27504 - DNA, 18 bp, synthetic construct
  source 1..18: mol_type = other DNA
taataagaatcagaatag

SEQ ID NO: 27505 - DNA, 18 bp, synthetic construct
  source 1..18: mol_type = other DNA
taataagacacaccacag

SEQ ID NO: 27506 - DNA, 18 bp, synthetic construct
  source 1..18: mol_type = other DNA
taataagacacaccatgg

SEQ ID NO: 27507 - DNA, 18 bp, synthetic construct
  source 1..18: mol_type = other DNA
taataagagtcacttcag

SEQ ID NO: 27508 - DNA, 18 bp, synthetic construct
  source 1..18: mol_type = other DNA
taataagatacactttag

SEQ ID NO: 27509 - DNA, 18 bp, synthetic construct
  source 1..18: mol_type = other DNA
taataagatttactttag

SEQ ID NO: 27510 - DNA, 18 bp, synthetic construct
  source 1..18: mol_type = other DNA
taataaggctctctttag

SEQ ID NO: 27511 - DNA, 18 bp, synthetic construct
  source 1..18: mol_type = other DNA
taataagtatcattatag

SEQ ID NO: 27512 - DNA, 18 bp, synthetic construct
  source 1..18: mol_type = other DNA
taataatactctctctag

SEQ ID NO: 27513 - DNA, 18 bp, synthetic construct
  source 1..18: mol_type = other DNA
taataattttcactatag

SEQ ID NO: 27514 - DNA, 18 bp, synthetic construct
  source 1..18: mol_type = other DNA
taatacaaatcactttgg

SEQ ID NO: 27515 - DNA, 18 bp, synthetic construct
  source 1..18: mol_type = other DNA
taatacaacacaatgtag

SEQ ID NO: 27516 - DNA, 18 bp, synthetic construct
  source 1..18: mol_type = other DNA
taatacaacactatatag

SEQ ID NO: 27517 - DNA, 18 bp, synthetic construct
  source 1..18: mol_type = other DNA
taatacaaccaaccatag

SEQ ID NO: 27518 - DNA, 18 bp, synthetic construct
  source 1..18: mol_type = other DNA
taatacaactatctgtag

SEQ ID NO: 27519 - DNA, 18 bp, synthetic construct
  source 1..18: mol_type = other DNA
taatacaactcagtttgg

SEQ ID NO: 27520 - DNA, 18 bp, synthetic construct
  source 1..18: mol_type = other DNA
taatacaactccataaag

SEQ ID NO: 27521 - DNA, 18 bp, synthetic construct
  source 1..18: mol_type = other DNA
taatacaactttctctag

SEQ ID NO: 27522 - DNA, 18 bp, synthetic construct
  source 1..18: mol_type = other DNA
taatacaagtcaacatag

SEQ ID NO: 27523 - DNA, 18 bp, synthetic construct
  source 1..18: mol_type = other DNA
taatacatatccctatag

SEQ ID NO: 27524 - DNA, 18 bp, synthetic construct
  source 1..18: mol_type = other DNA
taatacatctcactgaag

SEQ ID NO: 27525 - DNA, 18 bp, synthetic construct
  source 1..18: mol_type = other DNA
taatacatttcactctag

SEQ ID NO: 27526 - DNA, 18 bp, synthetic construct
  source 1..18: mol_type = other DNA
taataccagttaatatag

SEQ ID NO: 27527 - DNA, 18 bp, synthetic construct
  source 1..18: mol_type = other DNA
taataccgctaactaaag

SEQ ID NO: 27528 - DNA, 18 bp, synthetic construct
  source 1..18: mol_type = other DNA
taatacctctctctacag

SEQ ID NO: 27529 - DNA, 18 bp, synthetic construct
  source 1..18: mol_type = other DNA
taatacgaaactctacag

SEQ ID NO: 27530 - DNA, 18 bp, synthetic construct
  source 1..18: mol_type = other DNA
taatacgaaccattaaag

SEQ ID NO: 27531 - DNA, 18 bp, synthetic construct
  source 1..18: mol_type = other DNA
taatacgacacagattag

SEQ ID NO: 27532 - DNA, 18 bp, synthetic construct
  source 1..18: mol_type = other DNA
taatacgacacagtcaag

SEQ ID NO: 27533 - DNA, 18 bp, synthetic construct
  source 1..18: mol_type = other DNA
taatacgacattatatag

SEQ ID NO: 27534 - DNA, 18 bp, synthetic construct
  source 1..18: mol_type = other DNA
taatacgaccaacttgag

SEQ ID NO: 27535 - DNA, 18 bp, synthetic construct
  source 1..18: mol_type = other DNA
taatacgacgatcaatag

SEQ ID NO: 27536 - DNA, 18 bp, synthetic construct
  source 1..18: mol_type = other DNA
taatacgacgctataaag

SEQ ID NO: 27537 - DNA, 18 bp, synthetic construct
  source 1..18: mol_type = other DNA
taatacgactaccattag

SEQ ID NO: 27538 - DNA, 18 bp, synthetic construct
  source 1..18: mol_type = other DNA
taatacgactatcttcag

SEQ ID NO: 27539 - DNA, 18 bp, synthetic construct
  source 1..18: mol_type = other DNA
taatacgactcaaacaag

SEQ ID NO: 27540 - DNA, 18 bp, synthetic construct
  source 1..18: mol_type = other DNA
taatacgactctacctag

SEQ ID NO: 27541 - DNA, 18 bp, synthetic construct
  source 1..18: mol_type = other DNA
taatacgactctccgaag

SEQ ID NO: 27542 - DNA, 18 bp, synthetic construct
  source 1..18: mol_type = other DNA
taatacgactgcataaag

SEQ ID NO: 27543 - DNA, 18 bp, synthetic construct
  source 1..18: mol_type = other DNA
taatacgactttctttcg

SEQ ID NO: 27544 - DNA, 18 bp, synthetic construct
  source 1..18: mol_type = other DNA
taatacgagactctacag

SEQ ID NO: 27545 - DNA, 18 bp, synthetic construct
  source 1..18: mol_type = other DNA
taatacgagatattatag

SEQ ID NO: 27546 - DNA, 18 bp, synthetic construct
  source 1..18: mol_type = other DNA
taatacgatacaccttag

SEQ ID NO: 27547 - DNA, 18 bp, synthetic construct
  source 1..18: mol_type = other DNA
taatacgattcaatgcag

SEQ ID NO: 27548 - DNA, 18 bp, synthetic construct
  source 1..18: mol_type = other DNA
taatacgattctctgtgg

SEQ ID NO: 27549 - DNA, 18 bp, synthetic construct
  source 1..18: mol_type = other DNA
taatacgcatcaaaatag

SEQ ID NO: 27550 - DNA, 18 bp, synthetic construct
  source 1..18: mol_type = other DNA
taatacgccaaactttag

SEQ ID NO: 27551 - DNA, 18 bp, synthetic construct
  source 1..18: mol_type = other DNA
taatacgcctatcaatag

SEQ ID NO: 27552 - DNA, 18 bp, synthetic construct
  source 1..18: mol_type = other DNA
taatacgcctatctttag

SEQ ID NO: 27553 - DNA, 18 bp, synthetic construct
  source 1..18: mol_type = other DNA
taatacgcctttctatcg

SEQ ID NO: 27554 - DNA, 18 bp, synthetic construct
  source 1..18: mol_type = other DNA
taatacgtagtactatag

SEQ ID NO: 27555 - DNA, 18 bp, synthetic construct
  source 1..18: mol_type = other DNA
taatacgtatcacttcag

SEQ ID NO: 27556 - DNA, 18 bp, synthetic construct
  source 1..18: mol_type = other DNA
taatacgtattacaatag

SEQ ID NO: 27557 - DNA, 18 bp, synthetic construct
  source 1..18: mol_type = other DNA
taatacgtcaaaatatag

SEQ ID NO: 27558 - DNA, 18 bp, synthetic construct
  source 1..18: mol_type = other DNA
taatacgtcatactacag

SEQ ID NO: 27559 - DNA, 18 bp, synthetic construct
  source 1..18: mol_type = other DNA
taatacgtcctactaaag

SEQ ID NO: 27560 - DNA, 18 bp, synthetic construct
  source 1..18: mol_type = other DNA
taatacgtctatgtatag

SEQ ID NO: 27561 - DNA, 18 bp, synthetic construct
  source 1..18: mol_type = other DNA
taatacgtctcaataacg

SEQ ID NO: 27562 - DNA, 18 bp, synthetic construct
  source 1..18: mol_type = other DNA
taatacgtctcacatgag

SEQ ID NO: 27563 - DNA, 18 bp, synthetic construct
  source 1..18: mol_type = other DNA
taatacgtctgtatatag

SEQ ID NO: 27564 - DNA, 18 bp, synthetic construct
  source 1..18: mol_type = other DNA
taatacgtggcactatgg

SEQ ID NO: 27565 - DNA, 18 bp, synthetic construct
  source 1..18: mol_type = other DNA
taatactaatcataatag

SEQ ID NO: 27566 - DNA, 18 bp, synthetic construct
  source 1..18: mol_type = other DNA
taatactacacacgaaag

SEQ ID NO: 27567 - DNA, 18 bp, synthetic construct
  source 1..18: mol_type = other DNA
taatactacacataatag

SEQ ID NO: 27568 - DNA, 18 bp, synthetic construct
  source 1..18: mol_type = other DNA
taatactacactctacag

SEQ ID NO: 27569 - DNA, 18 bp, synthetic construct
  source 1..18: mol_type = other DNA
taatactacctacaatag

SEQ ID NO: 27570 - DNA, 18 bp, synthetic construct
  source 1..18: mol_type = other DNA
taatactactatctatgg

SEQ ID NO: 27571 - DNA, 18 bp, synthetic construct
  source 1..18: mol_type = other DNA
taatactactcactcacg

SEQ ID NO: 27572 - DNA, 18 bp, synthetic construct
  source 1..18: mol_type = other DNA
taatactactcaggaaag

SEQ ID NO: 27573 - DNA, 18 bp, synthetic construct
  source 1..18: mol_type = other DNA
taatactactctatctag

SEQ ID NO: 27574 - DNA, 18 bp, synthetic construct
  source 1..18: mol_type = other DNA
taatactacttacaacag

SEQ ID NO: 27575 - DNA, 18 bp, synthetic construct
  source 1..18: mol_type = other DNA
taatactacttactacgg

SEQ ID NO: 27576 - DNA, 18 bp, synthetic construct
  source 1..18: mol_type = other DNA
taatactaggcaatatag

SEQ ID NO: 27577 - DNA, 18 bp, synthetic construct
  source 1..18: mol_type = other DNA
taatactattcaatatcg

SEQ ID NO: 27578 - DNA, 18 bp, synthetic construct
  source 1..18: mol_type = other DNA
taatactcctctatatag

SEQ ID NO: 27579 - DNA, 18 bp, synthetic construct
  source 1..18: mol_type = other DNA
taatacttgtaactatag

SEQ ID NO: 27580 - DNA, 18 bp, synthetic construct
  source 1..18: mol_type = other DNA
taatagaactctcaatag

SEQ ID NO: 27581 - DNA, 18 bp, synthetic construct
  source 1..18: mol_type = other DNA
taatagatcacactatag

SEQ ID NO: 27582 - DNA, 18 bp, synthetic construct
  source 1..18: mol_type = other DNA
taatagatctcaccatag

SEQ ID NO: 27583 - DNA, 18 bp, synthetic construct
  source 1..18: mol_type = other DNA
taataggactaaccttag

SEQ ID NO: 27584 - DNA, 18 bp, synthetic construct
  source 1..18: mol_type = other DNA
taatagtacccacaatag

SEQ ID NO: 27585 - DNA, 18 bp, synthetic construct
  source 1..18: mol_type = other DNA
taatagtactccctaaag

SEQ ID NO: 27586 - DNA, 18 bp, synthetic construct
  source 1..18: mol_type = other DNA
taatataacacactatgg

SEQ ID NO: 27587 - DNA, 18 bp, synthetic construct
  source 1..18: mol_type = other DNA
taatataattcattatag

SEQ ID NO: 27588 - DNA, 18 bp, synthetic construct
  source 1..18: mol_type = other DNA
taatatctctcactttag

SEQ ID NO: 27589 - DNA, 18 bp, synthetic construct
  source 1..18: mol_type = other DNA
taatatgacacaaaatag

SEQ ID NO: 27590 - DNA, 18 bp, synthetic construct
  source 1..18: mol_type = other DNA
taatatgacacacgaaag

SEQ ID NO: 27591 - DNA, 18 bp, synthetic construct
  source 1..18: mol_type = other DNA
taatatgacacataatag

SEQ ID NO: 27592 - DNA, 18 bp, synthetic construct
  source 1..18: mol_type = other DNA
taatatgacagactctag

SEQ ID NO: 27593 - DNA, 18 bp, synthetic construct
  source 1..18: mol_type = other DNA
taatatgaccctctctag

SEQ ID NO: 27594 - DNA, 18 bp, synthetic construct
  source 1..18: mol_type = other DNA
taatatgacgaactttag

SEQ ID NO: 27595 - DNA, 18 bp, synthetic construct
  source 1..18: mol_type = other DNA
taatatgactacctaaag

SEQ ID NO: 27596 - DNA, 18 bp, synthetic construct
  source 1..18: mol_type = other DNA
taatatgactcagaaaag

SEQ ID NO: 27597 - DNA, 18 bp, synthetic construct
  source 1..18: mol_type = other DNA
taatatgatacacaatag

SEQ ID NO: 27598 - DNA, 18 bp, synthetic construct
  source 1..18: mol_type = other DNA
taatatgatgcactctag

SEQ ID NO: 27599 - DNA, 18 bp, synthetic construct
  source 1..18: mol_type = other DNA
taatatgattcaccctag

SEQ ID NO: 27600 - DNA, 18 bp, synthetic construct
  source 1..18: mol_type = other DNA
taatatgcctgactttag

SEQ ID NO: 27601 - DNA, 18 bp, synthetic construct
  source 1..18: mol_type = other DNA
taatatggcacacaatag

SEQ ID NO: 27602 - DNA, 18 bp, synthetic construct
  source 1..18: mol_type = other DNA
taatatggtccactatag

SEQ ID NO: 27603 - DNA, 18 bp, synthetic construct
  source 1..18: mol_type = other DNA
taatattacacactacag

SEQ ID NO: 27604 - DNA, 18 bp, synthetic construct
  source 1..18: mol_type = other DNA
taatattactcaaaatag

SEQ ID NO: 27605 - DNA, 18 bp, synthetic construct
  source 1..18: mol_type = other DNA
taatattactctctacag

SEQ ID NO: 27606 - DNA, 18 bp, synthetic construct
  source 1..18: mol_type = other DNA
taatattattcactaaag

SEQ ID NO: 27607 - DNA, 18 bp, synthetic construct
  source 1..18: mol_type = other DNA
taatcccactcaatttag

SEQ ID NO: 27608 - DNA, 18 bp, synthetic construct
  source 1..18: mol_type = other DNA
taatccgaatcattttag

SEQ ID NO: 27609 - DNA, 18 bp, synthetic construct
  source 1..18: mol_type = other DNA
taatccgactcacctcag

SEQ ID NO: 27610 - DNA, 18 bp, synthetic construct
  source 1..18: mol_type = other DNA
taatccgactctatatcg

SEQ ID NO: 27611 - DNA, 18 bp, synthetic construct
  source 1..18: mol_type = other DNA
taatccgcctcacaaaag

SEQ ID NO: 27612 - DNA, 18 bp, synthetic construct
  source 1..18: mol_type = other DNA
taatccggctcattctag

SEQ ID NO: 27613 - DNA, 18 bp, synthetic construct
  source 1..18: mol_type = other DNA
taatccgtcttacaatag

SEQ ID NO: 27614 - DNA, 18 bp, synthetic construct
  source 1..18: mol_type = other DNA
taatccgtttccctatag

SEQ ID NO: 27615 - DNA, 18 bp, synthetic construct
  source 1..18: mol_type = other DNA
taatcctacccactctag

SEQ ID NO: 27616 - DNA, 18 bp, synthetic construct
  source 1..18: mol_type = other DNA
taatctaacttactatag

SEQ ID NO: 27617 - DNA, 18 bp, synthetic construct
  source 1..18: mol_type = other DNA
taatctgactctctttag

SEQ ID NO: 27618 - DNA, 18 bp, synthetic construct
  source 1..18: mol_type = other DNA
taatgcaactaaccatag

SEQ ID NO: 27619 - DNA, 18 bp, synthetic construct
  source 1..18: mol_type = other DNA
taatgccactcactgaag

SEQ ID NO: 27620 - DNA, 18 bp, synthetic construct
  source 1..18: mol_type = other DNA
taatgcgactaataatag

SEQ ID NO: 27621 - DNA, 18 bp, synthetic construct
  source 1..18: mol_type = other DNA
taatgcgattatctatag

SEQ ID NO: 27622 - DNA, 18 bp, synthetic construct
  source 1..18: mol_type = other DNA
taatgcgatttacaatag

SEQ ID NO: 27623 - DNA, 18 bp, synthetic construct
  source 1..18: mol_type = other DNA
taatgcgtccctctatag

SEQ ID NO: 27624 - DNA, 18 bp, synthetic construct
  source 1..18: mol_type = other DNA
taatgcgtctaactatgg

SEQ ID NO: 27625 - DNA, 18 bp, synthetic construct
  source 1..18: mol_type = other DNA
taatgcgtctcatcatag

SEQ ID NO: 27626 - DNA, 18 bp, synthetic construct
  source 1..18: mol_type = other DNA
taatgctactccctaaag

SEQ ID NO: 27627 - DNA, 18 bp, synthetic construct
  source 1..18: mol_type = other DNA
taatgcttctcattatag

SEQ ID NO: 27628 - DNA, 18 bp, synthetic construct
  source 1..18: mol_type = other DNA
taatgtgacacacaatag

SEQ ID NO: 27629 - DNA, 18 bp, synthetic construct
  source 1..18: mol_type = other DNA
taatgtgattcactttag

SEQ ID NO: 27630 - DNA, 18 bp, synthetic construct
  source 1..18: mol_type = other DNA
tacaacgacgcattatag

SEQ ID NO: 27631 - DNA, 18 bp, synthetic construct
  source 1..18: mol_type = other DNA
tacaacgactcaatacag

SEQ ID NO: 27632 - DNA, 18 bp, synthetic construct
  source 1..18: mol_type = other DNA
tacaacgactcactcaag

SEQ ID NO: 27633 - DNA, 18 bp, synthetic construct
  source 1..18: mol_type = other DNA
tactacaaatcactgtag

SEQ ID NO: 27634 - DNA, 18 bp, synthetic construct
  source 1..18: mol_type = other DNA
tactacaacttactatcg

SEQ ID NO: 27635 - DNA, 18 bp, synthetic construct
  source 1..18: mol_type = other DNA
tactacacctcactaaag

SEQ ID NO: 27636 - DNA, 18 bp, synthetic construct
  source 1..18: mol_type = other DNA
tactacgacttacaacag

SEQ ID NO: 27637 - DNA, 18 bp, synthetic construct
  source 1..18: mol_type = other DNA
tactacggatcactttag

SEQ ID NO: 27638 - DNA, 18 bp, synthetic construct
  source 1..18: mol_type = other DNA
tactacgtatcactacag

SEQ ID NO: 27639 - DNA, 18 bp, synthetic construct
  source 1..18: mol_type = other DNA
tactactactaactaaag

SEQ ID NO: 27640 - DNA, 18 bp, synthetic construct
  source 1..18: mol_type = other DNA
tactaggccttactatag

SEQ ID NO: 27641 - DNA, 18 bp, synthetic construct
  source 1..18: mol_type = other DNA
tagaacgactctccatag

SEQ ID NO: 27642 - DNA, 18 bp, synthetic construct
  source 1..18: mol_type = other DNA
tagcacgacttactatcg

SEQ ID NO: 27643 - DNA, 18 bp, synthetic construct
  source 1..18: mol_type = other DNA
tagtaaaactcaccatag

SEQ ID NO: 27644 - DNA, 18 bp, synthetic construct
  source 1..18: mol_type = other DNA
tagtacaacttactatgg

SEQ ID NO: 27645 - DNA, 18 bp, synthetic construct
  source 1..18: mol_type = other DNA
tagtacgactctcaatgg

SEQ ID NO: 27646 - DNA, 18 bp, synthetic construct
  source 1..18: mol_type = other DNA
tagtacgactctgtttag

SEQ ID NO: 27647 - DNA, 18 bp, synthetic construct
  source 1..18: mol_type = other DNA
tagtacgacttacaaaag

SEQ ID NO: 27648 - DNA, 18 bp, synthetic construct
  source 1..18: mol_type = other DNA
tagtacgactttctacag

SEQ ID NO: 27649 - DNA, 18 bp, synthetic construct
  source 1..18: mol_type = other DNA
tagtacgtcccactgtag

SEQ ID NO: 27650 - DNA, 18 bp, synthetic construct
  source 1..18: mol_type = other DNA
tagtatgacacactaaag

SEQ ID NO: 27651 - DNA, 18 bp, synthetic construct
  source 1..18: mol_type = other DNA
tagtgcgactcacttaag

SEQ ID NO: 27652 - DNA, 18 bp, synthetic construct
  source 1..18: mol_type = other DNA
tataacgactcaccgtag

SEQ ID NO: 27653 - DNA, 18 bp, synthetic construct
  source 1..18: mol_type = other DNA
tataacgactcactccag

SEQ ID NO: 27654 - DNA, 18 bp, synthetic construct
  source 1..18: mol_type = other DNA
tataacgacttcctatag

SEQ ID NO: 27655 - DNA, 18 bp, synthetic construct
  source 1..18: mol_type = other DNA
tatagcgagtcactatag

SEQ ID NO: 27656 - DNA, 18 bp, synthetic construct
  source 1..18: mol_type = other DNA
tattaacactctctatag

SEQ ID NO: 27657 - DNA, 18 bp, synthetic construct
  source 1..18: mol_type = other DNA
tattaagactcaatacag

SEQ ID NO: 27658 - DNA, 18 bp, synthetic construct
  source 1..18: mol_type = other DNA
tattaagactcacattag

SEQ ID NO: 27659 - DNA, 18 bp, synthetic construct
  source 1..18: mol_type = other DNA
tattaagcatcactatag

SEQ ID NO: 27660 - DNA, 18 bp, synthetic construct
  source 1..18: mol_type = other DNA
tattacaactctctgtag

SEQ ID NO: 27661 - DNA, 18 bp, synthetic construct
  source 1..18: mol_type = other DNA
tattacaattcaatatag

SEQ ID NO: 27662 - DNA, 18 bp, synthetic construct
  source 1..18: mol_type = other DNA
tattaccaatccctatag

SEQ ID NO: 27663 - DNA, 18 bp, synthetic construct
  source 1..18: mol_type = other DNA
tattacgaattactttag

SEQ ID NO: 27664 - DNA, 18 bp, synthetic construct
  source 1..18: mol_type = other DNA
tattacgacacacaacag

SEQ ID NO: 27665 - DNA, 18 bp, synthetic construct
  source 1..18: mol_type = other DNA
tattacgactctctttcg

SEQ ID NO: 27666 - DNA, 18 bp, synthetic construct
  source 1..18: mol_type = other DNA
tattacgactctctttgg

SEQ ID NO: 27667 - DNA, 18 bp, synthetic construct
  source 1..18: mol_type = other DNA
tattacgcctcaataaag

SEQ ID NO: 27668 - DNA, 18 bp, synthetic construct
  source 1..18: mol_type = other DNA
tattacggttcactaaag

SEQ ID NO: 27669 - DNA, 18 bp, synthetic construct
  source 1..18: mol_type = other DNA
tattacgtctaattatag

SEQ ID NO: 27670 - DNA, 18 bp, synthetic construct
  source 1..18: mol_type = other DNA
tattacgtctcattatcg

SEQ ID NO: 27671 - DNA, 18 bp, synthetic construct
  source 1..18: mol_type = other DNA
tattacgtcttactctag

SEQ ID NO: 27672 - DNA, 18 bp, synthetic construct
  source 1..18: mol_type = other DNA
tattactacacagtatag

SEQ ID NO: 27673 - DNA, 18 bp, synthetic construct
  source 1..18: mol_type = other DNA
tattactactcaatatcg

SEQ ID NO: 27674 - DNA, 18 bp, synthetic construct
  source 1..18: mol_type = other DNA
tattactactcacttcag

SEQ ID NO: 27675 - DNA, 18 bp, synthetic construct
  source 1..18: mol_type = other DNA
tattactactcagtacag

SEQ ID NO: 27676 - DNA, 18 bp, synthetic construct
  source 1..18: mol_type = other DNA
tattactacttattatag

SEQ ID NO: 27677 - DNA, 18 bp, synthetic construct
  source 1..18: mol_type = other DNA
tattactattcactctag

SEQ ID NO: 27678 - DNA, 18 bp, synthetic construct
  source 1..18: mol_type = other DNA
tattactattcattatag

SEQ ID NO: 27679 - DNA, 18 bp, synthetic construct
  source 1..18: mol_type = other DNA
tattactcctcactctag

SEQ ID NO: 27680 - DNA, 18 bp, synthetic construct
  source 1..18: mol_type = other DNA
tattactgcacactatag

SEQ ID NO: 27681 - DNA, 18 bp, synthetic construct
  source 1..18: mol_type = other DNA
tattaggacacattatag

SEQ ID NO: 27682 - DNA, 18 bp, synthetic construct
  source 1..18: mol_type = other DNA
tattagtactcacaatag

SEQ ID NO: 27683 - DNA, 18 bp, synthetic construct
  source 1..18: mol_type = other DNA
tattatgactcattttag

SEQ ID NO: 27684 - DNA, 18 bp, synthetic construct
  source 1..18: mol_type = other DNA
tattatgattcacaatag

SEQ ID NO: 27685 - DNA, 18 bp, synthetic construct
  source 1..18: mol_type = other DNA
tattatgtctcattatag

SEQ ID NO: 27686 - DNA, 18 bp, synthetic construct
  source 1..18: mol_type = other DNA
tattatgtcttactatag

SEQ ID NO: 27687 - DNA, 18 bp, synthetic construct
  source 1..18: mol_type = other DNA
tattccgattcacaatag

SEQ ID NO: 27688 - DNA, 18 bp, synthetic construct
  source 1..18: mol_type = other DNA
tattgagactcacaatag

SEQ ID NO: 27689 - DNA, 18 bp, synthetic construct
  source 1..18: mol_type = other DNA
tattgcgactatctatag

SEQ ID NO: 27690 - DNA, 18 bp, synthetic construct
  source 1..18: mol_type = other DNA
tcaaacgactctctaaag

SEQ ID NO: 27691 - DNA, 18 bp, synthetic construct
  source 1..18: mol_type = other DNA
tcatacgacacaccacag

SEQ ID NO: 27692 - DNA, 18 bp, synthetic construct
  source 1..18: mol_type = other DNA
tcatacgacactatatag

SEQ ID NO: 27693 - DNA, 18 bp, synthetic construct
  source 1..18: mol_type = other DNA
tcatacgacatagtatag

SEQ ID NO: 27694 - DNA, 18 bp, synthetic construct
  source 1..18: mol_type = other DNA
tcatacgactcattaagg

SEQ ID NO: 27695 - DNA, 18 bp, synthetic construct
  source 1..18: mol_type = other DNA
tcatacgacttacaatgg

SEQ ID NO: 27696 - DNA, 18 bp, synthetic construct
  source 1..18: mol_type = other DNA
tcatacgagtcacttaag

SEQ ID NO: 27697 - DNA, 18 bp, synthetic construct
  source 1..18: mol_type = other DNA
tcatacgattcaacatag

SEQ ID NO: 27698 - DNA, 18 bp, synthetic construct
  source 1..18: mol_type = other DNA
tcatacgtgtctctatag

SEQ ID NO: 27699 - DNA, 18 bp, synthetic construct
  source 1..18: mol_type = other DNA
tcatactaatcactctag

SEQ ID NO: 27700 - DNA, 18 bp, synthetic construct
  source 1..18: mol_type = other DNA
tcatactacacactaaag

SEQ ID NO: 27701 - DNA, 18 bp, synthetic construct
  source 1..18: mol_type = other DNA
tcatactacacactttag

SEQ ID NO: 27702 - DNA, 18 bp, synthetic construct
  source 1..18: mol_type = other DNA
tcatactactaactttag

SEQ ID NO: 27703 - DNA, 18 bp, synthetic construct
  source 1..18: mol_type = other DNA
tcatactactctctacag

SEQ ID NO: 27704 - DNA, 18 bp, synthetic construct
  source 1..18: mol_type = other DNA
tcataggcctcactctag

SEQ ID NO: 27705 - DNA, 18 bp, synthetic construct
  source 1..18: mol_type = other DNA
tcatatgacactctatag

SEQ ID NO: 27706 - DNA, 18 bp, synthetic construct
  source 1..18: mol_type = other DNA
tcatgcgaatcactaaag

SEQ ID NO: 27707 - DNA, 18 bp, synthetic construct
  source 1..18: mol_type = other DNA
tcctacgacttactaaag

SEQ ID NO: 27708 - DNA, 18 bp, synthetic construct
  source 1..18: mol_type = other DNA
tcgtacgtcacactatag

SEQ ID NO: 27709 - DNA, 18 bp, synthetic construct
  source 1..18: mol_type = other DNA
tcttacgacaaactatag

SEQ ID NO: 27710 - DNA, 18 bp, synthetic construct
  source 1..18: mol_type = other DNA
tcttacgactcaatttag

SEQ ID NO: 27711 - DNA, 18 bp, synthetic construct
  source 1..18: mol_type = other DNA
tcttacgactccctaaag

SEQ ID NO: 27712 - DNA, 18 bp, synthetic construct
  source 1..18: mol_type = other DNA
tcttccgactcactttag

SEQ ID NO: 27713 - DNA, 18 bp, synthetic construct
  source 1..18: mol_type = other DNA
tgaaacgattctctatag

SEQ ID NO: 27714 - DNA, 18 bp, synthetic construct
  source 1..18: mol_type = other DNA
tgatacgacactctatcg

SEQ ID NO: 27715 - DNA, 18 bp, synthetic construct
  source 1..18: mol_type = other DNA
tgatacgactctctaacg

SEQ ID NO: 27716 - DNA, 18 bp, synthetic construct
  source 1..18: mol_type = other DNA
tgatacgattcaccatgg

SEQ ID NO: 27717 - DNA, 18 bp, synthetic construct
  source 1..18: mol_type = other DNA
tgatacgtcttactaaag

SEQ ID NO: 27718 - DNA, 18 bp, synthetic construct
  source 1..18: mol_type = other DNA
tgatactgctcactttag

SEQ ID NO: 27719 - DNA, 18 bp, synthetic construct
  source 1..18: mol_type = other DNA
tgatatgactgattatag

SEQ ID NO: 27720 - DNA, 18 bp, synthetic construct
  source 1..18: mol_type = other DNA
tgatgcgactctatatag

SEQ ID NO: 27721 - DNA, 18 bp, synthetic construct
  source 1..18: mol_type = other DNA
tgctacgactgactttag

SEQ ID NO: 27722 - DNA, 18 bp, synthetic construct
  source 1..18: mol_type = other DNA
tggtacgactctgtatag

SEQ ID NO: 27723 - DNA, 18 bp, synthetic construct
  source 1..18: mol_type = other DNA
tgttacgtcccactatag

SEQ ID NO: 27724 - DNA, 18 bp, synthetic construct
  source 1..18: mol_type = other DNA
ttaaacgtctcactacag

SEQ ID NO: 27725 - DNA, 18 bp, synthetic construct
  source 1..18: mol_type = other DNA
ttacaccactcaatatag

SEQ ID NO: 27726 - DNA, 18 bp, synthetic construct
  source 1..18: mol_type = other DNA
ttacacgactcactttcg

SEQ ID NO: 27727 - DNA, 18 bp, synthetic construct
  source 1..18: mol_type = other DNA
ttacatgactcactaaag

SEQ ID NO: 27728 - DNA, 18 bp, synthetic construct
  source 1..18: mol_type = other DNA
ttataagactccccatag

SEQ ID NO: 27729 - DNA, 18 bp, synthetic construct
  source 1..18: mol_type = other DNA
ttatacaactcaatacag

SEQ ID NO: 27730 - DNA, 18 bp, synthetic construct
  source 1..18: mol_type = other DNA
ttatacaactcactctcg

SEQ ID NO: 27731 - DNA, 18 bp, synthetic construct
  source 1..18: mol_type = other DNA
ttatacaactcactttgg

SEQ ID NO: 27732 - DNA, 18 bp, synthetic construct
  source 1..18: mol_type = other DNA
ttatacaactcattacag

SEQ ID NO: 27733 - DNA, 18 bp, synthetic construct
  source 1..18: mol_type = other DNA
ttatacgaataacaatag

SEQ ID NO: 27734 - DNA, 18 bp, synthetic construct
  source 1..18: mol_type = other DNA
ttatacgacacaccttag

SEQ ID NO: 27735 - DNA, 18 bp, synthetic construct
  source 1..18: mol_type = other DNA
ttatacgaccctctctag

SEQ ID NO: 27736 - DNA, 18 bp, synthetic construct
  source 1..18: mol_type = other DNA
ttatacgactcagttgag

SEQ ID NO: 27737 - DNA, 18 bp, synthetic construct
  source 1..18: mol_type = other DNA
ttatacgactcattttcg

SEQ ID NO: 27738 - DNA, 18 bp, synthetic construct
  source 1..18: mol_type = other DNA
ttatacgacttaccttag

SEQ ID NO: 27739 - DNA, 18 bp, synthetic construct
  source 1..18: mol_type = other DNA
ttatacgacttactaagg

SEQ ID NO: 27740 - DNA, 18 bp, synthetic construct
  source 1..18: mol_type = other DNA
ttatacgacttattaaag

SEQ ID NO: 27741 - DNA, 18 bp, synthetic construct
  source 1..18: mol_type = other DNA
ttatacgatttaatatag

SEQ ID NO: 27742 - DNA, 18 bp, synthetic construct
  source 1..18: mol_type = other DNA
ttatacgcctcattgtag

SEQ ID NO: 27743 - DNA, 18 bp, synthetic construct
  source 1..18: mol_type = other DNA
ttatacggctcactcgag

SEQ ID NO: 27744 - DNA, 18 bp, synthetic construct
  source 1..18: mol_type = other DNA
ttatacgtctcacttcag

SEQ ID NO: 27745 - DNA, 18 bp, synthetic construct
  source 1..18: mol_type = other DNA
ttatactacgctctatag

SEQ ID NO: 27746 - DNA, 18 bp, synthetic construct
  source 1..18: mol_type = other DNA
ttatactactccccatag

SEQ ID NO: 27747 - DNA, 18 bp, synthetic construct
  source 1..18: mol_type = other DNA
ttatactacttagtatag

SEQ ID NO: 27748 - DNA, 18 bp, synthetic construct
  source 1..18: mol_type = other DNA
ttatatgaatcactatcg

SEQ ID NO: 27749 - DNA, 18 bp, synthetic construct
  source 1..18: mol_type = other DNA
ttatattactcattatag

SEQ ID NO: 27750 - DNA, 18 bp, synthetic construct
  source 1..18: mol_type = other DNA
ttatcagactcactttag

SEQ ID NO: 27751 - DNA, 18 bp, synthetic construct
  source 1..18: mol_type = other DNA
ttatccgacgccctatag

SEQ ID NO: 27752 - DNA, 18 bp, synthetic construct
  source 1..18: mol_type = other DNA
ttatccgactcactctcg

SEQ ID NO: 27753 - DNA, 18 bp, synthetic construct
  source 1..18: mol_type = other DNA
ttatccgactctttatag

SEQ ID NO: 27754 - DNA, 18 bp, synthetic construct
  source 1..18: mol_type = other DNA
ttatccgtctcattatag

SEQ ID NO: 27755 - DNA, 18 bp, synthetic construct
  source 1..18: mol_type = other DNA
ttatcggactcactttag

SEQ ID NO: 27756 - DNA, 18 bp, synthetic construct
  source 1..18: mol_type = other DNA
ttatgctactctctatag

SEQ ID NO: 27757 - DNA, 18 bp, synthetic construct
  source 1..18: mol_type = other DNA
ttctaaaactcactatag

SEQ ID NO: 27758 - DNA, 18 bp, synthetic construct
  source 1..18: mol_type = other DNA
ttctatgacacactatag

SEQ ID NO: 27759 - DNA, 18 bp, synthetic construct
  source 1..18: mol_type = other DNA
ttgtacgacacactagag

SEQ ID NO: 27760 - DNA, 18 bp, synthetic construct
  source 1..18: mol_type = other DNA
ttgtacgactcacaagag

SEQ ID NO: 27761 - DNA, 18 bp, synthetic construct
  source 1..18: mol_type = other DNA
tttgacgactcacaatag

SEQ ID NO: 27762 - DNA, 18 bp, synthetic construct
  source 1..18: mol_type = other DNA
ttttaccacttactatag

SEQ ID NO: 27763 - DNA, 18 bp, synthetic construct
  source 1..18: mol_type = other DNA
ttttacgaatcactttag

SEQ ID NO: 27764 - DNA, 18 bp, synthetic construct
  source 1..18: mol_type = other DNA
ttttacgacacactacag

SEQ ID NO: 27765 - DNA, 18 bp, synthetic construct
  source 1..18: mol_type = other DNA
ttttacgcctaactatag

SEQ ID NO: 27766 - DNA, 18 bp, synthetic construct
  source 1..18: mol_type = other DNA
ttttactactctctatag

SEQ ID NO: 27767 - DNA, 18 bp, synthetic construct
  source 1..18: mol_type = other DNA
ttattcgactctctattg

SEQ ID NO: 27768 - DNA, 18 bp, synthetic construct
  source 1..18: mol_type = other DNA
tattacatctcacaatag

SEQ ID NO: 27769 - DNA, 18 bp, synthetic construct
  source 1..18: mol_type = other DNA
taattcaactctctattg

SEQ ID NO: 27770 - DNA, 18 bp, synthetic construct
  source 1..18: mol_type = other DNA
ttattcgactcacaacag

SEQ ID NO: 27771 - DNA, 18 bp, synthetic construct
  source 1..18: mol_type = other DNA
ttatacgactctataaag

SEQ ID NO: 27772 - DNA, 18 bp, synthetic construct
  source 1..18: mol_type = other DNA
ttatactactcacttcag

SEQ ID NO: 27773 - DNA, 18 bp, synthetic construct
  source 1..18: mol_type = other DNA
tataacgactcacttaag

SEQ ID NO: 27774 - DNA, 18 bp, synthetic construct
  source 1..18: mol_type = other DNA
taatacgactccttaatg

SEQ ID NO: 27775 - DNA, 18 bp, synthetic construct
  source 1..18: mol_type = other DNA
taatactactctatattg

SEQ ID NO: 27776 - DNA, 18 bp, synthetic construct
  source 1..18: mol_type = other DNA
taatatgacacacttttg

SEQ ID NO: 27777 - DNA, 18 bp, synthetic construct
  source 1..18: mol_type = other DNA
taatatgtcacactattg

SEQ ID NO: 27778 - DNA, 18 bp, synthetic construct
  source 1..18: mol_type = other DNA
tatttcaactcacaatag

SEQ ID NO: 27779 - DNA, 18 bp, synthetic construct
  source 1..18: mol_type = other DNA
atatacgtctcacaatag

SEQ ID NO: 27780 - DNA, 18 bp, synthetic construct
  source 1..18: mol_type = other DNA
caatacatctcactttag

SEQ ID NO: 27781 - DNA, 18 bp, synthetic construct
  source 1..18: mol_type = other DNA
taaaaagtctcactaaag

SEQ ID NO: 27782 - DNA, 18 bp, synthetic construct
  source 1..18: mol_type = other DNA
taatatttcacactatag

SEQ ID NO: 27783 - DNA, 18 bp, synthetic construct
  source 1..18: mol_type = other DNA
tattacgtatcactttag

SEQ ID NO: 27784 - DNA, 18 bp, synthetic construct
  source 1..18: mol_type = other DNA
ttatactattcactattg

SEQ ID NO: 27785 - DNA, 18 bp, synthetic construct
  source 1..18: mol_type = other DNA
atattcgactctctatag

SEQ ID NO: 27786 - DNA, 18 bp, synthetic construct
  source 1..18: mol_type = other DNA
caattcaactcactttag

SEQ ID NO: 27787 - DNA, 18 bp, synthetic construct
  source 1..18: mol_type = other DNA
ctatacaactcactattg

SEQ ID NO: 27788 - DNA, 18 bp, synthetic construct
  source 1..18: mol_type = other DNA
taaatcgactcaatgtag

SEQ ID NO: 27789 - DNA, 18 bp, synthetic construct
  source 1..18: mol_type = other DNA
taaatcgactcattttag

SEQ ID NO: 27790 - DNA, 18 bp, synthetic construct
  source 1..18: mol_type = other DNA
taatacgacatattattg

SEQ ID NO: 27791 - DNA, 18 bp, synthetic construct
  source 1..18: mol_type = other DNA
taatatgactccctaatg

SEQ ID NO: 27792 - DNA, 18 bp, synthetic construct
  source 1..18: mol_type = other DNA
taatatgtctcactactg

SEQ ID NO: 27793 - DNA, 18 bp, synthetic construct
  source 1..18: mol_type = other DNA
taattcaattcattatag

SEQ ID NO: 27794 - DNA, 18 bp, synthetic construct
  source 1..18: mol_type = other DNA
taattcgactctcaaaag

SEQ ID NO: 27795 - DNA, 18 bp, synthetic construct
  source 1..18: mol_type = other DNA
tactacgacactctattg

SEQ ID NO: 27796 - DNA, 18 bp, synthetic construct
  source 1..18: mol_type = other DNA
tattacgacactctattg

SEQ ID NO: 27797 - DNA, 18 bp, synthetic construct
  source 1..18: mol_type = other DNA
tattatgacttgctatag

SEQ ID NO: 27798 - DNA, 18 bp, synthetic construct
  source 1..18: mol_type = other DNA
ttacacgaatcactattg

SEQ ID NO: 27799 - DNA, 18 bp, synthetic construct
  source 1..18: mol_type = other DNA
ttactcgactcactacag

SEQ ID NO: 27800 - DNA, 18 bp, synthetic construct
  source 1..18: mol_type = other DNA
ttatacgatttactattg

SEQ ID NO: 27801 - DNA, 18 bp, synthetic construct
  source 1..18: mol_type = other DNA
ttattcaactcactatcg

SEQ ID NO: 27802 - DNA, 18 bp, synthetic construct
  source 1..18: mol_type = other DNA
aaatacgacactccatag

SEQ ID NO: 27803 - DNA, 18 bp, synthetic construct
  source 1..18: mol_type = other DNA
aaatacgattatctatag

SEQ ID NO: 27804 - DNA, 18 bp, synthetic construct
  source 1..18: mol_type = other DNA
aaatacgtctctccatag

SEQ ID NO: 27805 - DNA, 18 bp, synthetic construct
  source 1..18: mol_type = other DNA
aaatactattctctatag

SEQ ID NO: 27806 - DNA, 18 bp, synthetic construct
  source 1..18: mol_type = other DNA
aaatatgtcttactatag

SEQ ID NO: 27807 - DNA, 18 bp, synthetic construct
  source 1..18: mol_type = other DNA
taaaacaaaacactatag

SEQ ID NO: 27808 - DNA, 18 bp, synthetic construct
  source 1..18: mol_type = other DNA
taaaactacttcctatag

SEQ ID NO: 27809 - DNA, 18 bp, synthetic construct
  source 1..18: mol_type = other DNA
taaaatgacacactttag

SEQ ID NO: 27810 - DNA, 18 bp, synthetic construct
  source 1..18: mol_type = other DNA
taaagcgtctctctatag

SEQ ID NO: 27811 - DNA, 18 bp, synthetic construct
  source 1..18: mol_type = other DNA
taataaaacttacaatag

SEQ ID NO: 27812 - DNA, 18 bp, synthetic construct
  source 1..18: mol_type = other DNA
taataatactctatatag

SEQ ID NO: 27813 - DNA, 18 bp, synthetic construct
  source 1..18: mol_type = other DNA
taatacaactgtctaaag

SEQ ID NO: 27814 - DNA, 18 bp, synthetic construct
  source 1..18: mol_type = other DNA
taatacacctctctaaag

SEQ ID NO: 27815 - DNA, 18 bp, synthetic construct
  source 1..18: mol_type = other DNA
taatacgattctcttaag

SEQ ID NO: 27816 - DNA, 18 bp, synthetic construct
  source 1..18: mol_type = other DNA
taatacggttcacattag

SEQ ID NO: 27817 - DNA, 18 bp, synthetic construct
  source 1..18: mol_type = other DNA
taatacgtctctctcaag

SEQ ID NO: 27818 - DNA, 18 bp, synthetic construct
  source 1..18: mol_type = other DNA
tactactacttactacag

SEQ ID NO: 27819 - DNA, 18 bp, synthetic construct
  source 1..18: mol_type = other DNA
tagtatgtctcattatag

SEQ ID NO: 27820 - DNA, 18 bp, synthetic construct
  source 1..18: mol_type = other DNA
tatcacgtctcacaatag

SEQ ID NO: 27821 - DNA, 18 bp, synthetic construct
  source 1..18: mol_type = other DNA
tattacacctcactaaag

SEQ ID NO: 27822 - DNA, 18 bp, synthetic construct
  source 1..18: mol_type = other DNA
tattacgactcaataagg

SEQ ID NO: 27823 - DNA, 18 bp, synthetic construct
  source 1..18: mol_type = other DNA
tattacgatttactaaag

SEQ ID NO: 27824 - DNA, 18 bp, synthetic construct
  source 1..18: mol_type = other DNA
tattactacactctatag

SEQ ID NO: 27825 - DNA, 18 bp, synthetic construct
  source 1..18: mol_type = other DNA
tattaggactctcaatag

SEQ ID NO: 27826 - DNA, 18 bp, synthetic construct
  source 1..18: mol_type = other DNA
tattatgtctgactatag

SEQ ID NO: 27827 - DNA, 18 bp, synthetic construct
  source 1..18: mol_type = other DNA
tcatccgaatcacaatag

SEQ ID NO: 27828 - DNA, 18 bp, synthetic construct
  source 1..18: mol_type = other DNA
tcttaccactaactatag

SEQ ID NO: 27829 - DNA, 18 bp, synthetic construct
  source 1..18: mol_type = other DNA
tgatatggctcacaatag

SEQ ID NO: 27830 - DNA, 18 bp, synthetic construct
  source 1..18: mol_type = other DNA
ttaaacgactaactctag

SEQ ID NO: 27831 - DNA, 18 bp, synthetic construct
  source 1..18: mol_type = other DNA
ttatacgacaaattatag

SEQ ID NO: 27832 - DNA, 18 bp, synthetic construct
  source 1..18: mol_type = other DNA
ttatacgacacagtatcg

SEQ ID NO: 27833 - DNA, 18 bp, synthetic construct
  source 1..18: mol_type = other DNA
ttatacgcctcacaaaag

SEQ ID NO: 27834 - DNA, 18 bp, synthetic construct
  source 1..18: mol_type = other DNA
ttatacgtatcactgtag

SEQ ID NO: 27835 - DNA, 18 bp, synthetic construct
  source 1..18: mol_type = other DNA
ttatacgtatcattatag

SEQ ID NO: 27836 - DNA, 18 bp, synthetic construct
  source 1..18: mol_type = other DNA
ttatacgtctcaccatcg

SEQ ID NO: 27837 - DNA, 18 bp, synthetic construct
  source 1..18: mol_type = other DNA
ttttaccactcacaatag

SEQ ID NO: 27838 - DNA, 18 bp, synthetic construct
  source 1..18: mol_type = other DNA
ttttacgactctctttag

SEQ ID NO: 27839 - DNA, 18 bp, synthetic construct
  source 1..18: mol_type = other DNA
ttttacgtctccctatag

SEQ ID NO: 27840 - DNA, 18 bp, synthetic construct
  source 1..18: mol_type = other DNA
ttattcaactcactattg

SEQ ID NO: 27841 - DNA, 18 bp, synthetic construct
  source 1..18: mol_type = other DNA
taatacgtcacgctattg

SEQ ID NO: 27842 - DNA, 18 bp, synthetic construct
  source 1..18: mol_type = other DNA
taattcgactctctaatg

SEQ ID NO: 27843 - DNA, 18 bp, synthetic construct
  source 1..18: mol_type = other DNA
aaatacgactcaatactg

SEQ ID NO: 27844 - DNA, 18 bp, synthetic construct
  source 1..18: mol_type = other DNA
taatacgattctttattg

SEQ ID NO: 27845 - DNA, 18 bp, synthetic construct
  source 1..18: mol_type = other DNA
atttacgacacactatag

SEQ ID NO: 27846 - DNA, 18 bp, synthetic construct
  source 1..18: mol_type = other DNA
taatacaatacacaatag

SEQ ID NO: 27847 - DNA, 18 bp, synthetic construct
  source 1..18: mol_type = other DNA
taatacgactcaaataag

SEQ ID NO: 27848 - DNA, 18 bp, synthetic construct
  source 1..18: mol_type = other DNA
taatacttctaactttag

SEQ ID NO: 27849 - DNA, 18 bp, synthetic construct
  source 1..18: mol_type = other DNA
ttcaacgactcactttag

SEQ ID NO: 27850 - DNA, 18 bp, synthetic construct
  source 1..18: mol_type = other DNA
taatactacactccatag

SEQ ID NO: 27851 - DNA, 18 bp, synthetic construct
  source 1..18: mol_type = other DNA
ttttacgactcacaaaag

SEQ ID NO: 27852 - DNA, 18 bp, synthetic construct
  source 1..18: mol_type = other DNA
taaattgacacactatag

SEQ ID NO: 27853 - DNA, 18 bp, synthetic construct
  source 1..18: mol_type = other DNA
taattagtttcactatag

SEQ ID NO: 27854 - DNA, 18 bp, synthetic construct
  source 1..18: mol_type = other DNA
taattcgacatactttag

SEQ ID NO: 27855 - DNA, 18 bp, synthetic construct
  source 1..18: mol_type = other DNA
tataacgactcacaattg

SEQ ID NO: 27856 - DNA, 18 bp, synthetic construct
  source 1..18: mol_type = other DNA
ttatacgactcaattttg

SEQ ID NO: 27857 - DNA, 18 bp, synthetic construct
  source 1..18: mol_type = other DNA
aaaaacgaatcactttag

SEQ ID NO: 27858 - DNA, 18 bp, synthetic construct
  source 1..18: mol_type = other DNA
taaaacatctcactttag

SEQ ID NO: 27859 - DNA, 18 bp, synthetic construct
  source 1..18: mol_type = other DNA
taatgcgactctcaaaag

SEQ ID NO: 27860 - DNA, 18 bp, synthetic construct
  source 1..18: mol_type = other DNA
tattacgtcacactttag

SEQ ID NO: 27861 - DNA, 18 bp, synthetic construct
  source 1..18: mol_type = other DNA
ttatacgacacattttag

SEQ ID NO: 27862 - DNA, 18 bp, synthetic construct
  source 1..18: mol_type = other DNA
aaattcgactcgatatag

SEQ ID NO: 27863 - DNA, 18 bp, synthetic construct
  source 1..18: mol_type = other DNA
agattcgactcactattg

SEQ ID NO: 27864 - DNA, 18 bp, synthetic construct
  source 1..18: mol_type = other DNA
taactcgactcacttttg

SEQ ID NO: 27865 - DNA, 18 bp, synthetic construct
  source 1..18: mol_type = other DNA
taatacgactcggcattg

SEQ ID NO: 27866 - DNA, 18 bp, synthetic construct
  source 1..18: mol_type = other DNA
taatatgactcgatattg

SEQ ID NO: 27867 - DNA, 18 bp, synthetic construct
  source 1..18: mol_type = other DNA
taattagactcaccattg

SEQ ID NO: 27868 - DNA, 18 bp, synthetic construct
  source 1..18: mol_type = other DNA
taattcgacacgatatag

SEQ ID NO: 27869 - DNA, 18 bp, synthetic construct
  source 1..18: mol_type = other DNA
taatttgactcactgttg

SEQ ID NO: 27870 - DNA, 18 bp, synthetic construct
  source 1..18: mol_type = other DNA
aaaaacgagtcgctatag

SEQ ID NO: 27871 - DNA, 18 bp, synthetic construct
  source 1..18: mol_type = other DNA
aaaatcgacttactatag

SEQ ID NO: 27872 - DNA, 18 bp, synthetic construct
  source 1..18: mol_type = other DNA
aaacacgactcactaatg

SEQ ID NO: 27873 - DNA, 18 bp, synthetic construct
  source 1..18: mol_type = other DNA
aaatacgagtcattattg

SEQ ID NO: 27874 - DNA, 18 bp, synthetic construct
  source 1..18: mol_type = other DNA
aaatactactaactattg

SEQ ID NO: 27875 - DNA, 18 bp, synthetic construct
  source 1..18: mol_type = other DNA
aaattcaactcaatatag

SEQ ID NO: 27876 - DNA, 18 bp, synthetic construct
  source 1..18: mol_type = other DNA
aaattcgaattactatag

SEQ ID NO: 27877 - DNA, 18 bp, synthetic construct
  source 1..18: mol_type = other DNA
aaattcgactcacgttag

SEQ ID NO: 27878 - DNA, 18 bp, synthetic construct
  source 1..18: mol_type = other DNA
aaattcggctcactaaag

SEQ ID NO: 27879 - DNA, 18 bp, synthetic construct
  source 1..18: mol_type = other DNA
aaatttaactcactatag

SEQ ID NO: 27880 - DNA, 18 bp, synthetic construct
  source 1..18: mol_type = other DNA
aacttcgactcactttag

SEQ ID NO: 27881 - DNA, 18 bp, synthetic construct
  source 1..18: mol_type = other DNA
aatttccactcactatag

SEQ ID NO: 27882 - DNA, 18 bp, synthetic construct
  source 1..18: mol_type = other DNA
aatttcgactcactctag

SEQ ID NO: 27883 - DNA, 18 bp, synthetic construct
  source 1..18: mol_type = other DNA
agattcgcctcactatag

SEQ ID NO: 27884 - DNA, 18 bp, synthetic construct
  source 1..18: mol_type = other DNA
caaaacgactcaccattg

SEQ ID NO: 27885 - DNA, 18 bp, synthetic construct
  source 1..18: mol_type = other DNA
caataagattcactattg

SEQ ID NO: 27886 - DNA, 18 bp, synthetic construct
  source 1..18: mol_type = other DNA
caatacgactcacttatg

SEQ ID NO: 27887 - DNA, 18 bp, synthetic construct
  source 1..18: mol_type = other DNA
caattcaacttactatag

SEQ ID NO: 27888 - DNA, 18 bp, synthetic construct
  source 1..18: mol_type = other DNA
caattcctctcactatag

SEQ ID NO: 27889 - DNA, 18 bp, synthetic construct
  source 1..18: mol_type = other DNA
caattcgacacactatcg

SEQ ID NO: 27890 - DNA, 18 bp, synthetic construct
  source 1..18: mol_type = other DNA
caattcgactcacaaaag

SEQ ID NO: 27891 - DNA, 18 bp, synthetic construct
  source 1..18: mol_type = other DNA
caattcgacttacaatag

SEQ ID NO: 27892 - DNA, 18 bp, synthetic construct
  source 1..18: mol_type = other DNA
ccatacgtctcactattg

SEQ ID NO: 27893 - DNA, 18 bp, synthetic construct
  source 1..18: mol_type = other DNA
gaatacgactcacaaatg

SEQ ID NO: 27894 - DNA, 18 bp, synthetic construct
  source 1..18: mol_type = other DNA
taaaaagacccactattg

SEQ ID NO: 27895 - DNA, 18 bp, synthetic construct
  source 1..18: mol_type = other DNA
taaaacgactcgaaatag

SEQ ID NO: 27896 - DNA, 18 bp, synthetic construct
  source 1..18: mol_type = other DNA
taaaacgtcttactattg

SEQ ID NO: 27897 - DNA, 18 bp, synthetic construct
  source 1..18: mol_type = other DNA
taaatcaactcaatatag

SEQ ID NO: 27898 - DNA, 18 bp, synthetic construct
  source 1..18: mol_type = other DNA
taaatcgactatctatag

SEQ ID NO: 27899 - DNA, 18 bp, synthetic construct
  source 1..18: mol_type = other DNA
taaatcgattcaccatag

SEQ ID NO: 27900 - DNA, 18 bp, synthetic construct
  source 1..18: mol_type = other DNA
taaatctactcacaatag

SEQ ID NO: 27901 - DNA, 18 bp, synthetic construct
  source 1..18: mol_type = other DNA
taacacaactcactactg

SEQ ID NO: 27902 - DNA, 18 bp, synthetic construct
  source 1..18: mol_type = other DNA
taacaccgctcactattg

SEQ ID NO: 27903 - DNA, 18 bp, synthetic construct
  source 1..18: mol_type = other DNA
taacacgattcattattg

SEQ ID NO: 27904 - DNA, 18 bp, synthetic construct
  source 1..18: mol_type = other DNA
taactcgactcactaacg

SEQ ID NO: 27905 - DNA, 18 bp, synthetic construct
  source 1..18: mol_type = other DNA
taactcgactcacttgag

SEQ ID NO: 27906 - DNA, 18 bp, synthetic construct
  source 1..18: mol_type = other DNA
taagtagactaactatag

SEQ ID NO: 27907 - DNA, 18 bp, synthetic construct
  source 1..18: mol_type = other DNA
taataagcctcactaatg

SEQ ID NO: 27908 - DNA, 18 bp, synthetic construct
  source 1..18: mol_type = other DNA
taataagtctcgctacag

SEQ ID NO: 27909 - DNA, 18 bp, synthetic construct
  source 1..18: mol_type = other DNA
taataatactcacaattg

SEQ ID NO: 27910 - DNA, 18 bp, synthetic construct
  source 1..18: mol_type = other DNA
taatacaactcgcaaaag

SEQ ID NO: 27911 - DNA, 18 bp, synthetic construct
  source 1..18: mol_type = other DNA
taatacaacttgctttag

SEQ ID NO: 27912 - DNA, 18 bp, synthetic construct
  source 1..18: mol_type = other DNA
taatacatctaactattg

SEQ ID NO: 27913 - DNA, 18 bp, synthetic construct
  source 1..18: mol_type = other DNA
taatacatcttgctatag

SEQ ID NO: 27914 - DNA, 18 bp, synthetic construct
  source 1..18: mol_type = other DNA
taatacgacacacgtttg

SEQ ID NO: 27915 - DNA, 18 bp, synthetic construct
  source 1..18: mol_type = other DNA
taatacgacactcaattg

SEQ ID NO: 27916 - DNA, 18 bp, synthetic construct
  source 1..18: mol_type = other DNA
taatacgactccattttg

SEQ ID NO: 27917 - DNA, 18 bp, synthetic construct
  source 1..18: mol_type = other DNA
taatacgagttacaattg

SEQ ID NO: 27918 - DNA, 18 bp, synthetic construct
  source 1..18: mol_type = other DNA
taatacgattaaccattg

SEQ ID NO: 27919 - DNA, 18 bp, synthetic construct
  source 1..18: mol_type = other DNA
taatacgattcagaattg

SEQ ID NO: 27920 - DNA, 18 bp, synthetic construct
  source 1..18: mol_type = other DNA
taatacgattcattactg

SEQ ID NO: 27921 - DNA, 18 bp, synthetic construct
  source 1..18: mol_type = other DNA
taatacgattcattcttg

SEQ ID NO: 27922 - DNA, 18 bp, synthetic construct
  source 1..18: mol_type = other DNA
taatacggctcacaaatg

SEQ ID NO: 27923 - DNA, 18 bp, synthetic construct
  source 1..18: mol_type = other DNA
taatactaatgactattg

SEQ ID NO: 27924 - DNA, 18 bp, synthetic construct
  source 1..18: mol_type = other DNA
taatatgactcgctttcg

SEQ ID NO: 27925 - DNA, 18 bp, synthetic construct
  source 1..18: mol_type = other DNA
taatatgagtcacaattg

SEQ ID NO: 27926 - DNA, 18 bp, synthetic construct
  source 1..18: mol_type = other DNA
taatattacttgctatag

SEQ ID NO: 27927 - DNA, 18 bp, synthetic construct
  source 1..18: mol_type = other DNA
taatccgactcccaattg

SEQ ID NO: 27928 - DNA, 18 bp, synthetic construct
  source 1..18: mol_type = other DNA
taatccgtctcgctttag

SEQ ID NO: 27929 - DNA, 18 bp, synthetic construct
  source 1..18: mol_type = other DNA
taatgcatctcactattg

SEQ ID NO: 27930 - DNA, 18 bp, synthetic construct
  source 1..18: mol_type = other DNA
taatgcgacttacaattg

SEQ ID NO: 27931 - DNA, 18 bp, synthetic construct
  source 1..18: mol_type = other DNA
taattaaactcaatatag

SEQ ID NO: 27932 - DNA, 18 bp, synthetic construct
  source 1..18: mol_type = other DNA
taattcaaaacactatag

SEQ ID NO: 27933 - DNA, 18 bp, synthetic construct
  source 1..18: mol_type = other DNA
taattcaacccacaatag

SEQ ID NO: 27934 - DNA, 18 bp, synthetic construct
  source 1..18: mol_type = other DNA
taattcaactaactttag

SEQ ID NO: 27935 - DNA, 18 bp, synthetic construct
  source 1..18: mol_type = other DNA
taattcaactaattatag

SEQ ID NO: 27936 - DNA, 18 bp, synthetic construct
  source 1..18: mol_type = other DNA
taattcaactcactttcg

SEQ ID NO: 27937 - DNA, 18 bp, synthetic construct
  source 1..18: mol_type = other DNA
taattcctatcactatag

SEQ ID NO: 27938 - DNA, 18 bp, synthetic construct
  source 1..18: mol_type = other DNA
taattcgaaacactatcg

SEQ ID NO: 27939 - DNA, 18 bp, synthetic construct
  source 1..18: mol_type = other DNA
taattcgacacactttgg

SEQ ID NO: 27940 - DNA, 18 bp, synthetic construct
  source 1..18: mol_type = other DNA
taattcgacatagtatag

SEQ ID NO: 27941 - DNA, 18 bp, synthetic construct
  source 1..18: mol_type = other DNA
taattcgactaataatag

SEQ ID NO: 27942 - DNA, 18 bp, synthetic construct
  source 1..18: mol_type = other DNA
taattcgactcacgtaag

SEQ ID NO: 27943 - DNA, 18 bp, synthetic construct
  source 1..18: mol_type = other DNA
taattcgacttagtatcg

SEQ ID NO: 27944 - DNA, 18 bp, synthetic construct
  source 1..18: mol_type = other DNA
taattcgattcactaacg

SEQ ID NO: 27945 - DNA, 18 bp, synthetic construct
  source 1..18: mol_type = other DNA
taattcgattgtctatag

SEQ ID NO: 27946 - DNA, 18 bp, synthetic construct
  source 1..18: mol_type = other DNA
taattctaccccctatag

SEQ ID NO: 27947 - DNA, 18 bp, synthetic construct
  source 1..18: mol_type = other DNA
taattctactcattgtag

SEQ ID NO: 27948 - DNA, 18 bp, synthetic construct
  source 1..18: mol_type = other DNA
taattgaactcactaaag

SEQ ID NO: 27949 - DNA, 18 bp, synthetic construct
  source 1..18: mol_type = other DNA
taatttgtctcattatag

SEQ ID NO: 27950 - DNA, 18 bp, synthetic construct
  source 1..18: mol_type = other DNA
taattttactcaatatag

SEQ ID NO: 27951 - DNA, 18 bp, synthetic construct
  source 1..18: mol_type = other DNA
tacaccgactcactattg

SEQ ID NO: 27952 - DNA, 18 bp, synthetic construct
  source 1..18: mol_type = other DNA
tactaccactcacttttg

SEQ ID NO: 27953 - DNA, 18 bp, synthetic construct
  source 1..18: mol_type = other DNA
tacttcgaatccctatag

SEQ ID NO: 27954 - DNA, 18 bp, synthetic construct
  source 1..18: mol_type = other DNA
tagttcgacatactatag

SEQ ID NO: 27955 - DNA, 18 bp, synthetic construct
  source 1..18: mol_type = other DNA
tagttcgacttagtatag

SEQ ID NO: 27956 - DNA, 18 bp, synthetic construct
  source 1..18: mol_type = other DNA
tatttagactcattatag

SEQ ID NO: 27957 - DNA, 18 bp, synthetic construct
  source 1..18: mol_type = other DNA
tatttcgacagactatag

SEQ ID NO: 27958 - DNA, 18 bp, synthetic construct
  source 1..18: mol_type = other DNA
tatttcgaccccctatag

SEQ ID NO: 27959 - DNA, 18 bp, synthetic construct
  source 1..18: mol_type = other DNA
tatttcgactttctatag

SEQ ID NO: 27960 - DNA, 18 bp, synthetic construct
  source 1..18: mol_type = other DNA
tatttcgagtctctatag

SEQ ID NO: 27961 - DNA, 18 bp, synthetic construct
  source 1..18: mol_type = other DNA
tatttcgcttcactatag

SEQ ID NO: 27962 - DNA, 18 bp, synthetic construct
  source 1..18: mol_type = other DNA
tatttcggctcattatag

SEQ ID NO: 27963 - DNA, 18 bp, synthetic construct
  source 1..18: mol_type = other DNA
tatttctgctcactatag

SEQ ID NO: 27964 - DNA, 18 bp, synthetic construct
  source 1..18: mol_type = other DNA
tcactcgactcactaaag

SEQ ID NO: 27965 - DNA, 18 bp, synthetic construct
  source 1..18: mol_type = other DNA
tcataagaatcactattg

SEQ ID NO: 27966 - DNA, 18 bp, synthetic construct
  source 1..18: mol_type = other DNA
tcatacgacacaatattg

SEQ ID NO: 27967 - DNA, 18 bp, synthetic construct
  source 1..18: mol_type = other DNA
tcatacgacacactaatg

SEQ ID NO: 27968 - DNA, 18 bp, synthetic construct
  source 1..18: mol_type = other DNA
tcatacgactcatcattg

SEQ ID NO: 27969 - DNA, 18 bp, synthetic construct
  source 1..18: mol_type = other DNA
tcattagacccactatag

SEQ ID NO: 27970 - DNA, 18 bp, synthetic construct
  source 1..18: mol_type = other DNA
tcattcgattcactatgg

SEQ ID NO: 27971 - DNA, 18 bp, synthetic construct
  source 1..18: mol_type = other DNA
tgaaacgactaactattg

SEQ ID NO: 27972 - DNA, 18 bp, synthetic construct
  source 1..18: mol_type = other DNA
tgactcgactcactttag

SEQ ID NO: 27973 - DNA, 18 bp, synthetic construct
  source 1..18: mol_type = other DNA
tgatactacacactattg

SEQ ID NO: 27974 - DNA, 18 bp, synthetic construct
  source 1..18: mol_type = other DNA
tgatactactcattattg

SEQ ID NO: 27975 - DNA, 18 bp, synthetic construct
  source 1..18: mol_type = other DNA
tgattcgactctatatag

SEQ ID NO: 27976 - DNA, 18 bp, synthetic construct
  source 1..18: mol_type = other DNA
tgattcgactctctgtag

SEQ ID NO: 27977 - DNA, 18 bp, synthetic construct
  source 1..18: mol_type = other DNA
tgattcgcctctctatag

SEQ ID NO: 27978 - DNA, 18 bp, synthetic construct
  source 1..18: mol_type = other DNA
ttaaacgactcactactg

SEQ ID NO: 27979 - DNA, 18 bp, synthetic construct
  source 1..18: mol_type = other DNA
ttaatcgactcactatgg

SEQ ID NO: 27980 - DNA, 18 bp, synthetic construct
  source 1..18: mol_type = other DNA
ttactcgtctcactatag

SEQ ID NO: 27981 - DNA, 18 bp, synthetic construct
  source 1..18: mol_type = other DNA
ttataccactcaatattg

SEQ ID NO: 27982 - DNA, 18 bp, synthetic construct
  source 1..18: mol_type = other DNA
ttatacgacttcctattg

SEQ ID NO: 27983 - DNA, 18 bp, synthetic construct
  source 1..18: mol_type = other DNA
ttatatgactcaccattg

SEQ ID NO: 27984 - DNA, 18 bp, synthetic construct
  source 1..18: mol_type = other DNA
ttattcaactcattatag

SEQ ID NO: 27985 - DNA, 18 bp, synthetic construct
  source 1..18: mol_type = other DNA
ttattcgattcaccatag

SEQ ID NO: 27986 - DNA, 18 bp, synthetic construct
  source 1..18: mol_type = other DNA
ttgtacgagtcactattg

SEQ ID NO: 27987 - DNA, 18 bp, synthetic construct
  source 1..18: mol_type = other DNA
ttttacaactcactattg

SEQ ID NO: 27988 - DNA, 18 bp, synthetic construct
  source 1..18: mol_type = other DNA
ttttacgactccctattg

SEQ ID NO: 27989 - DNA, 18 bp, synthetic construct
  source 1..18: mol_type = other DNA
tttttcgaatcactatag

SEQ ID NO: 27990 - DNA, 18 bp, synthetic construct
  source 1..18: mol_type = other DNA
aaaaacgaatcacaatag

SEQ ID NO: 27991 - DNA, 18 bp, synthetic construct
  source 1..18: mol_type = other DNA
aaaaacgccacactatag

SEQ ID NO: 27992 - DNA, 18 bp, synthetic construct
  source 1..18: mol_type = other DNA
aaaaacgcctcaccatag

SEQ ID NO: 27993 - DNA, 18 bp, synthetic construct
  source 1..18: mol_type = other DNA
aaacaagactctctatag

SEQ ID NO: 27994 - DNA, 18 bp, synthetic construct
  source 1..18: mol_type = other DNA
aaataaaaatcactatag

SEQ ID NO: 27995 - DNA, 18 bp, synthetic construct
  source 1..18: mol_type = other DNA
aaataagactcattttag

SEQ ID NO: 27996 - DNA, 18 bp, synthetic construct
  source 1..18: mol_type = other DNA
aaatacaacccactaaag

SEQ ID NO: 27997 - DNA, 18 bp, synthetic construct
  source 1..18: mol_type = other DNA
aaatacaagtcactatcg

SEQ ID NO: 27998 - DNA, 18 bp, synthetic construct
  source 1..18: mol_type = other DNA
aaatacccctcactatcg

SEQ ID NO: 27999 - DNA, 18 bp, synthetic construct
  source 1..18: mol_type = other DNA
aaatacctctcactacag

SEQ ID NO: 28000 - DNA, 18 bp, synthetic construct
  source 1..18: mol_type = other DNA
aaatacctctcattatag

SEQ ID NO: 28001 - DNA, 18 bp, synthetic construct
  source 1..18: mol_type = other DNA
aaatacgaattactttag

SEQ ID NO: 28002 - DNA, 18 bp, synthetic construct
  source 1..18: mol_type = other DNA
aaatacgactatctatgg

SEQ ID NO: 28003 - DNA, 18 bp, synthetic construct
  source 1..18: mol_type = other DNA
aaatatgactaacaatag

SEQ ID NO: 28004 - DNA, 18 bp, synthetic construct
  source 1..18: mol_type = other DNA
aaatatgactccctataa

SEQ ID NO: 28005 - DNA, 18 bp, synthetic construct
  source 1..18: mol_type = other DNA
aaatatgattcaccatag

SEQ ID NO: 28006 - DNA, 18 bp, synthetic construct
  source 1..18: mol_type = other DNA
aaatatgattctctatag

SEQ ID NO: 28007 - DNA, 18 bp, synthetic construct
  source 1..18: mol_type = other DNA
aaatccgactctgtatag

SEQ ID NO: 28008 - DNA, 18 bp, synthetic construct
  source 1..18: mol_type = other DNA
aaatcctactaactatag

SEQ ID NO: 28009 - DNA, 18 bp, synthetic construct
  source 1..18: mol_type = other DNA
aaatgagactcactatcg

SEQ ID NO: 28010 - DNA, 18 bp, synthetic construct
  source 1..18: mol_type = other DNA
aacaacgactcactgtag

SEQ ID NO: 28011 - DNA, 18 bp, synthetic construct
  source 1..18: mol_type = other DNA
aagaacgacacactatag

SEQ ID NO: 28012 - DNA, 18 bp, synthetic construct
  source 1..18: mol_type = other DNA
aagcacgactcacaatag

SEQ ID NO: 28013 - DNA, 18 bp, synthetic construct
  source 1..18: mol_type = other DNA
aattacgacaccctatag

SEQ ID NO: 28014 - DNA, 18 bp, synthetic construct
  source 1..18: mol_type = other DNA
aattacgactcagtctag

SEQ ID NO: 28015 - DNA, 18 bp, synthetic construct
  source 1..18: mol_type = other DNA
aattacgattgactatag

SEQ ID NO: 28016 - DNA, 18 bp, synthetic construct
  source 1..18: mol_type = other DNA
aattactactcacaatag

SEQ ID NO: 28017 - DNA, 18 bp, synthetic construct
  source 1..18: mol_type = other DNA
aattataactcactatag

SEQ ID NO: 28018 - DNA, 18 bp, synthetic construct
  source 1..18: mol_type = other DNA
acatacgattcactaaag

SEQ ID NO: 28019 - DNA, 18 bp, synthetic construct
  source 1..18: mol_type = other DNA
acatacgattctctatag

SEQ ID NO: 28020 - DNA, 18 bp, synthetic construct
  source 1..18: mol_type = other DNA
acatacgtcccactatag

SEQ ID NO: 28021 - DNA, 18 bp, synthetic construct
  source 1..18: mol_type = other DNA
agatacgattcactaaag

SEQ ID NO: 28022 - DNA, 18 bp, synthetic construct
  source 1..18: mol_type = other DNA
aggtacgcctcactatag

SEQ ID NO: 28023 - DNA, 18 bp, synthetic construct
  source 1..18: mol_type = other DNA
atatacgaatcactgtag

SEQ ID NO: 28024 - DNA, 18 bp, synthetic construct
  source 1..18: mol_type = other DNA
atatacggctcacaatag

SEQ ID NO: 28025 - DNA, 18 bp, synthetic construct
  source 1..18: mol_type = other DNA
atatacgtgtcactatag

SEQ ID NO: 28026 - DNA, 18 bp, synthetic construct
  source 1..18: mol_type = other DNA
atatccgacccactatag

SEQ ID NO: 28027 - DNA, 18 bp, synthetic construct
  source 1..18: mol_type = other DNA
atatgcgactcacaatag

SEQ ID NO: 28028 - DNA, 18 bp, synthetic construct
  source 1..18: mol_type = other DNA
atctacgcctcactatag

SEQ ID NO: 28029 - DNA, 18 bp, synthetic construct
  source 1..18: mol_type = other DNA
caaaaagacttactatag

SEQ ID NO: 28030 - DNA, 18 bp, synthetic construct
  source 1..18: mol_type = other DNA
caatacaaatcactatcg

SEQ ID NO: 28031 - DNA, 18 bp, synthetic construct
  source 1..18: mol_type = other DNA
caatacaactcacaaaag

SEQ ID NO: 28032 - DNA, 18 bp, synthetic construct
  source 1..18: mol_type = other DNA
caatacaatacactatag

SEQ ID NO: 28033 - DNA, 18 bp, synthetic construct
  source 1..18: mol_type = other DNA
caataccactctcaatag

SEQ ID NO: 28034 - DNA, 18 bp, synthetic construct
  source 1..18: mol_type = other DNA
caatacgatacattatag

SEQ ID NO: 28035 - DNA, 18 bp, synthetic construct
  source 1..18: mol_type = other DNA
caatactaatcactatcg

SEQ ID NO: 28036 - DNA, 18 bp, synthetic construct
  source 1..18: mol_type = other DNA
caatatgactctctttag

SEQ ID NO: 28037 - DNA, 18 bp, synthetic construct
  source 1..18: mol_type = other DNA
caatccgactcacaaaag

SEQ ID NO: 28038 - DNA, 18 bp, synthetic construct
  source 1..18: mol_type = other DNA
caatccgactctctttag

SEQ ID NO: 28039 - DNA, 18 bp, synthetic construct
  source 1..18: mol_type = other DNA
cattaagactcacaatag

SEQ ID NO: 28040 - DNA, 18 bp, synthetic construct
  source 1..18: mol_type = other DNA
cattacaacacactatag

SEQ ID NO: 28041 - DNA, 18 bp, synthetic construct
  source 1..18: mol_type = other DNA
cattacaactcactgtag

SEQ ID NO: 28042 - DNA, 18 bp, synthetic construct
  source 1..18: mol_type = other DNA
ccatacgactcataatag

SEQ ID NO: 28043 - DNA, 18 bp, synthetic construct
  source 1..18: mol_type = other DNA
ctatacgactcactcaag

SEQ ID NO: 28044 - DNA, 18 bp, synthetic construct
  source 1..18: mol_type = other DNA
ctatacgtctcactatcg

SEQ ID NO: 28045 - DNA, 18 bp, synthetic construct
  source 1..18: mol_type = other DNA
gaatatgactcaatctag

SEQ ID NO: 28046 - DNA, 18 bp, synthetic construct
  source 1..18: mol_type = other DNA
taaaaagactaactaaag

SEQ ID NO: 28047 - DNA, 18 bp, synthetic construct
  source 1..18: mol_type = other DNA
taaaacctctcacaatag

SEQ ID NO: 28048 - DNA, 18 bp, synthetic construct
  source 1..18: mol_type = other DNA
taaaacgaagcactttag

SEQ ID NO: 28049 - DNA, 18 bp, synthetic construct
  source 1..18: mol_type = other DNA
taaaacgactcagttgag

SEQ ID NO: 28050 - DNA, 18 bp, synthetic construct
  source 1..18: mol_type = other DNA
taaaacgactcattaacg

SEQ ID NO: 28051 - DNA, 18 bp, synthetic construct
  source 1..18: mol_type = other DNA
taaaacgatacactctag

SEQ ID NO: 28052 - DNA, 18 bp, synthetic construct
  source 1..18: mol_type = other DNA
taaaacgatccaatatag

SEQ ID NO: 28053 - DNA, 18 bp, synthetic construct
  source 1..18: mol_type = other DNA
taaaacgattcactctcg

SEQ ID NO: 28054 - DNA, 18 bp, synthetic construct
  source 1..18: mol_type = other DNA
taaaacgccacactaaag

SEQ ID NO: 28055 - DNA, 18 bp, synthetic construct
  source 1..18: mol_type = other DNA
taaaacggatctctatag

SEQ ID NO: 28056 - DNA, 18 bp, synthetic construct
  source 1..18: mol_type = other DNA
taaaacgtctcactcgag

SEQ ID NO: 28057 - DNA, 18 bp, synthetic construct
  source 1..18: mol_type = other DNA
taaaacgtctccctttag

SEQ ID NO: 28058 - DNA, 18 bp, synthetic construct
  source 1..18: mol_type = other DNA
taaaacgtctgattatag

SEQ ID NO: 28059 - DNA, 18 bp, synthetic construct
  source 1..18: mol_type = other DNA
taaaactacatactatag

SEQ ID NO: 28060 - DNA, 18 bp, synthetic construct
  source 1..18: mol_type = other DNA
taaaactactcaccaaag

SEQ ID NO: 28061 - DNA, 18 bp, synthetic construct
  source 1..18: mol_type = other DNA
taaaagaactaactatag

SEQ ID NO: 28062 - DNA, 18 bp, synthetic construct
  source 1..18: mol_type = other DNA
taaaaggagtctctatag

SEQ ID NO: 28063 - DNA, 18 bp, synthetic construct
  source 1..18: mol_type = other DNA
taaaagggctcaatatag

SEQ ID NO: 28064 - DNA, 18 bp, synthetic construct
  source 1..18: mol_type = other DNA
taaaatgaatcattatag

SEQ ID NO: 28065 - DNA, 18 bp, synthetic construct
  source 1..18: mol_type = other DNA
taaaatgacacacaatag

SEQ ID NO: 28066 - DNA, 18 bp, synthetic construct
  source 1..18: mol_type = other DNA
taaaatgactcaataaag

SEQ ID NO: 28067 - DNA, 18 bp, synthetic construct
  source 1..18: mol_type = other DNA
taaacagactcactttag

SEQ ID NO: 28068 - DNA, 18 bp, synthetic construct
  source 1..18: mol_type = other DNA
taaaccgactctgtatag

SEQ ID NO: 28069 - DNA, 18 bp, synthetic construct
  source 1..18: mol_type = other DNA
taaagcgtcttactatag

SEQ ID NO: 28070 - DNA, 18 bp, synthetic construct
  source 1..18: mol_type = other DNA
taacaagactcacattag

SEQ ID NO: 28071 - DNA, 18 bp, synthetic construct
  source 1..18: mol_type = other DNA
taacaagtctcactctag

SEQ ID NO: 28072 - DNA, 18 bp, synthetic construct
  source 1..18: mol_type = other DNA
taacaccactcactctcg

SEQ ID NO: 28073 - DNA, 18 bp, synthetic construct
  source 1..18: mol_type = other DNA
taacacgacccacaaaag

SEQ ID NO: 28074 - DNA, 18 bp, synthetic construct
  source 1..18: mol_type = other DNA
taacacgaccctatatag

SEQ ID NO: 28075 - DNA, 18 bp, synthetic construct
  source 1..18: mol_type = other DNA
taacacgactcatttcag

SEQ ID NO: 28076 - DNA, 18 bp, synthetic construct
  source 1..18: mol_type = other DNA
taacacgattgattatag

SEQ ID NO: 28077 - DNA, 18 bp, synthetic construct
  source 1..18: mol_type = other DNA
taacacgtatccctatag

SEQ ID NO: 28078 - DNA, 18 bp, synthetic construct
  source 1..18: mol_type = other DNA
taacacgtctctttatag

SEQ ID NO: 28079 - DNA, 18 bp, synthetic construct
  source 1..18: mol_type = other DNA
taacacttctcactctag

SEQ ID NO: 28080 - DNA, 18 bp, synthetic construct
  source 1..18: mol_type = other DNA
taagaagacttaatatag

SEQ ID NO: 28081 - DNA, 18 bp, synthetic construct
  source 1..18: mol_type = other DNA
taagacaaatcaccatag

SEQ ID NO: 28082 - DNA, 18 bp, synthetic construct
  source 1..18: mol_type = other DNA
taagacgactttctctag

SEQ ID NO: 28083 - DNA, 18 bp, synthetic construct
  source 1..18: mol_type = other DNA
taagactactaactttag

SEQ ID NO: 28084 - DNA, 18 bp, synthetic construct
  source 1..18: mol_type = other DNA
taataacactcattaaag

SEQ ID NO: 28085 - DNA, 18 bp, synthetic construct
  source 1..18: mol_type = other DNA
taataacattcaatatag

SEQ ID NO: 28086 - DNA, 18 bp, synthetic construct
  source 1..18: mol_type = other DNA
taataagaatcacaacag

SEQ ID NO: 28087 - DNA, 18 bp, synthetic construct
  source 1..18: mol_type = other DNA
taataagactaactaagg

SEQ ID NO: 28088 - DNA, 18 bp, synthetic construct
  source 1..18: mol_type = other DNA
taataagagacactaaag

SEQ ID NO: 28089 - DNA, 18 bp, synthetic construct
  source 1..18: mol_type = other DNA
taataagattcactcaag

SEQ ID NO: 28090 - DNA, 18 bp, synthetic construct
  source 1..18: mol_type = other DNA
taataagtcagactatag

SEQ ID NO: 28091 - DNA, 18 bp, synthetic construct
  source 1..18: mol_type = other DNA
taataagtctcaatttag

SEQ ID NO: 28092 - DNA, 18 bp, synthetic construct
  source 1..18: mol_type = other DNA
taataatactctctaaag

SEQ ID NO: 28093 - DNA, 18 bp, synthetic construct
  source 1..18: mol_type = other DNA
taatacaaatcagaatag

SEQ ID NO: 28094 - DNA, 18 bp, synthetic construct
  source 1..18: mol_type = other DNA
taatacaacgtactttag

SEQ ID NO: 28095 - DNA, 18 bp, synthetic construct
  source 1..18: mol_type = other DNA
taatacaactcatttcag

SEQ ID NO: 28096 - DNA, 18 bp, synthetic construct
  source 1..18: mol_type = other DNA
taatacaactgtctagag

SEQ ID NO: 28097 - DNA, 18 bp, synthetic construct
  source 1..18: mol_type = other DNA
taatacaagacactgtag

SEQ ID NO: 28098 - DNA, 18 bp, synthetic construct
  source 1..18: mol_type = other DNA
taatacaagtcacaaaag

SEQ ID NO: 28099 - DNA, 18 bp, synthetic construct
  source 1..18: mol_type = other DNA
taatacatctccctttag

SEQ ID NO: 28100 - DNA, 18 bp, synthetic construct
  source 1..18: mol_type = other DNA
taataccaatcactttgg

SEQ ID NO: 28101 - DNA, 18 bp, synthetic construct
  source 1..18: mol_type = other DNA
taataccacactatatag

SEQ ID NO: 28102 - DNA, 18 bp, synthetic construct
  source 1..18: mol_type = other DNA
taataccactaaataaag

SEQ ID NO: 28103 - DNA, 18 bp, synthetic construct
  source 1..18: mol_type = other DNA
taataccactcaatctcg

SEQ ID NO: 28104 - DNA, 18 bp, synthetic construct
  source 1..18: mol_type = other DNA
taataccactcataatcg

SEQ ID NO: 28105 - DNA, 18 bp, synthetic construct
  source 1..18: mol_type = other DNA
taataccatgcaatatag

SEQ ID NO: 28106 - DNA, 18 bp, synthetic construct
  source 1..18: mol_type = other DNA
taatacgaatttccatag

SEQ ID NO: 28107 - DNA, 18 bp, synthetic construct
  source 1..18: mol_type = other DNA
taatacgacagactttcg

SEQ ID NO: 28108 - DNA, 18 bp, synthetic construct
  source 1..18: mol_type = other DNA
taatacgacccccttaag

SEQ ID NO: 28109 - DNA, 18 bp, synthetic construct
  source 1..18: mol_type = other DNA
taatacgactaacgtaag

SEQ ID NO: 28110 - DNA, 18 bp, synthetic construct
  source 1..18: mol_type = other DNA
taatacgactacatctag

SEQ ID NO: 28111 - DNA, 18 bp, synthetic construct
  source 1..18: mol_type = other DNA
taatacgactttccatcg

SEQ ID NO: 28112 - DNA, 18 bp, synthetic construct
  source 1..18: mol_type = other DNA
taatacgagacacaatgg

SEQ ID NO: 28113 - DNA, 18 bp, synthetic construct
  source 1..18: mol_type = other DNA
taatacgagtcattctgg

SEQ ID NO: 28114 - DNA, 18 bp, synthetic construct
  source 1..18: mol_type = other DNA
taatacgatacaatatgg

SEQ ID NO: 28115 - DNA, 18 bp, synthetic construct
  source 1..18: mol_type = other DNA
taatacgattaccaatag

SEQ ID NO: 28116 - DNA, 18 bp, synthetic construct
  source 1..18: mol_type = other DNA
taatacgattcagtttgg

SEQ ID NO: 28117 - DNA, 18 bp, synthetic construct
  source 1..18: mol_type = other DNA
taatacgattcatcaaag

SEQ ID NO: 28118 - DNA, 18 bp, synthetic construct
  source 1..18: mol_type = other DNA
taatacgattctttttag

SEQ ID NO: 28119 - DNA, 18 bp, synthetic construct
  source 1..18: mol_type = other DNA
taatacgatttacaatcg

SEQ ID NO: 28120 - DNA, 18 bp, synthetic construct
  source 1..18: mol_type = other DNA
taatacgcatctttatag

SEQ ID NO: 28121 - DNA, 18 bp, synthetic construct
  source 1..18: mol_type = other DNA
taatacgccttacattag

SEQ ID NO: 28122 - DNA, 18 bp, synthetic construct
  source 1..18: mol_type = other DNA
taatacgctacactttag

SEQ ID NO: 28123 - DNA, 18 bp, synthetic construct
  source 1..18: mol_type = other DNA
taatacgcttcacttaag

SEQ ID NO: 28124 - DNA, 18 bp, synthetic construct
  source 1..18: mol_type = other DNA
taatacggctaacttcag

SEQ ID NO: 28125 - DNA, 18 bp, synthetic construct
  source 1..18: mol_type = other DNA
taatacggctctccaaag

SEQ ID NO: 28126 - DNA, 18 bp, synthetic construct
  source 1..18: mol_type = other DNA
taatacggctgattttag

SEQ ID NO: 28127 - DNA, 18 bp, synthetic construct
  source 1..18: mol_type = other DNA
taatacgtatcacttgag

SEQ ID NO: 28128 - DNA, 18 bp, synthetic construct
  source 1..18: mol_type = other DNA
taatacgtattagtatag

SEQ ID NO: 28129 - DNA, 18 bp, synthetic construct
  source 1..18: mol_type = other DNA
taatacgtcactctgtag

SEQ ID NO: 28130 - DNA, 18 bp, synthetic construct
  source 1..18: mol_type = other DNA
taatacgtcatactatcg

SEQ ID NO: 28131 - DNA, 18 bp, synthetic construct
  source 1..18: mol_type = other DNA
taatacgtctcacgtgag

SEQ ID NO: 28132 - DNA, 18 bp, synthetic construct
  source 1..18: mol_type = other DNA
taatacgtctcactgacg

SEQ ID NO: 28133 - DNA, 18 bp, synthetic construct
  source 1..18: mol_type = other DNA
taatacgtctccctgtcg

SEQ ID NO: 28134 - DNA, 18 bp, synthetic construct
  source 1..18: mol_type = other DNA
taatacgtctctcagtag

SEQ ID NO: 28135 - DNA, 18 bp, synthetic construct
  source 1..18: mol_type = other DNA
taatacgtcttattatgg

SEQ ID NO: 28136 - DNA, 18 bp, synthetic construct
  source 1..18: mol_type = other DNA
taatacgtttgagtatag

SEQ ID NO: 28137 - DNA, 18 bp, synthetic construct
  source 1..18: mol_type = other DNA
taatactaatgacaatag

SEQ ID NO: 28138 - DNA, 18 bp, synthetic construct
  source 1..18: mol_type = other DNA
taatactacacactcaag

SEQ ID NO: 28139 - DNA, 18 bp, synthetic construct
  source 1..18: mol_type = other DNA
taatactacacccaatag

SEQ ID NO: 28140 - DNA, 18 bp, synthetic construct
  source 1..18: mol_type = other DNA
taatactattcagtttag

SEQ ID NO: 28141 - DNA, 18 bp, synthetic construct
  source 1..18: mol_type = other DNA
taatacttctaactctag

SEQ ID NO: 28142 - DNA, 18 bp, synthetic construct
  source 1..18: mol_type = other DNA
taataggaatcaaaatag

SEQ ID NO: 28143 - DNA, 18 bp, synthetic construct
  source 1..18: mol_type = other DNA
taataggacacacattag

SEQ ID NO: 28144 - DNA, 18 bp, synthetic construct
  source 1..18: mol_type = other DNA
taataggagccattatag

SEQ ID NO: 28145 - DNA, 18 bp, synthetic construct
  source 1..18: mol_type = other DNA
taataggtctcaataaag

SEQ ID NO: 28146 - DNA, 18 bp, synthetic construct
  source 1..18: mol_type = other DNA
taatataactcattaaag

SEQ ID NO: 28147 - DNA, 18 bp, synthetic construct
  source 1..18: mol_type = other DNA
taatatgaattattatag

SEQ ID NO: 28148 - DNA, 18 bp, synthetic construct
  source 1..18: mol_type = other DNA
taatatgacacattaaag

SEQ ID NO: 28149 - DNA, 18 bp, synthetic construct
  source 1..18: mol_type = other DNA
taatatgactcaccaagg

SEQ ID NO: 28150 - DNA, 18 bp, synthetic construct
  source 1..18: mol_type = other DNA
taatatgactgtcaatag

SEQ ID NO: 28151 - DNA, 18 bp, synthetic construct
  source 1..18: mol_type = other DNA
taatatgattcaatagag

SEQ ID NO: 28152 - DNA, 18 bp, synthetic construct
  source 1..18: mol_type = other DNA
taatatgtctacctatag

SEQ ID NO: 28153 - DNA, 18 bp, synthetic construct
  source 1..18: mol_type = other DNA
taatatgtctcactaacg

SEQ ID NO: 28154 - DNA, 18 bp, synthetic construct
  source 1..18: mol_type = other DNA
taatatgtctccctatcg

SEQ ID NO: 28155 - DNA, 18 bp, synthetic construct
  source 1..18: mol_type = other DNA
taatattaatcactctag

SEQ ID NO: 28156 - DNA, 18 bp, synthetic construct
  source 1..18: mol_type = other DNA
taatattacacactaaag

SEQ ID NO: 28157 - DNA, 18 bp, synthetic construct
  source 1..18: mol_type = other DNA
taatatttttcactatag

SEQ ID NO: 28158 - DNA, 18 bp, synthetic construct
  source 1..18: mol_type = other DNA
taatccgactccctgtcg

SEQ ID NO: 28159 - DNA, 18 bp, synthetic construct
  source 1..18: mol_type = other DNA
taatccgactctataaag

SEQ ID NO: 28160 - DNA, 18 bp, synthetic construct
  source 1..18: mol_type = other DNA
taatccgactttcaatag

SEQ ID NO: 28161 - DNA, 18 bp, synthetic construct
  source 1..18: mol_type = other DNA
taatccgagtctctaaag

SEQ ID NO: 28162 - DNA, 18 bp, synthetic construct
  source 1..18: mol_type = other DNA
taatccgattcattaaag

SEQ ID NO: 28163 - DNA, 18 bp, synthetic construct
  source 1..18: mol_type = other DNA
taatccgtcaaactatag

SEQ ID NO: 28164 - DNA, 18 bp, synthetic construct
  source 1..18: mol_type = other DNA
taatccgtctcactcaag

SEQ ID NO: 28165 - DNA, 18 bp, synthetic construct
  source 1..18: mol_type = other DNA
taatccgtgtctctatag

SEQ ID NO: 28166 - DNA, 18 bp, synthetic construct
  source 1..18: mol_type = other DNA
taatcctacaaactatag

SEQ ID NO: 28167 - DNA, 18 bp, synthetic construct
  source 1..18: mol_type = other DNA
taatcctactctctttag

SEQ ID NO: 28168 - DNA, 18 bp, synthetic construct
  source 1..18: mol_type = other DNA
taatctggctctctatag

SEQ ID NO: 28169 - DNA, 18 bp, synthetic construct
  source 1..18: mol_type = other DNA
taatgagactcactttcg

SEQ ID NO: 28170 - DNA, 18 bp, synthetic construct
  source 1..18: mol_type = other DNA
taatgcgaattcctatag

SEQ ID NO: 28171 - DNA, 18 bp, synthetic construct
  source 1..18: mol_type = other DNA
taatgcgacacacagtag

SEQ ID NO: 28172 - DNA, 18 bp, synthetic construct
  source 1..18: mol_type = other DNA
taatgcgacaccctttag

SEQ ID NO: 28173 - DNA, 18 bp, synthetic construct
  source 1..18: mol_type = other DNA
taatgcgactcacactcg

SEQ ID NO: 28174 - DNA, 18 bp, synthetic construct
  source 1..18: mol_type = other DNA
taatgctacacactttag

SEQ ID NO: 28175 - DNA, 18 bp, synthetic construct
  source 1..18: mol_type = other DNA
tacaacgatccactatag

SEQ ID NO: 28176 - DNA, 18 bp, synthetic construct
  source 1..18: mol_type = other DNA
tacaacggctctctatag

SEQ ID NO: 28177 - DNA, 18 bp, synthetic construct
  source 1..18: mol_type = other DNA
tacaacgtttcactatag

SEQ ID NO: 28178 - DNA, 18 bp, synthetic construct
  source 1..18: mol_type = other DNA
tacaaggactcacaatag

SEQ ID NO: 28179 - DNA, 18 bp, synthetic construct
  source 1..18: mol_type = other DNA
tacaatgactgactatag

SEQ ID NO: 28180 - DNA, 18 bp, synthetic construct
  source 1..18: mol_type = other DNA
taccacgactaactaaag

SEQ ID NO: 28181 - DNA, 18 bp, synthetic construct
  source 1..18: mol_type = other DNA
taccacgactcattttag

SEQ ID NO: 28182 - DNA, 18 bp, synthetic construct
  source 1..18: mol_type = other DNA
tactacgaatcacattag

SEQ ID NO: 28183 - DNA, 18 bp, synthetic construct
  source 1..18: mol_type = other DNA
tactacgacacccaatag

SEQ ID NO: 28184 - DNA, 18 bp, synthetic construct
  source 1..18: mol_type = other DNA
tactacgactctttagag

SEQ ID NO: 28185 - DNA, 18 bp, synthetic construct
  source 1..18: mol_type = other DNA
tactacgatccactttag

SEQ ID NO: 28186 - DNA, 18 bp, synthetic construct
  source 1..18: mol_type = other DNA
tactacgtaacactatag

SEQ ID NO: 28187 - DNA, 18 bp, synthetic construct
  source 1..18: mol_type = other DNA
tactacgtctctctctag

SEQ ID NO: 28188 - DNA, 18 bp, synthetic construct
  source 1..18: mol_type = other DNA
tactactaatcacaatag

SEQ ID NO: 28189 - DNA, 18 bp, synthetic construct
  source 1..18: mol_type = other DNA
tactactattcagtatag

SEQ ID NO: 28190 - DNA, 18 bp, synthetic construct
  source 1..18: mol_type = other DNA
tactataactcaatatag

SEQ ID NO: 28191 - DNA, 18 bp, synthetic construct
  source 1..18: mol_type = other DNA
tactgcgacttactttag

SEQ ID NO: 28192 - DNA, 18 bp, synthetic construct
  source 1..18: mol_type = other DNA
tagaaagactcacgatag

SEQ ID NO: 28193 - DNA, 18 bp, synthetic construct
  source 1..18: mol_type = other DNA
tagaacgactatctatag

SEQ ID NO: 28194 - DNA, 18 bp, synthetic construct
  source 1..18: mol_type = other DNA
tagaacgactcaatatcg

SEQ ID NO: 28195 - DNA, 18 bp, synthetic construct
  source 1..18: mol_type = other DNA
tagtaagtcttactatag

SEQ ID NO: 28196 - DNA, 18 bp, synthetic construct
  source 1..18: mol_type = other DNA
tagtacaattcactacag

SEQ ID NO: 28197 - DNA, 18 bp, synthetic construct
  source 1..18: mol_type = other DNA
tagtacgacacacgacag

SEQ ID NO: 28198 - DNA, 18 bp, synthetic construct
  source 1..18: mol_type = other DNA
tagtccgattcactttag

SEQ ID NO: 28199 - DNA, 18 bp, synthetic construct
  source 1..18: mol_type = other DNA
tataacgacacactagag

SEQ ID NO: 28200 - DNA, 18 bp, synthetic construct
  source 1..18: mol_type = other DNA
tatagctactcactatag

SEQ ID NO: 28201 - DNA, 18 bp, synthetic construct
  source 1..18: mol_type = other DNA
tatgaccgctcactatag

SEQ ID NO: 28202 - DNA, 18 bp, synthetic construct
  source 1..18: mol_type = other DNA
tattaagactcatcatag

SEQ ID NO: 28203 - DNA, 18 bp, synthetic construct
  source 1..18: mol_type = other DNA
tattaagcctcactaaag

SEQ ID NO: 28204 - DNA, 18 bp, synthetic construct
  source 1..18: mol_type = other DNA
tattaagcctcactctag

SEQ ID NO: 28205 - DNA, 18 bp, synthetic construct
  source 1..18: mol_type = other DNA
tattaatactcattatag

SEQ ID NO: 28206 - DNA, 18 bp, synthetic construct
  source 1..18: mol_type = other DNA
tattacacctctctatag

SEQ ID NO: 28207 - DNA, 18 bp, synthetic construct
  source 1..18: mol_type = other DNA
tattaccacatactatag

SEQ ID NO: 28208 - DNA, 18 bp, synthetic construct
  source 1..18: mol_type = other DNA
tattaccactcacaatgg

SEQ ID NO: 28209 - DNA, 18 bp, synthetic construct
  source 1..18: mol_type = other DNA
tattaccactcactaacg

SEQ ID NO: 28210 - DNA, 18 bp, synthetic construct
  source 1..18: mol_type = other DNA
tattacgaagcactctag

SEQ ID NO: 28211 - DNA, 18 bp, synthetic construct
  source 1..18: mol_type = other DNA
tattacgaataacaatag

SEQ ID NO: 28212 - DNA, 18 bp, synthetic construct
  source 1..18: mol_type = other DNA
tattacgactcaccacgg

SEQ ID NO: 28213 - DNA, 18 bp, synthetic construct
  source 1..18: mol_type = other DNA
tattacgactcattaggg

SEQ ID NO: 28214 - DNA, 18 bp, synthetic construct
  source 1..18: mol_type = other DNA
tattacgagtaactgtag

SEQ ID NO: 28215 - DNA, 18 bp, synthetic construct
  source 1..18: mol_type = other DNA
tattacgattaattatag

SEQ ID NO: 28216 - DNA, 18 bp, synthetic construct
  source 1..18: mol_type = other DNA
tattacgattgacgatag

SEQ ID NO: 28217 - DNA, 18 bp, synthetic construct
  source 1..18: mol_type = other DNA
tattacgtctcagtatcg

SEQ ID NO: 28218 - DNA, 18 bp, synthetic construct
  source 1..18: mol_type = other DNA
tattactaattactatag

SEQ ID NO: 28219 - DNA, 18 bp, synthetic construct
  source 1..18: mol_type = other DNA
tattactactaactaaag

SEQ ID NO: 28220 - DNA, 18 bp, synthetic construct
  source 1..18: mol_type = other DNA
tattatgaatcacaatag

SEQ ID NO: 28221 - DNA, 18 bp, synthetic construct
  source 1..18: mol_type = other DNA
tattatgactcacttgag

SEQ ID NO: 28222 - DNA, 18 bp, synthetic construct
  source 1..18: mol_type = other DNA
tattccgacccattatag

SEQ ID NO: 28223 - DNA, 18 bp, synthetic construct
  source 1..18: mol_type = other DNA
tattccgacttactaaag

SEQ ID NO: 28224 - DNA, 18 bp, synthetic construct
  source 1..18: mol_type = other DNA
tattgcgacttactttag

SEQ ID NO: 28225 - DNA, 18 bp, synthetic construct
  source 1..18: mol_type = other DNA
tcaaacgactaactttag

SEQ ID NO: 28226 - DNA, 18 bp, synthetic construct
  source 1..18: mol_type = other DNA
tcaagcgactcacaatag

SEQ ID NO: 28227 - DNA, 18 bp, synthetic construct
  source 1..18: mol_type = other DNA
tcatacgacccacttaag

SEQ ID NO: 28228 - DNA, 18 bp, synthetic construct
  source 1..18: mol_type = other DNA
tcatacgagtcactaagg

SEQ ID NO: 28229 - DNA, 18 bp, synthetic construct
  source 1..18: mol_type = other DNA
tcatacgtctcacaatcg

SEQ ID NO: 28230 - DNA, 18 bp, synthetic construct
  source 1..18: mol_type = other DNA
tcatacgtctcattatgg

SEQ ID NO: 28231 - DNA, 18 bp, synthetic construct
  source 1..18: mol_type = other DNA
tcatactagtcaatatag

SEQ ID NO: 28232 - DNA, 18 bp, synthetic construct
  source 1..18: mol_type = other DNA
tcataggattcactaaag

SEQ ID NO: 28233 - DNA, 18 bp, synthetic construct
  source 1..18: mol_type = other DNA
tcatatgaaacactatag

SEQ ID NO: 28234 - DNA, 18 bp, synthetic construct
  source 1..18: mol_type = other DNA
tcatatgactcattttag

SEQ ID NO: 28235 - DNA, 18 bp, synthetic construct
  source 1..18: mol_type = other DNA
tcatatgactctctaaag

SEQ ID NO: 28236 - DNA, 18 bp, synthetic construct
  source 1..18: mol_type = other DNA
tcatcacactcactatag

SEQ ID NO: 28237 - DNA, 18 bp, synthetic construct
  source 1..18: mol_type = other DNA
tcatccgaatcactaaag

SEQ ID NO: 28238 - DNA, 18 bp, synthetic construct
  source 1..18: mol_type = other DNA
tcatccgtcacactatag

SEQ ID NO: 28239 - DNA, 18 bp, synthetic construct
  source 1..18: mol_type = other DNA
tcatgcgactcacattag

SEQ ID NO: 28240 - DNA, 18 bp, synthetic construct
  source 1..18: mol_type = other DNA
tcgtaggactcactaaag

SEQ ID NO: 28241 - DNA, 18 bp, synthetic construct
  source 1..18: mol_type = other DNA
tcttaccacgcactatag

SEQ ID NO: 28242 - DNA, 18 bp, synthetic construct
  source 1..18: mol_type = other DNA
tcttacggcccactatag

SEQ ID NO: 28243 - DNA, 18 bp, synthetic construct
  source 1..18: mol_type = other DNA
tcttgcgattcactatag

SEQ ID NO: 28244 - DNA, 18 bp, synthetic construct
  source 1..18: mol_type = other DNA
tgaaacaacacactatag

SEQ ID NO: 28245 - DNA, 18 bp, synthetic construct
  source 1..18: mol_type = other DNA
tgataagacactctatag

SEQ ID NO: 28246 - DNA, 18 bp, synthetic construct
  source 1..18: mol_type = other DNA
tgataagactctcaatag

SEQ ID NO: 28247 - DNA, 18 bp, synthetic construct
  source 1..18: mol_type = other DNA
tgatacaacgccctatag

SEQ ID NO: 28248 - DNA, 18 bp, synthetic construct
  source 1..18: mol_type = other DNA
tgatacgactatcaatag

SEQ ID NO: 28249 - DNA, 18 bp, synthetic construct
  source 1..18: mol_type = other DNA
tgatacgtatcactaaag

SEQ ID NO: 28250 - DNA, 18 bp, synthetic construct
  source 1..18: mol_type = other DNA
tgatccatctcactatag

SEQ ID NO: 28251 - DNA, 18 bp, synthetic construct
  source 1..18: mol_type = other DNA
tgttaccactcactaaag

SEQ ID NO: 28252 - DNA, 18 bp, synthetic construct
  source 1..18: mol_type = other DNA
tgttacgatacactatag

SEQ ID NO: 28253 - DNA, 18 bp, synthetic construct
  source 1..18: mol_type = other DNA
ttaaaccactcaatatag

SEQ ID NO: 28254 - DNA, 18 bp, synthetic construct
  source 1..18: mol_type = other DNA
ttaaatgattcactatag

SEQ ID NO: 28255 - DNA, 18 bp, synthetic construct
  source 1..18: mol_type = other DNA
ttacacgacacaccatag

SEQ ID NO: 28256 - DNA, 18 bp, synthetic construct
  source 1..18: mol_type = other DNA
ttacactactaactatag

SEQ ID NO: 28257 - DNA, 18 bp, synthetic construct
  source 1..18: mol_type = other DNA
ttacactactcactatgg

SEQ ID NO: 28258 - DNA, 18 bp, synthetic construct
  source 1..18: mol_type = other DNA
ttacactactctctatag

SEQ ID NO: 28259 - DNA, 18 bp, synthetic construct
  source 1..18: mol_type = other DNA
ttagacgtctcactctag

SEQ ID NO: 28260 - DNA, 18 bp, synthetic construct
  source 1..18: mol_type = other DNA
ttataagacactctatag

SEQ ID NO: 28261 - DNA, 18 bp, synthetic construct
  source 1..18: mol_type = other DNA
ttatacaacatactatag

SEQ ID NO: 28262 - DNA, 18 bp, synthetic construct
  source 1..18: mol_type = other DNA
ttatacaagtcactgtag

SEQ ID NO: 28263 - DNA, 18 bp, synthetic construct
  source 1..18: mol_type = other DNA
ttataccaatcactaaag

SEQ ID NO: 28264 - DNA, 18 bp, synthetic construct
  source 1..18: mol_type = other DNA
ttataccactcaataaag

SEQ ID NO: 28265 - DNA, 18 bp, synthetic construct
  source 1..18: mol_type = other DNA
ttataccactcagcatag

SEQ ID NO: 28266 - DNA, 18 bp, synthetic construct
  source 1..18: mol_type = other DNA
ttataccattcacaatag

SEQ ID NO: 28267 - DNA, 18 bp, synthetic construct
  source 1..18: mol_type = other DNA
ttatacgacacacattag

SEQ ID NO: 28268 - DNA, 18 bp, synthetic construct
  source 1..18: mol_type = other DNA
ttatacgacaccctaaag

SEQ ID NO: 28269 - DNA, 18 bp, synthetic construct
  source 1..18: mol_type = other DNA
ttatacgacgcaatacag

SEQ ID NO: 28270 - DNA, 18 bp, synthetic construct
  source 1..18: mol_type = other DNA
ttatacgactgtctaaag

SEQ ID NO: 28271 - DNA, 18 bp, synthetic construct
  source 1..18: mol_type = other DNA
ttatacgagtctctaaag

SEQ ID NO: 28272 - DNA, 18 bp, synthetic construct
  source 1..18: mol_type = other DNA
ttatacgcattactatag

SEQ ID NO: 28273 - DNA, 18 bp, synthetic construct
  source 1..18: mol_type = other DNA
ttatacgcctaactatgg

SEQ ID NO: 28274 - DNA, 18 bp, synthetic construct
  source 1..18: mol_type = other DNA
ttatacgtaccactatag

SEQ ID NO: 28275 - DNA, 18 bp, synthetic construct
  source 1..18: mol_type = other DNA
ttatactactctctatcg

SEQ ID NO: 28276 - DNA, 18 bp, synthetic construct
  source 1..18: mol_type = other DNA
ttatactacttactatcg

SEQ ID NO: 28277 - DNA, 18 bp, synthetic construct
  source 1..18: mol_type = other DNA
ttatactgctcaatatag

SEQ ID NO: 28278 - DNA, 18 bp, synthetic construct
  source 1..18: mol_type = other DNA
ttatactgctctctatag

SEQ ID NO: 28279 - DNA, 18 bp, synthetic construct
  source 1..18: mol_type = other DNA
ttataggtctcattatag

SEQ ID NO: 28280 - DNA, 18 bp, synthetic construct
  source 1..18: mol_type = other DNA
ttatatgactcactaagg

SEQ ID NO: 28281 - DNA, 18 bp, synthetic construct
  source 1..18: mol_type = other DNA
ttatcccgctcactatag

SEQ ID NO: 28282 - DNA, 18 bp, synthetic construct
  source 1..18: mol_type = other DNA
ttatgccactcactatgg

SEQ ID NO: 28283 - DNA, 18 bp, synthetic construct
  source 1..18: mol_type = other DNA
ttatgccgctcactatag

SEQ ID NO: 28284 - DNA, 18 bp, synthetic construct
  source 1..18: mol_type = other DNA
ttatgcgactgaccatag

SEQ ID NO: 28285 - DNA, 18 bp, synthetic construct
  source 1..18: mol_type = other DNA
ttctactactctctatag

SEQ ID NO: 28286 - DNA, 18 bp, synthetic construct
  source 1..18: mol_type = other DNA
ttctaggaatcactatag

SEQ ID NO: 28287 - DNA, 18 bp, synthetic construct
  source 1..18: mol_type = other DNA
ttgtaggactcacaatag

SEQ ID NO: 28288 - DNA, 18 bp, synthetic construct
  source 1..18: mol_type = other DNA
tttgacgactaactatag

SEQ ID NO: 28289 - DNA, 18 bp, synthetic construct
  source 1..18: mol_type = other DNA
ttttaccagtcactatag

SEQ ID NO: 28290 - DNA, 18 bp, synthetic construct
  source 1..18: mol_type = other DNA
ttttacgaatctctatag

SEQ ID NO: 28291 - DNA, 18 bp, synthetic construct
  source 1..18: mol_type = other DNA
ttttacgactgaatatag

SEQ ID NO: 28292 - DNA, 18 bp, synthetic construct
  source 1..18: mol_type = other DNA
atttacgactcactttag

SEQ ID NO: 28293 - DNA, 18 bp, synthetic construct
  source 1..18: mol_type = other DNA
tatttcgactctctttag

SEQ ID NO: 28294 - DNA, 18 bp, synthetic construct
  source 1..18: mol_type = other DNA
ttaatcgactcactaaag

SEQ ID NO: 28295 - DNA, 18 bp, synthetic construct
  source 1..18: mol_type = other DNA
aaattcaactcactattg

SEQ ID NO: 28296 - DNA, 18 bp, synthetic construct
  source 1..18: mol_type = other DNA
ttaatcgtctcactatag

SEQ ID NO: 28297 - DNA, 18 bp, synthetic construct
  source 1..18: mol_type = other DNA
ttaaacgtctcactttag

SEQ ID NO: 28298 - DNA, 18 bp, synthetic construct
  source 1..18: mol_type = other DNA
ttatacgacacacaaaag

SEQ ID NO: 28299 - DNA, 18 bp, synthetic construct
  source 1..18: mol_type = other DNA
taattcaactcaccattg

SEQ ID NO: 28300 - DNA, 18 bp, synthetic construct
  source 1..18: mol_type = other DNA
tattacgacttgctattg

SEQ ID NO: 28301 - DNA, 18 bp, synthetic construct
  source 1..18: mol_type = other DNA
aaatacgacacactaatg

SEQ ID NO: 28302 - DNA, 18 bp, synthetic construct
  source 1..18: mol_type = other DNA
taaatctactcactttag

SEQ ID NO: 28303 - DNA, 18 bp, synthetic construct
  source 1..18: mol_type = other DNA
taataagaatcactaatg

SEQ ID NO: 28304 - DNA, 18 bp, synthetic construct
  source 1..18: mol_type = other DNA
taataggtcacactttag

SEQ ID NO: 28305 - DNA, 18 bp, synthetic construct
  source 1..18: mol_type = other DNA
taattcggctcacttttg

SEQ ID NO: 28306 - DNA, 18 bp, synthetic construct
  source 1..18: mol_type = other DNA
taatttgaatcactattg

SEQ ID NO: 28307 - DNA, 18 bp, synthetic construct
  source 1..18: mol_type = other DNA
aaattagactcactatcg

SEQ ID NO: 28308 - DNA, 18 bp, synthetic construct
  source 1..18: mol_type = other DNA
taaatcgacaaactatag

SEQ ID NO: 28309 - DNA, 18 bp, synthetic construct
  source 1..18: mol_type = other DNA
taataagattctctattg

SEQ ID NO: 28310 - DNA, 18 bp, synthetic construct
  source 1..18: mol_type = other DNA
taatacgacatacaattg

SEQ ID NO: 28311 - DNA, 18 bp, synthetic construct
  source 1..18: mol_type = other DNA
taatacgactcagatttg

SEQ ID NO: 28312 - DNA, 18 bp, synthetic construct
  source 1..18: mol_type = other DNA
taatatgattcattattg

SEQ ID NO: 28313 - DNA, 18 bp, synthetic construct
  source 1..18: mol_type = other DNA
taattagactttctatag

SEQ ID NO: 28314 - DNA, 18 bp, synthetic construct
  source 1..18: mol_type = other DNA
taattcaattcaatatag

SEQ ID NO: 28315 - DNA, 18 bp, synthetic construct
  source 1..18: mol_type = other DNA
taattcgacacactaagg

SEQ ID NO: 28316 - DNA, 18 bp, synthetic construct
  source 1..18: mol_type = other DNA
taattcgacactttatag

SEQ ID NO: 28317 - DNA, 18 bp, synthetic construct
  source 1..18: mol_type = other DNA
tacttcgtctcactttag

SEQ ID NO: 28318 - DNA, 18 bp, synthetic construct
  source 1..18: mol_type = other DNA
tatttcgcgtcactatag

SEQ ID NO: 28319 - DNA, 18 bp, synthetic construct
  source 1..18: mol_type = other DNA
tcatacgcctctctattg

SEQ ID NO: 28320 - DNA, 18 bp, synthetic construct
  source 1..18: mol_type = other DNA
tgattcgactcaatacag

SEQ ID NO: 28321 - DNA, 18 bp, synthetic construct
  source 1..18: mol_type = other DNA
ttacacgactcacttttg

SEQ ID NO: 28322 - DNA, 18 bp, synthetic construct
  source 1..18: mol_type = other DNA
ttttacgaatcactattg

SEQ ID NO: 28323 - DNA, 18 bp, synthetic construct
  source 1..18: mol_type = other DNA
aaatataactcactaaag

SEQ ID NO: 28324 - DNA, 18 bp, synthetic construct
  source 1..18: mol_type = other DNA
atataccactcaatatag

SEQ ID NO: 28325 - DNA, 18 bp, synthetic construct
  source 1..18: mol_type = other DNA
atatacgactctatatag

SEQ ID NO: 28326 - DNA, 18 bp, synthetic construct
  source 1..18: mol_type = other DNA
caataaaaatcactatag

SEQ ID NO: 28327 - DNA, 18 bp, synthetic construct
  source 1..18: mol_type = other DNA
caatacgaatctctaaag

SEQ ID NO: 28328 - DNA, 18 bp, synthetic construct
  source 1..18: mol_type = other DNA
caatacgtctaacaatag

SEQ ID NO: 28329 - DNA, 18 bp, synthetic construct
  source 1..18: mol_type = other DNA
taaaacgattcacaatgg

SEQ ID NO: 28330 - DNA, 18 bp, synthetic construct
  source 1..18: mol_type = other DNA
taacacgactctttttag

SEQ ID NO: 28331 - DNA, 18 bp, synthetic construct
  source 1..18: mol_type = other DNA
taacacgtcttactaaag

SEQ ID NO: 28332 - DNA, 18 bp, synthetic construct
  source 1..18: mol_type = other DNA
taatatgacacacaacag

SEQ ID NO: 28333 - DNA, 18 bp, synthetic construct
  source 1..18: mol_type = other DNA
taatccgacatacaatag

SEQ ID NO: 28334 - DNA, 18 bp, synthetic construct
  source 1..18: mol_type = other DNA
taatctgactctctaaag

SEQ ID NO: 28335 - DNA, 18 bp, synthetic construct
  source 1..18: mol_type = other DNA
taatgcgattcacaaaag

SEQ ID NO: 28336 - DNA, 18 bp, synthetic construct
  source 1..18: mol_type = other DNA
tacaaagactcactaaag

SEQ ID NO: 28337 - DNA, 18 bp, synthetic construct
  source 1..18: mol_type = other DNA
tactactacacactaaag

SEQ ID NO: 28338 - DNA, 18 bp, synthetic construct
  source 1..18: mol_type = other DNA
tagtacgattctcaatag

SEQ ID NO: 28339 - DNA, 18 bp, synthetic construct
  source 1..18: mol_type = other DNA
tagtacgtcacactttag

SEQ ID NO: 28340 - DNA, 18 bp, synthetic construct
  source 1..18: mol_type = other DNA
tattaatactcaccatag

SEQ ID NO: 28341 - DNA, 18 bp, synthetic construct
  source 1..18: mol_type = other DNA
tattacgactgtctaaag

SEQ ID NO: 28342 - DNA, 18 bp, synthetic construct
  source 1..18: mol_type = other DNA
tattacgtcagactatag

SEQ ID NO: 28343 - DNA, 18 bp, synthetic construct
  source 1..18: mol_type = other DNA
tattattactcacaatag

SEQ ID NO: 28344 - DNA, 18 bp, synthetic construct
  source 1..18: mol_type = other DNA
tattctgtctcactatag

SEQ ID NO: 28345 - DNA, 18 bp, synthetic construct
  source 1..18: mol_type = other DNA
tgttacgaatcacaatag

SEQ ID NO: 28346 - DNA, 18 bp, synthetic construct
  source 1..18: mol_type = other DNA
ttaaactactcaatatag

SEQ ID NO: 28347 - DNA, 18 bp, synthetic construct
  source 1..18: mol_type = other DNA
ttacacgaatcacaatag

SEQ ID NO: 28348 - DNA, 18 bp, synthetic construct
  source 1..18: mol_type = other DNA
ttatacatctcaatatag

SEQ ID NO: 28349 - DNA, 18 bp, synthetic construct
  source 1..18: mol_type = other DNA
ttatataactcactatcg

SEQ ID NO: 28350 - DNA, 18 bp, synthetic construct
  source 1..18: mol_type = other DNA
atataagactcactttag

SEQ ID NO: 28351 - DNA, 18 bp, synthetic construct
  source 1..18: mol_type = other DNA
aaattctactcactattg

SEQ ID NO: 28352 - DNA, 18 bp, synthetic construct
  source 1..18: mol_type = other DNA
taattctgctcactattg

SEQ ID NO: 28353 - DNA, 18 bp, synthetic construct
  source 1..18: mol_type = other DNA
taattcgacactatatag

SEQ ID NO: 28354 - DNA, 18 bp, synthetic construct
  source 1..18: mol_type = other DNA
aataacgtctcactatag

SEQ ID NO: 28355 - DNA, 18 bp, synthetic construct
  source 1..18: mol_type = other DNA
ttatacatctcactacag

SEQ ID NO: 28356 - DNA, 18 bp, synthetic construct
  source 1..18: mol_type = other DNA
ttattcgacatactatag

SEQ ID NO: 28357 - DNA, 18 bp, synthetic construct
  source 1..18: mol_type = other DNA
aaatacgactcgctaatg

SEQ ID NO: 28358 - DNA, 18 bp, synthetic construct
  source 1..18: mol_type = other DNA
taaatcgactcgcaatag

SEQ ID NO: 28359 - DNA, 18 bp, synthetic construct
  source 1..18: mol_type = other DNA
taatacaactagctattg

SEQ ID NO: 28360 - DNA, 18 bp, synthetic construct
  source 1..18: mol_type = other DNA
taatacaactcgcttttg

SEQ ID NO: 28361 - DNA, 18 bp, synthetic construct
  source 1..18: mol_type = other DNA
taattcaattcgctatag

SEQ ID NO: 28362 - DNA, 18 bp, synthetic construct
  source 1..18: mol_type = other DNA
taattccactaactattg

SEQ ID NO: 28363 - DNA, 18 bp, synthetic construct
  source 1..18: mol_type = other DNA
taattcgactatctattg

SEQ ID NO: 28364 - DNA, 18 bp, synthetic construct
  source 1..18: mol_type = other DNA
taattcgacttacaattg

SEQ ID NO: 28365 - DNA, 18 bp, synthetic construct
  source 1..18: mol_type = other DNA
taattcgagtcgcaatag

SEQ ID NO: 28366 - DNA, 18 bp, synthetic construct
  source 1..18: mol_type = other DNA
taattcgattcactgttg

SEQ ID NO: 28367 - DNA, 18 bp, synthetic construct
  source 1..18: mol_type = other DNA
taatttgactcaccattg

SEQ ID NO: 28368 - DNA, 18 bp, synthetic construct
  source 1..18: mol_type = other DNA
taatttgactcattattg

SEQ ID NO: 28369 - DNA, 18 bp, synthetic construct
  source 1..18: mol_type = other DNA
tattacgacccgctattg

SEQ ID NO: 28370 - DNA, 18 bp, synthetic construct
  source 1..18: mol_type = other DNA
tgattcgattcactattg

SEQ ID NO: 28371 - DNA, 18 bp, synthetic construct
  source 1..18: mol_type = other DNA
aaaaacgactaactattg

SEQ ID NO: 28372 - DNA, 18 bp, synthetic construct
  source 1..18: mol_type = other DNA
aaatacgactcagaattg

SEQ ID NO: 28373 - DNA, 18 bp, synthetic construct
  source 1..18: mol_type = other DNA
aaatacgtctcgatatag

SEQ ID NO: 28374 - DNA, 18 bp, synthetic construct
  source 1..18: mol_type = other DNA
aaatactacccgctatag

SEQ ID NO: 28375 - DNA, 18 bp, synthetic construct
  source 1..18: mol_type = other DNA
aaattcgacacactatgg

SEQ ID NO: 28376 - DNA, 18 bp, synthetic construct
  source 1..18: mol_type = other DNA
aaattcgactcactaacg

SEQ ID NO: 28377 - DNA, 18 bp, synthetic construct
  source 1..18: mol_type = other DNA
aaattctactcactacag

SEQ ID NO: 28378 - DNA, 18 bp, synthetic construct
  source 1..18: mol_type = other DNA
aactacggctcactattg

SEQ ID NO: 28379 - DNA, 18 bp, synthetic construct
  source 1..18: mol_type = other DNA
aattacgactcgctctag

SEQ ID NO: 28380 - DNA, 18 bp, synthetic construct
  source 1..18: mol_type = other DNA
caaaacgattcactattg

SEQ ID NO: 28381 - DNA, 18 bp, synthetic construct
  source 1..18: mol_type = other DNA
caataagactcacttttg

SEQ ID NO: 28382 - DNA, 18 bp, synthetic construct
  source 1..18: mol_type = other DNA
caattagactcactctag

SEQ ID NO: 28383 - DNA, 18 bp, synthetic construct
  source 1..18: mol_type = other DNA
caattcgagtctctatag

SEQ ID NO: 28384 - DNA, 18 bp, synthetic construct
  source 1..18: mol_type = other DNA
caattcgtctcactgtag

SEQ ID NO: 28385 - DNA, 18 bp, synthetic construct
  source 1..18: mol_type = other DNA
caattctcctcactatag

SEQ ID NO: 28386 - DNA, 18 bp, synthetic construct
  source 1..18: mol_type = other DNA
caatttgacttactatag

SEQ ID NO: 28387 - DNA, 18 bp, synthetic construct
  source 1..18: mol_type = other DNA
catttcgacttactatag

SEQ ID NO: 28388 - DNA, 18 bp, synthetic construct
  source 1..18: mol_type = other DNA
gaatctgactcactattg

SEQ ID NO: 28389 - DNA, 18 bp, synthetic construct
  source 1..18: mol_type = other DNA
gtatacgactcgctacag

SEQ ID NO: 28390 - DNA, 18 bp, synthetic construct
  source 1..18: mol_type = other DNA
taaaaagacacactattg

SEQ ID NO: 28391 - DNA, 18 bp, synthetic construct
  source 1..18: mol_type = other DNA
taaaaagtctcactattg

SEQ ID NO: 28392 - DNA, 18 bp, synthetic construct
  source 1..18: mol_type = other DNA
taaaacgacccactactg

SEQ ID NO: 28393 - DNA, 18 bp, synthetic construct
  source 1..18: mol_type = other DNA
taaaacgactcactgatg

SEQ ID NO: 28394 - DNA, 18 bp, synthetic construct
  source 1..18: mol_type = other DNA
taaaacgactctatattg

SEQ ID NO: 28395 - DNA, 18 bp, synthetic construct
  source 1..18: mol_type = other DNA
taaaacgtctcgctaaag

SEQ ID NO: 28396 - DNA, 18 bp, synthetic construct
  source 1..18: mol_type = other DNA
taaaaggactcacgattg

SEQ ID NO: 28397 - DNA, 18 bp, synthetic construct
  source 1..18: mol_type = other DNA
taaaatgacccactattg

SEQ ID NO: 28398 - DNA, 18 bp, synthetic construct
  source 1..18: mol_type = other DNA
taaatccacttactatag

SEQ ID NO: 28399 - DNA, 18 bp, synthetic construct
  source 1..18: mol_type = other DNA
taaatcgactaactatgg

SEQ ID NO: 28400 - DNA, 18 bp, synthetic construct
  source 1..18: mol_type = other DNA
taaatcgactcactctgg

SEQ ID NO: 28401 - DNA, 18 bp, synthetic construct
  source 1..18: mol_type = other DNA
taaatcggctcactaaag

SEQ ID NO: 28402 - DNA, 18 bp, synthetic construct
  source 1..18: mol_type = other DNA
taaatctactcactacag

SEQ ID NO: 28403 - DNA, 18 bp, synthetic construct
  source 1..18: mol_type = other DNA
taactcgatttactatag

SEQ ID NO: 28404 - DNA, 18 bp, synthetic construct
  source 1..18: mol_type = other DNA
taagacgactcacaaatg

SEQ ID NO: 28405 - DNA, 18 bp, synthetic construct
  source 1..18: mol_type = other DNA
taataactctcactattg

SEQ ID NO: 28406 - DNA, 18 bp, synthetic construct
  source 1..18: mol_type = other DNA
taataagacttacaattg

SEQ ID NO: 28407 - DNA, 18 bp, synthetic construct
  source 1..18: mol_type = other DNA
taatacaacccactaatg

SEQ ID NO: 28408 - DNA, 18 bp, synthetic construct
  source 1..18: mol_type = other DNA
taatacaacgcactaatg

SEQ ID NO: 28409 - DNA, 18 bp, synthetic construct
  source 1..18: mol_type = other DNA
taatacaacttgcaatag

SEQ ID NO: 28410 - DNA, 18 bp, synthetic construct
  source 1..18: mol_type = other DNA
taataccactaaatattg

SEQ ID NO: 28411 - DNA, 18 bp, synthetic construct
  source 1..18: mol_type = other DNA
taatacgactctataatg

SEQ ID NO: 28412 - DNA, 18 bp, synthetic construct
  source 1..18: mol_type = other DNA
taatacgacttaaaattg

SEQ ID NO: 28413 - DNA, 18 bp, synthetic construct
  source 1..18: mol_type = other DNA
taatacgagccaccattg

SEQ ID NO: 28414 - DNA, 18 bp, synthetic construct
  source 1..18: mol_type = other DNA
taatacgcctcaattttg

SEQ ID NO: 28415 - DNA, 18 bp, synthetic construct
  source 1..18: mol_type = other DNA
taatacgcttcgctaaag

SEQ ID NO: 28416 - DNA, 18 bp, synthetic construct
  source 1..18: mol_type = other DNA
taatacgtctcataattg

SEQ ID NO: 28417 - DNA, 18 bp, synthetic construct
  source 1..18: mol_type = other DNA
taatacgtctctctagtg

SEQ ID NO: 28418 - DNA, 18 bp, synthetic construct
  source 1..18: mol_type = other DNA
taatacgtctctctcttg

SEQ ID NO: 28419 - DNA, 18 bp, synthetic construct
  source 1..18: mol_type = other DNA
taatacgtcttcctattg

SEQ ID NO: 28420 - DNA, 18 bp, synthetic construct
  source 1..18: mol_type = other DNA
taatacgtgtcattattg

SEQ ID NO: 28421 - DNA, 18 bp, synthetic construct
  source 1..18: mol_type = other DNA
taatactacttactaatg

SEQ ID NO: 28422 - DNA, 18 bp, synthetic construct
  source 1..18: mol_type = other DNA
taataggacttactaatg

SEQ ID NO: 28423 - DNA, 18 bp, synthetic construct
  source 1..18: mol_type = other DNA
taatataactaactattg

SEQ ID NO: 28424 - DNA, 18 bp, synthetic construct
  source 1..18: mol_type = other DNA
taatataattcactattg

SEQ ID NO: 28425 - DNA, 18 bp, synthetic construct
  source 1..18: mol_type = other DNA
taatatgactcaccaatg

SEQ ID NO: 28426 - DNA, 18 bp, synthetic construct
  source 1..18: mol_type = other DNA
taatatgactcacttatg

SEQ ID NO: 28427 - DNA, 18 bp, synthetic construct
  source 1..18: mol_type = other DNA
taatatgattccctattg

SEQ ID NO: 28428 - DNA, 18 bp, synthetic construct
  source 1..18: mol_type = other DNA
taatattacttactattg

SEQ ID NO: 28429 - DNA, 18 bp, synthetic construct
  source 1..18: mol_type = other DNA
taatcccactcactaatg

SEQ ID NO: 28430 - DNA, 18 bp, synthetic construct
  source 1..18: mol_type = other DNA
taatccgactcgaaatag

SEQ ID NO: 28431 - DNA, 18 bp, synthetic construct
  source 1..18: mol_type = other DNA
taatccgactgattattg

SEQ ID NO: 28432 - DNA, 18 bp, synthetic construct
  source 1..18: mol_type = other DNA
taatgcgtctcattattg

SEQ ID NO: 28433 - DNA, 18 bp, synthetic construct
  source 1..18: mol_type = other DNA
taattagacacactgtag

SEQ ID NO: 28434 - DNA, 18 bp, synthetic construct
  source 1..18: mol_type = other DNA
taattagacttactgtag

SEQ ID NO: 28435 - DNA, 18 bp, synthetic construct
  source 1..18: mol_type = other DNA
taattagcctcacaatag

SEQ ID NO: 28436 - DNA, 18 bp, synthetic construct
  source 1..18: mol_type = other DNA
taattcaaatcactacag

SEQ ID NO: 28437 - DNA, 18 bp, synthetic construct
  source 1..18: mol_type = other DNA
taattcaactcacactag

SEQ ID NO: 28438 - DNA, 18 bp, synthetic construct
  source 1..18: mol_type = other DNA
taattcaacttactttag

SEQ ID NO: 28439 - DNA, 18 bp, synthetic construct
  source 1..18: mol_type = other DNA
taattccactcactcaag

SEQ ID NO: 28440 - DNA, 18 bp, synthetic construct
  source 1..18: mol_type = other DNA
taattccactcataatag

SEQ ID NO: 28441 - DNA, 18 bp, synthetic construct
  source 1..18: mol_type = other DNA
taattccattcactacag

SEQ ID NO: 28442 - DNA, 18 bp, synthetic construct
  source 1..18: mol_type = other DNA
taattcctctcactatgg

SEQ ID NO: 28443 - DNA, 18 bp, synthetic construct
  source 1..18: mol_type = other DNA
taattcgaatcaccaaag

SEQ ID NO: 28444 - DNA, 18 bp, synthetic construct
  source 1..18: mol_type = other DNA
taattcgaatttctatag

SEQ ID NO: 28445 - DNA, 18 bp, synthetic construct
  source 1..18: mol_type = other DNA
taattcgaccaacaatag

SEQ ID NO: 28446 - DNA, 18 bp, synthetic construct
  source 1..18: mol_type = other DNA
taattcgaccgaatatag

SEQ ID NO: 28447 - DNA, 18 bp, synthetic construct
  source 1..18: mol_type = other DNA
taattcgatactctatag

SEQ ID NO: 28448 - DNA, 18 bp, synthetic construct
  source 1..18: mol_type = other DNA
taattcggttcacaatag

SEQ ID NO: 28449 - DNA, 18 bp, synthetic construct
  source 1..18: mol_type = other DNA
taattcgtctccctaaag

SEQ ID NO: 28450 - DNA, 18 bp, synthetic construct
  source 1..18: mol_type = other DNA
taattcgtctccctttag

SEQ ID NO: 28451 - DNA, 18 bp, synthetic construct
  source 1..18: mol_type = other DNA
taattcgtttcactgtag

SEQ ID NO: 28452 - DNA, 18 bp, synthetic construct
  source 1..18: mol_type = other DNA
taattctacacactacag

SEQ ID NO: 28453 - DNA, 18 bp, synthetic construct
  source 1..18: mol_type = other DNA
taatttgactaattatag

SEQ ID NO: 28454 - DNA, 18 bp, synthetic construct
  source 1..18: mol_type = other DNA
taatttgacttacaatag

SEQ ID NO: 28455 - DNA, 18 bp, synthetic construct
  source 1..18: mol_type = other DNA
tactaagactgactattg

SEQ ID NO: 28456 - DNA, 18 bp, synthetic construct
  source 1..18: mol_type = other DNA
tactatgattcactattg

SEQ ID NO: 28457 - DNA, 18 bp, synthetic construct
  source 1..18: mol_type = other DNA
tagatcgactaactatag

SEQ ID NO: 28458 - DNA, 18 bp, synthetic construct
  source 1..18: mol_type = other DNA
tagttcgaatcattatag

SEQ ID NO: 28459 - DNA, 18 bp, synthetic construct
  source 1..18: mol_type = other DNA
tagttcgactctctttag

SEQ ID NO: 28460 - DNA, 18 bp, synthetic construct
  source 1..18: mol_type = other DNA
tagttcgattcactttag

SEQ ID NO: 28461 - DNA, 18 bp, synthetic construct
  source 1..18: mol_type = other DNA
tatatcgacgcactatag

SEQ ID NO: 28462 - DNA, 18 bp, synthetic construct
  source 1..18: mol_type = other DNA
tattacgacttaatattg

SEQ ID NO: 28463 - DNA, 18 bp, synthetic construct
  source 1..18: mol_type = other DNA
tattacgatccgctatag

SEQ ID NO: 28464 - DNA, 18 bp, synthetic construct
  source 1..18: mol_type = other DNA
tatttcgactaaatatag

SEQ ID NO: 28465 - DNA, 18 bp, synthetic construct
  source 1..18: mol_type = other DNA
tatttcgtcccactatag

SEQ ID NO: 28466 - DNA, 18 bp, synthetic construct
  source 1..18: mol_type = other DNA
tcataagacttactattg

SEQ ID NO: 28467 - DNA, 18 bp, synthetic construct
  source 1..18: mol_type = other DNA
tcatacgaattactattg

SEQ ID NO: 28468 - DNA, 18 bp, synthetic construct
  source 1..18: mol_type = other DNA
tcattccaatcactatag

SEQ ID NO: 28469 - DNA, 18 bp, synthetic construct
  source 1..18: mol_type = other DNA
tcattccagtcactatag

SEQ ID NO: 28470 - DNA, 18 bp, synthetic construct
  source 1..18: mol_type = other DNA
tcattcgaatcactaaag

SEQ ID NO: 28471 - DNA, 18 bp, synthetic construct
  source 1..18: mol_type = other DNA
tcattcgacaaactatag

SEQ ID NO: 28472 - DNA, 18 bp, synthetic construct
  source 1..18: mol_type = other DNA
tgaaacgactcacttttg

SEQ ID NO: 28473 - DNA, 18 bp, synthetic construct
  source 1..18: mol_type = other DNA
tgactcgactaactatag

SEQ ID NO: 28474 - DNA, 18 bp, synthetic construct
  source 1..18: mol_type = other DNA
tgatactactcgctacag

SEQ ID NO: 28475 - DNA, 18 bp, synthetic construct
  source 1..18: mol_type = other DNA
tgatatcactcactattg

SEQ ID NO: 28476 - DNA, 18 bp, synthetic construct
  source 1..18: mol_type = other DNA
tgattcgactcaatttag

SEQ ID NO: 28477 - DNA, 18 bp, synthetic construct
  source 1..18: mol_type = other DNA
tgattggattcactatag

SEQ ID NO: 28478 - DNA, 18 bp, synthetic construct
  source 1..18: mol_type = other DNA
ttacacgactctctattg

SEQ ID NO: 28479 - DNA, 18 bp, synthetic construct
  source 1..18: mol_type = other DNA
ttactcgaatcactatag

SEQ ID NO: 28480 - DNA, 18 bp, synthetic construct
  source 1..18: mol_type = other DNA
ttagacgactcactaatg

SEQ ID NO: 28481 - DNA, 18 bp, synthetic construct
  source 1..18: mol_type = other DNA
ttatacaaatcactattg

SEQ ID NO: 28482 - DNA, 18 bp, synthetic construct
  source 1..18: mol_type = other DNA
ttataccacttactattg

SEQ ID NO: 28483 - DNA, 18 bp, synthetic construct
  source 1..18: mol_type = other DNA
ttatacgaatcactcttg

SEQ ID NO: 28484 - DNA, 18 bp, synthetic construct
  source 1..18: mol_type = other DNA
ttatacgactaaatattg

SEQ ID NO: 28485 - DNA, 18 bp, synthetic construct
  source 1..18: mol_type = other DNA
ttatacgagtcaccattg

SEQ ID NO: 28486 - DNA, 18 bp, synthetic construct
  source 1..18: mol_type = other DNA
ttatacgatttgctatag

SEQ ID NO: 28487 - DNA, 18 bp, synthetic construct
  source 1..18: mol_type = other DNA
ttatccgactcactaatg

SEQ ID NO: 28488 - DNA, 18 bp, synthetic construct
  source 1..18: mol_type = other DNA
ttatccggctcactattg

SEQ ID NO: 28489 - DNA, 18 bp, synthetic construct
  source 1..18: mol_type = other DNA
ttattccagtcactatag

SEQ ID NO: 28490 - DNA, 18 bp, synthetic construct
  source 1..18: mol_type = other DNA
ttattcgtctcagtatag

SEQ ID NO: 28491 - DNA, 18 bp, synthetic construct
  source 1..18: mol_type = other DNA
ttattctaatcactatag

SEQ ID NO: 28492 - DNA, 18 bp, synthetic construct
  source 1..18: mol_type = other DNA
ttattggactcacaatag

SEQ ID NO: 28493 - DNA, 18 bp, synthetic construct
  source 1..18: mol_type = other DNA
ttatttgactcattatag

SEQ ID NO: 28494 - DNA, 18 bp, synthetic construct
  source 1..18: mol_type = other DNA
ttttacgactcggtatag

SEQ ID NO: 28495 - DNA, 18 bp, synthetic construct
  source 1..18: mol_type = other DNA
aaaaacgactaattatag

SEQ ID NO: 28496 - DNA, 18 bp, synthetic construct
  source 1..18: mol_type = other DNA
aaaaacgactcacttaag

SEQ ID NO: 28497 - DNA, 18 bp, synthetic construct
  source 1..18: mol_type = other DNA
aaacacgactcagaatag

SEQ ID NO: 28498 - DNA, 18 bp, synthetic construct
  source 1..18: mol_type = other DNA
aaacacgccacactatag

SEQ ID NO: 28499 - DNA, 18 bp, synthetic construct
  source 1..18: mol_type = other DNA
aaacacgtatcactatag

SEQ ID NO: 28500 - DNA, 18 bp, synthetic construct
  source 1..18: mol_type = other DNA
aaacactactcacaatag

SEQ ID NO: 28501 - DNA, 18 bp, synthetic construct
  source 1..18: mol_type = other DNA
aaataagacacactatgg

SEQ ID NO: 28502 - DNA, 18 bp, synthetic construct
  source 1..18: mol_type = other DNA
aaatacatctcaccatag

SEQ ID NO: 28503 - DNA, 18 bp, synthetic construct
  source 1..18: mol_type = other DNA
aaataccactgaccatag

SEQ ID NO: 28504 - DNA, 18 bp, synthetic construct
  source 1..18: mol_type = other DNA
aaatacgaatcacttaag

SEQ ID NO: 28505 - DNA, 18 bp, synthetic construct
  source 1..18: mol_type = other DNA
aaatacgacacacgaaag

SEQ ID NO: 28506 - DNA, 18 bp, synthetic construct
  source 1..18: mol_type = other DNA
aaatacgacacattaaag

SEQ ID NO: 28507 - DNA, 18 bp, synthetic construct
  source 1..18: mol_type = other DNA
aaatacgaccctccatag

SEQ ID NO: 28508 - DNA, 18 bp, synthetic construct
  source 1..18: mol_type = other DNA
aaatacgactatctctag

SEQ ID NO: 28509 - DNA, 18 bp, synthetic construct
  source 1..18: mol_type = other DNA
aaatacgactcaaaagag

SEQ ID NO: 28510 - DNA, 18 bp, synthetic construct
  source 1..18: mol_type = other DNA
aaatacgactcaaattag

SEQ ID NO: 28511 - DNA, 18 bp, synthetic construct
  source 1..18: mol_type = other DNA
aaatacgactcaacgtag

SEQ ID NO: 28512 - DNA, 18 bp, synthetic construct
  source 1..18: mol_type = other DNA
aaatacgactcattgaag

SEQ ID NO: 28513 - DNA, 18 bp, synthetic construct
  source 1..18: mol_type = other DNA
aaatacgatacactatcg

SEQ ID NO: 28514 - DNA, 18 bp, synthetic construct
  source 1..18: mol_type = other DNA
aaatacgatacactgtag

SEQ ID NO: 28515 - DNA, 18 bp, synthetic construct
  source 1..18: mol_type = other DNA
aaatacgtcacaatatag

SEQ ID NO: 28516 - DNA, 18 bp, synthetic construct
  source 1..18: mol_type = other DNA
aaatacgtcacactaaag

SEQ ID NO: 28517 - DNA, 18 bp, synthetic construct
  source 1..18: mol_type = other DNA
aaatacgtctcaccttag

SEQ ID NO: 28518 - DNA, 18 bp, synthetic construct
  source 1..18: mol_type = other DNA
aaatacgtcttacaatag

SEQ ID NO: 28519 - DNA, 18 bp, synthetic construct
  source 1..18: mol_type = other DNA
aaatactactcactgcag

SEQ ID NO: 28520 - DNA, 18 bp, synthetic construct
  source 1..18: mol_type = other DNA
aaatactagtcactatcg

SEQ ID NO: 28521 - DNA, 18 bp, synthetic construct
  source 1..18: mol_type = other DNA
aaatatgaatcactacag

SEQ ID NO: 28522 - DNA, 18 bp, synthetic construct
  source 1..18: mol_type = other DNA
aaatccgacacacaatag

SEQ ID NO: 28523 - DNA, 18 bp, synthetic construct
  source 1..18: mol_type = other DNA
aaatccgtatcactatag

SEQ ID NO: 28524 - DNA, 18 bp, synthetic construct
  source 1..18: mol_type = other DNA
aaatgaaactcactatag

SEQ ID NO: 28525 - DNA, 18 bp, synthetic construct
  source 1..18: mol_type = other DNA
aaatgcaactcactaaag

SEQ ID NO: 28526 - DNA, 18 bp, synthetic construct
  source 1..18: mol_type = other DNA
aaatgcgtctcactttag

SEQ ID NO: 28527 - DNA, 18 bp, synthetic construct
  source 1..18: mol_type = other DNA
aaccacgactcacgatag

SEQ ID NO: 28528 - DNA, 18 bp, synthetic construct
  source 1..18: mol_type = other DNA
aagaacgacccactatag

SEQ ID NO: 28529 - DNA, 18 bp, synthetic construct
  source 1..18: mol_type = other DNA
aagtacgtcttactatag

SEQ ID NO: 28530 - DNA, 18 bp, synthetic construct
  source 1..18: mol_type = other DNA
aagtactacttactatag

SEQ ID NO: 28531 - DNA, 18 bp, synthetic construct
  source 1..18: mol_type = other DNA
aattacaactaactatag

SEQ ID NO: 28532 - DNA, 18 bp, synthetic construct
  source 1..18: mol_type = other DNA
aattaccactctctatag

SEQ ID NO: 28533 - DNA, 18 bp, synthetic construct
  source 1..18: mol_type = other DNA
aattacgactcataatag

SEQ ID NO: 28534 - DNA, 18 bp, synthetic construct
  source 1..18: mol_type = other DNA
aattccgtctcactatag

SEQ ID NO: 28535 - DNA, 18 bp, synthetic construct
  source 1..18: mol_type = other DNA
aattgcgactcacaatag

SEQ ID NO: 28536 - DNA, 18 bp, synthetic construct
  source 1..18: mol_type = other DNA
acataagtctcactatag

SEQ ID NO: 28537 - DNA, 18 bp, synthetic construct
  source 1..18: mol_type = other DNA
acatacaactctctatag

SEQ ID NO: 28538 - DNA, 18 bp, synthetic construct
  source 1..18: mol_type = other DNA
acatacgactccctagag

SEQ ID NO: 28539 - DNA, 18 bp, synthetic construct
  source 1..18: mol_type = other DNA
acatacgattcactgtag

SEQ ID NO: 28540 - DNA, 18 bp, synthetic construct
  source 1..18: mol_type = other DNA
acatgcgactcacaatag

SEQ ID NO: 28541 - DNA, 18 bp, synthetic construct
  source 1..18: mol_type = other DNA
acttactactcactatag

SEQ ID NO: 28542 - DNA, 18 bp, synthetic construct
  source 1..18: mol_type = other DNA
atagccgactcactatag

SEQ ID NO: 28543 - DNA, 18 bp, synthetic construct
  source 1..18: mol_type = other DNA
atatacaactctctatag

SEQ ID NO: 28544 - DNA, 18 bp, synthetic construct
  source 1..18: mol_type = other DNA
atatacgaatcactacag

SEQ ID NO: 28545 - DNA, 18 bp, synthetic construct
  source 1..18: mol_type = other DNA
atatgcgactaactatag

SEQ ID NO: 28546 - DNA, 18 bp, synthetic construct
  source 1..18: mol_type = other DNA
atttacgactaactatag

SEQ ID NO: 28547 - DNA, 18 bp, synthetic construct
  source 1..18: mol_type = other DNA
atttacggctcactatag

SEQ ID NO: 28548 - DNA, 18 bp, synthetic construct
  source 1..18: mol_type = other DNA
caataagtcacactatag

SEQ ID NO: 28549 - DNA, 18 bp, synthetic construct
  source 1..18: mol_type = other DNA
caataatacacactatag

SEQ ID NO: 28550 - DNA, 18 bp, synthetic construct
  source 1..18: mol_type = other DNA
caatacaaatcactttag

SEQ ID NO: 28551 - DNA, 18 bp, synthetic construct
  source 1..18: mol_type = other DNA
caatacaacatactatag

SEQ ID NO: 28552 - DNA, 18 bp, synthetic construct
  source 1..18: mol_type = other DNA
caatacgactctcttaag

SEQ ID NO: 28553 - DNA, 18 bp, synthetic construct
  source 1..18: mol_type = other DNA
caatacgacttactaacg

SEQ ID NO: 28554 - DNA, 18 bp, synthetic construct
  source 1..18: mol_type = other DNA
caatacgcctcaccaaag

SEQ ID NO: 28555 - DNA, 18 bp, synthetic construct
  source 1..18: mol_type = other DNA
caatacgtctcactaacg

SEQ ID NO: 28556 - DNA, 18 bp, synthetic construct
  source 1..18: mol_type = other DNA
caatatgtctcactaaag

SEQ ID NO: 28557 - DNA, 18 bp, synthetic construct
  source 1..18: mol_type = other DNA
caatgagactcactaaag

SEQ ID NO: 28558 - DNA, 18 bp, synthetic construct
  source 1..18: mol_type = other DNA
caatgcgagtcactatgg

SEQ ID NO: 28559 - DNA, 18 bp, synthetic construct
  source 1..18: mol_type = other DNA
caatgcgattcaccatag

SEQ ID NO: 28560 - DNA, 18 bp, synthetic construct
  source 1..18: mol_type = other DNA
cactacgacttactttag

SEQ ID NO: 28561 - DNA, 18 bp, synthetic construct
  source 1..18: mol_type = other DNA
cagtacgaatcactttag

SEQ ID NO: 28562 - DNA, 18 bp, synthetic construct
  source 1..18: mol_type = other DNA
cattacgacttattatag

SEQ ID NO: 28563 - DNA, 18 bp, synthetic construct
  source 1..18: mol_type = other DNA
cattaggactctctatag

SEQ ID NO: 28564 - DNA, 18 bp, synthetic construct
  source 1..18: mol_type = other DNA
cattaggtctcactatag

SEQ ID NO: 28565 - DNA, 18 bp, synthetic construct
  source 1..18: mol_type = other DNA
ccatacgactaactaaag

SEQ ID NO: 28566 - DNA, 18 bp, synthetic construct
  source 1..18: mol_type = other DNA
ctataagtctcactatag

SEQ ID NO: 28567 - DNA, 18 bp, synthetic construct
  source 1..18: mol_type = other DNA
ctatacgcttcactatag

SEQ ID NO: 28568 - DNA, 18 bp, synthetic construct
  source 1..18: mol_type = other DNA
gaaaacgactcatgatag

SEQ ID NO: 28569 - DNA, 18 bp, synthetic construct
  source 1..18: mol_type = other DNA
gaatacgacactctttag

SEQ ID NO: 28570 - DNA, 18 bp, synthetic construct
  source 1..18: mol_type = other DNA
gaatactacttactaaag

SEQ ID NO: 28571 - DNA, 18 bp, synthetic construct
  source 1..18: mol_type = other DNA
gagtaagtctcactatag

SEQ ID NO: 28572 - DNA, 18 bp, synthetic construct
  source 1..18: mol_type = other DNA
gtatacgattcattatag

SEQ ID NO: 28573 - DNA, 18 bp, synthetic construct
  source 1..18: mol_type = other DNA
taaaaagacccattatag

SEQ ID NO: 28574 - DNA, 18 bp, synthetic construct
  source 1..18: mol_type = other DNA
taaaacatcacactatag

SEQ ID NO: 28575 - DNA, 18 bp, synthetic construct
  source 1..18: mol_type = other DNA
taaaacgaaacactctag

SEQ ID NO: 28576 - DNA, 18 bp, synthetic construct
  source 1..18: mol_type = other DNA
taaaacgacacattatgg

SEQ ID NO: 28577 - DNA, 18 bp, synthetic construct
  source 1..18: mol_type = other DNA
taaaacgaccctctatcg

SEQ ID NO: 28578 - DNA, 18 bp, synthetic construct
  source 1..18: mol_type = other DNA
taaaacgactcaaattag

SEQ ID NO: 28579 - DNA, 18 bp, synthetic construct
  source 1..18: mol_type = other DNA
taaaacgactccatacag

SEQ ID NO: 28580 - DNA, 18 bp, synthetic construct
  source 1..18: mol_type = other DNA
taaaacgactccgtttag

SEQ ID NO: 28581 - DNA, 18 bp, synthetic construct
  source 1..18: mol_type = other DNA
taaaacgactctctaacg

SEQ ID NO: 28582 - DNA, 18 bp, synthetic construct
  source 1..18: mol_type = other DNA
taaaacgactttctgtag

SEQ ID NO: 28583 - DNA, 18 bp, synthetic construct
  source 1..18: mol_type = other DNA
taaaacgatccacaatag

SEQ ID NO: 28584 - DNA, 18 bp, synthetic construct
  source 1..18: mol_type = other DNA
taaaacgatgcactacag

SEQ ID NO: 28585 - DNA, 18 bp, synthetic construct
  source 1..18: mol_type = other DNA
taaaacgattctccatag

SEQ ID NO: 28586 - DNA, 18 bp, synthetic construct
  source 1..18: mol_type = other DNA
taaaacgcctcattgtag

SEQ ID NO: 28587 - DNA, 18 bp, synthetic construct
  source 1..18: mol_type = other DNA
taaaacgcctccctatgg

SEQ ID NO: 28588 - DNA, 18 bp, synthetic construct
  source 1..18: mol_type = other DNA
taaaacggctacctatag

SEQ ID NO: 28589 - DNA, 18 bp, synthetic construct
  source 1..18: mol_type = other DNA
taaaacggttcaccatag

SEQ ID NO: 28590 - DNA, 18 bp, synthetic construct
  source 1..18: mol_type = other DNA
taaaactactcacaacag

SEQ ID NO: 28591 - DNA, 18 bp, synthetic construct
  source 1..18: mol_type = other DNA
taaaactactcaccacag

SEQ ID NO: 28592 - DNA, 18 bp, synthetic construct
  source 1..18: mol_type = other DNA
taaaactactctctgtag

SEQ ID NO: 28593 - DNA, 18 bp, synthetic construct
  source 1..18: mol_type = other DNA
taaaactacttaatatag

SEQ ID NO: 28594 - DNA, 18 bp, synthetic construct
  source 1..18: mol_type = other DNA
taaaaggactcattttag

SEQ ID NO: 28595 - DNA, 18 bp, synthetic construct
  source 1..18: mol_type = other DNA
taaaaggagtcactttag

SEQ ID NO: 28596 - DNA, 18 bp, synthetic construct
  source 1..18: mol_type = other DNA
taaaagtactaactatag

SEQ ID NO: 28597 - DNA, 18 bp, synthetic construct
  source 1..18: mol_type = other DNA
taaaatgactctctttag

SEQ ID NO: 28598 - DNA, 18 bp, synthetic construct
  source 1..18: mol_type = other DNA
taaaccgactcataatag

SEQ ID NO: 28599 - DNA, 18 bp, synthetic construct
  source 1..18: mol_type = other DNA
taaaccgtcacactatag

SEQ ID NO: 28600 - DNA, 18 bp, synthetic construct
  source 1..18: mol_type = other DNA
taaagccactcactaaag

SEQ ID NO: 28601 - DNA, 18 bp, synthetic construct
  source 1..18: mol_type = other DNA
taaagcgactcaataaag

SEQ ID NO: 28602 - DNA, 18 bp, synthetic construct
  source 1..18: mol_type = other DNA
taaagtgactcactacag

SEQ ID NO: 28603 - DNA, 18 bp, synthetic construct
  source 1..18: mol_type = other DNA
taaagtgactcactttag

SEQ ID NO: 28604 - DNA, 18 bp, synthetic construct
  source 1..18: mol_type = other DNA
taacaccactccatatag

SEQ ID NO: 28605 - DNA, 18 bp, synthetic construct
  source 1..18: mol_type = other DNA
taacacgactcattaacg

SEQ ID NO: 28606 - DNA, 18 bp, synthetic construct
  source 1..18: mol_type = other DNA
taacacgtctcactgaag

SEQ ID NO: 28607 - DNA, 18 bp, synthetic construct
  source 1..18: mol_type = other DNA
taacattactctctatag

SEQ ID NO: 28608 - DNA, 18 bp, synthetic construct
  source 1..18: mol_type = other DNA
taagacgacttataatag

SEQ ID NO: 28609 - DNA, 18 bp, synthetic construct
  source 1..18: mol_type = other DNA
taataaaacacattatag

SEQ ID NO: 28610 - DNA, 18 bp, synthetic construct
  source 1..18: mol_type = other DNA
taataaaacccactttag

SEQ ID NO: 28611 - DNA, 18 bp, synthetic construct
  source 1..18: mol_type = other DNA
taataaacctcactaaag

SEQ ID NO: 28612 - DNA, 18 bp, synthetic construct
  source 1..18: mol_type = other DNA
taataagaatctctaaag

SEQ ID NO: 28613 - DNA, 18 bp, synthetic construct
  source 1..18: mol_type = other DNA
taataagacacactaccg

SEQ ID NO: 28614 - DNA, 18 bp, synthetic construct
  source 1..18: mol_type = other DNA
taataagactgtatatag

SEQ ID NO: 28615 - DNA, 18 bp, synthetic construct
  source 1..18: mol_type = other DNA
taataagagtaactaaag

SEQ ID NO: 28616 - DNA, 18 bp, synthetic construct
  source 1..18: mol_type = other DNA
taataagtcactctatag

SEQ ID NO: 28617 - DNA, 18 bp, synthetic construct
  source 1..18: mol_type = other DNA
taataagtcttcctatag

SEQ ID NO: 28618 - DNA, 18 bp, synthetic construct
  source 1..18: mol_type = other DNA
taataagtgacactatag

SEQ ID NO: 28619 - DNA, 18 bp, synthetic construct
  source 1..18: mol_type = other DNA
taataagtgtaactatag

SEQ ID NO: 28620 - DNA, 18 bp, synthetic construct
  source 1..18: mol_type = other DNA
taatacaactctctgaag

SEQ ID NO: 28621 - DNA, 18 bp, synthetic construct
  source 1..18: mol_type = other DNA
taatacaattcaaaatag

SEQ ID NO: 28622 - DNA, 18 bp, synthetic construct
  source 1..18: mol_type = other DNA
taatacaatttactttag

SEQ ID NO: 28623 - DNA, 18 bp, synthetic construct
  source 1..18: mol_type = other DNA
taatacagcttagtatag

SEQ ID NO: 28624 - DNA, 18 bp, synthetic construct
  source 1..18: mol_type = other DNA
taatacatctcattttag

SEQ ID NO: 28625 - DNA, 18 bp, synthetic construct
  source 1..18: mol_type = other DNA
taataccaattactttag

SEQ ID NO: 28626 - DNA, 18 bp, synthetic construct
  source 1..18: mol_type = other DNA
taataccactctcaaaag

SEQ ID NO: 28627 - DNA, 18 bp, synthetic construct
  source 1..18: mol_type = other DNA
taataccactctttaaag

SEQ ID NO: 28628 - DNA, 18 bp, synthetic construct
  source 1..18: mol_type = other DNA
taatacctatcacaatag

SEQ ID NO: 28629 - DNA, 18 bp, synthetic construct
  source 1..18: mol_type = other DNA
taatacctcagactatag

SEQ ID NO: 28630 - DNA, 18 bp, synthetic construct
  source 1..18: mol_type = other DNA
taatacctttaactatag

SEQ ID NO: 28631 - DNA, 18 bp, synthetic construct
  source 1..18: mol_type = other DNA
taatacgaatcacctaag

SEQ ID NO: 28632 - DNA, 18 bp, synthetic construct
  source 1..18: mol_type = other DNA
taatacgaatcataacag

SEQ ID NO: 28633 - DNA, 18 bp, synthetic construct
  source 1..18: mol_type = other DNA
taatacgaatcattgaag

SEQ ID NO: 28634 - DNA, 18 bp, synthetic construct
  source 1..18: mol_type = other DNA
taatacgacaaactttcg

SEQ ID NO: 28635 - DNA, 18 bp, synthetic construct
  source 1..18: mol_type = other DNA
taatacgacaatctaaag

SEQ ID NO: 28636 - DNA, 18 bp, synthetic construct
  source 1..18: mol_type = other DNA
taatacgacacaattaag

SEQ ID NO: 28637 - DNA, 18 bp, synthetic construct
  source 1..18: mol_type = other DNA
taatacgacagaatagag

SEQ ID NO: 28638 - DNA, 18 bp, synthetic construct
  source 1..18: mol_type = other DNA
taatacgacctacttaag

SEQ ID NO: 28639 - DNA, 18 bp, synthetic construct
  source 1..18: mol_type = other DNA
taatacgactcaattgcg

SEQ ID NO: 28640 - DNA, 18 bp, synthetic construct
  source 1..18: mol_type = other DNA
taatacgactcacacagg

SEQ ID NO: 28641 - DNA, 18 bp, synthetic construct
  source 1..18: mol_type = other DNA
taatacgactcatacaag

SEQ ID NO: 28642 - DNA, 18 bp, synthetic construct
  source 1..18: mol_type = other DNA
taatacgactgtttatgg

SEQ ID NO: 28643 - DNA, 18 bp, synthetic construct
  source 1..18: mol_type = other DNA
taatacgactttttatcg

SEQ ID NO: 28644 - DNA, 18 bp, synthetic construct
  source 1..18: mol_type = other DNA
taatacgaggctctaaag

SEQ ID NO: 28645 - DNA, 18 bp, synthetic construct
  source 1..18: mol_type = other DNA
taatacgagtctctttcg

SEQ ID NO: 28646 - DNA, 18 bp, synthetic construct
  source 1..18: mol_type = other DNA
taatacgatacacttaag

SEQ ID NO: 28647 - DNA, 18 bp, synthetic construct
  source 1..18: mol_type = other DNA
taatacgattccatctag

SEQ ID NO: 28648 - DNA, 18 bp, synthetic construct
  source 1..18: mol_type = other DNA
taatacgattctatctag

SEQ ID NO: 28649 - DNA, 18 bp, synthetic construct
  source 1..18: mol_type = other DNA
taatacgcattaatatag

SEQ ID NO: 28650 - DNA, 18 bp, synthetic construct
  source 1..18: mol_type = other DNA
taatacgtcacattaaag

SEQ ID NO: 28651 - DNA, 18 bp, synthetic construct
  source 1..18: mol_type = other DNA
taatacgtcactcgatag

SEQ ID NO: 28652 - DNA, 18 bp, synthetic construct
  source 1..18: mol_type = other DNA
taatacgtccctttatag

SEQ ID NO: 28653 - DNA, 18 bp, synthetic construct
  source 1..18: mol_type = other DNA
taatacgtccgactttag

SEQ ID NO: 28654 - DNA, 18 bp, synthetic construct
  source 1..18: mol_type = other DNA
taatacgtctaacaatcg

SEQ ID NO: 28655 - DNA, 18 bp, synthetic construct
  source 1..18: mol_type = other DNA
taatacgtctcattaacg

SEQ ID NO: 28656 - DNA, 18 bp, synthetic construct
  source 1..18: mol_type = other DNA
taatacgtgagactatag

SEQ ID NO: 28657 - DNA, 18 bp, synthetic construct
  source 1..18: mol_type = other DNA
taatacgtgtacctatag

SEQ ID NO: 28658 - DNA, 18 bp, synthetic construct
  source 1..18: mol_type = other DNA
taatacgtgtcacgttag

SEQ ID NO: 28659 - DNA, 18 bp, synthetic construct
  source 1..18: mol_type = other DNA
taatacgttttacaatag

SEQ ID NO: 28660 - DNA, 18 bp, synthetic construct
  source 1..18: mol_type = other DNA
taatactaatctctatgg

SEQ ID NO: 28661 - DNA, 18 bp, synthetic construct
  source 1..18: mol_type = other DNA
taatactacccacactag

SEQ ID NO: 28662 - DNA, 18 bp, synthetic construct
  source 1..18: mol_type = other DNA
taatactactcacttacg

SEQ ID NO: 28663 - DNA, 18 bp, synthetic construct
  source 1..18: mol_type = other DNA
taatactactcattcgag

SEQ ID NO: 28664 - DNA, 18 bp, synthetic construct
  source 1..18: mol_type = other DNA
taatactactctttacag

SEQ ID NO: 28665 - DNA, 18 bp, synthetic construct
  source 1..18: mol_type = other DNA
taatactacttagtttag

SEQ ID NO: 28666 - DNA, 18 bp, synthetic construct
  source 1..18: mol_type = other DNA
taatactattcacgaaag

SEQ ID NO: 28667 - DNA, 18 bp, synthetic construct
  source 1..18: mol_type = other DNA
taatacttataactatag

SEQ ID NO: 28668 - DNA, 18 bp, synthetic construct
  source 1..18: mol_type = other DNA
taatacttatcactaaag

SEQ ID NO: 28669 - DNA, 18 bp, synthetic construct
  source 1..18: mol_type = other DNA
taataggattcattttag

SEQ ID NO: 28670 - DNA, 18 bp, synthetic construct
  source 1..18: mol_type = other DNA
taatagtacacactacag

SEQ ID NO: 28671 - DNA, 18 bp, synthetic construct
  source 1..18: mol_type = other DNA
taatagtacatactatag

SEQ ID NO: 28672 - DNA, 18 bp, synthetic construct
  source 1..18: mol_type = other DNA
taatagtactcattaaag

SEQ ID NO: 28673 - DNA, 18 bp, synthetic construct
  source 1..18: mol_type = other DNA
taatagttctcattatag

SEQ ID NO: 28674 - DNA, 18 bp, synthetic construct
  source 1..18: mol_type = other DNA
taatataacaaactatag

SEQ ID NO: 28675 - DNA, 18 bp, synthetic construct
  source 1..18: mol_type = other DNA
taatatcactcacaaaag

SEQ ID NO: 28676 - DNA, 18 bp, synthetic construct
  source 1..18: mol_type = other DNA
taatatctctcaatatag

SEQ ID NO: 28677 - DNA, 18 bp, synthetic construct
  source 1..18: mol_type = other DNA
taatatgaatcactttgg

SEQ ID NO: 28678 - DNA, 18 bp, synthetic construct
  source 1..18: mol_type = other DNA
taatatgacacaccaaag

SEQ ID NO: 28679 - DNA, 18 bp, synthetic construct
  source 1..18: mol_type = other DNA
taatatgactaacattag

SEQ ID NO: 28680 - DNA, 18 bp, synthetic construct
  source 1..18: mol_type = other DNA
taatatgacttactttcg

SEQ ID NO: 28681 - DNA, 18 bp, synthetic construct
  source 1..18: mol_type = other DNA
taatatgagtcacattag

SEQ ID NO: 28682 - DNA, 18 bp, synthetic construct
  source 1..18: mol_type = other DNA
taatatttctgactatag

SEQ ID NO: 28683 - DNA, 18 bp, synthetic construct
  source 1..18: mol_type = other DNA
taatcagacactctatag

SEQ ID NO: 28684 - DNA, 18 bp, synthetic construct
  source 1..18: mol_type = other DNA
taatccaactctctagag

SEQ ID NO: 28685 - DNA, 18 bp, synthetic construct
  source 1..18: mol_type = other DNA
taatcccactcaccttag

SEQ ID NO: 28686 - DNA, 18 bp, synthetic construct
  source 1..18: mol_type = other DNA
taatccgactgataatag

SEQ ID NO: 28687 - DNA, 18 bp, synthetic construct
  source 1..18: mol_type = other DNA
taatccgtctctctgtag

SEQ ID NO: 28688 - DNA, 18 bp, synthetic construct
  source 1..18: mol_type = other DNA
taatcctacttactttag

SEQ ID NO: 28689 - DNA, 18 bp, synthetic construct
  source 1..18: mol_type = other DNA
taatgcgaatctccatag

SEQ ID NO: 28690 - DNA, 18 bp, synthetic construct
  source 1..18: mol_type = other DNA
taatgcgacactatatag

SEQ ID NO: 28691 - DNA, 18 bp, synthetic construct
  source 1..18: mol_type = other DNA
taatgcgactccctcaag

SEQ ID NO: 28692 - DNA, 18 bp, synthetic construct
  source 1..18: mol_type = other DNA
taatgcgtcacactttag

SEQ ID NO: 28693 - DNA, 18 bp, synthetic construct
  source 1..18: mol_type = other DNA
taatgcttatcactatag

SEQ ID NO: 28694 - DNA, 18 bp, synthetic construct
  source 1..18: mol_type = other DNA
taatgtgaatctctatag

SEQ ID NO: 28695 - DNA, 18 bp, synthetic construct
  source 1..18: mol_type = other DNA
tactaagactcattaaag

SEQ ID NO: 28696 - DNA, 18 bp, synthetic construct
  source 1..18: mol_type = other DNA
tactacctctcactttag

SEQ ID NO: 28697 - DNA, 18 bp, synthetic construct
  source 1..18: mol_type = other DNA
tactacgactctagatag

SEQ ID NO: 28698 - DNA, 18 bp, synthetic construct
  source 1..18: mol_type = other DNA
tactacgactttctaaag

SEQ ID NO: 28699 - DNA, 18 bp, synthetic construct
  source 1..18: mol_type = other DNA
tactacgtcccactttag

SEQ ID NO: 28700 - DNA, 18 bp, synthetic construct
  source 1..18: mol_type = other DNA
tactactcctaactatag

SEQ ID NO: 28701 - DNA, 18 bp, synthetic construct
  source 1..18: mol_type = other DNA
tactccgattaactatag

SEQ ID NO: 28702 - DNA, 18 bp, synthetic construct
  source 1..18: mol_type = other DNA
tactgcgacactctatag

SEQ ID NO: 28703 - DNA, 18 bp, synthetic construct
  source 1..18: mol_type = other DNA
tagaaagacacactatag

SEQ ID NO: 28704 - DNA, 18 bp, synthetic construct
  source 1..18: mol_type = other DNA
tagaacttctcactatag

SEQ ID NO: 28705 - DNA, 18 bp, synthetic construct
  source 1..18: mol_type = other DNA
tagcatgactaactatag

SEQ ID NO: 28706 - DNA, 18 bp, synthetic construct
  source 1..18: mol_type = other DNA
tagtacgacttcctgtag

SEQ ID NO: 28707 - DNA, 18 bp, synthetic construct
  source 1..18: mol_type = other DNA
tagtacgtcatactatag

SEQ ID NO: 28708 - DNA, 18 bp, synthetic construct
  source 1..18: mol_type = other DNA
tagtacgtctaagtatag

SEQ ID NO: 28709 - DNA, 18 bp, synthetic construct
  source 1..18: mol_type = other DNA
tagtacgtctctatatag

SEQ ID NO: 28710 - DNA, 18 bp, synthetic construct
  source 1..18: mol_type = other DNA
tagtacgtgttactatag

SEQ ID NO: 28711 - DNA, 18 bp, synthetic construct
  source 1..18: mol_type = other DNA
tagtactattcactctag

SEQ ID NO: 28712 - DNA, 18 bp, synthetic construct
  source 1..18: mol_type = other DNA
tagtactccacactatag

SEQ ID NO: 28713 - DNA, 18 bp, synthetic construct
  source 1..18: mol_type = other DNA
tagtataactcactatgg

SEQ ID NO: 28714 - DNA, 18 bp, synthetic construct
  source 1..18: mol_type = other DNA
tataaagactcactctag

SEQ ID NO: 28715 - DNA, 18 bp, synthetic construct
  source 1..18: mol_type = other DNA
tataaagactcactttag

SEQ ID NO: 28716 - DNA, 18 bp, synthetic construct
  source 1..18: mol_type = other DNA
tataacaagtcactatag

SEQ ID NO: 28717 - DNA, 18 bp, synthetic construct
  source 1..18: mol_type = other DNA
tataacgacccactttag

SEQ ID NO: 28718 - DNA, 18 bp, synthetic construct
  source 1..18: mol_type = other DNA
tataacgactcagcatag

SEQ ID NO: 28719 - DNA, 18 bp, synthetic construct
  source 1..18: mol_type = other DNA
tataacgattcactatcg

SEQ ID NO: 28720 - DNA, 18 bp, synthetic construct
  source 1..18: mol_type = other DNA
tataccgactaactatag

SEQ ID NO: 28721 - DNA, 18 bp, synthetic construct
  source 1..18: mol_type = other DNA
tatagcgactcactttag

SEQ ID NO: 28722 - DNA, 18 bp, synthetic construct
  source 1..18: mol_type = other DNA
tatagcgactctctatag

SEQ ID NO: 28723 - DNA, 18 bp, synthetic construct
  source 1..18: mol_type = other DNA
tatcacggcttactatag

SEQ ID NO: 28724 - DNA, 18 bp, synthetic construct
  source 1..18: mol_type = other DNA
tatcatgactctctatag

SEQ ID NO: 28725 - DNA, 18 bp, synthetic construct
  source 1..18: mol_type = other DNA
tatgacgactaaatatag

SEQ ID NO: 28726 - DNA, 18 bp, synthetic construct
  source 1..18: mol_type = other DNA
tattaagaatcaatatag

SEQ ID NO: 28727 - DNA, 18 bp, synthetic construct
  source 1..18: mol_type = other DNA
tattaagactcacaacag

SEQ ID NO: 28728 - DNA, 18 bp, synthetic construct
  source 1..18: mol_type = other DNA
tattaagactcactcaag

SEQ ID NO: 28729 - DNA, 18 bp, synthetic construct
  source 1..18: mol_type = other DNA
tattaagactcacttcag

SEQ ID NO: 28730 - DNA, 18 bp, synthetic construct
  source 1..18: mol_type = other DNA
tattacaacagactatag

SEQ ID NO: 28731 - DNA, 18 bp, synthetic construct
  source 1..18: mol_type = other DNA
tattacaactatctatag

SEQ ID NO: 28732 - DNA, 18 bp, synthetic construct
  source 1..18: mol_type = other DNA
tattacaacttactacag

SEQ ID NO: 28733 - DNA, 18 bp, synthetic construct
  source 1..18: mol_type = other DNA
tattacaagtcaccatag

SEQ ID NO: 28734 - DNA, 18 bp, synthetic construct
  source 1..18: mol_type = other DNA
tattacacctcaatatag

SEQ ID NO: 28735 - DNA, 18 bp, synthetic construct
  source 1..18: mol_type = other DNA
tattacgactatctacag

SEQ ID NO: 28736 - DNA, 18 bp, synthetic construct
  source 1..18: mol_type = other DNA
tattacgagtctcaatag

SEQ ID NO: 28737 - DNA, 18 bp, synthetic construct
  source 1..18: mol_type = other DNA
tattacgattcacaaaag

SEQ ID NO: 28738 - DNA, 18 bp, synthetic construct
  source 1..18: mol_type = other DNA
tattacgccacactatcg

SEQ ID NO: 28739 - DNA, 18 bp, synthetic construct
  source 1..18: mol_type = other DNA
tattacgcctttctatag

SEQ ID NO: 28740 - DNA, 18 bp, synthetic construct
  source 1..18: mol_type = other DNA
tattacgtctgaatatag

SEQ ID NO: 28741 - DNA, 18 bp, synthetic construct
  source 1..18: mol_type = other DNA
tattacgtgttactatag

SEQ ID NO: 28742 - DNA, 18 bp, synthetic construct
  source 1..18: mol_type = other DNA
tattactaatcaccatag

SEQ ID NO: 28743 - DNA, 18 bp, synthetic construct
  source 1..18: mol_type = other DNA
tattactacacactagag

SEQ ID NO: 28744 - DNA, 18 bp, synthetic construct
  source 1..18: mol_type = other DNA
tattactactcacaatcg

SEQ ID NO: 28745 - DNA, 18 bp, synthetic construct
  source 1..18: mol_type = other DNA
tattactattgactatag

SEQ ID NO: 28746 - DNA, 18 bp, synthetic construct
  source 1..18: mol_type = other DNA
tattacttctcactctag

SEQ ID NO: 28747 - DNA, 18 bp, synthetic construct
  source 1..18: mol_type = other DNA
tattcccattcactatag

SEQ ID NO: 28748 - DNA, 18 bp, synthetic construct
  source 1..18: mol_type = other DNA
tattccgactcattacag

SEQ ID NO: 28749 - DNA, 18 bp, synthetic construct
  source 1..18: mol_type = other DNA
tattcctactcacaatag

SEQ ID NO: 28750 - DNA, 18 bp, synthetic construct
  source 1..18: mol_type = other DNA
tattgcgactcataatag

SEQ ID NO: 28751 - DNA, 18 bp, synthetic construct
  source 1..18: mol_type = other DNA
tcaaacgactctctttag

SEQ ID NO: 28752 - DNA, 18 bp, synthetic construct
  source 1..18: mol_type = other DNA
tcaaacgtcacactatag

SEQ ID NO: 28753 - DNA, 18 bp, synthetic construct
  source 1..18: mol_type = other DNA
tcaaactactcactacag

SEQ ID NO: 28754 - DNA, 18 bp, synthetic construct
  source 1..18: mol_type = other DNA
tcataagattcactttag

SEQ ID NO: 28755 - DNA, 18 bp, synthetic construct
  source 1..18: mol_type = other DNA
tcatacaactcaataaag

SEQ ID NO: 28756 - DNA, 18 bp, synthetic construct
  source 1..18: mol_type = other DNA
tcatacgacaatctatag

SEQ ID NO: 28757 - DNA, 18 bp, synthetic construct
  source 1..18: mol_type = other DNA
tcatacgaccaactttag

SEQ ID NO: 28758 - DNA, 18 bp, synthetic construct
  source 1..18: mol_type = other DNA
tcatacgaccgacaatag

SEQ ID NO: 28759 - DNA, 18 bp, synthetic construct
  source 1..18: mol_type = other DNA
tcatacgacttaaaatag

SEQ ID NO: 28760 - DNA, 18 bp, synthetic construct
  source 1..18: mol_type = other DNA
tcatacgacttattacag

SEQ ID NO: 28761 - DNA, 18 bp, synthetic construct
  source 1..18: mol_type = other DNA
tcatacgattcattttag

SEQ ID NO: 28762 - DNA, 18 bp, synthetic construct
  source 1..18: mol_type = other DNA
tcatatgactcacaacag

SEQ ID NO: 28763 - DNA, 18 bp, synthetic construct
  source 1..18: mol_type = other DNA
tcatccatctcactatag

SEQ ID NO: 28764 - DNA, 18 bp, synthetic construct
  source 1..18: mol_type = other DNA
tcttacgactcacttaag

SEQ ID NO: 28765 - DNA, 18 bp, synthetic construct
  source 1..18: mol_type = other DNA
tgaaacaactcattatag

SEQ ID NO: 28766 - DNA, 18 bp, synthetic construct
  source 1..18: mol_type = other DNA
tgaaacaactctctatag

SEQ ID NO: 28767 - DNA, 18 bp, synthetic construct
  source 1..18: mol_type = other DNA
tgaaacgactcactaccg

SEQ ID NO: 28768 - DNA, 18 bp, synthetic construct
  source 1..18: mol_type = other DNA
tgaaacgccccactatag

SEQ ID NO: 28769 - DNA, 18 bp, synthetic construct
  source 1..18: mol_type = other DNA
tgagacgactcagcatag

SEQ ID NO: 28770 - DNA, 18 bp, synthetic construct
  source 1..18: mol_type = other DNA
tgataagtttcactatag

SEQ ID NO: 28771 - DNA, 18 bp, synthetic construct
  source 1..18: mol_type = other DNA
tgatacaacacaatatag

SEQ ID NO: 28772 - DNA, 18 bp, synthetic construct
  source 1..18: mol_type = other DNA
tgatacaactcactttcg

SEQ ID NO: 28773 - DNA, 18 bp, synthetic construct
  source 1..18: mol_type = other DNA
tgatacatctctctatag

SEQ ID NO: 28774 - DNA, 18 bp, synthetic construct
  source 1..18: mol_type = other DNA
tgatacgcttcactaaag

SEQ ID NO: 28775 - DNA, 18 bp, synthetic construct
  source 1..18: mol_type = other DNA
tgatacttctcactttag

SEQ ID NO: 28776 - DNA, 18 bp, synthetic construct
  source 1..18: mol_type = other DNA
tgatccgacttactaaag

SEQ ID NO: 28777 - DNA, 18 bp, synthetic construct
  source 1..18: mol_type = other DNA
tgtaactactcactatag

SEQ ID NO: 28778 - DNA, 18 bp, synthetic construct
  source 1..18: mol_type = other DNA
tgttacgactaactctag

SEQ ID NO: 28779 - DNA, 18 bp, synthetic construct
  source 1..18: mol_type = other DNA
tgttccgactcactatgg

SEQ ID NO: 28780 - DNA, 18 bp, synthetic construct
  source 1..18: mol_type = other DNA
ttaaacgacaaactatag

SEQ ID NO: 28781 - DNA, 18 bp, synthetic construct
  source 1..18: mol_type = other DNA
ttaaacgtcgcactatag

SEQ ID NO: 28782 - DNA, 18 bp, synthetic construct
  source 1..18: mol_type = other DNA
ttaaaggactcactgtag

SEQ ID NO: 28783 - DNA, 18 bp, synthetic construct
  source 1..18: mol_type = other DNA
ttacacaactctctatag

SEQ ID NO: 28784 - DNA, 18 bp, synthetic construct
  source 1..18: mol_type = other DNA
ttacacgactccctttag

SEQ ID NO: 28785 - DNA, 18 bp, synthetic construct
  source 1..18: mol_type = other DNA
ttacacgtcacactatag

SEQ ID NO: 28786 - DNA, 18 bp, synthetic construct
  source 1..18: mol_type = other DNA
ttacacgtctcactagag

SEQ ID NO: 28787 - DNA, 18 bp, synthetic construct
  source 1..18: mol_type = other DNA
ttacatgcctcactatag

SEQ ID NO: 28788 - DNA, 18 bp, synthetic construct
  source 1..18: mol_type = other DNA
ttaggcgactaactatag

SEQ ID NO: 28789 - DNA, 18 bp, synthetic construct
  source 1..18: mol_type = other DNA
ttataaacctcactatag

SEQ ID NO: 28790 - DNA, 18 bp, synthetic construct
  source 1..18: mol_type = other DNA
ttataagactgattatag

SEQ ID NO: 28791 - DNA, 18 bp, synthetic construct
  source 1..18: mol_type = other DNA
ttatacaaatcactttag

SEQ ID NO: 28792 - DNA, 18 bp, synthetic construct
  source 1..18: mol_type = other DNA
ttatacaacttaatatag

SEQ ID NO: 28793 - DNA, 18 bp, synthetic construct
  source 1..18: mol_type = other DNA
ttataccacacaatatag

SEQ ID NO: 28794 - DNA, 18 bp, synthetic construct
  source 1..18: mol_type = other DNA
ttataccacctactatag

SEQ ID NO: 28795 - DNA, 18 bp, synthetic construct
  source 1..18: mol_type = other DNA
ttatacgaatcattatcg

SEQ ID NO: 28796 - DNA, 18 bp, synthetic construct
  source 1..18: mol_type = other DNA
ttatacgaatgactacag

SEQ ID NO: 28797 - DNA, 18 bp, synthetic construct
  source 1..18: mol_type = other DNA
ttatacgacgaaatatag

SEQ ID NO: 28798 - DNA, 18 bp, synthetic construct
  source 1..18: mol_type = other DNA
ttatacgattccccatag

SEQ ID NO: 28799 - DNA, 18 bp, synthetic construct
  source 1..18: mol_type = other DNA
ttatacgattctctaaag

SEQ ID NO: 28800 - DNA, 18 bp, synthetic construct
  source 1..18: mol_type = other DNA
ttatacggctcactccag

SEQ ID NO: 28801 - DNA, 18 bp, synthetic construct
  source 1..18: mol_type = other DNA
ttatacggctccttatag

SEQ ID NO: 28802 - DNA, 18 bp, synthetic construct
  source 1..18: mol_type = other DNA
ttatacgtatcactatgg

SEQ ID NO: 28803 - DNA, 18 bp, synthetic construct
  source 1..18: mol_type = other DNA
ttatacgtctaaccatag

SEQ ID NO: 28804 - DNA, 18 bp, synthetic construct
  source 1..18: mol_type = other DNA
ttatacgtctgactatcg

SEQ ID NO: 28805 - DNA, 18 bp, synthetic construct
  source 1..18: mol_type = other DNA
ttatacgtttcactatcg

SEQ ID NO: 28806 - DNA, 18 bp, synthetic construct
  source 1..18: mol_type = other DNA
ttatactccacactatag

SEQ ID NO: 28807 - DNA, 18 bp, synthetic construct
  source 1..18: mol_type = other DNA
ttatacttctaactatag

SEQ ID NO: 28808 - DNA, 18 bp, synthetic construct
  source 1..18: mol_type = other DNA
ttataggactcactccag

SEQ ID NO: 28809 - DNA, 18 bp, synthetic construct
  source 1..18: mol_type = other DNA
ttatagggctcacaatag

SEQ ID NO: 28810 - DNA, 18 bp, synthetic construct
  source 1..18: mol_type = other DNA
ttatatcactctctatag

SEQ ID NO: 28811 - DNA, 18 bp, synthetic construct
  source 1..18: mol_type = other DNA
ttatatctctcactatag

SEQ ID NO: 28812 - DNA, 18 bp, synthetic construct
  source 1..18: mol_type = other DNA
ttatatgactcactctcg

SEQ ID NO: 28813 - DNA, 18 bp, synthetic construct
  source 1..18: mol_type = other DNA
ttatatgacttactatcg

SEQ ID NO: 28814 - DNA, 18 bp, synthetic construct
  source 1..18: mol_type = other DNA
ttatatgtctcactctag

SEQ ID NO: 28815 - DNA, 18 bp, synthetic construct
  source 1..18: mol_type = other DNA
ttatccgcctcactacag

SEQ ID NO: 28816 - DNA, 18 bp, synthetic construct
  source 1..18: mol_type = other DNA
ttatccggctcactaaag

SEQ ID NO: 28817 - DNA, 18 bp, synthetic construct
  source 1..18: mol_type = other DNA
ttatccggctcactttag

SEQ ID NO: 28818 - DNA, 18 bp, synthetic construct
  source 1..18: mol_type = other DNA
ttatccgtctaactatag

SEQ ID NO: 28819 - DNA, 18 bp, synthetic construct
  source 1..18: mol_type = other DNA
ttatgcgactctccatag

SEQ ID NO: 28820 - DNA, 18 bp, synthetic construct
  source 1..18: mol_type = other DNA
ttcaatgactcactatag

SEQ ID NO: 28821 - DNA, 18 bp, synthetic construct
  source 1..18: mol_type = other DNA
ttgtacgaatcactttag

SEQ ID NO: 28822 - DNA, 18 bp, synthetic construct
  source 1..18: mol_type = other DNA
ttgtacgactcacaatcg

SEQ ID NO: 28823 - DNA, 18 bp, synthetic construct
  source 1..18: mol_type = other DNA
ttttaacactcactatag

SEQ ID NO: 28824 - DNA, 18 bp, synthetic construct
  source 1..18: mol_type = other DNA
ttttacgactgacaatag

SEQ ID NO: 28825 - DNA, 18 bp, synthetic construct
  source 1..18: mol_type = other DNA
ttttacgacttacaatag

SEQ ID NO: 28826 - DNA, 18 bp, synthetic construct
  source 1..18: mol_type = other DNA
ttttacgcctccctatag

SEQ ID NO: 28827 - DNA, 18 bp, synthetic construct
  source 1..18: mol_type = other DNA
ttttacgtcccactatag

SEQ ID NO: 28828 - DNA, 18 bp, synthetic construct
  source 1..18: mol_type = other DNA
ttttgccactcactatag

SEQ ID NO: 28829 - DNA, 18 bp, synthetic construct
  source 1..18: mol_type = other DNA
taattcgactcacttatg

SEQ ID NO: 28830 - DNA, 18 bp, synthetic construct
  source 1..18: mol_type = other DNA
tatttcaactctctatag

SEQ ID NO: 28831 - DNA, 18 bp, synthetic construct
  source 1..18: mol_type = other DNA
taataagactcacttatg

SEQ ID NO: 28832 - DNA, 18 bp, synthetic construct
  source 1..18: mol_type = other DNA
taattcttctcactttag

SEQ ID NO: 28833 - DNA, 18 bp, synthetic construct
  source 1..18: mol_type = other DNA
ttatacgactctttattg

SEQ ID NO: 28834 - DNA, 18 bp, synthetic construct
  source 1..18: mol_type = other DNA
tttaacgactcactattg

SEQ ID NO: 28835 - DNA, 18 bp, synthetic construct
  source 1..18: mol_type = other DNA
taatacaactcacaaatg

SEQ ID NO: 28836 - DNA, 18 bp, synthetic construct
  source 1..18: mol_type = other DNA
tattacgactctcttttg

SEQ ID NO: 28837 - DNA, 18 bp, synthetic construct
  source 1..18: mol_type = other DNA
aaaaacgactcacaacag

SEQ ID NO: 28838 - DNA, 18 bp, synthetic construct
  source 1..18: mol_type = other DNA
ataaacgactctctatag

SEQ ID NO: 28839 - DNA, 18 bp, synthetic construct
  source 1..18: mol_type = other DNA
ttaaacgtcttactatag

SEQ ID NO: 28840 - DNA, 18 bp, synthetic construct
  source 1..18: mol_type = other DNA
ttatactacactctatag

SEQ ID NO: 28841 - DNA, 18 bp, synthetic construct
  source 1..18: mol_type = other DNA
ttatccgtctcactttag

SEQ ID NO: 28842 - DNA, 18 bp, synthetic construct
  source 1..18: mol_type = other DNA
taattcaactcattattg

SEQ ID NO: 28843 - DNA, 18 bp, synthetic construct
  source 1..18: mol_type = other DNA
taattcgacccacttttg

SEQ ID NO: 28844 - DNA, 18 bp, synthetic construct
  source 1..18: mol_type = other DNA
aaaaacgacttactattg

SEQ ID NO: 28845 - DNA, 18 bp, synthetic construct
  source 1..18: mol_type = other DNA
aaaaatgactcactattg

SEQ ID NO: 28846 - DNA, 18 bp, synthetic construct
  source 1..18: mol_type = other DNA
aaatacgaatcaatattg

SEQ ID NO: 28847 - DNA, 18 bp, synthetic construct
  source 1..18: mol_type = other DNA
aaattcgaatcactatcg

SEQ ID NO: 28848 - DNA, 18 bp, synthetic construct
  source 1..18: mol_type = other DNA
aaattcgactctctatgg

SEQ ID NO: 28849 - DNA, 18 bp, synthetic construct
  source 1..18: mol_type = other DNA
aattacgaatcactattg

SEQ ID NO: 28850 - DNA, 18 bp, synthetic construct
  source 1..18: mol_type = other DNA
taacacaactcactaatg

SEQ ID NO: 28851 - DNA, 18 bp, synthetic construct
  source 1..18: mol_type = other DNA
taactcgtctcattatag

SEQ ID NO: 28852 - DNA, 18 bp, synthetic construct
  source 1..18: mol_type = other DNA
taataagacacactaatg

SEQ ID NO: 28853 - DNA, 18 bp, synthetic construct
  source 1..18: mol_type = other DNA
taataccaatcaccattg

SEQ ID NO: 28854 - DNA, 18 bp, synthetic construct
  source 1..18: mol_type = other DNA
taattcgattcactttcg

SEQ ID NO: 28855 - DNA, 18 bp, synthetic construct
  source 1..18: mol_type = other DNA
taattcgcctctctttag

SEQ ID NO: 28856 - DNA, 18 bp, synthetic construct
  source 1..18: mol_type = other DNA
tagttcgtttcactatag

SEQ ID NO: 28857 - DNA, 18 bp, synthetic construct
  source 1..18: mol_type = other DNA
tattacgtctcacgattg

SEQ ID NO: 28858 - DNA, 18 bp, synthetic construct
  source 1..18: mol_type = other DNA
tcatacgtctcactgttg

SEQ ID NO: 28859 - DNA, 18 bp, synthetic construct
  source 1..18: mol_type = other DNA
tgatatgactcacaattg

SEQ ID NO: 28860 - DNA, 18 bp, synthetic construct
  source 1..18: mol_type = other DNA
tgattcgtctcactttag

SEQ ID NO: 28861 - DNA, 18 bp, synthetic construct
  source 1..18: mol_type = other DNA
ttaaacgcctcactattg

SEQ ID NO: 28862 - DNA, 18 bp, synthetic construct
  source 1..18: mol_type = other DNA
ttataatactcactattg

SEQ ID NO: 28863 - DNA, 18 bp, synthetic construct
  source 1..18: mol_type = other DNA
ttattagactcattatag

SEQ ID NO: 28864 - DNA, 18 bp, synthetic construct
  source 1..18: mol_type = other DNA
aaatactactcataatag

SEQ ID NO: 28865 - DNA, 18 bp, synthetic construct
  source 1..18: mol_type = other DNA
acatatgactcactttag

SEQ ID NO: 28866 - DNA, 18 bp, synthetic construct
  source 1..18: mol_type = other DNA
atatacgaatcaatatag

SEQ ID NO: 28867 - DNA, 18 bp, synthetic construct
  source 1..18: mol_type = other DNA
atgtacaactcactatag

SEQ ID NO: 28868 - DNA, 18 bp, synthetic construct
  source 1..18: mol_type = other DNA
atttaagactcactatag

SEQ ID NO: 28869 - DNA, 18 bp, synthetic construct
  source 1..18: mol_type = other DNA
taaaacaacacacaatag

SEQ ID NO: 28870 - DNA, 18 bp, synthetic construct
  source 1..18: mol_type = other DNA
taaaacaacttactaaag

SEQ ID NO: 28871 - DNA, 18 bp, synthetic construct
  source 1..18: mol_type = other DNA
taaaacctctcattatag

SEQ ID NO: 28872 - DNA, 18 bp, synthetic construct
  source 1..18: mol_type = other DNA
taaaacggctcacaaaag

SEQ ID NO: 28873 - DNA, 18 bp, synthetic construct
  source 1..18: mol_type = other DNA
taatacaaatcacattag

SEQ ID NO: 28874 - DNA, 18 bp, synthetic construct
  source 1..18: mol_type = other DNA
taatacgactattaatag

SEQ ID NO: 28875 - DNA, 18 bp, synthetic construct
  source 1..18: mol_type = other DNA
taatacgtctccgtttag

SEQ ID NO: 28876 - DNA, 18 bp, synthetic construct
  source 1..18: mol_type = other DNA
taataggactctctacgg

SEQ ID NO: 28877 - DNA, 18 bp, synthetic construct
  source 1..18: mol_type = other DNA
taatatgtctcattttag

SEQ ID NO: 28878 - DNA, 18 bp, synthetic construct
  source 1..18: mol_type = other DNA
tactacatctcaccatag

SEQ ID NO: 28879 - DNA, 18 bp, synthetic construct
  source 1..18: mol_type = other DNA
tagtacttctcattatag

SEQ ID NO: 28880 - DNA, 18 bp, synthetic construct
  source 1..18: mol_type = other DNA
tataacgtctcactatgg

SEQ ID NO: 28881 - DNA, 18 bp, synthetic construct
  source 1..18: mol_type = other DNA
tattacgactctcttaag

SEQ ID NO: 28882 - DNA, 18 bp, synthetic construct
  source 1..18: mol_type = other DNA
tattacgtcttaatatag

SEQ ID NO: 28883 - DNA, 18 bp, synthetic construct
  source 1..18: mol_type = other DNA
tcatccgactctctttag

SEQ ID NO: 28884 - DNA, 18 bp, synthetic construct
  source 1..18: mol_type = other DNA
ttaaacaactcactttag

SEQ ID NO: 28885 - DNA, 18 bp, synthetic construct
  source 1..18: mol_type = other DNA
ttaaacgaaacactatag

SEQ ID NO: 28886 - DNA, 18 bp, synthetic construct
  source 1..18: mol_type = other DNA
ttaaacgacccacaatag

SEQ ID NO: 28887 - DNA, 18 bp, synthetic construct
  source 1..18: mol_type = other DNA
ttatacctctcactttag

SEQ ID NO: 28888 - DNA, 18 bp, synthetic construct
  source 1..18: mol_type = other DNA
ttatacgacacaaaatag

SEQ ID NO: 28889 - DNA, 18 bp, synthetic construct
  source 1..18: mol_type = other DNA
ttatacgactaacgaaag

SEQ ID NO: 28890 - DNA, 18 bp, synthetic construct
  source 1..18: mol_type = other DNA
ttatacgactctcattag

SEQ ID NO: 28891 - DNA, 18 bp, synthetic construct
  source 1..18: mol_type = other DNA
ttatatgattcacaatag

SEQ ID NO: 28892 - DNA, 18 bp, synthetic construct
  source 1..18: mol_type = other DNA
tataacgactctcaatag

SEQ ID NO: 28893 - DNA, 18 bp, synthetic construct
  source 1..18: mol_type = other DNA
tatctcgactcactattg

SEQ ID NO: 28894 - DNA, 18 bp, synthetic construct
  source 1..18: mol_type = other DNA
taacacgactctctaatg

SEQ ID NO: 28895 - DNA, 18 bp, synthetic construct
  source 1..18: mol_type = other DNA
taatacaattcacaattg

SEQ ID NO: 28896 - DNA, 18 bp, synthetic construct
  source 1..18: mol_type = other DNA
taatactacacactaatg

SEQ ID NO: 28897 - DNA, 18 bp, synthetic construct
  source 1..18: mol_type = other DNA
taatccgactctcttttg

SEQ ID NO: 28898 - DNA, 18 bp, synthetic construct
  source 1..18: mol_type = other DNA
tatttcgtcacactatag

SEQ ID NO: 28899 - DNA, 18 bp, synthetic construct
  source 1..18: mol_type = other DNA
aaatacatctcacaatag

SEQ ID NO: 28900 - DNA, 18 bp, synthetic construct
  source 1..18: mol_type = other DNA
atatacgactaacaatag

SEQ ID NO: 28901 - DNA, 18 bp, synthetic construct
  source 1..18: mol_type = other DNA
taatacaactcacataag

SEQ ID NO: 28902 - DNA, 18 bp, synthetic construct
  source 1..18: mol_type = other DNA
ttatacgattcacaaaag

SEQ ID NO: 28903 - DNA, 18 bp, synthetic construct
  source 1..18: mol_type = other DNA
ttatacgtctcaatttag

SEQ ID NO: 28904 - DNA, 18 bp, synthetic construct
  source 1..18: mol_type = other DNA
ttatatgacactctatag

SEQ ID NO: 28905 - DNA, 18 bp, synthetic construct
  source 1..18: mol_type = other DNA
ttttacgtttcactatag

SEQ ID NO: 28906 - DNA, 18 bp, synthetic construct
  source 1..18: mol_type = other DNA
ttattcgactcattttag

SEQ ID NO: 28907 - DNA, 18 bp, synthetic construct
  source 1..18: mol_type = other DNA
atatacgacacactttag

SEQ ID NO: 28908 - DNA, 18 bp, synthetic construct
  source 1..18: mol_type = other DNA
tattacttctcactaaag

SEQ ID NO: 28909 - DNA, 18 bp, synthetic construct
  source 1..18: mol_type = other DNA
taattcgactctcaattg

SEQ ID NO: 28910 - DNA, 18 bp, synthetic construct
  source 1..18: mol_type = other DNA
taattcgactttctattg

SEQ ID NO: 28911 - DNA, 18 bp, synthetic construct
  source 1..18: mol_type = other DNA
taatacgtctatctattg

SEQ ID NO: 28912 - DNA, 18 bp, synthetic construct
  source 1..18: mol_type = other DNA
ttatacgactcaataatg

SEQ ID NO: 28913 - DNA, 18 bp, synthetic construct
  source 1..18: mol_type = other DNA
ttattcgacacactctag

SEQ ID NO: 28914 - DNA, 18 bp, synthetic construct
  source 1..18: mol_type = other DNA
atatactactcacaatag

SEQ ID NO: 28915 - DNA, 18 bp, synthetic construct
  source 1..18: mol_type = other DNA
taaaacgattctctttag

SEQ ID NO: 28916 - DNA, 18 bp, synthetic construct
  source 1..18: mol_type = other DNA
taatacgaccctcaaaag

SEQ ID NO: 28917 - DNA, 18 bp, synthetic construct
  source 1..18: mol_type = other DNA
ttatacaattcactaaag

SEQ ID NO: 28918 - DNA, 18 bp, synthetic construct
  source 1..18: mol_type = other DNA
ttatacgattcacattag

SEQ ID NO: 28919 - DNA, 18 bp, synthetic construct
  source 1..18: mol_type = other DNA
aaatatgactcgctattg

SEQ ID NO: 28920 - DNA, 18 bp, synthetic construct
  source 1..18: mol_type = other DNA
aaattcgactcagtattg

SEQ ID NO: 28921 - DNA, 18 bp, synthetic construct
  source 1..18: mol_type = other DNA
aacttcgactcactattg

SEQ ID NO: 28922 - DNA, 18 bp, synthetic construct
  source 1..18: mol_type = other DNA
cacttcgactcactattg

SEQ ID NO: 28923 - DNA, 18 bp, synthetic construct
  source 1..18: mol_type = other DNA
taaattgactcactattg

SEQ ID NO: 28924 - DNA, 18 bp, synthetic construct
  source 1..18: mol_type = other DNA
taataggactcgcttttg

SEQ ID NO: 28925 - DNA, 18 bp, synthetic construct
  source 1..18: mol_type = other DNA
taattcgactcacacttg

SEQ ID NO: 28926 - DNA, 18 bp, synthetic construct
  source 1..18: mol_type = other DNA
taattcgactgactaatg

SEQ ID NO: 28927 - DNA, 18 bp, synthetic construct
  source 1..18: mol_type = other DNA
tacttcgattcactattg

SEQ ID NO: 28928 - DNA, 18 bp, synthetic construct
  source 1..18: mol_type = other DNA
aaataccactcaatattg

SEQ ID NO: 28929 - DNA, 18 bp, synthetic construct
  source 1..18: mol_type = other DNA
aaatacgacagactattg

SEQ ID NO: 28930 - DNA, 18 bp, synthetic construct
  source 1..18: mol_type = other DNA
aaatacgactagctaaag

SEQ ID NO: 28931 - DNA, 18 bp, synthetic construct
  source 1..18: mol_type = other DNA
aaatacgactctcaattg

SEQ ID NO: 28932 - DNA, 18 bp, synthetic construct
  source 1..18: mol_type = other DNA
aaatacgactctctcttg

SEQ ID NO: 28933 - DNA, 18 bp, synthetic construct
  source 1..18: mol_type = other DNA
aaatacgactctctgttg

SEQ ID NO: 28934 - DNA, 18 bp, synthetic construct
  source 1..18: mol_type = other DNA
aaattcgcctctctatag

SEQ ID NO: 28935 - DNA, 18 bp, synthetic construct
  source 1..18: mol_type = other DNA
aaatttgagtcactatag

SEQ ID NO: 28936 - DNA, 18 bp, synthetic construct
  source 1..18: mol_type = other DNA
aagttcgactctctatag

SEQ ID NO: 28937 - DNA, 18 bp, synthetic construct
  source 1..18: mol_type = other DNA
acattctactcactatag

SEQ ID NO: 28938 - DNA, 18 bp, synthetic construct
  source 1..18: mol_type = other DNA
caatacgactaacaattg

SEQ ID NO: 28939 - DNA, 18 bp, synthetic construct
  source 1..18: mol_type = other DNA
caatacgtctcacaattg

SEQ ID NO: 28940 - DNA, 18 bp, synthetic construct
  source 1..18: mol_type = other DNA
caattagactcactaaag

SEQ ID NO: 28941 - DNA, 18 bp, synthetic construct
  source 1..18: mol_type = other DNA
caattagactctctatag

SEQ ID NO: 28942 - DNA, 18 bp, synthetic construct
  source 1..18: mol_type = other DNA
caattcgacatactatag

SEQ ID NO: 28943 - DNA, 18 bp, synthetic construct
  source 1..18: mol_type = other DNA
caatttgactcacaatag

SEQ ID NO: 28944 - DNA, 18 bp, synthetic construct
  source 1..18: mol_type = other DNA
gtattcaactcactatag

SEQ ID NO: 28945 - DNA, 18 bp, synthetic construct
  source 1..18: mol_type = other DNA
taaaaagactcaatattg

SEQ ID NO: 28946 - DNA, 18 bp, synthetic construct
  source 1..18: mol_type = other DNA
taaaacaactaactattg

SEQ ID NO: 28947 - DNA, 18 bp, synthetic construct
  source 1..18: mol_type = other DNA
taaaacgacacaatattg

SEQ ID NO: 28948 - DNA, 18 bp, synthetic construct
  source 1..18: mol_type = other DNA
taaaacgacgcacaattg

SEQ ID NO: 28949 - DNA, 18 bp, synthetic construct
  source 1..18: mol_type = other DNA
taaaacgagtcactcttg

SEQ ID NO: 28950 - DNA, 18 bp, synthetic construct
  source 1..18: mol_type = other DNA
taaaacgcctcgttatag

SEQ ID NO: 28951 - DNA, 18 bp, synthetic construct
  source 1..18: mol_type = other DNA
taaaacggctcactaatg

SEQ ID NO: 28952 - DNA, 18 bp, synthetic construct
  source 1..18: mol_type = other DNA
taaaacggctcgcaatag

SEQ ID NO: 28953 - DNA, 18 bp, synthetic construct
  source 1..18: mol_type = other DNA
taaaatgactcacaattg

SEQ ID NO: 28954 - DNA, 18 bp, synthetic construct
  source 1..18: mol_type = other DNA
taaatagactcaccatag

SEQ ID NO: 28955 - DNA, 18 bp, synthetic construct
  source 1..18: mol_type = other DNA
taaatcgactttctatag

SEQ ID NO: 28956 - DNA, 18 bp, synthetic construct
  source 1..18: mol_type = other DNA
taaatctacacactatag

SEQ ID NO: 28957 - DNA, 18 bp, synthetic construct
  source 1..18: mol_type = other DNA
taacacgactcaccaatg

SEQ ID NO: 28958 - DNA, 18 bp, synthetic construct
  source 1..18: mol_type = other DNA
taacacgactcgccaaag

SEQ ID NO: 28959 - DNA, 18 bp, synthetic construct
  source 1..18: mol_type = other DNA
taacacgtctcgatatag

SEQ ID NO: 28960 - DNA, 18 bp, synthetic construct
  source 1..18: mol_type = other DNA
taactcaaatcactatag

SEQ ID NO: 28961 - DNA, 18 bp, synthetic construct
  source 1..18: mol_type = other DNA
taactcgacccactttag

SEQ ID NO: 28962 - DNA, 18 bp, synthetic construct
  source 1..18: mol_type = other DNA
taactcgactccctatcg

SEQ ID NO: 28963 - DNA, 18 bp, synthetic construct
  source 1..18: mol_type = other DNA
taactcgtcttactatag

SEQ ID NO: 28964 - DNA, 18 bp, synthetic construct
  source 1..18: mol_type = other DNA
taacttaactcactatag

SEQ ID NO: 28965 - DNA, 18 bp, synthetic construct
  source 1..18: mol_type = other DNA
taagactactccctattg

SEQ ID NO: 28966 - DNA, 18 bp, synthetic construct
  source 1..18: mol_type = other DNA
taataagacacgctttag

SEQ ID NO: 28967 - DNA, 18 bp, synthetic construct
  source 1..18: mol_type = other DNA
taataagactaactgttg

SEQ ID NO: 28968 - DNA, 18 bp, synthetic construct
  source 1..18: mol_type = other DNA
taataagactcaccaatg

SEQ ID NO: 28969 - DNA, 18 bp, synthetic construct
  source 1..18: mol_type = other DNA
taataagacttacttttg

SEQ ID NO: 28970 - DNA, 18 bp, synthetic construct
  source 1..18: mol_type = other DNA
taatacaaattactattg

SEQ ID NO: 28971 - DNA, 18 bp, synthetic construct
  source 1..18: mol_type = other DNA
taatacaagtcaccattg

SEQ ID NO: 28972 - DNA, 18 bp, synthetic construct
  source 1..18: mol_type = other DNA
taatacatcccactattg

SEQ ID NO: 28973 - DNA, 18 bp, synthetic construct
  source 1..18: mol_type = other DNA
taataccactctctagtg

SEQ ID NO: 28974 - DNA, 18 bp, synthetic construct
  source 1..18: mol_type = other DNA
taatacctcttactattg

SEQ ID NO: 28975 - DNA, 18 bp, synthetic construct
  source 1..18: mol_type = other DNA
taatacgaatcgctaacg

SEQ ID NO: 28976 - DNA, 18 bp, synthetic construct
  source 1..18: mol_type = other DNA
taatacgagtaacaattg

SEQ ID NO: 28977 - DNA, 18 bp, synthetic construct
  source 1..18: mol_type = other DNA
taatacggctaacttttg

SEQ ID NO: 28978 - DNA, 18 bp, synthetic construct
  source 1..18: mol_type = other DNA
taatacggctcacttatg

SEQ ID NO: 28979 - DNA, 18 bp, synthetic construct
  source 1..18: mol_type = other DNA
taatacgtatcactagtg

SEQ ID NO: 28980 - DNA, 18 bp, synthetic construct
  source 1..18: mol_type = other DNA
taatacgttacgctatag

SEQ ID NO: 28981 - DNA, 18 bp, synthetic construct
  source 1..18: mol_type = other DNA
taatacgttttactattg

SEQ ID NO: 28982 - DNA, 18 bp, synthetic construct
  source 1..18: mol_type = other DNA
taatactaatcactcttg

SEQ ID NO: 28983 - DNA, 18 bp, synthetic construct
  source 1..18: mol_type = other DNA
taatactacacactactg

SEQ ID NO: 28984 - DNA, 18 bp, synthetic construct
  source 1..18: mol_type = other DNA
taatactactcgctttgg

SEQ ID NO: 28985 - DNA, 18 bp, synthetic construct
  source 1..18: mol_type = other DNA
taatactactctctagtg

SEQ ID NO: 28986 - DNA, 18 bp, synthetic construct
  source 1..18: mol_type = other DNA
taataggactctcttttg

SEQ ID NO: 28987 - DNA, 18 bp, synthetic construct
  source 1..18: mol_type = other DNA
taatccaactcacaattg

SEQ ID NO: 28988 - DNA, 18 bp, synthetic construct
  source 1..18: mol_type = other DNA
taatccaactcattattg

SEQ ID NO: 28989 - DNA, 18 bp, synthetic construct
  source 1..18: mol_type = other DNA
taatccgactcacctttg

SEQ ID NO: 28990 - DNA, 18 bp, synthetic construct
  source 1..18: mol_type = other DNA
taatccgtctcattattg

SEQ ID NO: 28991 - DNA, 18 bp, synthetic construct
  source 1..18: mol_type = other DNA
taattagactaacaatag

SEQ ID NO: 28992 - DNA, 18 bp, synthetic construct
  source 1..18: mol_type = other DNA
taattcaattctctatag

SEQ ID NO: 28993 - DNA, 18 bp, synthetic construct
  source 1..18: mol_type = other DNA
taattccacgctctatag

SEQ ID NO: 28994 - DNA, 18 bp, synthetic construct
  source 1..18: mol_type = other DNA
taattcctctcactttag

SEQ ID NO: 28995 - DNA, 18 bp, synthetic construct
  source 1..18: mol_type = other DNA
taattcgactcaccaagg

SEQ ID NO: 28996 - DNA, 18 bp, synthetic construct
  source 1..18: mol_type = other DNA
taattcgatacactatgg

SEQ ID NO: 28997 - DNA, 18 bp, synthetic construct
  source 1..18: mol_type = other DNA
taattcgcatctctatag

SEQ ID NO: 28998 - DNA, 18 bp, synthetic construct
  source 1..18: mol_type = other DNA
taattcgccccacaatag

SEQ ID NO: 28999 - DNA, 18 bp, synthetic construct
  source 1..18: mol_type = other DNA
taattcgcctcacaaaag

SEQ ID NO: 29000 - DNA, 18 bp, synthetic construct
  source 1..18: mol_type = other DNA
taattcgtatgactatag

SEQ ID NO: 29001 - DNA, 18 bp, synthetic construct
  source 1..18: mol_type = other DNA
taattcgtctcagtaaag

SEQ ID NO: 29002 - DNA, 18 bp, synthetic construct
  source 1..18: mol_type = other DNA
taattctactctctatcg

SEQ ID NO: 29003 - DNA, 18 bp, synthetic construct
  source 1..18: mol_type = other DNA
taattggaatcactacag

SEQ ID NO: 29004 - DNA, 18 bp, synthetic construct
  source 1..18: mol_type = other DNA
taatttgactctctacag

SEQ ID NO: 29005 - DNA, 18 bp, synthetic construct
  source 1..18: mol_type = other DNA
taatttgacttaccatag

SEQ ID NO: 29006 - DNA, 18 bp, synthetic construct
  source 1..18: mol_type = other DNA
tacaatgactcactattg

SEQ ID NO: 29007 - DNA, 18 bp, synthetic construct
  source 1..18: mol_type = other DNA
tactaagactcacttttg

SEQ ID NO: 29008 - DNA, 18 bp, synthetic construct
  source 1..18: mol_type = other DNA
tactacaactcgctatcg

SEQ ID NO: 29009 - DNA, 18 bp, synthetic construct
  source 1..18: mol_type = other DNA
tactacgactcacctttg

SEQ ID NO: 29010 - DNA, 18 bp, synthetic construct
  source 1..18: mol_type = other DNA
tactacgatttactattg

SEQ ID NO: 29011 - DNA, 18 bp, synthetic construct
  source 1..18: mol_type = other DNA
tacttagactcaccatag

SEQ ID NO: 29012 - DNA, 18 bp, synthetic construct
  source 1..18: mol_type = other DNA
tacttcgaatcactaaag

SEQ ID NO: 29013 - DNA, 18 bp, synthetic construct
  source 1..18: mol_type = other DNA
tacttcgaatcactttag

SEQ ID NO: 29014 - DNA, 18 bp, synthetic construct
  source 1..18: mol_type = other DNA
tacttggactcactctag

SEQ ID NO: 29015 - DNA, 18 bp, synthetic construct
  source 1..18: mol_type = other DNA
tagaacgactcactactg

SEQ ID NO: 29016 - DNA, 18 bp, synthetic construct
  source 1..18: mol_type = other DNA
tagttggactcacaatag

SEQ ID NO: 29017 - DNA, 18 bp, synthetic construct
  source 1..18: mol_type = other DNA
tataacgactcgctttag

SEQ ID NO: 29018 - DNA, 18 bp, synthetic construct
  source 1..18: mol_type = other DNA
tatctcaactcactatag

SEQ ID NO: 29019 - DNA, 18 bp, synthetic construct
  source 1..18: mol_type = other DNA
tattacgaccctctattg

SEQ ID NO: 29020 - DNA, 18 bp, synthetic construct
  source 1..18: mol_type = other DNA
tattacgactctctgttg

SEQ ID NO: 29021 - DNA, 18 bp, synthetic construct
  source 1..18: mol_type = other DNA
tattatgactagctatag

SEQ ID NO: 29022 - DNA, 18 bp, synthetic construct
  source 1..18: mol_type = other DNA
tatttcgacacactacag

SEQ ID NO: 29023 - DNA, 18 bp, synthetic construct
  source 1..18: mol_type = other DNA
tatttcgactctctatgg

SEQ ID NO: 29024 - DNA, 18 bp, synthetic construct
  source 1..18: mol_type = other DNA
tatttcgcatcactatag

SEQ ID NO: 29025 - DNA, 18 bp, synthetic construct
  source 1..18: mol_type = other DNA
tcataagactcgctagag

SEQ ID NO: 29026 - DNA, 18 bp, synthetic construct
  source 1..18: mol_type = other DNA
tcatacatctcactattg

SEQ ID NO: 29027 - DNA, 18 bp, synthetic construct
  source 1..18: mol_type = other DNA
tcatacgacactctattg

SEQ ID NO: 29028 - DNA, 18 bp, synthetic construct
  source 1..18: mol_type = other DNA
tcatacgactcccttttg

SEQ ID NO: 29029 - DNA, 18 bp, synthetic construct
  source 1..18: mol_type = other DNA
tcattcgactcataatag

SEQ ID NO: 29030 - DNA, 18 bp, synthetic construct
  source 1..18: mol_type = other DNA
tgaaaagactcactattg

SEQ ID NO: 29031 - DNA, 18 bp, synthetic construct
  source 1..18: mol_type = other DNA
tgaaacgactctctattg

SEQ ID NO: 29032 - DNA, 18 bp, synthetic construct
  source 1..18: mol_type = other DNA
tgatacgacttactaatg

SEQ ID NO: 29033 - DNA, 18 bp, synthetic construct
  source 1..18: mol_type = other DNA
ttaatcgactccctatag

SEQ ID NO: 29034 - DNA, 18 bp, synthetic construct
  source 1..18: mol_type = other DNA
ttacatgactcactattg

SEQ ID NO: 29035 - DNA, 18 bp, synthetic construct
  source 1..18: mol_type = other DNA
ttataagactaactattg

SEQ ID NO: 29036 - DNA, 18 bp, synthetic construct
  source 1..18: mol_type = other DNA
ttataagactcactactg

SEQ ID NO: 29037 - DNA, 18 bp, synthetic construct
  source 1..18: mol_type = other DNA
ttataccactcattattg

SEQ ID NO: 29038 - DNA, 18 bp, synthetic construct
  source 1..18: mol_type = other DNA
ttatacgaataactattg

SEQ ID NO: 29039 - DNA, 18 bp, synthetic construct
  source 1..18: mol_type = other DNA
ttatacggctcactaatg

SEQ ID NO: 29040 - DNA, 18 bp, synthetic construct
  source 1..18: mol_type = other DNA
ttatacgtctcactgttg

SEQ ID NO: 29041 - DNA, 18 bp, synthetic construct
  source 1..18: mol_type = other DNA
ttatacgtctcgccatag

SEQ ID NO: 29042 - DNA, 18 bp, synthetic construct
  source 1..18: mol_type = other DNA
ttatgcaactcactattg

SEQ ID NO: 29043 - DNA, 18 bp, synthetic construct
  source 1..18: mol_type = other DNA
ttatgcgactagctatag

SEQ ID NO: 29044 - DNA, 18 bp, synthetic construct
  source 1..18: mol_type = other DNA
ttattagactgactatag

SEQ ID NO: 29045 - DNA, 18 bp, synthetic construct
  source 1..18: mol_type = other DNA
ttattcgactaactacag

SEQ ID NO: 29046 - DNA, 18 bp, synthetic construct
  source 1..18: mol_type = other DNA
ttattcgtctcactatgg

SEQ ID NO: 29047 - DNA, 18 bp, synthetic construct
  source 1..18: mol_type = other DNA
ttctacgattcactattg

SEQ ID NO: 29048 - DNA, 18 bp, synthetic construct
  source 1..18: mol_type = other DNA
ttgatcgactcactatag

SEQ ID NO: 29049 - DNA, 18 bp, synthetic construct
  source 1..18: mol_type = other DNA
ttgtccgactcactattg

SEQ ID NO: 29050 - DNA, 18 bp, synthetic construct
  source 1..18: mol_type = other DNA
ttttaccactcactattg

SEQ ID NO: 29051 - DNA, 18 bp, synthetic construct
  source 1..18: mol_type = other DNA
ttttacgcctcactattg

SEQ ID NO: 29052 - DNA, 18 bp, synthetic construct
  source 1..18: mol_type = other DNA
aaaaacgacttactctag

SEQ ID NO: 29053 - DNA, 18 bp, synthetic construct
  source 1..18: mol_type = other DNA
aaaaacgattcactacag

SEQ ID NO: 29054 - DNA, 18 bp, synthetic construct
  source 1..18: mol_type = other DNA
aaaaatgtctcactatag

SEQ ID NO: 29055 - DNA, 18 bp, synthetic construct
  source 1..18: mol_type = other DNA
aaacacgattctctatag

SEQ ID NO: 29056 - DNA, 18 bp, synthetic construct
  source 1..18: mol_type = other DNA
aaataaaactcactgtag

SEQ ID NO: 29057 - DNA, 18 bp, synthetic construct
  source 1..18: mol_type = other DNA
aaataagaatcacaatag

SEQ ID NO: 29058 - DNA, 18 bp, synthetic construct
  source 1..18: mol_type = other DNA
aaataagactcactaacg

SEQ ID NO: 29059 - DNA, 18 bp, synthetic construct
  source 1..18: mol_type = other DNA
aaataatactcactatgg

SEQ ID NO: 29060 - DNA, 18 bp, synthetic construct
  source 1..18: mol_type = other DNA
aaatacaacttactctag

SEQ ID NO: 29061 - DNA, 18 bp, synthetic construct
  source 1..18: mol_type = other DNA
aaataccactgactttag

SEQ ID NO: 29062 - DNA, 18 bp, synthetic construct
  source 1..18: mol_type = other DNA
aaataccagtcactaaag

SEQ ID NO: 29063 - DNA, 18 bp, synthetic construct
  source 1..18: mol_type = other DNA
aaataccagtcactacag

SEQ ID NO: 29064 - DNA, 18 bp, synthetic construct
  source 1..18: mol_type = other DNA
aaatacgacaaactctag

SEQ ID NO: 29065 - DNA, 18 bp, synthetic construct
  source 1..18: mol_type = other DNA
aaatacgactaaccaaag

SEQ ID NO: 29066 - DNA, 18 bp, synthetic construct
  source 1..18: mol_type = other DNA
aaatacgagtctctttag

SEQ ID NO: 29067 - DNA, 18 bp, synthetic construct
  source 1..18: mol_type = other DNA
aaatacgcctctcaatag

SEQ ID NO: 29068 - DNA, 18 bp, synthetic construct
  source 1..18: mol_type = other DNA
aaatacggcacactttag

SEQ ID NO: 29069 - DNA, 18 bp, synthetic construct
  source 1..18: mol_type = other DNA
aaatacggcttacaatag

SEQ ID NO: 29070 - DNA, 18 bp, synthetic construct
  source 1..18: mol_type = other DNA
aaatacgtgccactatag

SEQ ID NO: 29071 - DNA, 18 bp, synthetic construct
  source 1..18: mol_type = other DNA
aaatactactcaatctag

SEQ ID NO: 29072 - DNA, 18 bp, synthetic construct
  source 1..18: mol_type = other DNA
aaatagaactcactaaag

SEQ ID NO: 29073 - DNA, 18 bp, synthetic construct
  source 1..18: mol_type = other DNA
aaatagcactcactatcg

SEQ ID NO: 29074 - DNA, 18 bp, synthetic construct
  source 1..18: mol_type = other DNA
aaatgcgacacactacag

SEQ ID NO: 29075 - DNA, 18 bp, synthetic construct
  source 1..18: mol_type = other DNA
aactacgattccctatag

SEQ ID NO: 29076 - DNA, 18 bp, synthetic construct
  source 1..18: mol_type = other DNA
aagtacaacacactatag

SEQ ID NO: 29077 - DNA, 18 bp, synthetic construct
  source 1..18: mol_type = other DNA
aattatgactcactaaag

SEQ ID NO: 29078 - DNA, 18 bp, synthetic construct
  source 1..18: mol_type = other DNA
aattatgactcagtatag

SEQ ID NO: 29079 - DNA, 18 bp, synthetic construct
  source 1..18: mol_type = other DNA
aattatgattcactatag

SEQ ID NO: 29080 - DNA, 18 bp, synthetic construct
  source 1..18: mol_type = other DNA
acatacgactccctacag

SEQ ID NO: 29081 - DNA, 18 bp, synthetic construct
  source 1..18: mol_type = other DNA
acatacgacttacaatag

SEQ ID NO: 29082 - DNA, 18 bp, synthetic construct
  source 1..18: mol_type = other DNA
agatacggctcactaaag

SEQ ID NO: 29083 - DNA, 18 bp, synthetic construct
  source 1..18: mol_type = other DNA
atataccacccactatag

SEQ ID NO: 29084 - DNA, 18 bp, synthetic construct
  source 1..18: mol_type = other DNA
atatacgactcattatcg

SEQ ID NO: 29085 - DNA, 18 bp, synthetic construct
  source 1..18: mol_type = other DNA
atatacgactctccatag

SEQ ID NO: 29086 - DNA, 18 bp, synthetic construct
  source 1..18: mol_type = other DNA
atatactaatcactatag

SEQ ID NO: 29087 - DNA, 18 bp, synthetic construct
  source 1..18: mol_type = other DNA
atatatcactcactatag

SEQ ID NO: 29088 - DNA, 18 bp, synthetic construct
  source 1..18: mol_type = other DNA
caaaacgatacactatag

SEQ ID NO: 29089 - DNA, 18 bp, synthetic construct
  source 1..18: mol_type = other DNA
caataagacacagtatag

SEQ ID NO: 29090 - DNA, 18 bp, synthetic construct
  source 1..18: mol_type = other DNA
caatacgacaaactatcg

SEQ ID NO: 29091 - DNA, 18 bp, synthetic construct
  source 1..18: mol_type = other DNA
caatacgacatacaatag

SEQ ID NO: 29092 - DNA, 18 bp, synthetic construct
  source 1..18: mol_type = other DNA
caatacgactaattttag

SEQ ID NO: 29093 - DNA, 18 bp, synthetic construct
  source 1..18: mol_type = other DNA
caatacgattcacattag

SEQ ID NO: 29094 - DNA, 18 bp, synthetic construct
  source 1..18: mol_type = other DNA
caatacgtctcaataaag

SEQ ID NO: 29095 - DNA, 18 bp, synthetic construct
  source 1..18: mol_type = other DNA
cactacgacttactacag

SEQ ID NO: 29096 - DNA, 18 bp, synthetic construct
  source 1..18: mol_type = other DNA
cataaccactcactatag

SEQ ID NO: 29097 - DNA, 18 bp, synthetic construct
  source 1..18: mol_type = other DNA
catcacgactcactaaag

SEQ ID NO: 29098 - DNA, 18 bp, synthetic construct
  source 1..18: mol_type = other DNA
cattacgacttactgtag

SEQ ID NO: 29099 - DNA, 18 bp, synthetic construct
  source 1..18: mol_type = other DNA
ccatacgactcacttaag

SEQ ID NO: 29100 - DNA, 18 bp, synthetic construct
  source 1..18: mol_type = other DNA
ctacacgactcaatatag

SEQ ID NO: 29101 - DNA, 18 bp, synthetic construct
  source 1..18: mol_type = other DNA
ctatacatctcactatag

SEQ ID NO: 29102 - DNA, 18 bp, synthetic construct
  source 1..18: mol_type = other DNA
ctatactacttactatag

SEQ ID NO: 29103 - DNA, 18 bp, synthetic construct
  source 1..18: mol_type = other DNA
cttaacgactcactatag

SEQ ID NO: 29104 - DNA, 18 bp, synthetic construct
  source 1..18: mol_type = other DNA
ctttacgagtcactatag

SEQ ID NO: 29105 - DNA, 18 bp, synthetic construct
  source 1..18: mol_type = other DNA
gaatacgatacaccatag

SEQ ID NO: 29106 - DNA, 18 bp, synthetic construct
  source 1..18: mol_type = other DNA
gagtacgtctcactaaag

SEQ ID NO: 29107 - DNA, 18 bp, synthetic construct
  source 1..18: mol_type = other DNA
taaaacaactcaatttag

SEQ ID NO: 29108 - DNA, 18 bp, synthetic construct
  source 1..18: mol_type = other DNA
taaaacaagtcactaaag

SEQ ID NO: 29109 - DNA, 18 bp, synthetic construct
  source 1..18: mol_type = other DNA
taaaacacttcactatag

SEQ ID NO: 29110 - DNA, 18 bp, synthetic construct
  source 1..18: mol_type = other DNA
taaaaccactcacaatcg

SEQ ID NO: 29111 - DNA, 18 bp, synthetic construct
  source 1..18: mol_type = other DNA
taaaacgaatcaatttag

SEQ ID NO: 29112 - DNA, 18 bp, synthetic construct
  source 1..18: mol_type = other DNA
taaaacgactcacattcg

SEQ ID NO: 29113 - DNA, 18 bp, synthetic construct
  source 1..18: mol_type = other DNA
taaaacgattaactatgg

SEQ ID NO: 29114 - DNA, 18 bp, synthetic construct
  source 1..18: mol_type = other DNA
taaaacgattaattatag

SEQ ID NO: 29115 - DNA, 18 bp, synthetic construct
  source 1..18: mol_type = other DNA
taaaacgattcacttcag

SEQ ID NO: 29116 - DNA, 18 bp, synthetic construct
  source 1..18: mol_type = other DNA
taaaacggtttactatag

SEQ ID NO: 29117 - DNA, 18 bp, synthetic construct
  source 1..18: mol_type = other DNA
taaaacgtctcattaaag

SEQ ID NO: 29118 - DNA, 18 bp, synthetic construct
  source 1..18: mol_type = other DNA
taaaacgtttcaatatag

SEQ ID NO: 29119 - DNA, 18 bp, synthetic construct
  source 1..18: mol_type = other DNA
taaaactactcactttgg

SEQ ID NO: 29120 - DNA, 18 bp, synthetic construct
  source 1..18: mol_type = other DNA
taaaactactcccaatag

SEQ ID NO: 29121 - DNA, 18 bp, synthetic construct
  source 1..18: mol_type = other DNA
taaaaggaatcactaaag

SEQ ID NO: 29122 - DNA, 18 bp, synthetic construct
  source 1..18: mol_type = other DNA
taaaatcactctctatag

SEQ ID NO: 29123 - DNA, 18 bp, synthetic construct
  source 1..18: mol_type = other DNA
taaaatgacacactaaag

SEQ ID NO: 29124 - DNA, 18 bp, synthetic construct
  source 1..18: mol_type = other DNA
taaaatgactcacgttag

SEQ ID NO: 29125 - DNA, 18 bp, synthetic construct
  source 1..18: mol_type = other DNA
taaaatgacttagtatag

SEQ ID NO: 29126 - DNA, 18 bp, synthetic construct
  source 1..18: mol_type = other DNA
taaaattactcacaatag

SEQ ID NO: 29127 - DNA, 18 bp, synthetic construct
  source 1..18: mol_type = other DNA
taaagcaattcactatag

SEQ ID NO: 29128 - DNA, 18 bp, synthetic construct
  source 1..18: mol_type = other DNA
taaagcgtctcacaatag

SEQ ID NO: 29129 - DNA, 18 bp, synthetic construct
  source 1..18: mol_type = other DNA
taacaagaattactatag

SEQ ID NO: 29130 - DNA, 18 bp, synthetic construct
  source 1..18: mol_type = other DNA
taacacgaaacacaatag

SEQ ID NO: 29131 - DNA, 18 bp, synthetic construct
  source 1..18: mol_type = other DNA
taacacgacaatctatag

SEQ ID NO: 29132 - DNA, 18 bp, synthetic construct
  source 1..18: mol_type = other DNA
taacacgactgacaaaag

SEQ ID NO: 29133 - DNA, 18 bp, synthetic construct
  source 1..18: mol_type = other DNA
taacacgtctccctacag

SEQ ID NO: 29134 - DNA, 18 bp, synthetic construct
  source 1..18: mol_type = other DNA
taacactactcaatttag

SEQ ID NO: 29135 - DNA, 18 bp, synthetic construct
  source 1..18: mol_type = other DNA
taacactactcacttaag

SEQ ID NO: 29136 - DNA, 18 bp, synthetic construct
  source 1..18: mol_type = other DNA
taacatgacacaccatag

SEQ ID NO: 29137 - DNA, 18 bp, synthetic construct
  source 1..18: mol_type = other DNA
taagacgcctcacagtag

SEQ ID NO: 29138 - DNA, 18 bp, synthetic construct
  source 1..18: mol_type = other DNA
taagacgtcactctatag

SEQ ID NO: 29139 - DNA, 18 bp, synthetic construct
  source 1..18: mol_type = other DNA
taataagtcacattatag

SEQ ID NO: 29140 - DNA, 18 bp, synthetic construct
  source 1..18: mol_type = other DNA
taataagtctatctatag

SEQ ID NO: 29141 - DNA, 18 bp, synthetic construct
  source 1..18: mol_type = other DNA
taataagtttcactatcg

SEQ ID NO: 29142 - DNA, 18 bp, synthetic construct
  source 1..18: mol_type = other DNA
taataatatttactatag

SEQ ID NO: 29143 - DNA, 18 bp, synthetic construct
  source 1..18: mol_type = other DNA
taataattcttactatag

SEQ ID NO: 29144 - DNA, 18 bp, synthetic construct
  source 1..18: mol_type = other DNA
taatacaacagactagag

SEQ ID NO: 29145 - DNA, 18 bp, synthetic construct
  source 1..18: mol_type = other DNA
taatacaaccctcaatag

SEQ ID NO: 29146 - DNA, 18 bp, synthetic construct
  source 1..18: mol_type = other DNA
taatacaactaacttaag

SEQ ID NO: 29147 - DNA, 18 bp, synthetic construct
  source 1..18: mol_type = other DNA
taatacaactcaaaagag

SEQ ID NO: 29148 - DNA, 18 bp, synthetic construct
  source 1..18: mol_type = other DNA
taatacaactctctttcg

SEQ ID NO: 29149 - DNA, 18 bp, synthetic construct
  source 1..18: mol_type = other DNA
taatacaatatactatag

SEQ ID NO: 29150 - DNA, 18 bp, synthetic construct
  source 1..18: mol_type = other DNA
taatacaattcattatcg

SEQ ID NO: 29151 - DNA, 18 bp, synthetic construct
  source 1..18: mol_type = other DNA
taatacacctcacttcag

SEQ ID NO: 29152 - DNA, 18 bp, synthetic construct
  source 1..18: mol_type = other DNA
taatacatttcacaatag

SEQ ID NO: 29153 - DNA, 18 bp, synthetic construct
  source 1..18: mol_type = other DNA
taataccagtccatatag

SEQ ID NO: 29154 - DNA, 18 bp, synthetic construct
  source 1..18: mol_type = other DNA
taatacgaaattctatag

SEQ ID NO: 29155 - DNA, 18 bp, synthetic construct
  source 1..18: mol_type = other DNA
taatacgaatctctccag

SEQ ID NO: 29156 - DNA, 18 bp, synthetic construct
  source 1..18: mol_type = other DNA
taatacgaatttttatag

SEQ ID NO: 29157 - DNA, 18 bp, synthetic construct
  source 1..18: mol_type = other DNA
taatacgacactcaacag

SEQ ID NO: 29158 - DNA, 18 bp, synthetic construct
  source 1..18: mol_type = other DNA
taatacgaccctcattag

SEQ ID NO: 29159 - DNA, 18 bp, synthetic construct
  source 1..18: mol_type = other DNA
taatacgaccgaatatcg

SEQ ID NO: 29160 - DNA, 18 bp, synthetic construct
  source 1..18: mol_type = other DNA
taatacgacgctttaaag

SEQ ID NO: 29161 - DNA, 18 bp, synthetic construct
  source 1..18: mol_type = other DNA
taatacgactaaattcag

SEQ ID NO: 29162 - DNA, 18 bp, synthetic construct
  source 1..18: mol_type = other DNA
taatacgactctcaaagg

SEQ ID NO: 29163 - DNA, 18 bp, synthetic construct
  source 1..18: mol_type = other DNA
taatacgactttccaaag

SEQ ID NO: 29164 - DNA, 18 bp, synthetic construct
  source 1..18: mol_type = other DNA
taatacgagacaatttag

SEQ ID NO: 29165 - DNA, 18 bp, synthetic construct
  source 1..18: mol_type = other DNA
taatacgagatactatgg

SEQ ID NO: 29166 - DNA, 18 bp, synthetic construct
  source 1..18: mol_type = other DNA
taatacgataaactatgg

SEQ ID NO: 29167 - DNA, 18 bp, synthetic construct
  source 1..18: mol_type = other DNA
taatacgatacacgacag

SEQ ID NO: 29168 - DNA, 18 bp, synthetic construct
  source 1..18: mol_type = other DNA
taatacgatgcaccgtag

SEQ ID NO: 29169 - DNA, 18 bp, synthetic construct
  source 1..18: mol_type = other DNA
taatacggctctttaaag

SEQ ID NO: 29170 - DNA, 18 bp, synthetic construct
  source 1..18: mol_type = other DNA
taatacgtatcactccag

SEQ ID NO: 29171 - DNA, 18 bp, synthetic construct
  source 1..18: mol_type = other DNA
taatacgtcacagaatag

SEQ ID NO: 29172 - DNA, 18 bp, synthetic construct
  source 1..18: mol_type = other DNA
taatacgtctcacacaag

SEQ ID NO: 29173 - DNA, 18 bp, synthetic construct
  source 1..18: mol_type = other DNA
taatacgtctcccttcag

SEQ ID NO: 29174 - DNA, 18 bp, synthetic construct
  source 1..18: mol_type = other DNA
taatacgtctctctgaag

SEQ ID NO: 29175 - DNA, 18 bp, synthetic construct
  source 1..18: mol_type = other DNA
taatacgtcttacaaaag

SEQ ID NO: 29176 - DNA, 18 bp, synthetic construct
  source 1..18: mol_type = other DNA
taatacgtcttaccttag

SEQ ID NO: 29177 - DNA, 18 bp, synthetic construct
  source 1..18: mol_type = other DNA
taatacgtttcactcaag

SEQ ID NO: 29178 - DNA, 18 bp, synthetic construct
  source 1..18: mol_type = other DNA
taatacgtttcactttcg

SEQ ID NO: 29179 - DNA, 18 bp, synthetic construct
  source 1..18: mol_type = other DNA
taatactaataactaaag

SEQ ID NO: 29180 - DNA, 18 bp, synthetic construct
  source 1..18: mol_type = other DNA
taatactactaactctgg

SEQ ID NO: 29181 - DNA, 18 bp, synthetic construct
  source 1..18: mol_type = other DNA
taatactatacaccatag

SEQ ID NO: 29182 - DNA, 18 bp, synthetic construct
  source 1..18: mol_type = other DNA
taatactcctcaacatag

SEQ ID NO: 29183 - DNA, 18 bp, synthetic construct
  source 1..18: mol_type = other DNA
taatactgctcattaaag

SEQ ID NO: 29184 - DNA, 18 bp, synthetic construct
  source 1..18: mol_type = other DNA
taatactgctctatatag

SEQ ID NO: 29185 - DNA, 18 bp, synthetic construct
  source 1..18: mol_type = other DNA
taatacttctcacattag

SEQ ID NO: 29186 - DNA, 18 bp, synthetic construct
  source 1..18: mol_type = other DNA
taatacttcttacaatag

SEQ ID NO: 29187 - DNA, 18 bp, synthetic construct
  source 1..18: mol_type = other DNA
taatacttcttactatcg

SEQ ID NO: 29188 - DNA, 18 bp, synthetic construct
  source 1..18: mol_type = other DNA
taataggactccccttag

SEQ ID NO: 29189 - DNA, 18 bp, synthetic construct
  source 1..18: mol_type = other DNA
taataggtcttactaaag

SEQ ID NO: 29190 - DNA, 18 bp, synthetic construct
  source 1..18: mol_type = other DNA
taatataactccctttag

SEQ ID NO: 29191 - DNA, 18 bp, synthetic construct
  source 1..18: mol_type = other DNA
taatataattcagtatag

SEQ ID NO: 29192 - DNA, 18 bp, synthetic construct
  source 1..18: mol_type = other DNA
taatatctcccactatag

SEQ ID NO: 29193 - DNA, 18 bp, synthetic construct
  source 1..18: mol_type = other DNA
taatatgaaccactttag

SEQ ID NO: 29194 - DNA, 18 bp, synthetic construct
  source 1..18: mol_type = other DNA
taatatgacacaatatcg

SEQ ID NO: 29195 - DNA, 18 bp, synthetic construct
  source 1..18: mol_type = other DNA
taatatgactcacttccg

SEQ ID NO: 29196 - DNA, 18 bp, synthetic construct
  source 1..18: mol_type = other DNA
taatatgattcattacag

SEQ ID NO: 29197 - DNA, 18 bp, synthetic construct
  source 1..18: mol_type = other DNA
taatatgtcatactatag

SEQ ID NO: 29198 - DNA, 18 bp, synthetic construct
  source 1..18: mol_type = other DNA
taatcagactcaaaatag

SEQ ID NO: 29199 - DNA, 18 bp, synthetic construct
  source 1..18: mol_type = other DNA
taatcagattctctatag

SEQ ID NO: 29200 - DNA, 18 bp, synthetic construct
  source 1..18: mol_type = other DNA
taatccgacactctttag

SEQ ID NO: 29201 - DNA, 18 bp, synthetic construct
  source 1..18: mol_type = other DNA
taatccgactctcttaag

SEQ ID NO: 29202 - DNA, 18 bp, synthetic construct
  source 1..18: mol_type = other DNA
taatccgattcacttaag

SEQ ID NO: 29203 - DNA, 18 bp, synthetic construct
  source 1..18: mol_type = other DNA
taatccgattcactttgg

SEQ ID NO: 29204 - DNA, 18 bp, synthetic construct
  source 1..18: mol_type = other DNA
taatccgccacacaatag

SEQ ID NO: 29205 - DNA, 18 bp, synthetic construct
  source 1..18: mol_type = other DNA
taatcctaatcactaaag

SEQ ID NO: 29206 - DNA, 18 bp, synthetic construct
  source 1..18: mol_type = other DNA
taatccttcttactatag

SEQ ID NO: 29207 - DNA, 18 bp, synthetic construct
  source 1..18: mol_type = other DNA
taatctgacacacaatag

SEQ ID NO: 29208 - DNA, 18 bp, synthetic construct
  source 1..18: mol_type = other DNA
taatgagactcataatag

SEQ ID NO: 29209 - DNA, 18 bp, synthetic construct
  source 1..18: mol_type = other DNA
taatgagactctctaaag

SEQ ID NO: 29210 - DNA, 18 bp, synthetic construct
  source 1..18: mol_type = other DNA
taatgcgactcaccccag

SEQ ID NO: 29211 - DNA, 18 bp, synthetic construct
  source 1..18: mol_type = other DNA
taatgcgactcagttcag

SEQ ID NO: 29212 - DNA, 18 bp, synthetic construct
  source 1..18: mol_type = other DNA
taatgcgactctctgtgg

SEQ ID NO: 29213 - DNA, 18 bp, synthetic construct
  source 1..18: mol_type = other DNA
taatgcgatcctctatag

SEQ ID NO: 29214 - DNA, 18 bp, synthetic construct
  source 1..18: mol_type = other DNA
taatgggactctctttag

SEQ ID NO: 29215 - DNA, 18 bp, synthetic construct
  source 1..18: mol_type = other DNA
tacaacgactctccatag

SEQ ID NO: 29216 - DNA, 18 bp, synthetic construct
  source 1..18: mol_type = other DNA
tactaacacacactatag

SEQ ID NO: 29217 - DNA, 18 bp, synthetic construct
  source 1..18: mol_type = other DNA
tactaagaatcaccatag

SEQ ID NO: 29218 - DNA, 18 bp, synthetic construct
  source 1..18: mol_type = other DNA
tactacatcacactatag

SEQ ID NO: 29219 - DNA, 18 bp, synthetic construct
  source 1..18: mol_type = other DNA
tactaccacaccctatag

SEQ ID NO: 29220 - DNA, 18 bp, synthetic construct
  source 1..18: mol_type = other DNA
tactacgactatctacag

SEQ ID NO: 29221 - DNA, 18 bp, synthetic construct
  source 1..18: mol_type = other DNA
tactacgactcatcatcg

SEQ ID NO: 29222 - DNA, 18 bp, synthetic construct
  source 1..18: mol_type = other DNA
tactacgatacactagag

SEQ ID NO: 29223 - DNA, 18 bp, synthetic construct
  source 1..18: mol_type = other DNA
tactacttatcactatag

SEQ ID NO: 29224 - DNA, 18 bp, synthetic construct
  source 1..18: mol_type = other DNA
tagaccgactcactatcg

SEQ ID NO: 29225 - DNA, 18 bp, synthetic construct
  source 1..18: mol_type = other DNA
tagcaagattcactatag

SEQ ID NO: 29226 - DNA, 18 bp, synthetic construct
  source 1..18: mol_type = other DNA
tagtaagacacactttag

SEQ ID NO: 29227 - DNA, 18 bp, synthetic construct
  source 1..18: mol_type = other DNA
tagtacgaatctctttag

SEQ ID NO: 29228 - DNA, 18 bp, synthetic construct
  source 1..18: mol_type = other DNA
tagtacgactcaataacg

SEQ ID NO: 29229 - DNA, 18 bp, synthetic construct
  source 1..18: mol_type = other DNA
tagtacgtctcaataaag

SEQ ID NO: 29230 - DNA, 18 bp, synthetic construct
  source 1..18: mol_type = other DNA
tataacgacacactctag

SEQ ID NO: 29231 - DNA, 18 bp, synthetic construct
  source 1..18: mol_type = other DNA
tataacggcacactatag

SEQ ID NO: 29232 - DNA, 18 bp, synthetic construct
  source 1..18: mol_type = other DNA
tataactactcagtatag

SEQ ID NO: 29233 - DNA, 18 bp, synthetic construct
  source 1..18: mol_type = other DNA
tatcacgtttcactatag

SEQ ID NO: 29234 - DNA, 18 bp, synthetic construct
  source 1..18: mol_type = other DNA
tatgacgactcactttgg

SEQ ID NO: 29235 - DNA, 18 bp, synthetic construct
  source 1..18: mol_type = other DNA
tatgactactcagtatag

SEQ ID NO: 29236 - DNA, 18 bp, synthetic construct
  source 1..18: mol_type = other DNA
tattacaactaactaaag

SEQ ID NO: 29237 - DNA, 18 bp, synthetic construct
  source 1..18: mol_type = other DNA
tattacaattcactttag

SEQ ID NO: 29238 - DNA, 18 bp, synthetic construct
  source 1..18: mol_type = other DNA
tattacgacactctgtag

SEQ ID NO: 29239 - DNA, 18 bp, synthetic construct
  source 1..18: mol_type = other DNA
tattacgactaactgtcg

SEQ ID NO: 29240 - DNA, 18 bp, synthetic construct
  source 1..18: mol_type = other DNA
tattacgactcaacaaag

SEQ ID NO: 29241 - DNA, 18 bp, synthetic construct
  source 1..18: mol_type = other DNA
tattacgactcatgaaag

SEQ ID NO: 29242 - DNA, 18 bp, synthetic construct
  source 1..18: mol_type = other DNA
tattacgagtctctaaag

SEQ ID NO: 29243 - DNA, 18 bp, synthetic construct
  source 1..18: mol_type = other DNA
tattacgattctcgatag

SEQ ID NO: 29244 - DNA, 18 bp, synthetic construct
  source 1..18: mol_type = other DNA
tattacgcctcaatatgg

SEQ ID NO: 29245 - DNA, 18 bp, synthetic construct
  source 1..18: mol_type = other DNA
tattacggatcattatag

SEQ ID NO: 29246 - DNA, 18 bp, synthetic construct
  source 1..18: mol_type = other DNA
tattacgtctccccatag

SEQ ID NO: 29247 - DNA, 18 bp, synthetic construct
  source 1..18: mol_type = other DNA
tattactactcactaacg

SEQ ID NO: 29248 - DNA, 18 bp, synthetic construct
  source 1..18: mol_type = other DNA
tattatgacactctatag

SEQ ID NO: 29249 - DNA, 18 bp, synthetic construct
  source 1..18: mol_type = other DNA
tattccgactttctatag

SEQ ID NO: 29250 - DNA, 18 bp, synthetic construct
  source 1..18: mol_type = other DNA
tattgcaaatcactatag

SEQ ID NO: 29251 - DNA, 18 bp, synthetic construct
  source 1..18: mol_type = other DNA
tattgcatctcactatag

SEQ ID NO: 29252 - DNA, 18 bp, synthetic construct
  source 1..18: mol_type = other DNA
tcaaacaactctctatag

SEQ ID NO: 29253 - DNA, 18 bp, synthetic construct
  source 1..18: mol_type = other DNA
tcataaaaatcactatag

SEQ ID NO: 29254 - DNA, 18 bp, synthetic construct
  source 1..18: mol_type = other DNA
tcataatactcactttag

SEQ ID NO: 29255 - DNA, 18 bp, synthetic construct
  source 1..18: mol_type = other DNA
tcataatactcattatag

SEQ ID NO: 29256 - DNA, 18 bp, synthetic construct
  source 1..18: mol_type = other DNA
tcatacaacttactttag

SEQ ID NO: 29257 - DNA, 18 bp, synthetic construct
  source 1..18: mol_type = other DNA
tcatacatctcactatcg

SEQ ID NO: 29258 - DNA, 18 bp, synthetic construct
  source 1..18: mol_type = other DNA
tcataccactctcaatag

SEQ ID NO: 29259 - DNA, 18 bp, synthetic construct
  source 1..18: mol_type = other DNA
tcatacgacacaataaag

SEQ ID NO: 29260 - DNA, 18 bp, synthetic construct
  source 1..18: mol_type = other DNA
tcatacgactcacattgg

SEQ ID NO: 29261 - DNA, 18 bp, synthetic construct
  source 1..18: mol_type = other DNA
tcatacgactctccatcg

SEQ ID NO: 29262 - DNA, 18 bp, synthetic construct
  source 1..18: mol_type = other DNA
tcatacgatacactacag

SEQ ID NO: 29263 - DNA, 18 bp, synthetic construct
  source 1..18: mol_type = other DNA
tcatacgtttcaatatag

SEQ ID NO: 29264 - DNA, 18 bp, synthetic construct
  source 1..18: mol_type = other DNA
tcatactcctcacaatag

SEQ ID NO: 29265 - DNA, 18 bp, synthetic construct
  source 1..18: mol_type = other DNA
tcatacttctaactatag

SEQ ID NO: 29266 - DNA, 18 bp, synthetic construct
  source 1..18: mol_type = other DNA
tcatatgaccctctatag

SEQ ID NO: 29267 - DNA, 18 bp, synthetic construct
  source 1..18: mol_type = other DNA
tcatgctactcactttag

SEQ ID NO: 29268 - DNA, 18 bp, synthetic construct
  source 1..18: mol_type = other DNA
tcttactactcactgtag

SEQ ID NO: 29269 - DNA, 18 bp, synthetic construct
  source 1..18: mol_type = other DNA
tgaaacacctcactatag

SEQ ID NO: 29270 - DNA, 18 bp, synthetic construct
  source 1..18: mol_type = other DNA
tgaaacgactcaccttag

SEQ ID NO: 29271 - DNA, 18 bp, synthetic construct
  source 1..18: mol_type = other DNA
tgaaaggaatcactatag

SEQ ID NO: 29272 - DNA, 18 bp, synthetic construct
  source 1..18: mol_type = other DNA
tgataaaactcattatag

SEQ ID NO: 29273 - DNA, 18 bp, synthetic construct
  source 1..18: mol_type = other DNA
tgataagacctactatag

SEQ ID NO: 29274 - DNA, 18 bp, synthetic construct
  source 1..18: mol_type = other DNA
tgataccacttactaaag

SEQ ID NO: 29275 - DNA, 18 bp, synthetic construct
  source 1..18: mol_type = other DNA
tgatacgactctcttcag

SEQ ID NO: 29276 - DNA, 18 bp, synthetic construct
  source 1..18: mol_type = other DNA
tgatacgcgtcaatatag

SEQ ID NO: 29277 - DNA, 18 bp, synthetic construct
  source 1..18: mol_type = other DNA
tgatacggctctctaaag

SEQ ID NO: 29278 - DNA, 18 bp, synthetic construct
  source 1..18: mol_type = other DNA
tgataggacacattatag

SEQ ID NO: 29279 - DNA, 18 bp, synthetic construct
  source 1..18: mol_type = other DNA
tgatatgactctctttag

SEQ ID NO: 29280 - DNA, 18 bp, synthetic construct
  source 1..18: mol_type = other DNA
tgatgggactcattatag

SEQ ID NO: 29281 - DNA, 18 bp, synthetic construct
  source 1..18: mol_type = other DNA
tggtacgacttactatgg

SEQ ID NO: 29282 - DNA, 18 bp, synthetic construct
  source 1..18: mol_type = other DNA
tgttaagactcaatatag

SEQ ID NO: 29283 - DNA, 18 bp, synthetic construct
  source 1..18: mol_type = other DNA
ttaaaccactcaccatag

SEQ ID NO: 29284 - DNA, 18 bp, synthetic construct
  source 1..18: mol_type = other DNA
ttaaacgactacctatag

SEQ ID NO: 29285 - DNA, 18 bp, synthetic construct
  source 1..18: mol_type = other DNA
ttaaacgactcacaacag

SEQ ID NO: 29286 - DNA, 18 bp, synthetic construct
  source 1..18: mol_type = other DNA
ttaaacgactcacattag

SEQ ID NO: 29287 - DNA, 18 bp, synthetic construct
  source 1..18: mol_type = other DNA
ttaaacgactcactaacg

SEQ ID NO: 29288 - DNA, 18 bp, synthetic construct
  source 1..18: mol_type = other DNA
ttaaactactcacaatag

SEQ ID NO: 29289 - DNA, 18 bp, synthetic construct
  source 1..18: mol_type = other DNA
ttaaactactgactatag

SEQ ID NO: 29290 - DNA, 18 bp, synthetic construct
  source 1..18: mol_type = other DNA
ttaagagactcactatag

SEQ ID NO: 29291 - DNA, 18 bp, synthetic construct
  source 1..18: mol_type = other DNA
ttacacaactcattatag

SEQ ID NO: 29292 - DNA, 18 bp, synthetic construct
  source 1..18: mol_type = other DNA
ttacagtactcactatag

SEQ ID NO: 29293 - DNA, 18 bp, synthetic construct
  source 1..18: mol_type = other DNA
ttaggcgactcactacag

SEQ ID NO: 29294 - DNA, 18 bp, synthetic construct
  source 1..18: mol_type = other DNA
ttataaaactcaatatag

SEQ ID NO: 29295 - DNA, 18 bp, synthetic construct
  source 1..18: mol_type = other DNA
ttataagaatcacaatag

SEQ ID NO: 29296 - DNA, 18 bp, synthetic construct
  source 1..18: mol_type = other DNA
ttataagtctccctatag

SEQ ID NO: 29297 - DNA, 18 bp, synthetic construct
  source 1..18: mol_type = other DNA
ttataccactcccgatag

SEQ ID NO: 29298 - DNA, 18 bp, synthetic construct
  source 1..18: mol_type = other DNA
ttataccattcactttag

SEQ ID NO: 29299 - DNA, 18 bp, synthetic construct
  source 1..18: mol_type = other DNA
ttatacgaataaatatag

SEQ ID NO: 29300 - DNA, 18 bp, synthetic construct
  source 1..18: mol_type = other DNA
ttatacgacacacttcag

SEQ ID NO: 29301 - DNA, 18 bp, synthetic construct
  source 1..18: mol_type = other DNA
ttatacgacactcgatag

SEQ ID NO: 29302 - DNA, 18 bp, synthetic construct
  source 1..18: mol_type = other DNA
ttatacgacccaatttag

SEQ ID NO: 29303 - DNA, 18 bp, synthetic construct
  source 1..18: mol_type = other DNA
ttatacgactccctgaag

SEQ ID NO: 29304 - DNA, 18 bp, synthetic construct
  source 1..18: mol_type = other DNA
ttatacgactttctagag

SEQ ID NO: 29305 - DNA, 18 bp, synthetic construct
  source 1..18: mol_type = other DNA
ttatacgagtgactaaag

SEQ ID NO: 29306 - DNA, 18 bp, synthetic construct
  source 1..18: mol_type = other DNA
ttatacgtcccattatag

SEQ ID NO: 29307 - DNA, 18 bp, synthetic construct
  source 1..18: mol_type = other DNA
ttatacgtcttactacag

SEQ ID NO: 29308 - DNA, 18 bp, synthetic construct
  source 1..18: mol_type = other DNA
ttatactactgtctatag

SEQ ID NO: 29309 - DNA, 18 bp, synthetic construct
  source 1..18: mol_type = other DNA
ttatactggtcactatag

SEQ ID NO: 29310 - DNA, 18 bp, synthetic construct
  source 1..18: mol_type = other DNA
ttatagcactaactatag

SEQ ID NO: 29311 - DNA, 18 bp, synthetic construct
  source 1..18: mol_type = other DNA
ttatagggctcactttag

SEQ ID NO: 29312 - DNA, 18 bp, synthetic construct
  source 1..18: mol_type = other DNA
ttatagttctcactatag

SEQ ID NO: 29313 - DNA, 18 bp, synthetic construct
  source 1..18: mol_type = other DNA
ttatccgactcacaaaag

SEQ ID NO: 29314 - DNA, 18 bp, synthetic construct
  source 1..18: mol_type = other DNA
ttatccgactcattaaag

SEQ ID NO: 29315 - DNA, 18 bp, synthetic construct
  source 1..18: mol_type = other DNA
ttatgcgacccattatag

SEQ ID NO: 29316 - DNA, 18 bp, synthetic construct
  source 1..18: mol_type = other DNA
ttatgcgatacactatag

SEQ ID NO: 29317 - DNA, 18 bp, synthetic construct
  source 1..18: mol_type = other DNA
ttctaagactcactaaag

SEQ ID NO: 29318 - DNA, 18 bp, synthetic construct
  source 1..18: mol_type = other DNA
ttctacgatacactatag

SEQ ID NO: 29319 - DNA, 18 bp, synthetic construct
  source 1..18: mol_type = other DNA
ttctatgactcactacag

SEQ ID NO: 29320 - DNA, 18 bp, synthetic construct
  source 1..18: mol_type = other DNA
ttgtacgacatactatag

SEQ ID NO: 29321 - DNA, 18 bp, synthetic construct
  source 1..18: mol_type = other DNA
ttgtacgattaactatag

SEQ ID NO: 29322 - DNA, 18 bp, synthetic construct
  source 1..18: mol_type = other DNA
tttgacgactcactttag

SEQ ID NO: 29323 - DNA, 18 bp, synthetic construct
  source 1..18: mol_type = other DNA
ttttacgaataactatag

SEQ ID NO: 29324 - DNA, 18 bp, synthetic construct
  source 1..18: mol_type = other DNA
ttttacgacacactatgg

SEQ ID NO: 29325 - DNA, 18 bp, synthetic construct
  source 1..18: mol_type = other DNA
ttttacgactcattaaag

SEQ ID NO: 29326 - DNA, 18 bp, synthetic construct
  source 1..18: mol_type = other DNA
ttttacgtgtcactatag

SEQ ID NO: 29327 - DNA, 18 bp, synthetic construct
  source 1..18: mol_type = other DNA
taatacgtcacacaattg

SEQ ID NO: 29328 - DNA, 18 bp, synthetic construct
  source 1..18: mol_type = other DNA
tatttcgactcacaaaag

SEQ ID NO: 29329 - DNA, 18 bp, synthetic construct
  source 1..18: mol_type = other DNA
ttatacgacacacttttg

SEQ ID NO: 29330 - DNA, 18 bp, synthetic construct
  source 1..18: mol_type = other DNA
atatacgtctcactattg

SEQ ID NO: 29331 - DNA, 18 bp, synthetic construct
  source 1..18: mol_type = other DNA
tattacgtcccactattg

SEQ ID NO: 29332 - DNA, 18 bp, synthetic construct
  source 1..18: mol_type = other DNA
ttatacgtcccactattg

SEQ ID NO: 29333 - DNA, 18 bp, synthetic construct
  source 1..18: mol_type = other DNA
aaaaacatctcactatag

SEQ ID NO: 29334 - DNA, 18 bp, synthetic construct
  source 1..18: mol_type = other DNA
atatacgaatcactttag

SEQ ID NO: 29335 - DNA, 18 bp, synthetic construct
  source 1..18: mol_type = other DNA
taatatgattcacattag

SEQ ID NO: 29336 - DNA, 18 bp, synthetic construct
  source 1..18: mol_type = other DNA
tataacgtctcactttag

SEQ ID NO: 29337 - DNA, 18 bp, synthetic construct
  source 1..18: mol_type = other DNA
tattacgactcataaaag

SEQ ID NO: 29338 - DNA, 18 bp, synthetic construct
  source 1..18: mol_type = other DNA
ttatacaacacactaaag

SEQ ID NO: 29339 - DNA, 18 bp, synthetic construct
  source 1..18: mol_type = other DNA
ttttactactcactaaag

SEQ ID NO: 29340 - DNA, 18 bp, synthetic construct
  source 1..18: mol_type = other DNA
caattcgacccactattg

SEQ ID NO: 29341 - DNA, 18 bp, synthetic construct
  source 1..18: mol_type = other DNA
taattcgacacgctaaag

SEQ ID NO: 29342 - DNA, 18 bp, synthetic construct
  source 1..18: mol_type = other DNA
agatacgacacactattg

SEQ ID NO: 29343 - DNA, 18 bp, synthetic construct
  source 1..18: mol_type = other DNA
taatacgtttcaccattg

SEQ ID NO: 29344 - DNA, 18 bp, synthetic construct
  source 1..18: mol_type = other DNA
taatacttctaactattg

SEQ ID NO: 29345 - DNA, 18 bp, synthetic construct
  source 1..18: mol_type = other DNA
taatatgtctcaatattg

SEQ ID NO: 29346 - DNA, 18 bp, synthetic construct
  source 1..18: mol_type = other DNA
taatccgtctcacaattg

SEQ ID NO: 29347 - DNA, 18 bp, synthetic construct
  source 1..18: mol_type = other DNA
taattcgaatcacttaag

SEQ ID NO: 29348 - DNA, 18 bp, synthetic construct
  source 1..18: mol_type = other DNA
taattcgacactctttag

SEQ ID NO: 29349 - DNA, 18 bp, synthetic construct
  source 1..18: mol_type = other DNA
taattctattctctatag

SEQ ID NO: 29350 - DNA, 18 bp, synthetic construct
  source 1..18: mol_type = other DNA
tatttcgtctcactacag

SEQ ID NO: 29351 - DNA, 18 bp, synthetic construct
  source 1..18: mol_type = other DNA
ttatacgattcactactg

SEQ ID NO: 29352 - DNA, 18 bp, synthetic construct
  source 1..18: mol_type = other DNA
ttattccactcactctag

SEQ ID NO: 29353 - DNA, 18 bp, synthetic construct
  source 1..18: mol_type = other DNA
ttattcgtcccactatag

SEQ ID NO: 29354 - DNA, 18 bp, synthetic construct
  source 1..18: mol_type = other DNA
aaatacgtctctcaatag

SEQ ID NO: 29355 - DNA, 18 bp, synthetic construct
  source 1..18: mol_type = other DNA
aaatacgttacactatag

SEQ ID NO: 29356 - DNA, 18 bp, synthetic construct
  source 1..18: mol_type = other DNA
aattacgactctctaaag

SEQ ID NO: 29357 - DNA, 18 bp, synthetic construct
  source 1..18: mol_type = other DNA
ataaacgactcactatgg

SEQ ID NO: 29358 - DNA, 18 bp, synthetic construct
  source 1..18: mol_type = other DNA
atatacgactctctatgg

SEQ ID NO: 29359 - DNA, 18 bp, synthetic construct
  source 1..18: mol_type = other DNA
taatacaattctctttag

SEQ ID NO: 29360 - DNA, 18 bp, synthetic construct
  source 1..18: mol_type = other DNA
taatacgaatctgtaaag

SEQ ID NO: 29361 - DNA, 18 bp, synthetic construct
  source 1..18: mol_type = other DNA
taatacttctcattaaag

SEQ ID NO: 29362 - DNA, 18 bp, synthetic construct
  source 1..18: mol_type = other DNA
taatacttttcactaaag

SEQ ID NO: 29363 - DNA, 18 bp, synthetic construct
  source 1..18: mol_type = other DNA
taatacttttcactttag

SEQ ID NO: 29364 - DNA, 18 bp, synthetic construct
  source 1..18: mol_type = other DNA
taatataacactctatag

SEQ ID NO: 29365 - DNA, 18 bp, synthetic construct
  source 1..18: mol_type = other DNA
taatatgacacacaaaag

SEQ ID NO: 29366 - DNA, 18 bp, synthetic construct
  source 1..18: mol_type = other DNA
taatatgacacattttag

SEQ ID NO: 29367 - DNA, 18 bp, synthetic construct
  source 1..18: mol_type = other DNA
taatgctattcactttag

SEQ ID NO: 29368 - DNA, 18 bp, synthetic construct
  source 1..18: mol_type = other DNA
tattacgattgtctatag

SEQ ID NO: 29369 - DNA, 18 bp, synthetic construct
  source 1..18: mol_type = other DNA
tcatacatctcactaaag

SEQ ID NO: 29370 - DNA, 18 bp, synthetic construct
  source 1..18: mol_type = other DNA
tgaaacgtctcactttag

SEQ ID NO: 29371 - DNA, 18 bp, synthetic construct
  source 1..18: mol_type = other DNA
tgttacaactctctatag

SEQ ID NO: 29372 - DNA, 18 bp, synthetic construct
  source 1..18: mol_type = other DNA
ttaaactactcaccatag

SEQ ID NO: 29373 - DNA, 18 bp, synthetic construct
  source 1..18: mol_type = other DNA
ttatacgacactccatag

SEQ ID NO: 29374 - DNA, 18 bp, synthetic construct
  source 1..18: mol_type = other DNA
ttatacggctcaccaaag

SEQ ID NO: 29375 - DNA, 18 bp, synthetic construct
  source 1..18: mol_type = other DNA
ttatacgtattactatag

SEQ ID NO: 29376 - DNA, 18 bp, synthetic construct
  source 1..18: mol_type = other DNA
ttatactcctcactatcg

SEQ ID NO: 29377 - DNA, 18 bp, synthetic construct
  source 1..18: mol_type = other DNA
ttatatgaatcactaaag

SEQ ID NO: 29378 - DNA, 18 bp, synthetic construct
  source 1..18: mol_type = other DNA
ttatccgcctcactttag

SEQ ID NO: 29379 - DNA, 18 bp, synthetic construct
  source 1..18: mol_type = other DNA
ttgtacgactcacttaag

SEQ ID NO: 29380 - DNA, 18 bp, synthetic construct
  source 1..18: mol_type = other DNA
tttcactactcactatag

SEQ ID NO: 29381 - DNA, 18 bp, synthetic construct
  source 1..18: mol_type = other DNA
ttatacatctcactattg

SEQ ID NO: 29382 - DNA, 18 bp, synthetic construct
  source 1..18: mol_type = other DNA
aaattcgactctctttag

SEQ ID NO: 29383 - DNA, 18 bp, synthetic construct
  source 1..18: mol_type = other DNA
taatacgattctctactg

SEQ ID NO: 29384 - DNA, 18 bp, synthetic construct
  source 1..18: mol_type = other DNA
taatatgactctcttttg

SEQ ID NO: 29385 - DNA, 18 bp, synthetic construct
  source 1..18: mol_type = other DNA
tatttcaactcactttag

SEQ ID NO: 29386 - DNA, 18 bp, synthetic construct
  source 1..18: mol_type = other DNA
aaatgcgtctcactaaag

SEQ ID NO: 29387 - DNA, 18 bp, synthetic construct
  source 1..18: mol_type = other DNA
taatacgcctctcttaag

SEQ ID NO: 29388 - DNA, 18 bp, synthetic construct
  source 1..18: mol_type = other DNA
taattcttctcactaaag

SEQ ID NO: 29389 - DNA, 18 bp, synthetic construct
  source 1..18: mol_type = other DNA
ttaatcaactcactatag

SEQ ID NO: 29390 - DNA, 18 bp, synthetic construct
  source 1..18: mol_type = other DNA
ttattagactctctatag

SEQ ID NO: 29391 - DNA, 18 bp, synthetic construct
  source 1..18: mol_type = other DNA
aaaaacgtcttactatag

SEQ ID NO: 29392 - DNA, 18 bp, synthetic construct
  source 1..18: mol_type = other DNA
atatacgactcacaaaag

SEQ ID NO: 29393 - DNA, 18 bp, synthetic construct
  source 1..18: mol_type = other DNA
taatacgattttctttag

SEQ ID NO: 29394 - DNA, 18 bp, synthetic construct
  source 1..18: mol_type = other DNA
taatatgtctctcaatag

SEQ ID NO: 29395 - DNA, 18 bp, synthetic construct
  source 1..18: mol_type = other DNA
tattacgactctttttag

SEQ ID NO: 29396 - DNA, 18 bp, synthetic construct
  source 1..18: mol_type = other DNA
tcatacgtctctctaaag

SEQ ID NO: 29397 - DNA, 18 bp, synthetic construct
  source 1..18: mol_type = other DNA
ttttacgtctctctatag

SEQ ID NO: 29398 - DNA, 18 bp, synthetic construct
  source 1..18: mol_type = other DNA
caattcgactaactattg

SEQ ID NO: 29399 - DNA, 18 bp, synthetic construct
  source 1..18: mol_type = other DNA
taattcacctcgctatag

SEQ ID NO: 29400 - DNA, 18 bp, synthetic construct
  source 1..18: mol_type = other DNA
taattcgaatcgctatgg

SEQ ID NO: 29401 - DNA, 18 bp, synthetic construct
  source 1..18: mol_type = other DNA
taattctactcagtattg

SEQ ID NO: 29402 - DNA, 18 bp, synthetic construct
  source 1..18: mol_type = other DNA
ttattcgactcactgttg

SEQ ID NO: 29403 - DNA, 18 bp, synthetic construct
  source 1..18: mol_type = other DNA
aaatacctctcactattg

SEQ ID NO: 29404 - DNA, 18 bp, synthetic construct
  source 1..18: mol_type = other DNA
aaatactactcacaattg

SEQ ID NO: 29405 - DNA, 18 bp, synthetic construct
  source 1..18: mol_type = other DNA
aaattcaacacactatag

SEQ ID NO: 29406 - DNA, 18 bp, synthetic construct
  source 1..18: mol_type = other DNA
aaattcaactcactttag

SEQ ID NO: 29407 - DNA, 18 bp, synthetic construct
  source 1..18: mol_type = other DNA
aaattcgactcagaatag

SEQ ID NO: 29408 - DNA, 18 bp, synthetic construct
  source 1..18: mol_type = other DNA
aaattctactcattatag

SEQ ID NO: 29409 - DNA, 18 bp, synthetic construct
  source 1..18: mol_type = other DNA
aattacggctcactattg

SEQ ID NO: 29410 - DNA, 18 bp, synthetic construct
  source 1..18: mol_type = other DNA
caaatcgactcattatag

SEQ ID NO: 29411 - DNA, 18 bp, synthetic construct
  source 1..18: mol_type = other DNA
caacacgaatcactattg

SEQ ID NO: 29412 - DNA, 18 bp, synthetic construct
  source 1..18: mol_type = other DNA
caatacaactcacttttg

SEQ ID NO: 29413 - DNA, 18 bp, synthetic construct
  source 1..18: mol_type = other DNA
caatacgaatcactaatg

SEQ ID NO: 29414 - DNA, 18 bp, synthetic construct
  source 1..18: mol_type = other DNA
caattcgactaactaaag

SEQ ID NO: 29415 - DNA, 18 bp, synthetic construct
  source 1..18: mol_type = other DNA
caattctattcactatag

SEQ ID NO: 29416 - DNA, 18 bp, synthetic construct
  source 1..18: mol_type = other DNA
catttcgactcattatag

SEQ ID NO: 29417 - DNA, 18 bp, synthetic construct
  source 1..18: mol_type = other DNA
gattacgactctctattg

SEQ ID NO: 29418 - DNA, 18 bp, synthetic construct
  source 1..18: mol_type = other DNA
taaaacgactcacagttg

SEQ ID NO: 29419 - DNA, 18 bp, synthetic construct
  source 1..18: mol_type = other DNA
taaaagaactcactattg

SEQ ID NO: 29420 - DNA, 18 bp, synthetic construct
  source 1..18: mol_type = other DNA
taaatcgactccccatag

SEQ ID NO: 29421 - DNA, 18 bp, synthetic construct
  source 1..18: mol_type = other DNA
taacaaaactcactattg

SEQ ID NO: 29422 - DNA, 18 bp, synthetic construct
  source 1..18: mol_type = other DNA
taacacgactgaatattg

SEQ ID NO: 29423 - DNA, 18 bp, synthetic construct
  source 1..18: mol_type = other DNA
taacacgtttcactattg

SEQ ID NO: 29424 - DNA, 18 bp, synthetic construct
  source 1..18: mol_type = other DNA
taactcgattgactatag

SEQ ID NO: 29425 - DNA, 18 bp, synthetic construct
  source 1..18: mol_type = other DNA
taatacaactctctaatg

SEQ ID NO: 29426 - DNA, 18 bp, synthetic construct
  source 1..18: mol_type = other DNA
taataccactcataattg

SEQ ID NO: 29427 - DNA, 18 bp, synthetic construct
  source 1..18: mol_type = other DNA
taatacctcacactattg

SEQ ID NO: 29428 - DNA, 18 bp, synthetic construct
  source 1..18: mol_type = other DNA
taatacctctcactactg

SEQ ID NO: 29429 - DNA, 18 bp, synthetic construct
  source 1..18: mol_type = other DNA
taatacgactaacagttg

SEQ ID NO: 29430 - DNA, 18 bp, synthetic construct
  source 1..18: mol_type = other DNA
taatacgactctctgatg

SEQ ID NO: 29431 - DNA, 18 bp, synthetic construct
  source 1..18: mol_type = other DNA
taatacgactttatattg

SEQ ID NO: 29432 - DNA, 18 bp, synthetic construct
  source 1..18: mol_type = other DNA
taatacgattaattattg

SEQ ID NO: 29433 - DNA, 18 bp, synthetic construct
  source 1..18: mol_type = other DNA
taatacgattaggtatag

SEQ ID NO: 29434 - DNA, 18 bp, synthetic construct
  source 1..18: mol_type = other DNA
taatacgattcaaaattg

SEQ ID NO: 29435 - DNA, 18 bp, synthetic construct
  source 1..18: mol_type = other DNA
taatacgattcaattttg

SEQ ID NO: 29436 - DNA, 18 bp, synthetic construct
  source 1..18: mol_type = other DNA
taatacggctcccaattg

SEQ ID NO: 29437 - DNA, 18 bp, synthetic construct
  source 1..18: mol_type = other DNA
taatacgtcacactagtg

SEQ ID NO: 29438 - DNA, 18 bp, synthetic construct
  source 1..18: mol_type = other DNA
taatacgtctcccttttg

SEQ ID NO: 29439 - DNA, 18 bp, synthetic construct
  source 1..18: mol_type = other DNA
taatacgtctggatatag

SEQ ID NO: 29440 - DNA, 18 bp, synthetic construct
  source 1..18: mol_type = other DNA
taatactacacgcaatag

SEQ ID NO: 29441 - DNA, 18 bp, synthetic construct
  source 1..18: mol_type = other DNA
taatactacccaccattg

SEQ ID NO: 29442 - DNA, 18 bp, synthetic construct
  source 1..18: mol_type = other DNA
taatactacccactaatg

SEQ ID NO: 29443 - DNA, 18 bp, synthetic construct
  source 1..18: mol_type = other DNA
taatactactcaccaatg

SEQ ID NO: 29444 - DNA, 18 bp, synthetic construct
  source 1..18: mol_type = other DNA
taatactactcgcttaag

SEQ ID NO: 29445 - DNA, 18 bp, synthetic construct
  source 1..18: mol_type = other DNA
taatactcctcgcaatag

SEQ ID NO: 29446 - DNA, 18 bp, synthetic construct
  source 1..18: mol_type = other DNA
taataggaatcattattg

SEQ ID NO: 29447 - DNA, 18 bp, synthetic construct
  source 1..18: mol_type = other DNA
taataggactcaccaatg

SEQ ID NO: 29448 - DNA, 18 bp, synthetic construct
  source 1..18: mol_type = other DNA
taataggtctaactattg

SEQ ID NO: 29449 - DNA, 18 bp, synthetic construct
  source 1..18: mol_type = other DNA
taatatgactctctcttg

SEQ ID NO: 29450 - DNA, 18 bp, synthetic construct
  source 1..18: mol_type = other DNA
taatccgactttctattg

SEQ ID NO: 29451 - DNA, 18 bp, synthetic construct
  source 1..18: mol_type = other DNA
taatccgtctaactattg

SEQ ID NO: 29452 - DNA, 18 bp, synthetic construct
  source 1..18: mol_type = other DNA
taatccgtctcgctatcg

SEQ ID NO: 29453 - DNA, 18 bp, synthetic construct
  source 1..18: mol_type = other DNA
taatgagcctcactattg

SEQ ID NO: 29454 - DNA, 18 bp, synthetic construct
  source 1..18: mol_type = other DNA
taatgcgacaaactattg

SEQ ID NO: 29455 - DNA, 18 bp, synthetic construct
  source 1..18: mol_type = other DNA
taattatacttactatag

SEQ ID NO: 29456 - DNA, 18 bp, synthetic construct
  source 1..18: mol_type = other DNA
taattcaaatcacaatag

SEQ ID NO: 29457 - DNA, 18 bp, synthetic construct
  source 1..18: mol_type = other DNA
taattcaacaccctatag

SEQ ID NO: 29458 - DNA, 18 bp, synthetic construct
  source 1..18: mol_type = other DNA
taattcatcttactatag

SEQ ID NO: 29459 - DNA, 18 bp, synthetic construct
  source 1..18: mol_type = other DNA
taattccaatcacaatag

SEQ ID NO: 29460 - DNA, 18 bp, synthetic construct
  source 1..18: mol_type = other DNA
taattcctttcactatag

SEQ ID NO: 29461 - DNA, 18 bp, synthetic construct
  source 1..18: mol_type = other DNA
taattcgaaactctatag

SEQ ID NO: 29462 - DNA, 18 bp, synthetic construct
  source 1..18: mol_type = other DNA
taattcgaatctctgtag

SEQ ID NO: 29463 - DNA, 18 bp, synthetic construct
  source 1..18: mol_type = other DNA
taattcgacccagaatag

SEQ ID NO: 29464 - DNA, 18 bp, synthetic construct
  source 1..18: mol_type = other DNA
taattcgactaacattag

SEQ ID NO: 29465 - DNA, 18 bp, synthetic construct
  source 1..18: mol_type = other DNA
taattcgacttactttcg

SEQ ID NO: 29466 - DNA, 18 bp, synthetic construct
  source 1..18: mol_type = other DNA
taattcgagacactaaag

SEQ ID NO: 29467 - DNA, 18 bp, synthetic construct
  source 1..18: mol_type = other DNA
taattcgatacactagag

SEQ ID NO: 29468 - DNA, 18 bp, synthetic construct
  source 1..18: mol_type = other DNA
taattcgattaactgtag

SEQ ID NO: 29469 - DNA, 18 bp, synthetic construct
  source 1..18: mol_type = other DNA
taattcgcattactatag

SEQ ID NO: 29470 - DNA, 18 bp, synthetic construct
  source 1..18: mol_type = other DNA
taattcggctcactttcg

SEQ ID NO: 29471 - DNA, 18 bp, synthetic construct
  source 1..18: mol_type = other DNA
taattcggcttaccatag

SEQ ID NO: 29472 - DNA, 18 bp, synthetic construct
  source 1..18: mol_type = other DNA
taattcgtctcaccgtag

SEQ ID NO: 29473 - DNA, 18 bp, synthetic construct
  source 1..18: mol_type = other DNA
taattcgtctcactttgg

SEQ ID NO: 29474 - DNA, 18 bp, synthetic construct
  source 1..18: mol_type = other DNA
taattcgtctccctatcg

SEQ ID NO: 29475 - DNA, 18 bp, synthetic construct
  source 1..18: mol_type = other DNA
taattctacacactgtag

SEQ ID NO: 29476 - DNA, 18 bp, synthetic construct
  source 1..18: mol_type = other DNA
taattctactgacgatag

SEQ ID NO: 29477 - DNA, 18 bp, synthetic construct
  source 1..18: mol_type = other DNA
taattggaatcattatag

SEQ ID NO: 29478 - DNA, 18 bp, synthetic construct
  source 1..18: mol_type = other DNA
taattggacacaatatag

SEQ ID NO: 29479 - DNA, 18 bp, synthetic construct
  source 1..18: mol_type = other DNA
taatttgtctccctatag

SEQ ID NO: 29480 - DNA, 18 bp, synthetic construct
  source 1..18: mol_type = other DNA
tacaacgactcaatattg

SEQ ID NO: 29481 - DNA, 18 bp, synthetic construct
  source 1..18: mol_type = other DNA
tactaccactcagtattg

SEQ ID NO: 29482 - DNA, 18 bp, synthetic construct
  source 1..18: mol_type = other DNA
tactacgacacattattg

SEQ ID NO: 29483 - DNA, 18 bp, synthetic construct
  source 1..18: mol_type = other DNA
tactaggactaactattg

SEQ ID NO: 29484 - DNA, 18 bp, synthetic construct
  source 1..18: mol_type = other DNA
tacttcgactgactttag

SEQ ID NO: 29485 - DNA, 18 bp, synthetic construct
  source 1..18: mol_type = other DNA
tagtacgaatcacttttg

SEQ ID NO: 29486 - DNA, 18 bp, synthetic construct
  source 1..18: mol_type = other DNA
tagttcaactcagtatag

SEQ ID NO: 29487 - DNA, 18 bp, synthetic construct
  source 1..18: mol_type = other DNA
tagttcgactcacttaag

SEQ ID NO: 29488 - DNA, 18 bp, synthetic construct
  source 1..18: mol_type = other DNA
tagttcgacttattatag

SEQ ID NO: 29489 - DNA, 18 bp, synthetic construct
  source 1..18: mol_type = other DNA
tatcacgcctcgctatag

SEQ ID NO: 29490 - DNA, 18 bp, synthetic construct
  source 1..18: mol_type = other DNA
tatcacgtctcgctatag

SEQ ID NO: 29491 - DNA, 18 bp, synthetic construct
  source 1..18: mol_type = other DNA
tattacgactcaatgttg

SEQ ID NO: 29492 - DNA, 18 bp, synthetic construct
  source 1..18: mol_type = other DNA
tattacgactcattcttg

SEQ ID NO: 29493 - DNA, 18 bp, synthetic construct
  source 1..18: mol_type = other DNA
tattacgattccctattg

SEQ ID NO: 29494 - DNA, 18 bp, synthetic construct
  source 1..18: mol_type = other DNA
tattactactcattattg

SEQ ID NO: 29495 - DNA, 18 bp, synthetic construct
  source 1..18: mol_type = other DNA
tattcagactcactattg

SEQ ID NO: 29496 - DNA, 18 bp, synthetic construct
  source 1..18: mol_type = other DNA
tattccgacacactattg

SEQ ID NO: 29497 - DNA, 18 bp, synthetic construct
  source 1..18: mol_type = other DNA
tatttcgcctcactagag

SEQ ID NO: 29498 - DNA, 18 bp, synthetic construct
  source 1..18: mol_type = other DNA
tatttggaatcactatag

SEQ ID NO: 29499 - DNA, 18 bp, synthetic construct
  source 1..18: mol_type = other DNA
tcattcgactctctttag

SEQ ID NO: 29500 - DNA, 18 bp, synthetic construct
  source 1..18: mol_type = other DNA
tcattcgactttctatag

SEQ ID NO: 29501 - DNA, 18 bp, synthetic construct
  source 1..18: mol_type = other DNA
tgattcgagtcactaaag

SEQ ID NO: 29502 - DNA, 18 bp, synthetic construct
  source 1..18: mol_type = other DNA
tgtttcgactctctatag

SEQ ID NO: 29503 - DNA, 18 bp, synthetic construct
  source 1..18: mol_type = other DNA
tgtttctactcactatag

SEQ ID NO: 29504 - DNA, 18 bp, synthetic construct
  source 1..18: mol_type = other DNA
ttaaacgattcactattg

SEQ ID NO: 29505 - DNA, 18 bp, synthetic construct
  source 1..18: mol_type = other DNA
ttactcgactcaatatag

SEQ ID NO: 29506 - DNA, 18 bp, synthetic construct
  source 1..18: mol_type = other DNA
ttactcgactctctatag

SEQ ID NO: 29507 - DNA, 18 bp, synthetic construct
  source 1..18: mol_type = other DNA
ttagtcgtctcactatag

SEQ ID NO: 29508 - DNA, 18 bp, synthetic construct
  source 1..18: mol_type = other DNA
ttatacgacaaactattg

SEQ ID NO: 29509 - DNA, 18 bp, synthetic construct
  source 1..18: mol_type = other DNA
ttatacgactgactaatg

SEQ ID NO: 29510 - DNA, 18 bp, synthetic construct
  source 1..18: mol_type = other DNA
ttattcgaatccctatag

SEQ ID NO: 29511 - DNA, 18 bp, synthetic construct
  source 1..18: mol_type = other DNA
ttgttcaactcactatag

SEQ ID NO: 29512 - DNA, 18 bp, synthetic construct
  source 1..18: mol_type = other DNA
aaaaacgtatcactatag

SEQ ID NO: 29513 - DNA, 18 bp, synthetic construct
  source 1..18: mol_type = other DNA
aaacacgactctcaatag

SEQ ID NO: 29514 - DNA, 18 bp, synthetic construct
  source 1..18: mol_type = other DNA
aaataattctcactatag

SEQ ID NO: 29515 - DNA, 18 bp, synthetic construct
  source 1..18: mol_type = other DNA
aaatacaaatctctatag

SEQ ID NO: 29516 - DNA, 18 bp, synthetic construct
  source 1..18: mol_type = other DNA
aaatacaactctcaatag

SEQ ID NO: 29517 - DNA, 18 bp, synthetic construct
  source 1..18: mol_type = other DNA
aaatacgaataattatag

SEQ ID NO: 29518 - DNA, 18 bp, synthetic construct
  source 1..18: mol_type = other DNA
aaatacgaattacaatag

SEQ ID NO: 29519 - DNA, 18 bp, synthetic construct
  source 1..18: mol_type = other DNA
aaatacgactctctgaag

SEQ ID NO: 29520 - DNA, 18 bp, synthetic construct
  source 1..18: mol_type = other DNA
aaatacgactctcttgag

SEQ ID NO: 29521 - DNA, 18 bp, synthetic construct
  source 1..18: mol_type = other DNA
aaatacgacttactctcg

SEQ ID NO: 29522 - DNA, 18 bp, synthetic construct
  source 1..18: mol_type = other DNA
aaatacgactttctaaag

SEQ ID NO: 29523 - DNA, 18 bp, synthetic construct
  source 1..18: mol_type = other DNA
aaatacgattctctaaag

SEQ ID NO: 29524 - DNA, 18 bp, synthetic construct
  source 1..18: mol_type = other DNA
aaatacgattctctatcg

SEQ ID NO: 29525 - DNA, 18 bp, synthetic construct
  source 1..18: mol_type = other DNA
aaatacggttcaatatag

SEQ ID NO: 29526 - DNA, 18 bp, synthetic construct
  source 1..18: mol_type = other DNA
aaatacgtctaacaatag

SEQ ID NO: 29527 - DNA, 18 bp, synthetic construct
  source 1..18: mol_type = other DNA
aaatacgtctaactaaag

SEQ ID NO: 29528 - DNA, 18 bp, synthetic construct
  source 1..18: mol_type = other DNA
aaatacgtctcactttcg

SEQ ID NO: 29529 - DNA, 18 bp, synthetic construct
  source 1..18: mol_type = other DNA
aaatagggctcactttag

SEQ ID NO: 29530 - DNA, 18 bp, synthetic construct
  source 1..18: mol_type = other DNA
aaatatgactcacttgag

SEQ ID NO: 29531 - DNA, 18 bp, synthetic construct
  source 1..18: mol_type = other DNA
aaatatgactcagtttag

SEQ ID NO: 29532 - DNA, 18 bp, synthetic construct
  source 1..18: mol_type = other DNA
aaatatggctcacaatag

SEQ ID NO: 29533 - DNA, 18 bp, synthetic construct
  source 1..18: mol_type = other DNA
aaatccgactcacttaag

SEQ ID NO: 29534 - DNA, 18 bp, synthetic construct
  source 1..18: mol_type = other DNA
aaatgccaatcactatag

SEQ ID NO: 29535 - DNA, 18 bp, synthetic construct
  source 1..18: mol_type = other DNA
aactacgattcacaatag

SEQ ID NO: 29536 - DNA, 18 bp, synthetic construct
  source 1..18: mol_type = other DNA
aactccgaatcactatag

SEQ ID NO: 29537 - DNA, 18 bp, synthetic construct
  source 1..18: mol_type = other DNA
aatcacgcctcactatag

SEQ ID NO: 29538 - DNA, 18 bp, synthetic construct
  source 1..18: mol_type = other DNA
aattaccactcattatag

SEQ ID NO: 29539 - DNA, 18 bp, synthetic construct
  source 1..18: mol_type = other DNA
aattacctctcactatag

SEQ ID NO: 29540 - DNA, 18 bp, synthetic construct
  source 1..18: mol_type = other DNA
aattacgacacactctag

SEQ ID NO: 29541 - DNA, 18 bp, synthetic construct
  source 1..18: mol_type = other DNA
aattacgactcaaaatag

SEQ ID NO: 29542 - DNA, 18 bp, synthetic construct
  source 1..18: mol_type = other DNA
aattacgactcacattag

SEQ ID NO: 29543 - DNA, 18 bp, synthetic construct
  source 1..18: mol_type = other DNA
aattacgattcaccatag

SEQ ID NO: 29544 - DNA, 18 bp, synthetic construct
  source 1..18: mol_type = other DNA
aattacgcctctctatag

SEQ ID NO: 29545 - DNA, 18 bp, synthetic construct
  source 1..18: mol_type = other DNA
aattccgattcactatag

SEQ ID NO: 29546 - DNA, 18 bp, synthetic construct
  source 1..18: mol_type = other DNA
acataagactcactacag

SEQ ID NO: 29547 - DNA, 18 bp, synthetic construct
  source 1..18: mol_type = other DNA
acatacgacacaccatag

SEQ ID NO: 29548 - DNA, 18 bp, synthetic construct
  source 1..18: mol_type = other DNA
acatacgcctcactatcg

SEQ ID NO: 29549 - DNA, 18 bp, synthetic construct
  source 1..18: mol_type = other DNA
acatatgactcaatatag

SEQ ID NO: 29550 - DNA, 18 bp, synthetic construct
  source 1..18: mol_type = other DNA
atatacgactaactaaag

SEQ ID NO: 29551 - DNA, 18 bp, synthetic construct
  source 1..18: mol_type = other DNA
atatacgcctcagtatag

SEQ ID NO: 29552 - DNA, 18 bp, synthetic construct
  source 1..18: mol_type = other DNA
atatacggcacactatag

SEQ ID NO: 29553 - DNA, 18 bp, synthetic construct
  source 1..18: mol_type = other DNA
atatatgaatcactatag

SEQ ID NO: 29554 - DNA, 18 bp, synthetic construct
  source 1..18: mol_type = other DNA
caataagacacacaatag

SEQ ID NO: 29555 - DNA, 18 bp, synthetic construct
  source 1..18: mol_type = other DNA
caatacgacttccgatag

SEQ ID NO: 29556 - DNA, 18 bp, synthetic construct
  source 1..18: mol_type = other DNA
caatacgtctcaatttag

SEQ ID NO: 29557 - DNA, 18 bp, synthetic construct
  source 1..18: mol_type = other DNA
caatacgtctctctctag

SEQ ID NO: 29558 - DNA, 18 bp, synthetic construct
  source 1..18: mol_type = other DNA
caatgtgattcactatag

SEQ ID NO: 29559 - DNA, 18 bp, synthetic construct
  source 1..18: mol_type = other DNA
cattactacacactatag

SEQ ID NO: 29560 - DNA, 18 bp, synthetic construct
  source 1..18: mol_type = other DNA
ccatactactcacaatag

SEQ ID NO: 29561 - DNA, 18 bp, synthetic construct
  source 1..18: mol_type = other DNA
ccatactactcactatgg

SEQ ID NO: 29562 - DNA, 18 bp, synthetic construct
  source 1..18: mol_type = other DNA
ctatacgactcacaatcg

SEQ ID NO: 29563 - DNA, 18 bp, synthetic construct
  source 1..18: mol_type = other DNA
ctatacgactcacttaag

SEQ ID NO: 29564 - DNA, 18 bp, synthetic construct
  source 1..18: mol_type = other DNA
ctatccgactcacaatag

SEQ ID NO: 29565 - DNA, 18 bp, synthetic construct
  source 1..18: mol_type = other DNA
gaaaatgactcactttag

SEQ ID NO: 29566 - DNA, 18 bp, synthetic construct
  source 1..18: mol_type = other DNA
gataaagactcactatag

SEQ ID NO: 29567 - DNA, 18 bp, synthetic construct
  source 1..18: mol_type = other DNA
gtatacgagtaactatag

SEQ ID NO: 29568 - DNA, 18 bp, synthetic construct
  source 1..18: mol_type = other DNA
gtatacggttcactatag

SEQ ID NO: 29569 - DNA, 18 bp, synthetic construct
  source 1..18: mol_type = other DNA
gtatccgaatcactatag

SEQ ID NO: 29570 - DNA, 18 bp, synthetic construct
  source 1..18: mol_type = other DNA
taaaaacactcactatgg

SEQ ID NO: 29571 - DNA, 18 bp, synthetic construct
  source 1..18: mol_type = other DNA
taaaacaactaactacag

SEQ ID NO: 29572 - DNA, 18 bp, synthetic construct
  source 1..18: mol_type = other DNA
taaaacgacagactttag

SEQ ID NO: 29573 - DNA, 18 bp, synthetic construct
  source 1..18: mol_type = other DNA
taaaacgacctaatatag

SEQ ID NO: 29574 - DNA, 18 bp, synthetic construct
  source 1..18: mol_type = other DNA
taaaacgtctcacaagag

SEQ ID NO: 29575 - DNA, 18 bp, synthetic construct
  source 1..18: mol_type = other DNA
taaaactactcactctgg

SEQ ID NO: 29576 - DNA, 18 bp, synthetic construct
  source 1..18: mol_type = other DNA
taaaacttctcactacag

SEQ ID NO: 29577 - DNA, 18 bp, synthetic construct
  source 1..18: mol_type = other DNA
taaaataacttactatag

SEQ ID NO: 29578 - DNA, 18 bp, synthetic construct
  source 1..18: mol_type = other DNA
taaacctcctcactatag

SEQ ID NO: 29579 - DNA, 18 bp, synthetic construct
  source 1..18: mol_type = other DNA
taaagcgactaattatag

SEQ ID NO: 29580 - DNA, 18 bp, synthetic construct
  source 1..18: mol_type = other DNA
taacaagacactctatag

SEQ ID NO: 29581 - DNA, 18 bp, synthetic construct
  source 1..18: mol_type = other DNA
taacaagtttcactatag

SEQ ID NO: 29582 - DNA, 18 bp, synthetic construct
  source 1..18: mol_type = other DNA
taacacctctaactatag

SEQ ID NO: 29583 - DNA, 18 bp, synthetic construct
  source 1..18: mol_type = other DNA
taacacgtctcacattag

SEQ ID NO: 29584 - DNA, 18 bp, synthetic construct
  source 1..18: mol_type = other DNA
taacactgcacactatag

SEQ ID NO: 29585 - DNA, 18 bp, synthetic construct
  source 1..18: mol_type = other DNA
taaccctactcacaatag

SEQ ID NO: 29586 - DNA, 18 bp, synthetic construct
  source 1..18: mol_type = other DNA
taataaatctaactatag

SEQ ID NO: 29587 - DNA, 18 bp, synthetic construct
  source 1..18: mol_type = other DNA
taataagaatcattctag

SEQ ID NO: 29588 - DNA, 18 bp, synthetic construct
  source 1..18: mol_type = other DNA
taataagattcattaaag

SEQ ID NO: 29589 - DNA, 18 bp, synthetic construct
  source 1..18: mol_type = other DNA
taataaggcactctatag

SEQ ID NO: 29590 - DNA, 18 bp, synthetic construct
  source 1..18: mol_type = other DNA
taatacaaatctctacag

SEQ ID NO: 29591 - DNA, 18 bp, synthetic construct
  source 1..18: mol_type = other DNA
taatacaacacaatacag

SEQ ID NO: 29592 - DNA, 18 bp, synthetic construct
  source 1..18: mol_type = other DNA
taatacaacacattgtag

SEQ ID NO: 29593 - DNA, 18 bp, synthetic construct
  source 1..18: mol_type = other DNA
taatacaacttactttcg

SEQ ID NO: 29594 - DNA, 18 bp, synthetic construct
  source 1..18: mol_type = other DNA
taatacaactttctatcg

SEQ ID NO: 29595 - DNA, 18 bp, synthetic construct
  source 1..18: mol_type = other DNA
taatacaagtaacaatag

SEQ ID NO: 29596 - DNA, 18 bp, synthetic construct
  source 1..18: mol_type = other DNA
taataccaattactaaag

SEQ ID NO: 29597 - DNA, 18 bp, synthetic construct
  source 1..18: mol_type = other DNA
taataccactaacattag

SEQ ID NO: 29598 - DNA, 18 bp, synthetic construct
  source 1..18: mol_type = other DNA
taataccattcacttaag

SEQ ID NO: 29599 - DNA, 18 bp, synthetic construct
  source 1..18: mol_type = other DNA
taatacgaacctcaatag

SEQ ID NO: 29600 - DNA, 18 bp, synthetic construct
  source 1..18: mol_type = other DNA
taatacgaatcattttcg

SEQ ID NO: 29601 - DNA, 18 bp, synthetic construct
  source 1..18: mol_type = other DNA
taatacgacaacctttag

SEQ ID NO: 29602 - DNA, 18 bp, synthetic construct
  source 1..18: mol_type = other DNA
taatacgacacaataacg

SEQ ID NO: 29603 - DNA, 18 bp, synthetic construct
  source 1..18: mol_type = other DNA
taatacgacacatcaaag

SEQ ID NO: 29604 - DNA, 18 bp, synthetic construct
  source 1..18: mol_type = other DNA
taatacgacaccttctag

SEQ ID NO: 29605 - DNA, 18 bp, synthetic construct
  source 1..18: mol_type = other DNA
taatacgaccctataaag

SEQ ID NO: 29606 - DNA, 18 bp, synthetic construct
  source 1..18: mol_type = other DNA
taatacgactatcgaaag

SEQ ID NO: 29607 - DNA, 18 bp, synthetic construct
  source 1..18: mol_type = other DNA
taatacgactcacatccg

SEQ ID NO: 29608 - DNA, 18 bp, synthetic construct
  source 1..18: mol_type = other DNA
taatacgagatactacag

SEQ ID NO: 29609 - DNA, 18 bp, synthetic construct
  source 1..18: mol_type = other DNA
taatacgatactatatag

SEQ ID NO: 29610 - DNA, 18 bp, synthetic construct
  source 1..18: mol_type = other DNA
taatacgattgtctaaag

SEQ ID NO: 29611 - DNA, 18 bp, synthetic construct
  source 1..18: mol_type = other DNA
taatacgccactcaatag

SEQ ID NO: 29612 - DNA, 18 bp, synthetic construct
  source 1..18: mol_type = other DNA
taatacggaacaccatag

SEQ ID NO: 29613 - DNA, 18 bp, synthetic construct
  source 1..18: mol_type = other DNA
taatacggttctcaatag

SEQ ID NO: 29614 - DNA, 18 bp, synthetic construct
  source 1..18: mol_type = other DNA
taatacgtaaaactatag

SEQ ID NO: 29615 - DNA, 18 bp, synthetic construct
  source 1..18: mol_type = other DNA
taatacgtcagactaaag

SEQ ID NO: 29616 - DNA, 18 bp, synthetic construct
  source 1..18: mol_type = other DNA
taatacgtcctaccatag

SEQ ID NO: 29617 - DNA, 18 bp, synthetic construct
  source 1..18: mol_type = other DNA
taatacgtctatctttag

SEQ ID NO: 29618 - DNA, 18 bp, synthetic construct
  source 1..18: mol_type = other DNA
taatacgtctcattcaag

SEQ ID NO: 29619 - DNA, 18 bp, synthetic construct
  source 1..18: mol_type = other DNA
taatacgtctctatctag

SEQ ID NO: 29620 - DNA, 18 bp, synthetic construct
  source 1..18: mol_type = other DNA
taatacgttccactatgg

SEQ ID NO: 29621 - DNA, 18 bp, synthetic construct
  source 1..18: mol_type = other DNA
taatactaccaactttag

SEQ ID NO: 29622 - DNA, 18 bp, synthetic construct
  source 1..18: mol_type = other DNA
taatactactctctgtcg

SEQ ID NO: 29623 - DNA, 18 bp, synthetic construct
  source 1..18: mol_type = other DNA
taatactactgacaaaag

SEQ ID NO: 29624 - DNA, 18 bp, synthetic construct
  source 1..18: mol_type = other DNA
taatacttcacactctag

SEQ ID NO: 29625 - DNA, 18 bp, synthetic construct
  source 1..18: mol_type = other DNA
taatacttctcagtaaag

SEQ ID NO: 29626 - DNA, 18 bp, synthetic construct
  source 1..18: mol_type = other DNA
taataggaatctctaaag

SEQ ID NO: 29627 - DNA, 18 bp, synthetic construct
  source 1..18: mol_type = other DNA
taatataacttactttag

SEQ ID NO: 29628 - DNA, 18 bp, synthetic construct
  source 1..18: mol_type = other DNA
taatatatctcactatgg

SEQ ID NO: 29629 - DNA, 18 bp, synthetic construct
  source 1..18: mol_type = other DNA
taatatcaatcactttag

SEQ ID NO: 29630 - DNA, 18 bp, synthetic construct
  source 1..18: mol_type = other DNA
taatatgaaacactaaag

SEQ ID NO: 29631 - DNA, 18 bp, synthetic construct
  source 1..18: mol_type = other DNA
taatatgacaaaatatag

SEQ ID NO: 29632 - DNA, 18 bp, synthetic construct
  source 1..18: mol_type = other DNA
taatatgattcaagatag

SEQ ID NO: 29633 - DNA, 18 bp, synthetic construct
  source 1..18: mol_type = other DNA
taatcagacaccctatag

SEQ ID NO: 29634 - DNA, 18 bp, synthetic construct
  source 1..18: mol_type = other DNA
taatcagactcacaaaag

SEQ ID NO: 29635 - DNA, 18 bp, synthetic construct
  source 1..18: mol_type = other DNA
taatccgacacattaaag

SEQ ID NO: 29636 - DNA, 18 bp, synthetic construct
  source 1..18: mol_type = other DNA
taatcctactcactttcg

SEQ ID NO: 29637 - DNA, 18 bp, synthetic construct
  source 1..18: mol_type = other DNA
taatcctactctttatag

SEQ ID NO: 29638 - DNA, 18 bp, synthetic construct
  source 1..18: mol_type = other DNA
taatctaactcagtatag

SEQ ID NO: 29639 - DNA, 18 bp, synthetic construct
  source 1..18: mol_type = other DNA
taatctgacacattatag

SEQ ID NO: 29640 - DNA, 18 bp, synthetic construct
  source 1..18: mol_type = other DNA
taatctgtctcactttag

SEQ ID NO: 29641 - DNA, 18 bp, synthetic construct
  source 1..18: mol_type = other DNA
taatgccactctctagag

SEQ ID NO: 29642 - DNA, 18 bp, synthetic construct
  source 1..18: mol_type = other DNA
taatgcgactctttttag

SEQ ID NO: 29643 - DNA, 18 bp, synthetic construct
  source 1..18: mol_type = other DNA
taatgcgacttattttag

SEQ ID NO: 29644 - DNA, 18 bp, synthetic construct
  source 1..18: mol_type = other DNA
taatgctactcattctag

SEQ ID NO: 29645 - DNA, 18 bp, synthetic construct
  source 1..18: mol_type = other DNA
tacaaccactcactaaag

SEQ ID NO: 29646 - DNA, 18 bp, synthetic construct
  source 1..18: mol_type = other DNA
tacaacgaatcaatatag

SEQ ID NO: 29647 - DNA, 18 bp, synthetic construct
  source 1..18: mol_type = other DNA
tacaacgacacattatag

SEQ ID NO: 29648 - DNA, 18 bp, synthetic construct
  source 1..18: mol_type = other DNA
tacaacgacatactatag

SEQ ID NO: 29649 - DNA, 18 bp, synthetic construct
  source 1..18: mol_type = other DNA
tactacgaaacagtatag

SEQ ID NO: 29650 - DNA, 18 bp, synthetic construct
  source 1..18: mol_type = other DNA
tactacgacacacaaaag

SEQ ID NO: 29651 - DNA, 18 bp, synthetic construct
  source 1..18: mol_type = other DNA
tactacgtccaactatag

SEQ ID NO: 29652 - DNA, 18 bp, synthetic construct
  source 1..18: mol_type = other DNA
tactacgtcttactctag

SEQ ID NO: 29653 - DNA, 18 bp, synthetic construct
  source 1..18: mol_type = other DNA
tactacgtttcactacag

SEQ ID NO: 29654 - DNA, 18 bp, synthetic construct
  source 1..18: mol_type = other DNA
tactatgacacactttag

SEQ ID NO: 29655 - DNA, 18 bp, synthetic construct
  source 1..18: mol_type = other DNA
tactatgactatctatag

SEQ ID NO: 29656 - DNA, 18 bp, synthetic construct
  source 1..18: mol_type = other DNA
tactccgactcaatatgg

SEQ ID NO: 29657 - DNA, 18 bp, synthetic construct
  source 1..18: mol_type = other DNA
tactgcgactcaatatcg

SEQ ID NO: 29658 - DNA, 18 bp, synthetic construct
  source 1..18: mol_type = other DNA
tagtacgaatcatcatag

SEQ ID NO: 29659 - DNA, 18 bp, synthetic construct
  source 1..18: mol_type = other DNA
tagtacgagtcattacag

SEQ ID NO: 29660 - DNA, 18 bp, synthetic construct
  source 1..18: mol_type = other DNA
tagtactactcagtttag

SEQ ID NO: 29661 - DNA, 18 bp, synthetic construct
  source 1..18: mol_type = other DNA
tagtactacttactatcg

SEQ ID NO: 29662 - DNA, 18 bp, synthetic construct
  source 1..18: mol_type = other DNA
tataaagaatcactatag

SEQ ID NO: 29663 - DNA, 18 bp, synthetic construct
  source 1..18: mol_type = other DNA
tataacgacacactacag

SEQ ID NO: 29664 - DNA, 18 bp, synthetic construct
  source 1..18: mol_type = other DNA
tataacgattcactctag

SEQ ID NO: 29665 - DNA, 18 bp, synthetic construct
  source 1..18: mol_type = other DNA
tatcacaactcattatag

SEQ ID NO: 29666 - DNA, 18 bp, synthetic construct
  source 1..18: mol_type = other DNA
tatcacctctcactatag

SEQ ID NO: 29667 - DNA, 18 bp, synthetic construct
  source 1..18: mol_type = other DNA
tatcacgactcacattag

SEQ ID NO: 29668 - DNA, 18 bp, synthetic construct
  source 1..18: mol_type = other DNA
tatcacggctcactaaag

SEQ ID NO: 29669 - DNA, 18 bp, synthetic construct
  source 1..18: mol_type = other DNA
tattaagactcaccaaag

SEQ ID NO: 29670 - DNA, 18 bp, synthetic construct
  source 1..18: mol_type = other DNA
tattaagactgacaatag

SEQ ID NO: 29671 - DNA, 18 bp, synthetic construct
  source 1..18: mol_type = other DNA
tattaagattcaatatag

SEQ ID NO: 29672 - DNA, 18 bp, synthetic construct
  source 1..18: mol_type = other DNA
tattacgaatctatatag

SEQ ID NO: 29673 - DNA, 18 bp, synthetic construct
  source 1..18: mol_type = other DNA
tattacgacacaccaaag

SEQ ID NO: 29674 - DNA, 18 bp, synthetic construct
  source 1..18: mol_type = other DNA
tattacgacactctatcg

SEQ ID NO: 29675 - DNA, 18 bp, synthetic construct
  source 1..18: mol_type = other DNA
tattacgactcaatttgg

SEQ ID NO: 29676 - DNA, 18 bp, synthetic construct
  source 1..18: mol_type = other DNA
tattacgacttactaagg

SEQ ID NO: 29677 - DNA, 18 bp, synthetic construct
  source 1..18: mol_type = other DNA
tattacgacttattaaag

SEQ ID NO: 29678 - DNA, 18 bp, synthetic construct
  source 1..18: mol_type = other DNA
tattacgattaacaatag

SEQ ID NO: 29679 - DNA, 18 bp, synthetic construct
  source 1..18: mol_type = other DNA
tattacggatctctatag

SEQ ID NO: 29680 - DNA, 18 bp, synthetic construct
  source 1..18: mol_type = other DNA
tattacggcaaactatag

SEQ ID NO: 29681 - DNA, 18 bp, synthetic construct
  source 1..18: mol_type = other DNA
tattactaatcactatcg

SEQ ID NO: 29682 - DNA, 18 bp, synthetic construct
  source 1..18: mol_type = other DNA
tattactacacactaaag

SEQ ID NO: 29683 - DNA, 18 bp, synthetic construct
  source 1..18: mol_type = other DNA
tattactagtcactgtag

SEQ ID NO: 29684 - DNA, 18 bp, synthetic construct
  source 1..18: mol_type = other DNA
tattactagtcactttag

SEQ ID NO: 29685 - DNA, 18 bp, synthetic construct
  source 1..18: mol_type = other DNA
tattacttgtcactatag

SEQ ID NO: 29686 - DNA, 18 bp, synthetic construct
  source 1..18: mol_type = other DNA
tattagaacttactatag

SEQ ID NO: 29687 - DNA, 18 bp, synthetic construct
  source 1..18: mol_type = other DNA
tattatgactcacactag

SEQ ID NO: 29688 - DNA, 18 bp, synthetic construct
  source 1..18: mol_type = other DNA
tattattactcattatag

SEQ ID NO: 29689 - DNA, 18 bp, synthetic construct
  source 1..18: mol_type = other DNA
tattccgtcacactatag

SEQ ID NO: 29690 - DNA, 18 bp, synthetic construct
  source 1..18: mol_type = other DNA
tattctgattcactatag

SEQ ID NO: 29691 - DNA, 18 bp, synthetic construct
  source 1..18: mol_type = other DNA
tattgcaactcactaaag

SEQ ID NO: 29692 - DNA, 18 bp, synthetic construct
  source 1..18: mol_type = other DNA
tcaaatgactctctatag

SEQ ID NO: 29693 - DNA, 18 bp, synthetic construct
  source 1..18: mol_type = other DNA
tcatacaactctctctag

SEQ ID NO: 29694 - DNA, 18 bp, synthetic construct
  source 1..18: mol_type = other DNA
tcataccactaactctag

SEQ ID NO: 29695 - DNA, 18 bp, synthetic construct
  source 1..18: mol_type = other DNA
tcataccactcactaagg

SEQ ID NO: 29696 - DNA, 18 bp, synthetic construct
  source 1..18: mol_type = other DNA
tcatacgaatcacttcag

SEQ ID NO: 29697 - DNA, 18 bp, synthetic construct
  source 1..18: mol_type = other DNA
tcatacgacttacaaaag

SEQ ID NO: 29698 - DNA, 18 bp, synthetic construct
  source 1..18: mol_type = other DNA
tcatacgattcacattag

SEQ ID NO: 29699 - DNA, 18 bp, synthetic construct
  source 1..18: mol_type = other DNA
tcatacgattctctaaag

SEQ ID NO: 29700 - DNA, 18 bp, synthetic construct
  source 1..18: mol_type = other DNA
tcatactactcattttag

SEQ ID NO: 29701 - DNA, 18 bp, synthetic construct
  source 1..18: mol_type = other DNA
tcatataactaactatag

SEQ ID NO: 29702 - DNA, 18 bp, synthetic construct
  source 1..18: mol_type = other DNA
tcccacgactcactctag

SEQ ID NO: 29703 - DNA, 18 bp, synthetic construct
  source 1..18: mol_type = other DNA
tgacacaactcactacag

SEQ ID NO: 29704 - DNA, 18 bp, synthetic construct
  source 1..18: mol_type = other DNA
tgacatgactcactacag

SEQ ID NO: 29705 - DNA, 18 bp, synthetic construct
  source 1..18: mol_type = other DNA
tgataagactcaataaag

SEQ ID NO: 29706 - DNA, 18 bp, synthetic construct
  source 1..18: mol_type = other DNA
tgatacaatacactatag

SEQ ID NO: 29707 - DNA, 18 bp, synthetic construct
  source 1..18: mol_type = other DNA
tgatacgacataatatag

SEQ ID NO: 29708 - DNA, 18 bp, synthetic construct
  source 1..18: mol_type = other DNA
tgatacgacccactcaag

SEQ ID NO: 29709 - DNA, 18 bp, synthetic construct
  source 1..18: mol_type = other DNA
tgatacgactcagttaag

SEQ ID NO: 29710 - DNA, 18 bp, synthetic construct
  source 1..18: mol_type = other DNA
tgatacgacttacgttag

SEQ ID NO: 29711 - DNA, 18 bp, synthetic construct
  source 1..18: mol_type = other DNA
tgatatgactcataatag

SEQ ID NO: 29712 - DNA, 18 bp, synthetic construct
  source 1..18: mol_type = other DNA
tgatccgactctcaatag

SEQ ID NO: 29713 - DNA, 18 bp, synthetic construct
  source 1..18: mol_type = other DNA
tgatgctactctctatag

SEQ ID NO: 29714 - DNA, 18 bp, synthetic construct
  source 1..18: mol_type = other DNA
tgcaacgattcactatag

SEQ ID NO: 29715 - DNA, 18 bp, synthetic construct
  source 1..18: mol_type = other DNA
tgttacgactcactttcg

SEQ ID NO: 29716 - DNA, 18 bp, synthetic construct
  source 1..18: mol_type = other DNA
tgttacgactctctacag

SEQ ID NO: 29717 - DNA, 18 bp, synthetic construct
  source 1..18: mol_type = other DNA
ttacacgacacaatatag

SEQ ID NO: 29718 - DNA, 18 bp, synthetic construct
  source 1..18: mol_type = other DNA
ttacacgactaacgatag

SEQ ID NO: 29719 - DNA, 18 bp, synthetic construct
  source 1..18: mol_type = other DNA
ttataagacaccctatag

SEQ ID NO: 29720 - DNA, 18 bp, synthetic construct
  source 1..18: mol_type = other DNA
ttataaggctcactgtag

SEQ ID NO: 29721 - DNA, 18 bp, synthetic construct
  source 1..18: mol_type = other DNA
ttataatactcagtatag

SEQ ID NO: 29722 - DNA, 18 bp, synthetic construct
  source 1..18: mol_type = other DNA
ttatacaagtgactatag

SEQ ID NO: 29723 - DNA, 18 bp, synthetic construct
  source 1..18: mol_type = other DNA
ttataccacacacaatag

SEQ ID NO: 29724 - DNA, 18 bp, synthetic construct
  source 1..18: mol_type = other DNA
ttataccactatctatag

SEQ ID NO: 29725 - DNA, 18 bp, synthetic construct
  source 1..18: mol_type = other DNA
ttatacctctcaccatag

SEQ ID NO: 29726 - DNA, 18 bp, synthetic construct
  source 1..18: mol_type = other DNA
ttatacgacaaacaatag

SEQ ID NO: 29727 - DNA, 18 bp, synthetic construct
  source 1..18: mol_type = other DNA
ttatacgactcagttaag

SEQ ID NO: 29728 - DNA, 18 bp, synthetic construct
  source 1..18: mol_type = other DNA
ttatacgactcatattag

SEQ ID NO: 29729 - DNA, 18 bp, synthetic construct
  source 1..18: mol_type = other DNA
ttatacgccttactttag

SEQ ID NO: 29730 - DNA, 18 bp, synthetic construct
  source 1..18: mol_type = other DNA
ttatacgcttcactttag

SEQ ID NO: 29731 - DNA, 18 bp, synthetic construct
  source 1..18: mol_type = other DNA
ttatacgtctaattatag

SEQ ID NO: 29732 - DNA, 18 bp, synthetic construct
  source 1..18: mol_type = other DNA
ttatacgtctgaccatag

SEQ ID NO: 29733 - DNA, 18 bp, synthetic construct
  source 1..18: mol_type = other DNA
ttatacgttttactatag

SEQ ID NO: 29734 - DNA, 18 bp, synthetic construct
  source 1..18: mol_type = other DNA
ttataggactctttatag

SEQ ID NO: 29735 - DNA, 18 bp, synthetic construct
  source 1..18: mol_type = other DNA
ttatatgactcacaaaag

SEQ ID NO: 29736 - DNA, 18 bp, synthetic construct
  source 1..18: mol_type = other DNA
ttatgcgagtcacaatag

SEQ ID NO: 29737 - DNA, 18 bp, synthetic construct
  source 1..18: mol_type = other DNA
ttccacgtctcactatag

SEQ ID NO: 29738 - DNA, 18 bp, synthetic construct
  source 1..18: mol_type = other DNA
ttctacgactcattaaag

SEQ ID NO: 29739 - DNA, 18 bp, synthetic construct
  source 1..18: mol_type = other DNA
ttgaacgactcactatcg

SEQ ID NO: 29740 - DNA, 18 bp, synthetic construct
  source 1..18: mol_type = other DNA
ttgaacgagtcactatag

SEQ ID NO: 29741 - DNA, 18 bp, synthetic construct
  source 1..18: mol_type = other DNA
ttgtacgactttctatag

SEQ ID NO: 29742 - DNA, 18 bp, synthetic construct
  source 1..18: mol_type = other DNA
ttgtatgactcacaatag

SEQ ID NO: 29743 - DNA, 18 bp, synthetic construct
  source 1..18: mol_type = other DNA
tttcacgactcacaatag

SEQ ID NO: 29744 - DNA, 18 bp, synthetic construct
  source 1..18: mol_type = other DNA
ttttacaactcactacag

SEQ ID NO: 29745 - DNA, 18 bp, synthetic construct
  source 1..18: mol_type = other DNA
ttttacgaaacactatag

SEQ ID NO: 29746 - DNA, 18 bp, synthetic construct
  source 1..18: mol_type = other DNA
ttttacgactcacttaag

SEQ ID NO: 29747 - DNA, 18 bp, synthetic construct
  source 1..18: mol_type = other DNA
taattcgtctcaataaag

SEQ ID NO: 29748 - DNA, 18 bp, synthetic construct
  source 1..18: mol_type = other DNA
atatacgtcacactatag

SEQ ID NO: 29749 - DNA, 18 bp, synthetic construct
  source 1..18: mol_type = other DNA
ttaaacgactcacaattg

SEQ ID NO: 29750 - DNA, 18 bp, synthetic construct
  source 1..18: mol_type = other DNA
taatactacacacttttg

SEQ ID NO: 29751 - DNA, 18 bp, synthetic construct
  source 1..18: mol_type = other DNA
ttatacgactcacttatg

SEQ ID NO: 29752 - DNA, 18 bp, synthetic construct
  source 1..18: mol_type = other DNA
taatacatttcactaaag

SEQ ID NO: 29753 - DNA, 18 bp, synthetic construct
  source 1..18: mol_type = other DNA
ttatacatctcacaatag

SEQ ID NO: 29754 - DNA, 18 bp, synthetic construct
  source 1..18: mol_type = other DNA
ttattagactcactattg

SEQ ID NO: 29755 - DNA, 18 bp, synthetic construct
  source 1..18: mol_type = other DNA
ttattcgactaactattg

SEQ ID NO: 29756 - DNA, 18 bp, synthetic construct
  source 1..18: mol_type = other DNA
aaattcaactcactaaag

SEQ ID NO: 29757 - DNA, 18 bp, synthetic construct
  source 1..18: mol_type = other DNA
aattacgactcactaatg

SEQ ID NO: 29758 - DNA, 18 bp, synthetic construct
  source 1..18: mol_type = other DNA
atattcgactcactctag

SEQ ID NO: 29759 - DNA, 18 bp, synthetic construct
  source 1..18: mol_type = other DNA
caatacgactctttattg

SEQ ID NO: 29760 - DNA, 18 bp, synthetic construct
  source 1..18: mol_type = other DNA
taaaaagactcattattg

SEQ ID NO: 29761 - DNA, 18 bp, synthetic construct
  source 1..18: mol_type = other DNA
taaaaccactcacaattg

SEQ ID NO: 29762 - DNA, 18 bp, synthetic construct
  source 1..18: mol_type = other DNA
taattcaactaacaatag

SEQ ID NO: 29763 - DNA, 18 bp, synthetic construct
  source 1..18: mol_type = other DNA
taattcgtcaaactatag

SEQ ID NO: 29764 - DNA, 18 bp, synthetic construct
  source 1..18: mol_type = other DNA
tagaacgattcactattg

SEQ ID NO: 29765 - DNA, 18 bp, synthetic construct
  source 1..18: mol_type = other DNA
tatcacgactcacttttg

SEQ ID NO: 29766 - DNA, 18 bp, synthetic construct
  source 1..18: mol_type = other DNA
tattacgacacaatattg

SEQ ID NO: 29767 - DNA, 18 bp, synthetic construct
  source 1..18: mol_type = other DNA
ttaaacgacttactattg

SEQ ID NO: 29768 - DNA, 18 bp, synthetic construct
  source 1..18: mol_type = other DNA
aaatacgactctttagag

SEQ ID NO: 29769 - DNA, 18 bp, synthetic construct
  source 1..18: mol_type = other DNA
atgtacgactcactttag

SEQ ID NO: 29770 - DNA, 18 bp, synthetic construct
  source 1..18: mol_type = other DNA
taaaactactcagtttag

SEQ ID NO: 29771 - DNA, 18 bp, synthetic construct
  source 1..18: mol_type = other DNA
taaaccgacactctatag

SEQ ID NO: 29772 - DNA, 18 bp, synthetic construct
  source 1..18: mol_type = other DNA
taatacaattcacattag

SEQ ID NO: 29773 - DNA, 18 bp, synthetic construct
  source 1..18: mol_type = other DNA
taatacatctaactttag

SEQ ID NO: 29774 - DNA, 18 bp, synthetic construct
  source 1..18: mol_type = other DNA
taataccacacacattag

SEQ ID NO: 29775 - DNA, 18 bp, synthetic construct
  source 1..18: mol_type = other DNA
taatacgacatacattag

SEQ ID NO: 29776 - DNA, 18 bp, synthetic construct
  source 1..18: mol_type = other DNA
taatacgacattctaaag

SEQ ID NO: 29777 - DNA, 18 bp, synthetic construct
  source 1..18: mol_type = other DNA
taatacgagtcaatcgag

SEQ ID NO: 29778 - DNA, 18 bp, synthetic construct
  source 1..18: mol_type = other DNA
taatctgtctcactaaag

SEQ ID NO: 29779 - DNA, 18 bp, synthetic construct
  source 1..18: mol_type = other DNA
tataacgacacacaatag

SEQ ID NO: 29780 - DNA, 18 bp, synthetic construct
  source 1..18: mol_type = other DNA
tattacgactaaatttag

SEQ ID NO: 29781 - DNA, 18 bp, synthetic construct
  source 1..18: mol_type = other DNA
tgtaaagactcactatag

SEQ ID NO: 29782 - DNA, 18 bp, synthetic construct
  source 1..18: mol_type = other DNA
ttaaacgactcagtaaag

SEQ ID NO: 29783 - DNA, 18 bp, synthetic construct
  source 1..18: mol_type = other DNA
ttatacgactctctaacg

SEQ ID NO: 29784 - DNA, 18 bp, synthetic construct
  source 1..18: mol_type = other DNA
ttatacgtctcaatgtag

SEQ ID NO: 29785 - DNA, 18 bp, synthetic construct
  source 1..18: mol_type = other DNA
ttatactaatctctatag

SEQ ID NO: 29786 - DNA, 18 bp, synthetic construct
  source 1..18: mol_type = other DNA
ttgaatgactcactatag

SEQ ID NO: 29787 - DNA, 18 bp, synthetic construct
  source 1..18: mol_type = other DNA
ttttaagtctcactatag

SEQ ID NO: 29788 - DNA, 18 bp, synthetic construct
  source 1..18: mol_type = other DNA
ttttaggactcacaatag

SEQ ID NO: 29789 - DNA, 18 bp, synthetic construct
  source 1..18: mol_type = other DNA
taattcgtctcaatattg

SEQ ID NO: 29790 - DNA, 18 bp, synthetic construct
  source 1..18: mol_type = other DNA
atatacgattcactattg

SEQ ID NO: 29791 - DNA, 18 bp, synthetic construct
  source 1..18: mol_type = other DNA
taaaacgaatctctattg

SEQ ID NO: 29792 - DNA, 18 bp, synthetic construct
  source 1..18: mol_type = other DNA
taataagacacaccattg

SEQ ID NO: 29793 - DNA, 18 bp, synthetic construct
  source 1..18: mol_type = other DNA
taatacaactcatttttg

SEQ ID NO: 29794 - DNA, 18 bp, synthetic construct
  source 1..18: mol_type = other DNA
taatacgtctaattattg

SEQ ID NO: 29795 - DNA, 18 bp, synthetic construct
  source 1..18: mol_type = other DNA
taattcgtataactatag

SEQ ID NO: 29796 - DNA, 18 bp, synthetic construct
  source 1..18: mol_type = other DNA
tattactattcactattg

SEQ ID NO: 29797 - DNA, 18 bp, synthetic construct
  source 1..18: mol_type = other DNA
taaaacgtttctctatag

SEQ ID NO: 29798 - DNA, 18 bp, synthetic construct
  source 1..18: mol_type = other DNA
taatacgactctcataag

SEQ ID NO: 29799 - DNA, 18 bp, synthetic construct
  source 1..18: mol_type = other DNA
ttatacgatacactttag

SEQ ID NO: 29800 - DNA, 18 bp, synthetic construct
  source 1..18: mol_type = other DNA
aattactactctctatag

SEQ ID NO: 29801 - DNA, 18 bp, synthetic construct
  source 1..18: mol_type = other DNA
tattacgaatcacattag

SEQ ID NO: 29802 - DNA, 18 bp, synthetic construct
  source 1..18: mol_type = other DNA
tattacgtctctctttag

SEQ ID NO: 29803 - DNA, 18 bp, synthetic construct
  source 1..18: mol_type = other DNA
atatacgactcacttttg

SEQ ID NO: 29804 - DNA, 18 bp, synthetic construct
  source 1..18: mol_type = other DNA
taataccactctatattg

SEQ ID NO: 29805 - DNA, 18 bp, synthetic construct
  source 1..18: mol_type = other DNA
taatacgtctcacatttg

SEQ ID NO: 29806 - DNA, 18 bp, synthetic construct
  source 1..18: mol_type = other DNA
ttatacgactctatattg

SEQ ID NO: 29807 - DNA, 18 bp, synthetic construct
  source 1..18: mol_type = other DNA
ttattcaactcacaatag

SEQ ID NO: 29808 - DNA, 18 bp, synthetic construct
  source 1..18: mol_type = other DNA
atatacaactcactaaag

SEQ ID NO: 29809 - DNA, 18 bp, synthetic construct
  source 1..18: mol_type = other DNA
taatataacacacaatag

SEQ ID NO: 29810 - DNA, 18 bp, synthetic construct
  source 1..18: mol_type = other DNA
taatatgattcgctattg

SEQ ID NO: 29811 - DNA, 18 bp, synthetic construct
  source 1..18: mol_type = other DNA
taattcaacacgctatag

SEQ ID NO: 29812 - DNA, 18 bp, synthetic construct
  source 1..18: mol_type = other DNA
taattcgacacgctctag

SEQ ID NO: 29813 - DNA, 18 bp, synthetic construct
  source 1..18: mol_type = other DNA
taattcgacttgctgtag

SEQ ID NO: 29814 - DNA, 18 bp, synthetic construct
  source 1..18: mol_type = other DNA
taattcgcctcactcttg

SEQ ID NO: 29815 - DNA, 18 bp, synthetic construct
  source 1..18: mol_type = other DNA
taattttactcgctatag

SEQ ID NO: 29816 - DNA, 18 bp, synthetic construct
  source 1..18: mol_type = other DNA
tagttcgactcacttttg

SEQ ID NO: 29817 - DNA, 18 bp, synthetic construct
  source 1..18: mol_type = other DNA
tgattcgactcacttttg

SEQ ID NO: 29818 - DNA, 18 bp, synthetic construct
  source 1..18: mol_type = other DNA
aaaaacgactcgttatag

SEQ ID NO: 29819 - DNA, 18 bp, synthetic construct
  source 1..18: mol_type = other DNA
aaataccgctcactattg

SEQ ID NO: 29820 - DNA, 18 bp, synthetic construct
  source 1..18: mol_type = other DNA
aaattcgactcaatttag

SEQ ID NO: 29821 - DNA, 18 bp, synthetic construct
  source 1..18: mol_type = other DNA
aaattcgactctccatag

SEQ ID NO: 29822 - DNA, 18 bp, synthetic construct
  source 1..18: mol_type = other DNA
aaattcggctcactttag

SEQ ID NO: 29823 - DNA, 18 bp, synthetic construct
  source 1..18: mol_type = other DNA
aaattctactaactatag

SEQ ID NO: 29824 - DNA, 18 bp, synthetic construct
  source 1..18: mol_type = other DNA
aacttcgactcattatag

SEQ ID NO: 29825 - DNA, 18 bp, synthetic construct
  source 1..18: mol_type = other DNA
atagacgactcactattg

SEQ ID NO: 29826 - DNA, 18 bp, synthetic construct
  source 1..18: mol_type = other DNA
atattcgacacactatag

SEQ ID NO: 29827 - DNA, 18 bp, synthetic construct
  source 1..18: mol_type = other DNA
atattcgacttactatag

SEQ ID NO: 29828 - DNA, 18 bp, synthetic construct
  source 1..18: mol_type = other DNA
caatacgacccacaattg

SEQ ID NO: 29829 - DNA, 18 bp, synthetic construct
  source 1..18: mol_type = other DNA
caattcgactgaccatag

SEQ ID NO: 29830 - DNA, 18 bp, synthetic construct
  source 1..18: mol_type = other DNA
cacttcgactcactttag

SEQ ID NO: 29831 - DNA, 18 bp, synthetic construct
  source 1..18: mol_type = other DNA
cattacgactcaatattg

SEQ ID NO: 29832 - DNA, 18 bp, synthetic construct
  source 1..18: mol_type = other DNA
ctattcggctcactatag

SEQ ID NO: 29833 - DNA, 18 bp, synthetic construct
  source 1..18: mol_type = other DNA
taaaacgactcagtaatg

SEQ ID NO: 29834 - DNA, 18 bp, synthetic construct
  source 1..18: mol_type = other DNA
taaaacgactggctacag

SEQ ID NO: 29835 - DNA, 18 bp, synthetic construct
  source 1..18: mol_type = other DNA
taaaacgacttattattg

SEQ ID NO: 29836 - DNA, 18 bp, synthetic construct
  source 1..18: mol_type = other DNA
taaaacgattcaatattg

SEQ ID NO: 29837 - DNA, 18 bp, synthetic construct
  source 1..18: mol_type = other DNA
taaatcacctcactatag

SEQ ID NO: 29838 - DNA, 18 bp, synthetic construct
  source 1..18: mol_type = other DNA
taaatcgagtcacaatag

SEQ ID NO: 29839 - DNA, 18 bp, synthetic construct
  source 1..18: mol_type = other DNA
taacacaacacactattg

SEQ ID NO: 29840 - DNA, 18 bp, synthetic construct
  source 1..18: mol_type = other DNA
taagaagactcattattg

SEQ ID NO: 29841 - DNA, 18 bp, synthetic construct
  source 1..18: mol_type = other DNA
taagacgactcgcttaag

SEQ ID NO: 29842 - DNA, 18 bp, synthetic construct
  source 1..18: mol_type = other DNA
taagacgactctctaatg

SEQ ID NO: 29843 - DNA, 18 bp, synthetic construct
  source 1..18: mol_type = other DNA
taagtcaactcactagag

SEQ ID NO: 29844 - DNA, 18 bp, synthetic construct
  source 1..18: mol_type = other DNA
taatacacctaactattg

SEQ ID NO: 29845 - DNA, 18 bp, synthetic construct
  source 1..18: mol_type = other DNA
taataccactagctttag

SEQ ID NO: 29846 - DNA, 18 bp, synthetic construct
  source 1..18: mol_type = other DNA
taatacgacccagtcttg

SEQ ID NO: 29847 - DNA, 18 bp, synthetic construct
  source 1..18: mol_type = other DNA
taatacgactaacacttg

SEQ ID NO: 29848 - DNA, 18 bp, synthetic construct
  source 1..18: mol_type = other DNA
taatacgattcaatgttg

SEQ ID NO: 29849 - DNA, 18 bp, synthetic construct
  source 1..18: mol_type = other DNA
taatacgcctcacatttg

SEQ ID NO: 29850 - DNA, 18 bp, synthetic construct
  source 1..18: mol_type = other DNA
taatacgtttcactcttg

SEQ ID NO: 29851 - DNA, 18 bp, synthetic construct
  source 1..18: mol_type = other DNA
taatactacacaccattg

SEQ ID NO: 29852 - DNA, 18 bp, synthetic construct
  source 1..18: mol_type = other DNA
taatactactcacaaatg

SEQ ID NO: 29853 - DNA, 18 bp, synthetic construct
  source 1..18: mol_type = other DNA
taatatgacacactgttg

SEQ ID NO: 29854 - DNA, 18 bp, synthetic construct
  source 1..18: mol_type = other DNA
taatgtaactcactattg

SEQ ID NO: 29855 - DNA, 18 bp, synthetic construct
  source 1..18: mol_type = other DNA
taattagacttactttag

SEQ ID NO: 29856 - DNA, 18 bp, synthetic construct
  source 1..18: mol_type = other DNA
taattcaacccactaaag

SEQ ID NO: 29857 - DNA, 18 bp, synthetic construct
  source 1..18: mol_type = other DNA
taattcaactcaatttag

SEQ ID NO: 29858 - DNA, 18 bp, synthetic construct
  source 1..18: mol_type = other DNA
taattcaactcattaaag

SEQ ID NO: 29859 - DNA, 18 bp, synthetic construct
  source 1..18: mol_type = other DNA
taattcgacccactcaag

SEQ ID NO: 29860 - DNA, 18 bp, synthetic construct
  source 1..18: mol_type = other DNA
taattcgatccaatatag

SEQ ID NO: 29861 - DNA, 18 bp, synthetic construct
  source 1..18: mol_type = other DNA
taattcgattctttatag

SEQ ID NO: 29862 - DNA, 18 bp, synthetic construct
  source 1..18: mol_type = other DNA
taattcgccatactatag

SEQ ID NO: 29863 - DNA, 18 bp, synthetic construct
  source 1..18: mol_type = other DNA
taattcgtctcacactag

SEQ ID NO: 29864 - DNA, 18 bp, synthetic construct
  source 1..18: mol_type = other DNA
taattctaatcacaatag

SEQ ID NO: 29865 - DNA, 18 bp, synthetic construct
  source 1..18: mol_type = other DNA
taattctactaacaatag

SEQ ID NO: 29866 - DNA, 18 bp, synthetic construct
  source 1..18: mol_type = other DNA
taattcttctcaatatag

SEQ ID NO: 29867 - DNA, 18 bp, synthetic construct
  source 1..18: mol_type = other DNA
taatttgacacattatag

SEQ ID NO: 29868 - DNA, 18 bp, synthetic construct
  source 1..18: mol_type = other DNA
taatttgactcacgttag

SEQ ID NO: 29869 - DNA, 18 bp, synthetic construct
  source 1..18: mol_type = other DNA
taatttgatacactatag

SEQ ID NO: 29870 - DNA, 18 bp, synthetic construct
  source 1..18: mol_type = other DNA
tacaacgactcacaattg

SEQ ID NO: 29871 - DNA, 18 bp, synthetic construct
  source 1..18: mol_type = other DNA
tactacgattcacaattg

SEQ ID NO: 29872 - DNA, 18 bp, synthetic construct
  source 1..18: mol_type = other DNA
tacttcgattcacaatag

SEQ ID NO: 29873 - DNA, 18 bp, synthetic construct
  source 1..18: mol_type = other DNA
tagttcgactctttatag

SEQ ID NO: 29874 - DNA, 18 bp, synthetic construct
  source 1..18: mol_type = other DNA
tatatcgactcaccatag

SEQ ID NO: 29875 - DNA, 18 bp, synthetic construct
  source 1..18: mol_type = other DNA
tattacgacccagtattg

SEQ ID NO: 29876 - DNA, 18 bp, synthetic construct
  source 1..18: mol_type = other DNA
tattacgactcccaattg

SEQ ID NO: 29877 - DNA, 18 bp, synthetic construct
  source 1..18: mol_type = other DNA
tattacgactgacaattg

SEQ ID NO: 29878 - DNA, 18 bp, synthetic construct
  source 1..18: mol_type = other DNA
tattacgtcgcactattg

SEQ ID NO: 29879 - DNA, 18 bp, synthetic construct
  source 1..18: mol_type = other DNA
tattactactcactaatg

SEQ ID NO: 29880 - DNA, 18 bp, synthetic construct
  source 1..18: mol_type = other DNA
tatttcgaattactatag

SEQ ID NO: 29881 - DNA, 18 bp, synthetic construct
  source 1..18: mol_type = other DNA
tatttcgacttattatag

SEQ ID NO: 29882 - DNA, 18 bp, synthetic construct
  source 1..18: mol_type = other DNA
tatttcgagtcactttag

SEQ ID NO: 29883 - DNA, 18 bp, synthetic construct
  source 1..18: mol_type = other DNA
tatttcgatttactatag

SEQ ID NO: 29884 - DNA, 18 bp, synthetic construct
  source 1..18: mol_type = other DNA
tcaaacgactctctattg

SEQ ID NO: 29885 - DNA, 18 bp, synthetic construct
  source 1..18: mol_type = other DNA
tcatacgattaactattg

SEQ ID NO: 29886 - DNA, 18 bp, synthetic construct
  source 1..18: mol_type = other DNA
tcatacgtctctctattg

SEQ ID NO: 29887 - DNA, 18 bp, synthetic construct
  source 1..18: mol_type = other DNA
tcattcgtctcacaatag

SEQ ID NO: 29888 - DNA, 18 bp, synthetic construct
  source 1..18: mol_type = other DNA
tcttacgactcactactg

SEQ ID NO: 29889 - DNA, 18 bp, synthetic construct
  source 1..18: mol_type = other DNA
tcttacgacttactattg

SEQ ID NO: 29890 - DNA, 18 bp, synthetic construct
  source 1..18: mol_type = other DNA
tctttctactcactatag

SEQ ID NO: 29891 - DNA, 18 bp, synthetic construct
  source 1..18: mol_type = other DNA
ttatacgacttactagtg

SEQ ID NO: 29892 - DNA, 18 bp, synthetic construct
  source 1..18: mol_type = other DNA
ttatacgattcactaatg

SEQ ID NO: 29893 - DNA, 18 bp, synthetic construct
  source 1..18: mol_type = other DNA
ttatacggcttactattg

SEQ ID NO: 29894 - DNA, 18 bp, synthetic construct
  source 1..18: mol_type = other DNA
ttatactactcagtattg

SEQ ID NO: 29895 - DNA, 18 bp, synthetic construct
  source 1..18: mol_type = other DNA
ttatccaactcgctatag

SEQ ID NO: 29896 - DNA, 18 bp, synthetic construct
  source 1..18: mol_type = other DNA
ttattcgaatcacaatag

SEQ ID NO: 29897 - DNA, 18 bp, synthetic construct
  source 1..18: mol_type = other DNA
ttattcgactgacaatag

SEQ ID NO: 29898 - DNA, 18 bp, synthetic construct
  source 1..18: mol_type = other DNA
ttattcgactgagtatag

SEQ ID NO: 29899 - DNA, 18 bp, synthetic construct
  source 1..18: mol_type = other DNA
ttattctactcactacag

SEQ ID NO: 29900 - DNA, 18 bp, synthetic construct
  source 1..18: mol_type = other DNA
ttgtacgactcacttttg

SEQ ID NO: 29901 - DNA, 18 bp, synthetic construct
  source 1..18: mol_type = other DNA
ttttacgactaactattg

SEQ ID NO: 29902 - DNA, 18 bp, synthetic construct
  source 1..18: mol_type = other DNA
aaaaacggctcacaatag

SEQ ID NO: 29903 - DNA, 18 bp, synthetic construct
  source 1..18: mol_type = other DNA
aaaaatggctcactatag

SEQ ID NO: 29904 - DNA, 18 bp, synthetic construct
  source 1..18: mol_type = other DNA
aaaacccactcactatag

SEQ ID NO: 29905 - DNA, 18 bp, synthetic construct
  source 1..18: mol_type = other DNA
aaaaccgactcactttag

SEQ ID NO: 29906 - DNA, 18 bp, synthetic construct
  source 1..18: mol_type = other DNA
aaagaccattcactatag

SEQ ID NO: 29907 - DNA, 18 bp, synthetic construct
  source 1..18: mol_type = other DNA
aaataaaactaactatag

SEQ ID NO: 29908 - DNA, 18 bp, synthetic construct
  source 1..18: mol_type = other DNA
aaatacaactcaccaaag

SEQ ID NO: 29909 - DNA, 18 bp, synthetic construct
  source 1..18: mol_type = other DNA
aaataccactcattatcg

SEQ ID NO: 29910 - DNA, 18 bp, synthetic construct
  source 1..18: mol_type = other DNA
aaatacgaatcattaaag

SEQ ID NO: 29911 - DNA, 18 bp, synthetic construct
  source 1..18: mol_type = other DNA
aaatacgacacacttcag

SEQ ID NO: 29912 - DNA, 18 bp, synthetic construct
  source 1..18: mol_type = other DNA
aaatacgacccactaagg

SEQ ID NO: 29913 - DNA, 18 bp, synthetic construct
  source 1..18: mol_type = other DNA
aaatacgacccactttcg

SEQ ID NO: 29914 - DNA, 18 bp, synthetic construct
  source 1..18: mol_type = other DNA
aaatacgactaacaacag

SEQ ID NO: 29915 - DNA, 18 bp, synthetic construct
  source 1..18: mol_type = other DNA
aaatacgactctcattag

SEQ ID NO: 29916 - DNA, 18 bp, synthetic construct
  source 1..18: mol_type = other DNA
aaatacgattcattaaag

SEQ ID NO: 29917 - DNA, 18 bp, synthetic construct
  source 1..18: mol_type = other DNA
aaatacgtctcactttgg

SEQ ID NO: 29918 - DNA, 18 bp, synthetic construct
  source 1..18: mol_type = other DNA
aaatacgtctcccaatag

SEQ ID NO: 29919 - DNA, 18 bp, synthetic construct
  source 1..18: mol_type = other DNA
aaatactacacattatag

SEQ ID NO: 29920 - DNA, 18 bp, synthetic construct
  source 1..18: mol_type = other DNA
aaatactactcacaatgg

SEQ ID NO: 29921 - DNA, 18 bp, synthetic construct
  source 1..18: mol_type = other DNA
aaatatgtctcactctag

SEQ ID NO: 29922 - DNA, 18 bp, synthetic construct
  source 1..18: mol_type = other DNA
aaatgcgacacacaatag

SEQ ID NO: 29923 - DNA, 18 bp, synthetic construct
  source 1..18: mol_type = other DNA
aaatgcgacttactaaag

SEQ ID NO: 29924 - DNA, 18 bp, synthetic construct
  source 1..18: mol_type = other DNA
aacaacgattcactatag

SEQ ID NO: 29925 - DNA, 18 bp, synthetic construct
  source 1..18: mol_type = other DNA
aactacgtctcacaatag

SEQ ID NO: 29926 - DNA, 18 bp, synthetic construct
  source 1..18: mol_type = other DNA
aactactactccctatag

SEQ ID NO: 29927 - DNA, 18 bp, synthetic construct
  source 1..18: mol_type = other DNA
aattaagactcactatcg

SEQ ID NO: 29928 - DNA, 18 bp, synthetic construct
  source 1..18: mol_type = other DNA
aattacgacacaatatag

SEQ ID NO: 29929 - DNA, 18 bp, synthetic construct
  source 1..18: mol_type = other DNA
aattacgactctctctag

SEQ ID NO: 29930 - DNA, 18 bp, synthetic construct
  source 1..18: mol_type = other DNA
aattacgattcactctag

SEQ ID NO: 29931 - DNA, 18 bp, synthetic construct
  source 1..18: mol_type = other DNA
aattacgtctcactatcg

SEQ ID NO: 29932 - DNA, 18 bp, synthetic construct
  source 1..18: mol_type = other DNA
aattactactaactatag

SEQ ID NO: 29933 - DNA, 18 bp, synthetic construct
  source 1..18: mol_type = other DNA
acatactactcactaaag

SEQ ID NO: 29934 - DNA, 18 bp, synthetic construct
  source 1..18: mol_type = other DNA
agctacgactaactatag

SEQ ID NO: 29935 - DNA, 18 bp, synthetic construct
  source 1..18: mol_type = other DNA
atatacaactcaatatag

SEQ ID NO: 29936 - DNA, 18 bp, synthetic construct
  source 1..18: mol_type = other DNA
atatacgacctactatag

SEQ ID NO: 29937 - DNA, 18 bp, synthetic construct
  source 1..18: mol_type = other DNA
atatccgacttactatag

SEQ ID NO: 29938 - DNA, 18 bp, synthetic construct
  source 1..18: mol_type = other DNA
atatgtgactcactatag

SEQ ID NO: 29939 - DNA, 18 bp, synthetic construct
  source 1..18: mol_type = other DNA
atttacgactcactctag

SEQ ID NO: 29940 - DNA, 18 bp, synthetic construct
  source 1..18: mol_type = other DNA
caaaacgacacactaaag

SEQ ID NO: 29941 - DNA, 18 bp, synthetic construct
  source 1..18: mol_type = other DNA
caatacaattaactatag

SEQ ID NO: 29942 - DNA, 18 bp, synthetic construct
  source 1..18: mol_type = other DNA
caatacgacccacgacag

SEQ ID NO: 29943 - DNA, 18 bp, synthetic construct
  source 1..18: mol_type = other DNA
caatacgacttacttaag

SEQ ID NO: 29944 - DNA, 18 bp, synthetic construct
  source 1..18: mol_type = other DNA
caatacgagtaacaatag

SEQ ID NO: 29945 - DNA, 18 bp, synthetic construct
  source 1..18: mol_type = other DNA
caatacgattcacgttag

SEQ ID NO: 29946 - DNA, 18 bp, synthetic construct
  source 1..18: mol_type = other DNA
caatacgtaccactatag

SEQ ID NO: 29947 - DNA, 18 bp, synthetic construct
  source 1..18: mol_type = other DNA
caatacgtctctctaaag

SEQ ID NO: 29948 - DNA, 18 bp, synthetic construct
  source 1..18: mol_type = other DNA
caatccgacactctatag

SEQ ID NO: 29949 - DNA, 18 bp, synthetic construct
  source 1..18: mol_type = other DNA
cattacgacacactaaag

SEQ ID NO: 29950 - DNA, 18 bp, synthetic construct
  source 1..18: mol_type = other DNA
cattacgactcactctcg

SEQ ID NO: 29951 - DNA, 18 bp, synthetic construct
  source 1..18: mol_type = other DNA
cattactactcacaatag

SEQ ID NO: 29952 - DNA, 18 bp, synthetic construct
  source 1..18: mol_type = other DNA
ccctacgactccctatag

SEQ ID NO: 29953 - DNA, 18 bp, synthetic construct
  source 1..18: mol_type = other DNA
ctatacgaccaactatag

SEQ ID NO: 29954 - DNA, 18 bp, synthetic construct
  source 1..18: mol_type = other DNA
ctatccaactcactatag

SEQ ID NO: 29955 - DNA, 18 bp, synthetic construct
  source 1..18: mol_type = other DNA
gaatacaactaactaaag

SEQ ID NO: 29956 - DNA, 18 bp, synthetic construct
  source 1..18: mol_type = other DNA
gaatacacctcacaatag

SEQ ID NO: 29957 - DNA, 18 bp, synthetic construct
  source 1..18: mol_type = other DNA
gaatacgactaacattag

SEQ ID NO: 29958 - DNA, 18 bp, synthetic construct
  source 1..18: mol_type = other DNA
gcatacaaatcactatag

SEQ ID NO: 29959 - DNA, 18 bp, synthetic construct
  source 1..18: mol_type = other DNA
gtatacaactcattatag

SEQ ID NO: 29960 - DNA, 18 bp, synthetic construct
  source 1..18: mol_type = other DNA
taaaaagaatcactaaag

SEQ ID NO: 29961 - DNA, 18 bp, synthetic construct
  source 1..18: mol_type = other DNA
taaaacaactcaatatgg

SEQ ID NO: 29962 - DNA, 18 bp, synthetic construct
  source 1..18: mol_type = other DNA
taaaacaactcattaaag

SEQ ID NO: 29963 - DNA, 18 bp, synthetic construct
  source 1..18: mol_type = other DNA
taaaacaattcactatcg

SEQ ID NO: 29964 - DNA, 18 bp, synthetic construct
  source 1..18: mol_type = other DNA
taaaacatctcactgtag

SEQ ID NO: 29965 - DNA, 18 bp, synthetic construct
  source 1..18: mol_type = other DNA
taaaacgaatcaatacag

SEQ ID NO: 29966 - DNA, 18 bp, synthetic construct
  source 1..18: mol_type = other DNA
taaaacgaattactatgg

SEQ ID NO: 29967 - DNA, 18 bp, synthetic construct
  source 1..18: mol_type = other DNA
taaaacgacacactttcg

SEQ ID NO: 29968 - DNA, 18 bp, synthetic construct
  source 1..18: mol_type = other DNA
taaaacgactcacgcaag

SEQ ID NO: 29969 - DNA, 18 bp, synthetic construct
  source 1..18: mol_type = other DNA
taaaacgactgacattag

SEQ ID NO: 29970 - DNA, 18 bp, synthetic construct
  source 1..18: mol_type = other DNA
taaaacgactgtatatag

SEQ ID NO: 29971 - DNA, 18 bp, synthetic construct
  source 1..18: mol_type = other DNA
taaaacgactttctaaag

SEQ ID NO: 29972 - DNA, 18 bp, synthetic construct
  source 1..18: mol_type = other DNA
taaaacgcctccctatcg

SEQ ID NO: 29973 - DNA, 18 bp, synthetic construct
  source 1..18: mol_type = other DNA
taaaacgccttaatatag

SEQ ID NO: 29974 - DNA, 18 bp, synthetic construct
  source 1..18: mol_type = other DNA
taaaacgtctcattacag

SEQ ID NO: 29975 - DNA, 18 bp, synthetic construct
  source 1..18: mol_type = other DNA
taaaatgactcactcaag

SEQ ID NO: 29976 - DNA, 18 bp, synthetic construct
  source 1..18: mol_type = other DNA
taaaatgactcacttaag

SEQ ID NO: 29977 - DNA, 18 bp, synthetic construct
  source 1..18: mol_type = other DNA
taaagcgactctatatag

SEQ ID NO: 29978 - DNA, 18 bp, synthetic construct
  source 1..18: mol_type = other DNA
taacacgacacaccaaag

SEQ ID NO: 29979 - DNA, 18 bp, synthetic construct
  source 1..18: mol_type = other DNA
taacacgattcactcaag

SEQ ID NO: 29980 - DNA, 18 bp, synthetic construct
  source 1..18: mol_type = other DNA
taagacgacattctatag

SEQ ID NO: 29981 - DNA, 18 bp, synthetic construct
  source 1..18: mol_type = other DNA
taagccgtgtcactatag

SEQ ID NO: 29982 - DNA, 18 bp, synthetic construct
  source 1..18: mol_type = other DNA
taataaaacacactttag

SEQ ID NO: 29983 - DNA, 18 bp, synthetic construct
  source 1..18: mol_type = other DNA
taataacaataactatag

SEQ ID NO: 29984 - DNA, 18 bp, synthetic construct
  source 1..18: mol_type = other DNA
taataacactcacagtag

SEQ ID NO: 29985 - DNA, 18 bp, synthetic construct
  source 1..18: mol_type = other DNA
taataagaataactacag

SEQ ID NO: 29986 - DNA, 18 bp, synthetic construct
  source 1..18: mol_type = other DNA
taataagactcacttagg

SEQ ID NO: 29987 - DNA, 18 bp, synthetic construct
  source 1..18: mol_type = other DNA
taataagactctttaaag

SEQ ID NO: 29988 - DNA, 18 bp, synthetic construct
  source 1..18: mol_type = other DNA
taatacaacacaaaatag

SEQ ID NO: 29989 - DNA, 18 bp, synthetic construct
  source 1..18: mol_type = other DNA
taatacaactcacttccg

SEQ ID NO: 29990 - DNA, 18 bp, synthetic construct
  source 1..18: mol_type = other DNA
taatacaattcactttgg

SEQ ID NO: 29991 - DNA, 18 bp, synthetic construct
  source 1..18: mol_type = other DNA
taatacacctcacaaaag

SEQ ID NO: 29992 - DNA, 18 bp, synthetic construct
  source 1..18: mol_type = other DNA
taatacctctaactgtag

SEQ ID NO: 29993 - DNA, 18 bp, synthetic construct
  source 1..18: mol_type = other DNA
taatacctttctctatag

SEQ ID NO: 29994 - DNA, 18 bp, synthetic construct
  source 1..18: mol_type = other DNA
taatacgaaatactttag

SEQ ID NO: 29995 - DNA, 18 bp, synthetic construct
  source 1..18: mol_type = other DNA
taatacgaattattaaag

SEQ ID NO: 29996 - DNA, 18 bp, synthetic construct
  source 1..18: mol_type = other DNA
taatacgacaaaccaaag

SEQ ID NO: 29997 - DNA, 18 bp, synthetic construct
  source 1..18: mol_type = other DNA
taatacgacactacatag

SEQ ID NO: 29998 - DNA, 18 bp, synthetic construct
  source 1..18: mol_type = other DNA
taatacgacatataatag

SEQ ID NO: 29999 - DNA, 18 bp, synthetic construct
  source 1..18: mol_type = other DNA
taatacgactacttttag

SEQ ID NO: 30000 - DNA, 18 bp, synthetic construct
  source 1..18: mol_type = other DNA
taatacgactctataacg

SEQ ID NO: 30001 - DNA, 18 bp, synthetic construct
  source 1..18: mol_type = other DNA
taatacgactctctgtcc

SEQ ID NO: 30002 - DNA, 18 bp, synthetic construct
  source 1..18: mol_type = other DNA
taatacgactctttaagg

SEQ ID NO: 30003 - DNA, 18 bp, synthetic construct
  source 1..18: mol_type = other DNA
taatacgactttcactag

SEQ ID NO: 30004 - DNA, 18 bp, synthetic construct
  source 1..18: mol_type = other DNA
taatacgagaaactaaag

SEQ ID NO: 30005 - DNA, 18 bp, synthetic construct
  source 1..18: mol_type = other DNA
taatacgagtcacaaagg

SEQ ID NO: 30006 - DNA, 18 bp, synthetic construct
  source 1..18: mol_type = other DNA
taatacgagtctatgtag

SEQ ID NO: 30007 - DNA, 18 bp, synthetic construct
  source 1..18: mol_type = other DNA
taatacgattccataaag

SEQ ID NO: 30008 - DNA, 18 bp, synthetic construct
  source 1..18: mol_type = other DNA
taatacgattgacattag

SEQ ID NO: 30009 - DNA, 18 bp, synthetic construct
  source 1..18: mol_type = other DNA
taatacgatttagtaaag

SEQ ID NO: 30010 - DNA, 18 bp, synthetic construct
  source 1..18: mol_type = other DNA
taatacgtatcaatttag

SEQ ID NO: 30011 - DNA, 18 bp, synthetic construct
  source 1..18: mol_type = other DNA
taatacgtatctatatag

SEQ ID NO: 30012 - DNA, 18 bp, synthetic construct
  source 1..18: mol_type = other DNA
taatacgtcacacagtag

SEQ ID NO: 30013 - DNA, 18 bp, synthetic construct
  source 1..18: mol_type = other DNA
taatacgtccaactctag

SEQ ID NO: 30014 - DNA, 18 bp, synthetic construct
  source 1..18: mol_type = other DNA
taatacgtctaacaagag

SEQ ID NO: 30015 - DNA, 18 bp, synthetic construct
  source 1..18: mol_type = other DNA
taatacgtctcataatgg

SEQ ID NO: 30016 - DNA, 18 bp, synthetic construct
  source 1..18: mol_type = other DNA
taatacgtttcaaaatag

SEQ ID NO: 30017 - DNA, 18 bp, synthetic construct
  source 1..18: mol_type = other DNA
taatacgtttctctatgg

SEQ ID NO: 30018 - DNA, 18 bp, synthetic construct
  source 1..18: mol_type = other DNA
taatactaaacaatatag

SEQ ID NO: 30019 - DNA, 18 bp, synthetic construct
  source 1..18: mol_type = other DNA
taatactacacaatatcg

SEQ ID NO: 30020 - DNA, 18 bp, synthetic construct
  source 1..18: mol_type = other DNA
taatactactcccattag

SEQ ID NO: 30021 - DNA, 18 bp, synthetic construct
  source 1..18: mol_type = other DNA
taatactcctctcaatag

SEQ ID NO: 30022 - DNA, 18 bp, synthetic construct
  source 1..18: mol_type = other DNA
taatactgcatactatag

SEQ ID NO: 30023 - DNA, 18 bp, synthetic construct
  source 1..18: mol_type = other DNA
taataggactctcattag

SEQ ID NO: 30024 - DNA, 18 bp, synthetic construct
  source 1..18: mol_type = other DNA
taataggtttctctatag

SEQ ID NO: 30025 - DNA, 18 bp, synthetic construct
  source 1..18: mol_type = other DNA
taatatatcccactatag

SEQ ID NO: 30026 - DNA, 18 bp, synthetic construct
  source 1..18: mol_type = other DNA
taatatcactctctaaag

SEQ ID NO: 30027 - DNA, 18 bp, synthetic construct
  source 1..18: mol_type = other DNA
taatatgacaaacaatag

SEQ ID NO: 30028 - DNA, 18 bp, synthetic construct
  source 1..18: mol_type = other DNA
taatatgactaactttcg

SEQ ID NO: 30029 - DNA, 18 bp, synthetic construct
  source 1..18: mol_type = other DNA
taatatgactcacacaag

SEQ ID NO: 30030 - DNA, 18 bp, synthetic construct
  source 1..18: mol_type = other DNA
taatatgactcagcacag

SEQ ID NO: 30031 - DNA, 18 bp, synthetic construct
  source 1..18: mol_type = other DNA
taatatgactctcaacag

SEQ ID NO: 30032 - DNA, 18 bp, synthetic construct
  source 1..18: mol_type = other DNA
taatatgactgtctttag

SEQ ID NO: 30033 - DNA, 18 bp, synthetic construct
  source 1..18: mol_type = other DNA
taatatgagtctctttag

SEQ ID NO: 30034 - DNA, 18 bp, synthetic construct
  source 1..18: mol_type = other DNA
taatatgattaaatatag

SEQ ID NO: 30035 - DNA, 18 bp, synthetic construct
  source 1..18: mol_type = other DNA
taatatgattcacttcag

SEQ ID NO: 30036 - DNA, 18 bp, synthetic construct
  source 1..18: mol_type = other DNA
taatatgattccctatcg

SEQ ID NO: 30037 - DNA, 18 bp, synthetic construct
  source 1..18: mol_type = other DNA
taatatgtctaactaaag

SEQ ID NO: 30038 - DNA, 18 bp, synthetic construct
  source 1..18: mol_type = other DNA
taatatgtctcccaatag

SEQ ID NO: 30039 - DNA, 18 bp, synthetic construct
  source 1..18: mol_type = other DNA
taatatgtctctctacag

SEQ ID NO: 30040 - DNA, 18 bp, synthetic construct
  source 1..18: mol_type = other DNA
taatattacttactaaag

SEQ ID NO: 30041 - DNA, 18 bp, synthetic construct
  source 1..18: mol_type = other DNA
taatatttctctctatag

SEQ ID NO: 30042 - DNA, 18 bp, synthetic construct
  source 1..18: mol_type = other DNA
taatcccgctcactttag

SEQ ID NO: 30043 - DNA, 18 bp, synthetic construct
  source 1..18: mol_type = other DNA
taatccgacccactgtcg

SEQ ID NO: 30044 - DNA, 18 bp, synthetic construct
  source 1..18: mol_type = other DNA
taatccgactaagtaaag

SEQ ID NO: 30045 - DNA, 18 bp, synthetic construct
  source 1..18: mol_type = other DNA
taatccgactctaaatag

SEQ ID NO: 30046 - DNA, 18 bp, synthetic construct
  source 1..18: mol_type = other DNA
taatccggctctctttag

SEQ ID NO: 30047 - DNA, 18 bp, synthetic construct
  source 1..18: mol_type = other DNA
taatccgtcacactctag

SEQ ID NO: 30048 - DNA, 18 bp, synthetic construct
  source 1..18: mol_type = other DNA
taatccgtctcaaaatag

SEQ ID NO: 30049 - DNA, 18 bp, synthetic construct
  source 1..18: mol_type = other DNA
taatctgacacactatgg

SEQ ID NO: 30050 - DNA, 18 bp, synthetic construct
  source 1..18: mol_type = other DNA
taatgcagctcacaatag

SEQ ID NO: 30051 - DNA, 18 bp, synthetic construct
  source 1..18: mol_type = other DNA
taatgcatctcactaaag

SEQ ID NO: 30052 - DNA, 18 bp, synthetic construct
  source 1..18: mol_type = other DNA
taatgcgaatcattatcg

SEQ ID NO: 30053 - DNA, 18 bp, synthetic construct
  source 1..18: mol_type = other DNA
taatgcgactcaatcaag

SEQ ID NO: 30054 - DNA, 18 bp, synthetic construct
  source 1..18: mol_type = other DNA
taatgcgcctcattaaag

SEQ ID NO: 30055 - DNA, 18 bp, synthetic construct
  source 1..18: mol_type = other DNA
taatgtgactcacactag

SEQ ID NO: 30056 - DNA, 18 bp, synthetic construct
  source 1..18: mol_type = other DNA
tactacgactatctttag

SEQ ID NO: 30057 - DNA, 18 bp, synthetic construct
  source 1..18: mol_type = other DNA
tactacgactcatattag

SEQ ID NO: 30058 - DNA, 18 bp, synthetic construct
  source 1..18: mol_type = other DNA
tactatagctcactatag

SEQ ID NO: 30059 - DNA, 18 bp, synthetic construct
  source 1..18: mol_type = other DNA
tagtaagaatcactaaag

SEQ ID NO: 30060 - DNA, 18 bp, synthetic construct
  source 1..18: mol_type = other DNA
tagtaagactcaataaag

SEQ ID NO: 30061 - DNA, 18 bp, synthetic construct
  source 1..18: mol_type = other DNA
tagtacatttcactatag

SEQ ID NO: 30062 - DNA, 18 bp, synthetic construct
  source 1..18: mol_type = other DNA
tagtacgtctcacactag

SEQ ID NO: 30063 - DNA, 18 bp, synthetic construct
  source 1..18: mol_type = other DNA
tagtacgtctcactctaa

SEQ ID NO: 30064 - DNA, 18 bp, synthetic construct
  source 1..18: mol_type = other DNA
tagtactactcacaacag

SEQ ID NO: 30065 - DNA, 18 bp, synthetic construct
  source 1..18: mol_type = other DNA
tagtactactcagtgtag

SEQ ID NO: 30066 - DNA, 18 bp, synthetic construct
  source 1..18: mol_type = other DNA
tagtacttctcactctag

SEQ ID NO: 30067 - DNA, 18 bp, synthetic construct
  source 1..18: mol_type = other DNA
tataacgacacactatcg

SEQ ID NO: 30068 - DNA, 18 bp, synthetic construct
  source 1..18: mol_type = other DNA
tataacgacaccctatag

SEQ ID NO: 30069 - DNA, 18 bp, synthetic construct
  source 1..18: mol_type = other DNA
tataacgactcataatag

SEQ ID NO: 30070 - DNA, 18 bp, synthetic construct
  source 1..18: mol_type = other DNA
tatagcgactcacaatag

SEQ ID NO: 30071 - DNA, 18 bp, synthetic construct
  source 1..18: mol_type = other DNA
tatcacgacgcactatcg

SEQ ID NO: 30072 - DNA, 18 bp, synthetic construct
  source 1..18: mol_type = other DNA
tatcacgattcactacag

SEQ ID NO: 30073 - DNA, 18 bp, synthetic construct
  source 1..18: mol_type = other DNA
tatcatgactcactaaag

SEQ ID NO: 30074 - DNA, 18 bp, synthetic construct
  source 1..18: mol_type = other DNA
tattaagaattactatag

SEQ ID NO: 30075 - DNA, 18 bp, synthetic construct
  source 1..18: mol_type = other DNA
tattaagactcactaagg

SEQ ID NO: 30076 - DNA, 18 bp, synthetic construct
  source 1..18: mol_type = other DNA
tattaaggctcactaaag

SEQ ID NO: 30077 - DNA, 18 bp, synthetic construct
  source 1..18: mol_type = other DNA
tattaccacacactaaag

SEQ ID NO: 30078 - DNA, 18 bp, synthetic construct
  source 1..18: mol_type = other DNA
tattaccactcaatgtag

SEQ ID NO: 30079 - DNA, 18 bp, synthetic construct
  source 1..18: mol_type = other DNA
tattacgaattactaaag

SEQ ID NO: 30080 - DNA, 18 bp, synthetic construct
  source 1..18: mol_type = other DNA
tattacgacatacaatag

SEQ ID NO: 30081 - DNA, 18 bp, synthetic construct
  source 1..18: mol_type = other DNA
tattacgaccatctatag

SEQ ID NO: 30082 - DNA, 18 bp, synthetic construct
  source 1..18: mol_type = other DNA
tattacgactcattttgg

SEQ ID NO: 30083 - DNA, 18 bp, synthetic construct
  source 1..18: mol_type = other DNA
tattacgacttactgaag

SEQ ID NO: 30084 - DNA, 18 bp, synthetic construct
  source 1..18: mol_type = other DNA
tattacgacttcatatag

SEQ ID NO: 30085 - DNA, 18 bp, synthetic construct
  source 1..18: mol_type = other DNA
tattacgagacaatatag

SEQ ID NO: 30086 - DNA, 18 bp, synthetic construct
  source 1..18: mol_type = other DNA
tattacgatccactaaag

SEQ ID NO: 30087 - DNA, 18 bp, synthetic construct
  source 1..18: mol_type = other DNA
tattacgattaactctag

SEQ ID NO: 30088 - DNA, 18 bp, synthetic construct
  source 1..18: mol_type = other DNA
tattacgattatctatag

SEQ ID NO: 30089 - DNA, 18 bp, synthetic construct
  source 1..18: mol_type = other DNA
tattacgattgactttag

SEQ ID NO: 30090 - DNA, 18 bp, synthetic construct
  source 1..18: mol_type = other DNA
tattacgtatcactctag

SEQ ID NO: 30091 - DNA, 18 bp, synthetic construct
  source 1..18: mol_type = other DNA
tattacgtctaaatatag

SEQ ID NO: 30092 - DNA, 18 bp, synthetic construct
  source 1..18: mol_type = other DNA
tattacgtctaactttag

SEQ ID NO: 30093 - DNA, 18 bp, synthetic construct
  source 1..18: mol_type = other DNA
tattacgtctcacaaaag

SEQ ID NO: 30094 - DNA, 18 bp, synthetic construct
  source 1..18: mol_type = other DNA
tattacgtgtcagtatag

SEQ ID NO: 30095 - DNA, 18 bp, synthetic construct
  source 1..18: mol_type = other DNA
tattagaactcaatatag

SEQ ID NO: 30096 - DNA, 18 bp, synthetic construct
  source 1..18: mol_type = other DNA
tattaggactcactaacg

SEQ ID NO: 30097 - DNA, 18 bp, synthetic construct
  source 1..18: mol_type = other DNA
tattatgactcactttcg

SEQ ID NO: 30098 - DNA, 18 bp, synthetic construct
  source 1..18: mol_type = other DNA
tattgcgaccctctatag

SEQ ID NO: 30099 - DNA, 18 bp, synthetic construct
  source 1..18: mol_type = other DNA
tattgcggttcactatag

SEQ ID NO: 30100 - DNA, 18 bp, synthetic construct
  source 1..18: mol_type = other DNA
tcaaacgacacactttag

SEQ ID NO: 30101 - DNA, 18 bp, synthetic construct
  source 1..18: mol_type = other DNA
tcataagacacactttag

SEQ ID NO: 30102 - DNA, 18 bp, synthetic construct
  source 1..18: mol_type = other DNA
tcatacaaatctctatag

SEQ ID NO: 30103 - DNA, 18 bp, synthetic construct
  source 1..18: mol_type = other DNA
tcatacgaatatctatag

SEQ ID NO: 30104 - DNA, 18 bp, synthetic construct
  source 1..18: mol_type = other DNA
tcatacgcctcacattag

SEQ ID NO: 30105 - DNA, 18 bp, synthetic construct
  source 1..18: mol_type = other DNA
tcatactactctctttag

SEQ ID NO: 30106 - DNA, 18 bp, synthetic construct
  source 1..18: mol_type = other DNA
tcgtacgacacactatcg

SEQ ID NO: 30107 - DNA, 18 bp, synthetic construct
  source 1..18: mol_type = other DNA
tctaacgactcactatgg

SEQ ID NO: 30108 - DNA, 18 bp, synthetic construct
  source 1..18: mol_type = other DNA
tcttacgtttcactatag

SEQ ID NO: 30109 - DNA, 18 bp, synthetic construct
  source 1..18: mol_type = other DNA
tgataccaaacactatag

SEQ ID NO: 30110 - DNA, 18 bp, synthetic construct
  source 1..18: mol_type = other DNA
tgatacgacaaactacag

SEQ ID NO: 30111 - DNA, 18 bp, synthetic construct
  source 1..18: mol_type = other DNA
tgatacgcttcaatatag

SEQ ID NO: 30112 - DNA, 18 bp, synthetic construct
  source 1..18: mol_type = other DNA
tgatacgtctacctatag

SEQ ID NO: 30113 - DNA, 18 bp, synthetic construct
  source 1..18: mol_type = other DNA
tgatactactttctatag

SEQ ID NO: 30114 - DNA, 18 bp, synthetic construct
  source 1..18: mol_type = other DNA
tgatatatctcactatag

SEQ ID NO: 30115 - DNA, 18 bp, synthetic construct
  source 1..18: mol_type = other DNA
tgatcggactcacaatag

SEQ ID NO: 30116 - DNA, 18 bp, synthetic construct
  source 1..18: mol_type = other DNA
tgttaagactcactaaag

SEQ ID NO: 30117 - DNA, 18 bp, synthetic construct
  source 1..18: mol_type = other DNA
tgttaccactcactttag

SEQ ID NO: 30118 - DNA, 18 bp, synthetic construct
  source 1..18: mol_type = other DNA
ttaaaaaactcactatag

SEQ ID NO: 30119 - DNA, 18 bp, synthetic construct
  source 1..18: mol_type = other DNA
ttacacgaatccctatag

SEQ ID NO: 30120 - DNA, 18 bp, synthetic construct
  source 1..18: mol_type = other DNA
ttacacgactcaatttag

SEQ ID NO: 30121 - DNA, 18 bp, synthetic construct
  source 1..18: mol_type = other DNA
ttacacgtctcaccatag

SEQ ID NO: 30122 - DNA, 18 bp, synthetic construct
  source 1..18: mol_type = other DNA
ttacactactcattatag

SEQ ID NO: 30123 - DNA, 18 bp, synthetic construct
  source 1..18: mol_type = other DNA
ttagacgaatcactacag

SEQ ID NO: 30124 - DNA, 18 bp, synthetic construct
  source 1..18: mol_type = other DNA
ttataacaatcactatag

SEQ ID NO: 30125 - DNA, 18 bp, synthetic construct
  source 1..18: mol_type = other DNA
ttataagacatactatag

SEQ ID NO: 30126 - DNA, 18 bp, synthetic construct
  source 1..18: mol_type = other DNA
ttataagactcaaaatag

SEQ ID NO: 30127 - DNA, 18 bp, synthetic construct
  source 1..18: mol_type = other DNA
ttataagtatcactatag

SEQ ID NO: 30128 - DNA, 18 bp, synthetic construct
  source 1..18: mol_type = other DNA
ttataagtttcactatag

SEQ ID NO: 30129 - DNA, 18 bp, synthetic construct
  source 1..18: mol_type = other DNA
ttataatactcaatatag

SEQ ID NO: 30130 - DNA, 18 bp, synthetic construct
  source 1..18: mol_type = other DNA
ttatacaaatcacaatag

SEQ ID NO: 30131 - DNA, 18 bp, synthetic construct
  source 1..18: mol_type = other DNA
ttatacaactcattctag

SEQ ID NO: 30132 - DNA, 18 bp, synthetic construct
  source 1..18: mol_type = other DNA
ttatacgacagaatatag

SEQ ID NO: 30133 - DNA, 18 bp, synthetic construct
  source 1..18: mol_type = other DNA
ttatacgactaacttgag

SEQ ID NO: 30134 - DNA, 18 bp, synthetic construct
  source 1..18: mol_type = other DNA
ttatacgactcaaaagag

SEQ ID NO: 30135 - DNA, 18 bp, synthetic construct
  source 1..18: mol_type = other DNA
ttatacgactctctgtgg

SEQ ID NO: 30136 - DNA, 18 bp, synthetic construct
  source 1..18: mol_type = other DNA
ttatacgtcacactatcg

SEQ ID NO: 30137 - DNA, 18 bp, synthetic construct
  source 1..18: mol_type = other DNA
ttatactaatcaatatag

SEQ ID NO: 30138 - DNA, 18 bp, synthetic construct
  source 1..18: mol_type = other DNA
ttatactaatcattatag

SEQ ID NO: 30139 - DNA, 18 bp, synthetic construct
  source 1..18: mol_type = other DNA
ttatactattcactgtag

SEQ ID NO: 30140 - DNA, 18 bp, synthetic construct
  source 1..18: mol_type = other DNA
ttataggacttactaaag

SEQ ID NO: 30141 - DNA, 18 bp, synthetic construct
  source 1..18: mol_type = other DNA
ttataggattctctatag

SEQ ID NO: 30142 - DNA, 18 bp, synthetic construct
  source 1..18: mol_type = other DNA
ttatataacacactatag

SEQ ID NO: 30143 - DNA, 18 bp, synthetic construct
  source 1..18: mol_type = other DNA
ttatatgagttactatag

SEQ ID NO: 30144 - DNA, 18 bp, synthetic construct
  source 1..18: mol_type = other DNA
ttatatgattcaatatag

SEQ ID NO: 30145 - DNA, 18 bp, synthetic construct
  source 1..18: mol_type = other DNA
ttatatggctcactaaag

SEQ ID NO: 30146 - DNA, 18 bp, synthetic construct
  source 1..18: mol_type = other DNA
ttatccgactcacttcag

SEQ ID NO: 30147 - DNA, 18 bp, synthetic construct
  source 1..18: mol_type = other DNA
ttatccgtctctctatag

SEQ ID NO: 30148 - DNA, 18 bp, synthetic construct
  source 1..18: mol_type = other DNA
ttatgtgacacactatag

SEQ ID NO: 30149 - DNA, 18 bp, synthetic construct
  source 1..18: mol_type = other DNA
ttctacgactcactaacg

SEQ ID NO: 30150 - DNA, 18 bp, synthetic construct
  source 1..18: mol_type = other DNA
ttctacgactcattttag

SEQ ID NO: 30151 - DNA, 18 bp, synthetic construct
  source 1..18: mol_type = other DNA
ttattagactcactaaag

SEQ ID NO: 30152 - DNA, 18 bp, synthetic construct
  source 1..18: mol_type = other DNA
ttatatgtctcacaatag

SEQ ID NO: 30153 - DNA, 18 bp, synthetic construct
  source 1..18: mol_type = other DNA
tatcactactcactattg

SEQ ID NO: 30154 - DNA, 18 bp, synthetic construct
  source 1..18: mol_type = other DNA
ttttatgactcactaaag

SEQ ID NO: 30155 - DNA, 18 bp, synthetic construct
  source 1..18: mol_type = other DNA
taaatcgaatcactattg

SEQ ID NO: 30156 - DNA, 18 bp, synthetic construct
  source 1..18: mol_type = other DNA
aaattccactcactaaag

SEQ ID NO: 30157 - DNA, 18 bp, synthetic construct
  source 1..18: mol_type = other DNA
aaatttgactcacaatag

SEQ ID NO: 30158 - DNA, 18 bp, synthetic construct
  source 1..18: mol_type = other DNA
taaaacgacccactaatg

SEQ ID NO: 30159 - DNA, 18 bp, synthetic construct
  source 1..18: mol_type = other DNA
taaaatgactcactaatg

SEQ ID NO: 30160 - DNA, 18 bp, synthetic construct
  source 1..18: mol_type = other DNA
taataagacacacaattg

SEQ ID NO: 30161 - DNA, 18 bp, synthetic construct
  source 1..18: mol_type = other DNA
taattcgtatcacaatag

SEQ ID NO: 30162 - DNA, 18 bp, synthetic construct
  source 1..18: mol_type = other DNA
taattcgtctcactttcg

SEQ ID NO: 30163 - DNA, 18 bp, synthetic construct
  source 1..18: mol_type = other DNA
tataacaactcactattg

SEQ ID NO: 30164 - DNA, 18 bp, synthetic construct
  source 1..18: mol_type = other DNA
tattacggctcacttttg

SEQ ID NO: 30165 - DNA, 18 bp, synthetic construct
  source 1..18: mol_type = other DNA
tattactactccctattg

SEQ ID NO: 30166 - DNA, 18 bp, synthetic construct
  source 1..18: mol_type = other DNA
tatttcgtttcactatag

SEQ ID NO: 30167 - DNA, 18 bp, synthetic construct
  source 1..18: mol_type = other DNA
tatttctactcaatatag

SEQ ID NO: 30168 - DNA, 18 bp, synthetic construct
  source 1..18: mol_type = other DNA
ttattcgactctcaatag

SEQ ID NO: 30169 - DNA, 18 bp, synthetic construct
  source 1..18: mol_type = other DNA
ttattcgtctgactatag

SEQ ID NO: 30170 - DNA, 18 bp, synthetic construct
  source 1..18: mol_type = other DNA
ttttacgactcacttttg

SEQ ID NO: 30171 - DNA, 18 bp, synthetic construct
  source 1..18: mol_type = other DNA
atatacgattcactacag

SEQ ID NO: 30172 - DNA, 18 bp, synthetic construct
  source 1..18: mol_type = other DNA
cattacgacactctatag

SEQ ID NO: 30173 - DNA, 18 bp, synthetic construct
  source 1..18: mol_type = other DNA
taaaacaactcacttcag

SEQ ID NO: 30174 - DNA, 18 bp, synthetic construct
  source 1..18: mol_type = other DNA
taacacgtctctctaaag

SEQ ID NO: 30175 - DNA, 18 bp, synthetic construct
  source 1..18: mol_type = other DNA
taataagtttcacaatag

SEQ ID NO: 30176 - DNA, 18 bp, synthetic construct
  source 1..18: mol_type = other DNA
taatacgattctcttcag

SEQ ID NO: 30177 - DNA, 18 bp, synthetic construct
  source 1..18: mol_type = other DNA
tataaagtctcactatag

SEQ ID NO: 30178 - DNA, 18 bp, synthetic construct
  source 1..18: mol_type = other DNA
tcatacgtcaaactatag

SEQ ID NO: 30179 - DNA, 18 bp, synthetic construct
  source 1..18: mol_type = other DNA
tgttacgacactctatag

SEQ ID NO: 30180 - DNA, 18 bp, synthetic construct
  source 1..18: mol_type = other DNA
ttataagactcactaagg

SEQ ID NO: 30181 - DNA, 18 bp, synthetic construct
  source 1..18: mol_type = other DNA
ttatacaacacactttag

SEQ ID NO: 30182 - DNA, 18 bp, synthetic construct
  source 1..18: mol_type = other DNA
ttatacgattaacaatag

SEQ ID NO: 30183 - DNA, 18 bp, synthetic construct
  source 1..18: mol_type = other DNA
ttatattactaactatag

SEQ ID NO: 30184 - DNA, 18 bp, synthetic construct
  source 1..18: mol_type = other DNA
ttctacgacacactttag

SEQ ID NO: 30185 - DNA, 18 bp, synthetic construct
  source 1..18: mol_type = other DNA
ttttaagattcactatag

SEQ ID NO: 30186 - DNA, 18 bp, synthetic construct
  source 1..18: mol_type = other DNA
ttttacgaatcactaaag

SEQ ID NO: 30187 - DNA, 18 bp, synthetic construct
  source 1..18: mol_type = other DNA
tattacgactcacttatg

SEQ ID NO: 30188 - DNA, 18 bp, synthetic construct
  source 1..18: mol_type = other DNA
ttatacgactcacatttg

SEQ ID NO: 30189 - DNA, 18 bp, synthetic construct
  source 1..18: mol_type = other DNA
tattacttctcactattg

SEQ ID NO: 30190 - DNA, 18 bp, synthetic construct
  source 1..18: mol_type = other DNA
taatacgtctcaaattag

SEQ ID NO: 30191 - DNA, 18 bp, synthetic construct
  source 1..18: mol_type = other DNA
ttatacgtctctctaaag

SEQ ID NO: 30192 - DNA, 18 bp, synthetic construct
  source 1..18: mol_type = other DNA
atattcgtctcactatag

SEQ ID NO: 30193 - DNA, 18 bp, synthetic construct
  source 1..18: mol_type = other DNA
aaaatcgactcactattg

SEQ ID NO: 30194 - DNA, 18 bp, synthetic construct
  source 1..18: mol_type = other DNA
taaatcgacttgctatag

SEQ ID NO: 30195 - DNA, 18 bp, synthetic construct
  source 1..18: mol_type = other DNA
taattcgacatactattg

SEQ ID NO: 30196 - DNA, 18 bp, synthetic construct
  source 1..18: mol_type = other DNA
taattcgactcagtaatg

SEQ ID NO: 30197 - DNA, 18 bp, synthetic construct
  source 1..18: mol_type = other DNA
tatttcgactcactcttg

SEQ ID NO: 30198 - DNA, 18 bp, synthetic construct
  source 1..18: mol_type = other DNA
tgatacgactcgcaattg

SEQ ID NO: 30199 - DNA, 18 bp, synthetic construct
  source 1..18: mol_type = other DNA
tgattcgactcgctaaag

SEQ ID NO: 30200 - DNA, 18 bp, synthetic construct
  source 1..18: mol_type = other DNA
ttattcgattcactattg

SEQ ID NO: 30201 - DNA, 18 bp, synthetic construct
  source 1..18: mol_type = other DNA
aaaaacggctcactattg

SEQ ID NO: 30202 - DNA, 18 bp, synthetic construct
  source 1..18: mol_type = other DNA
aaatacgacttagtattg

SEQ ID NO: 30203 - DNA, 18 bp, synthetic construct
  source 1..18: mol_type = other DNA
aaattcaactcaccatag

SEQ ID NO: 30204 - DNA, 18 bp, synthetic construct
  source 1..18: mol_type = other DNA
aaattcgacacactaaag

SEQ ID NO: 30205 - DNA, 18 bp, synthetic construct
  source 1..18: mol_type = other DNA
aaattcgacccactctag

SEQ ID NO: 30206 - DNA, 18 bp, synthetic construct
  source 1..18: mol_type = other DNA
aaattcgactccctttag

SEQ ID NO: 30207 - DNA, 18 bp, synthetic construct
  source 1..18: mol_type = other DNA
atgtacgactcactattg

SEQ ID NO: 30208 - DNA, 18 bp, synthetic construct
  source 1..18: mol_type = other DNA
caatacatctcactattg

SEQ ID NO: 30209 - DNA, 18 bp, synthetic construct
  source 1..18: mol_type = other DNA
caatacggctcacttttg

SEQ ID NO: 30210 - DNA, 18 bp, synthetic construct
  source 1..18: mol_type = other DNA
caatacgtcacactattg

SEQ ID NO: 30211 - DNA, 18 bp, synthetic construct
  source 1..18: mol_type = other DNA
gaatacaacttactattg

SEQ ID NO: 30212 - DNA, 18 bp, synthetic construct
  source 1..18: mol_type = other DNA
gtatacgcctcgctatag

SEQ ID NO: 30213 - DNA, 18 bp, synthetic construct
  source 1..18: mol_type = other DNA
taaaaccactcgctaaag

SEQ ID NO: 30214 - DNA, 18 bp, synthetic construct
  source 1..18: mol_type = other DNA
taaaacgtttcgctatag

SEQ ID NO: 30215 - DNA, 18 bp, synthetic construct
  source 1..18: mol_type = other DNA
taaatctactcactatcg

SEQ ID NO: 30216 - DNA, 18 bp, synthetic construct
  source 1..18: mol_type = other DNA
taagacgactctctcttg

SEQ ID NO: 30217 - DNA, 18 bp, synthetic construct
  source 1..18: mol_type = other DNA
taagtagtctcactatag

SEQ ID NO: 30218 - DNA, 18 bp, synthetic construct
  source 1..18: mol_type = other DNA
taatacccctcacaattg

SEQ ID NO: 30219 - DNA, 18 bp, synthetic construct
  source 1..18: mol_type = other DNA
taatacgaaacactcttg

SEQ ID NO: 30220 - DNA, 18 bp, synthetic construct
  source 1..18: mol_type = other DNA
taatacgaatctccattg

SEQ ID NO: 30221 - DNA, 18 bp, synthetic construct
  source 1..18: mol_type = other DNA
taatacgacactctactg

SEQ ID NO: 30222 - DNA, 18 bp, synthetic construct
  source 1..18: mol_type = other DNA
taatacgactgacaaatg

SEQ ID NO: 30223 - DNA, 18 bp, synthetic construct
  source 1..18: mol_type = other DNA
taatacgagactctattg

SEQ ID NO: 30224 - DNA, 18 bp, synthetic construct
  source 1..18: mol_type = other DNA
taatacgagttactaatg

SEQ ID NO: 30225 - DNA, 18 bp, synthetic construct
  source 1..18: mol_type = other DNA
taatacgataccctattg

SEQ ID NO: 30226 - DNA, 18 bp, synthetic construct
  source 1..18: mol_type = other DNA
taatacgattgtctattg

SEQ ID NO: 30227 - DNA, 18 bp, synthetic construct
  source 1..18: mol_type = other DNA
taatacgccatactattg

SEQ ID NO: 30228 - DNA, 18 bp, synthetic construct
  source 1..18: mol_type = other DNA
taatacgcctaactaatg

SEQ ID NO: 30229 - DNA, 18 bp, synthetic construct
  source 1..18: mol_type = other DNA
taatacgcttcaatattg

SEQ ID NO: 30230 - DNA, 18 bp, synthetic construct
  source 1..18: mol_type = other DNA
taatacggctttctattg

SEQ ID NO: 30231 - DNA, 18 bp, synthetic construct
  source 1..18: mol_type = other DNA
taataggactctccattg

SEQ ID NO: 30232 - DNA, 18 bp, synthetic construct
  source 1..18: mol_type = other DNA
taatatacctcgctatag

SEQ ID NO: 30233 - DNA, 18 bp, synthetic construct
  source 1..18: mol_type = other DNA
taatatgacacaatattg

SEQ ID NO: 30234 - DNA, 18 bp, synthetic construct
  source 1..18: mol_type = other DNA
taatatgtctctctattg

SEQ ID NO: 30235 - DNA, 18 bp, synthetic construct
  source 1..18: mol_type = other DNA
taatgcaactccctattg

SEQ ID NO: 30236 - DNA, 18 bp, synthetic construct
  source 1..18: mol_type = other DNA
taattagacatactatag

SEQ ID NO: 30237 - DNA, 18 bp, synthetic construct
  source 1..18: mol_type = other DNA
taattagtctgactatag

SEQ ID NO: 30238 - DNA, 18 bp, synthetic construct
  source 1..18: mol_type = other DNA
taattatactcattatag

SEQ ID NO: 30239 - DNA, 18 bp, synthetic construct
  source 1..18: mol_type = other DNA
taattcaacacattatag

SEQ ID NO: 30240 - DNA, 18 bp, synthetic construct
  source 1..18: mol_type = other DNA
taattcaactgacaatag

SEQ ID NO: 30241 - DNA, 18 bp, synthetic construct
  source 1..18: mol_type = other DNA
taattcatctaactatag

SEQ ID NO: 30242 - DNA, 18 bp, synthetic construct
  source 1..18: mol_type = other DNA
taattccactttctatag

SEQ ID NO: 30243 - DNA, 18 bp, synthetic construct
  source 1..18: mol_type = other DNA
taattcgaattactctag

SEQ ID NO: 30244 - DNA, 18 bp, synthetic construct
  source 1..18: mol_type = other DNA
taattcgactcacactcg

SEQ ID NO: 30245 - DNA, 18 bp, synthetic construct
  source 1..18: mol_type = other DNA
taattcgactctgtaaag

SEQ ID NO: 30246 - DNA, 18 bp, synthetic construct
  source 1..18: mol_type = other DNA
taattcgtcacactatcg

SEQ ID NO: 30247 - DNA, 18 bp, synthetic construct
  source 1..18: mol_type = other DNA
taattcgtcccactaaag

SEQ ID NO: 30248 - DNA, 18 bp, synthetic construct
  source 1..18: mol_type = other DNA
taattcgtctgaatatag

SEQ ID NO: 30249 - DNA, 18 bp, synthetic construct
  source 1..18: mol_type = other DNA
taattcgtttcactagag

SEQ ID NO: 30250 - DNA, 18 bp, synthetic construct
  source 1..18: mol_type = other DNA
taattctacacactatgg

SEQ ID NO: 30251 - DNA, 18 bp, synthetic construct
  source 1..18: mol_type = other DNA
taattctacttcctatag

SEQ ID NO: 30252 - DNA, 18 bp, synthetic construct
  source 1..18: mol_type = other DNA
taattggtctcactacag

SEQ ID NO: 30253 - DNA, 18 bp, synthetic construct
  source 1..18: mol_type = other DNA
taatttaactcactatgg

SEQ ID NO: 30254 - DNA, 18 bp, synthetic construct
  source 1..18: mol_type = other DNA
taatttcactcacaatag

SEQ ID NO: 30255 - DNA, 18 bp, synthetic construct
  source 1..18: mol_type = other DNA
tactacgacctactattg

SEQ ID NO: 30256 - DNA, 18 bp, synthetic construct
  source 1..18: mol_type = other DNA
tacttcgactctgtatag

SEQ ID NO: 30257 - DNA, 18 bp, synthetic construct
  source 1..18: mol_type = other DNA
tagattgactcactatag

SEQ ID NO: 30258 - DNA, 18 bp, synthetic construct
  source 1..18: mol_type = other DNA
tagtacgactcacagttg

SEQ ID NO: 30259 - DNA, 18 bp, synthetic construct
  source 1..18: mol_type = other DNA
tagtacgactccccattg

SEQ ID NO: 30260 - DNA, 18 bp, synthetic construct
  source 1..18: mol_type = other DNA
tagtactacacactattg

SEQ ID NO: 30261 - DNA, 18 bp, synthetic construct
  source 1..18: mol_type = other DNA
tagttcaactcacaatag

SEQ ID NO: 30262 - DNA, 18 bp, synthetic construct
  source 1..18: mol_type = other DNA
tagttcgaatctctatag

SEQ ID NO: 30263 - DNA, 18 bp, synthetic construct
  source 1..18: mol_type = other DNA
tattaccactcacttttg

SEQ ID NO: 30264 - DNA, 18 bp, synthetic construct
  source 1..18: mol_type = other DNA
tattacgattcgctttag

SEQ ID NO: 30265 - DNA, 18 bp, synthetic construct
  source 1..18: mol_type = other DNA
tattacgcctctctattg

SEQ ID NO: 30266 - DNA, 18 bp, synthetic construct
  source 1..18: mol_type = other DNA
tattccgattcactattg

SEQ ID NO: 30267 - DNA, 18 bp, synthetic construct
  source 1..18: mol_type = other DNA
tattccgattcgctatag

SEQ ID NO: 30268 - DNA, 18 bp, synthetic construct
  source 1..18: mol_type = other DNA
tatttcgtatcactatag

SEQ ID NO: 30269 - DNA, 18 bp, synthetic construct
  source 1..18: mol_type = other DNA
tatttcgtctcaatatag

SEQ ID NO: 30270 - DNA, 18 bp, synthetic construct
  source 1..18: mol_type = other DNA
tatttcgtctcactttag

SEQ ID NO: 30271 - DNA, 18 bp, synthetic construct
  source 1..18: mol_type = other DNA
tatttggactctctatag

SEQ ID NO: 30272 - DNA, 18 bp, synthetic construct
  source 1..18: mol_type = other DNA
tcaaacgactcactaatg

SEQ ID NO: 30273 - DNA, 18 bp, synthetic construct
  source 1..18: mol_type = other DNA
tcatacgactaacaattg

SEQ ID NO: 30274 - DNA, 18 bp, synthetic construct
  source 1..18: mol_type = other DNA
tcatacgactcacaactg

SEQ ID NO: 30275 - DNA, 18 bp, synthetic construct
  source 1..18: mol_type = other DNA
tcattctaatcactatag

SEQ ID NO: 30276 - DNA, 18 bp, synthetic construct
  source 1..18: mol_type = other DNA
tcttacgactctctattg

SEQ ID NO: 30277 - DNA, 18 bp, synthetic construct
  source 1..18: mol_type = other DNA
tgatacgactcattcttg

SEQ ID NO: 30278 - DNA, 18 bp, synthetic construct
  source 1..18: mol_type = other DNA
tgatactactctctattg

SEQ ID NO: 30279 - DNA, 18 bp, synthetic construct
  source 1..18: mol_type = other DNA
tgattcaactctctatag

SEQ ID NO: 30280 - DNA, 18 bp, synthetic construct
  source 1..18: mol_type = other DNA
tgattcgactctttatag

SEQ ID NO: 30281 - DNA, 18 bp, synthetic construct
  source 1..18: mol_type = other DNA
tgattcgattcactttag

SEQ ID NO: 30282 - DNA, 18 bp, synthetic construct
  source 1..18: mol_type = other DNA
tgattctactctctatag

SEQ ID NO: 30283 - DNA, 18 bp, synthetic construct
  source 1..18: mol_type = other DNA
tgtctcgactcactatag

SEQ ID NO: 30284 - DNA, 18 bp, synthetic construct
  source 1..18: mol_type = other DNA
tgttacgactcattattg

SEQ ID NO: 30285 - DNA, 18 bp, synthetic construct
  source 1..18: mol_type = other DNA
ttaaacgactcaccattg

SEQ ID NO: 30286 - DNA, 18 bp, synthetic construct
  source 1..18: mol_type = other DNA
ttaatctactcactatag

SEQ ID NO: 30287 - DNA, 18 bp, synthetic construct
  source 1..18: mol_type = other DNA
ttatacgacaccctattg

SEQ ID NO: 30288 - DNA, 18 bp, synthetic construct
  source 1..18: mol_type = other DNA
ttatacgacgcactcttg

SEQ ID NO: 30289 - DNA, 18 bp, synthetic construct
  source 1..18: mol_type = other DNA
ttatacgactcattcttg

SEQ ID NO: 30290 - DNA, 18 bp, synthetic construct
  source 1..18: mol_type = other DNA
ttatactactcactactg

SEQ ID NO: 30291 - DNA, 18 bp, synthetic construct
  source 1..18: mol_type = other DNA
ttatatgactcgctaaag

SEQ ID NO: 30292 - DNA, 18 bp, synthetic construct
  source 1..18: mol_type = other DNA
ttatccgacacactattg

SEQ ID NO: 30293 - DNA, 18 bp, synthetic construct
  source 1..18: mol_type = other DNA
ttatgcgacttactattg

SEQ ID NO: 30294 - DNA, 18 bp, synthetic construct
  source 1..18: mol_type = other DNA
ttattcgattcaatatag

SEQ ID NO: 30295 - DNA, 18 bp, synthetic construct
  source 1..18: mol_type = other DNA
ttgttcgtctcactatag

SEQ ID NO: 30296 - DNA, 18 bp, synthetic construct
  source 1..18: mol_type = other DNA
aaaaaacactcactatag

SEQ ID NO: 30297 - DNA, 18 bp, synthetic construct
  source 1..18: mol_type = other DNA
aaaaacgaatcactctag

SEQ ID NO: 30298 - DNA, 18 bp, synthetic construct
  source 1..18: mol_type = other DNA
aaaaacgactcaccaaag

SEQ ID NO: 30299 - DNA, 18 bp, synthetic construct
  source 1..18: mol_type = other DNA
aaaaacgactcagtaaag

SEQ ID NO: 30300 - DNA, 18 bp, synthetic construct
  source 1..18: mol_type = other DNA
aaacacgaatcattatag

SEQ ID NO: 30301 - DNA, 18 bp, synthetic construct
  source 1..18: mol_type = other DNA
aaataagaatcactaaag

SEQ ID NO: 30302 - DNA, 18 bp, synthetic construct
  source 1..18: mol_type = other DNA
aaataagtctcactgtag

SEQ ID NO: 30303 - DNA, 18 bp, synthetic construct
  source 1..18: mol_type = other DNA
aaatacaacacactttag

SEQ ID NO: 30304 - DNA, 18 bp, synthetic construct
  source 1..18: mol_type = other DNA
aaatacgacactctacag

SEQ ID NO: 30305 - DNA, 18 bp, synthetic construct
  source 1..18: mol_type = other DNA
aaatacgattcacaaaag

SEQ ID NO: 30306 - DNA, 18 bp, synthetic construct
  source 1..18: mol_type = other DNA
aaatactatacactatag

SEQ ID NO: 30307 - DNA, 18 bp, synthetic construct
  source 1..18: mol_type = other DNA
aaatatcactcacaatag

SEQ ID NO: 30308 - DNA, 18 bp, synthetic construct
  source 1..18: mol_type = other DNA
aaatattactcactaaag

SEQ ID NO: 30309 - DNA, 18 bp, synthetic construct
  source 1..18: mol_type = other DNA
aactactactcacaatag

SEQ ID NO: 30310 - DNA, 18 bp, synthetic construct
  source 1..18: mol_type = other DNA
aagtacgactcattaaag

SEQ ID NO: 30311 - DNA, 18 bp, synthetic construct
  source 1..18: mol_type = other DNA
aagtacgtcccactatag

SEQ ID NO: 30312 - DNA, 18 bp, synthetic construct
  source 1..18: mol_type = other DNA
aagtacgtctcaatatag

SEQ ID NO: 30313 - DNA, 18 bp, synthetic construct
  source 1..18: mol_type = other DNA
aattaagactccctatag

SEQ ID NO: 30314 - DNA, 18 bp, synthetic construct
  source 1..18: mol_type = other DNA
aattacgactcacttgag

SEQ ID NO: 30315 - DNA, 18 bp, synthetic construct
  source 1..18: mol_type = other DNA
aattatgacacactatag

SEQ ID NO: 30316 - DNA, 18 bp, synthetic construct
  source 1..18: mol_type = other DNA
acaaatgactcactatag

SEQ ID NO: 30317 - DNA, 18 bp, synthetic construct
  source 1..18: mol_type = other DNA
acataagacacactatag

SEQ ID NO: 30318 - DNA, 18 bp, synthetic construct
  source 1..18: mol_type = other DNA
acatacgacctactatag

SEQ ID NO: 30319 - DNA, 18 bp, synthetic construct
  source 1..18: mol_type = other DNA
acatacgactctctatgg

SEQ ID NO: 30320 - DNA, 18 bp, synthetic construct
  source 1..18: mol_type = other DNA
agaaacgactcactctag

SEQ ID NO: 30321 - DNA, 18 bp, synthetic construct
  source 1..18: mol_type = other DNA
agatacgactcacattag

SEQ ID NO: 30322 - DNA, 18 bp, synthetic construct
  source 1..18: mol_type = other DNA
ataaacgactcaccatag

SEQ ID NO: 30323 - DNA, 18 bp, synthetic construct
  source 1..18: mol_type = other DNA
atatacgacacacgatag

SEQ ID NO: 30324 - DNA, 18 bp, synthetic construct
  source 1..18: mol_type = other DNA
atatacgattcactaaag

SEQ ID NO: 30325 - DNA, 18 bp, synthetic construct
  source 1..18: mol_type = other DNA
atatacggctcacgatag

SEQ ID NO: 30326 - DNA, 18 bp, synthetic construct
  source 1..18: mol_type = other DNA
atatgcgtctcactatag

SEQ ID NO: 30327 - DNA, 18 bp, synthetic construct
  source 1..18: mol_type = other DNA
atctacgactcacaatag

SEQ ID NO: 30328 - DNA, 18 bp, synthetic construct
  source 1..18: mol_type = other DNA
caataacactcacaatag

SEQ ID NO: 30329 - DNA, 18 bp, synthetic construct
  source 1..18: mol_type = other DNA
caataagaatcactttag

SEQ ID NO: 30330 - DNA, 18 bp, synthetic construct
  source 1..18: mol_type = other DNA
caatacgactcaaaaaag

SEQ ID NO: 30331 - DNA, 18 bp, synthetic construct
  source 1..18: mol_type = other DNA
catgacgactaactatag

SEQ ID NO: 30332 - DNA, 18 bp, synthetic construct
  source 1..18: mol_type = other DNA
cattacggctcactctag

SEQ ID NO: 30333 - DNA, 18 bp, synthetic construct
  source 1..18: mol_type = other DNA
ccatacgacttacaatag

SEQ ID NO: 30334 - DNA, 18 bp, synthetic construct
  source 1..18: mol_type = other DNA
cgatacgactcattagag

SEQ ID NO: 30335 - DNA, 18 bp, synthetic construct
  source 1..18: mol_type = other DNA
cgatacgactgactaaag

SEQ ID NO: 30336 - DNA, 18 bp, synthetic construct
  source 1..18: mol_type = other DNA
ctatacgtctcaatatag

SEQ ID NO: 30337 - DNA, 18 bp, synthetic construct
  source 1..18: mol_type = other DNA
gattacgcctcactttag

SEQ ID NO: 30338 - DNA, 18 bp, synthetic construct
  source 1..18: mol_type = other DNA
gtatacatctcactatag

SEQ ID NO: 30339 - DNA, 18 bp, synthetic construct
  source 1..18: mol_type = other DNA
taaaaagactctctatcg

SEQ ID NO: 30340 - DNA, 18 bp, synthetic construct
  source 1..18: mol_type = other DNA
taaaacatctcactctag

SEQ ID NO: 30341 - DNA, 18 bp, synthetic construct
  source 1..18: mol_type = other DNA
taaaacgacaacctatag

SEQ ID NO: 30342 - DNA, 18 bp, synthetic construct
  source 1..18: mol_type = other DNA
taaaacgacagacaatag

SEQ ID NO: 30343 - DNA, 18 bp, synthetic construct
  source 1..18: mol_type = other DNA
taaaacgactatctatcg

SEQ ID NO: 30344 - DNA, 18 bp, synthetic construct
  source 1..18: mol_type = other DNA
taaaacgattaactaaag

SEQ ID NO: 30345 - DNA, 18 bp, synthetic construct
  source 1..18: mol_type = other DNA
taaaacgtcacaatatag

SEQ ID NO: 30346 - DNA, 18 bp, synthetic construct
  source 1..18: mol_type = other DNA
taaaacgtgacactatag

SEQ ID NO: 30347 - DNA, 18 bp, synthetic construct
  source 1..18: mol_type = other DNA
taaaacgtttcactatcg

SEQ ID NO: 30348 - DNA, 18 bp, synthetic construct
  source 1..18: mol_type = other DNA
taaaacgtttcactatgg

SEQ ID NO: 30349 - DNA, 18 bp, synthetic construct
  source 1..18: mol_type = other DNA
taaaactactatctatag

SEQ ID NO: 30350 - DNA, 18 bp, synthetic construct
  source 1..18: mol_type = other DNA
taaaactccacactatag

SEQ ID NO: 30351 - DNA, 18 bp, synthetic construct
  source 1..18: mol_type = other DNA
taaagagattcactatag

SEQ ID NO: 30352 - DNA, 18 bp, synthetic construct
  source 1..18: mol_type = other DNA
taaagcgactcattttag

SEQ ID NO: 30353 - DNA, 18 bp, synthetic construct
  source 1..18: mol_type = other DNA
taacaaaactaactatag

SEQ ID NO: 30354 - DNA, 18 bp, synthetic construct
  source 1..18: mol_type = other DNA
taacacaactcaaaatag

SEQ ID NO: 30355 - DNA, 18 bp, synthetic construct
  source 1..18: mol_type = other DNA
taacacaactcaccatcg

SEQ ID NO: 30356 - DNA, 18 bp, synthetic construct
  source 1..18: mol_type = other DNA
taacacgaatctctttag

SEQ ID NO: 30357 - DNA, 18 bp, synthetic construct
  source 1..18: mol_type = other DNA
taacacgagtctcaatag

SEQ ID NO: 30358 - DNA, 18 bp, synthetic construct
  source 1..18: mol_type = other DNA
taacacgtcactctatag

SEQ ID NO: 30359 - DNA, 18 bp, synthetic construct
  source 1..18: mol_type = other DNA
taacacgtttcattatag

SEQ ID NO: 30360 - DNA, 18 bp, synthetic construct
  source 1..18: mol_type = other DNA
taacacgtttctctatag

SEQ ID NO: 30361 - DNA, 18 bp, synthetic construct
  source 1..18: mol_type = other DNA
taacatgactcactttcg

SEQ ID NO: 30362 - DNA, 18 bp, synthetic construct
  source 1..18: mol_type = other DNA
taacgcgactcattttag

SEQ ID NO: 30363 - DNA, 18 bp, synthetic construct
  source 1..18: mol_type = other DNA
taaggctactcacaatag

SEQ ID NO: 30364 - DNA, 18 bp, synthetic construct
  source 1..18: mol_type = other DNA
taataacaccctctatag

SEQ ID NO: 30365 - DNA, 18 bp, synthetic construct
  source 1..18: mol_type = other DNA
taataagactcagtttcg

SEQ ID NO: 30366 - DNA, 18 bp, synthetic construct
  source 1..18: mol_type = other DNA
taataagtcacactctag

SEQ ID NO: 30367 - DNA, 18 bp, synthetic construct
  source 1..18: mol_type = other DNA
taatacaacacactttcg

SEQ ID NO: 30368 - DNA, 18 bp, synthetic construct
  source 1..18: mol_type = other DNA
taatacaactcattaacg

SEQ ID NO: 30369 - DNA, 18 bp, synthetic construct
  source 1..18: mol_type = other DNA
taatacaactctcaacag

SEQ ID NO: 30370 - DNA, 18 bp, synthetic construct
  source 1..18: mol_type = other DNA
taatacaactctcttaag

SEQ ID NO: 30371 - DNA, 18 bp, synthetic construct
  source 1..18: mol_type = other DNA
taatacaacttacaatgg

SEQ ID NO: 30372 - DNA, 18 bp, synthetic construct
  source 1..18: mol_type = other DNA
taatacaagtcagcatag

SEQ ID NO: 30373 - DNA, 18 bp, synthetic construct
  source 1..18: mol_type = other DNA
taatacaattaactaaag

SEQ ID NO: 30374 - DNA, 18 bp, synthetic construct
  source 1..18: mol_type = other DNA
taatacagcacacaatag

SEQ ID NO: 30375 - DNA, 18 bp, synthetic construct
  source 1..18: mol_type = other DNA
taatacatctcaacatag

SEQ ID NO: 30376 - DNA, 18 bp, synthetic construct
  source 1..18: mol_type = other DNA
taataccaatcactctcg

SEQ ID NO: 30377 - DNA, 18 bp, synthetic construct
  source 1..18: mol_type = other DNA
taataccactctataaag

SEQ ID NO: 30378 - DNA, 18 bp, synthetic construct
  source 1..18: mol_type = other DNA
taatacgacacatgacag

SEQ ID NO: 30379 - DNA, 18 bp, synthetic construct
  source 1..18: mol_type = other DNA
taatacgaccctcaacag

SEQ ID NO: 30380 - DNA, 18 bp, synthetic construct
  source 1..18: mol_type = other DNA
taatacgactatctcaag

SEQ ID NO: 30381 - DNA, 18 bp, synthetic construct
  source 1..18: mol_type = other DNA
taatacgactatgaatag

SEQ ID NO: 30382 - DNA, 18 bp, synthetic construct
  source 1..18: mol_type = other DNA
taatacgactcttttcag

SEQ ID NO: 30383 - DNA, 18 bp, synthetic construct
  source 1..18: mol_type = other DNA
taatacgactttacatag

SEQ ID NO: 30384 - DNA, 18 bp, synthetic construct
  source 1..18: mol_type = other DNA
taatacgatccacttaag

SEQ ID NO: 30385 - DNA, 18 bp, synthetic construct
  source 1..18: mol_type = other DNA
taatacgattccctttcg

SEQ ID NO: 30386 - DNA, 18 bp, synthetic construct
  source 1..18: mol_type = other DNA
taatacgatttaccaaag

SEQ ID NO: 30387 - DNA, 18 bp, synthetic construct
  source 1..18: mol_type = other DNA
taatacgcatcacaaaag

SEQ ID NO: 30388 - DNA, 18 bp, synthetic construct
  source 1..18: mol_type = other DNA
taatacgcctctataaag

SEQ ID NO: 30389 - DNA, 18 bp, synthetic construct
  source 1..18: mol_type = other DNA
taatacgctaccctatag

SEQ ID NO: 30390 - DNA, 18 bp, synthetic construct
  source 1..18: mol_type = other DNA
taatacgcttcaatatcg

SEQ ID NO: 30391 - DNA, 18 bp, synthetic construct
  source 1..18: mol_type = other DNA
taatacgtataacaatag

SEQ ID NO: 30392 - DNA, 18 bp, synthetic construct
  source 1..18: mol_type = other DNA
taatacgtctcccattag

SEQ ID NO: 30393 - DNA, 18 bp, synthetic construct
  source 1..18: mol_type = other DNA
taatacgtttcataatag

SEQ ID NO: 30394 - DNA, 18 bp, synthetic construct
  source 1..18: mol_type = other DNA
taatacgtttctttatag

SEQ ID NO: 30395 - DNA, 18 bp, synthetic construct
  source 1..18: mol_type = other DNA
taatactacccacttaag

SEQ ID NO: 30396 - DNA, 18 bp, synthetic construct
  source 1..18: mol_type = other DNA
taatactactctctaggg

SEQ ID NO: 30397 - DNA, 18 bp, synthetic construct
  source 1..18: mol_type = other DNA
taatactacttactttcg

SEQ ID NO: 30398 - DNA, 18 bp, synthetic construct
  source 1..18: mol_type = other DNA
taatactccttacaatag

SEQ ID NO: 30399 - DNA, 18 bp, synthetic construct
  source 1..18: mol_type = other DNA
taatacttctctccatag

SEQ ID NO: 30400 - DNA, 18 bp, synthetic construct
  source 1..18: mol_type = other DNA
taatagatctaactatag

SEQ ID NO: 30401 - DNA, 18 bp, synthetic construct
  source 1..18: mol_type = other DNA
taataggactaacattag

SEQ ID NO: 30402 - DNA, 18 bp, synthetic construct
  source 1..18: mol_type = other DNA
taataggactctatttag

SEQ ID NO: 30403 - DNA, 18 bp, synthetic construct
  source 1..18: mol_type = other DNA
taataggactttctaaag

SEQ ID NO: 30404 - DNA, 18 bp, synthetic construct
  source 1..18: mol_type = other DNA
taataggtcatactatag

SEQ ID NO: 30405 - DNA, 18 bp, synthetic construct
  source 1..18: mol_type = other DNA
taatatcactcactaagg

SEQ ID NO: 30406 - DNA, 18 bp, synthetic construct
  source 1..18: mol_type = other DNA
taatatcactcataatag

SEQ ID NO: 30407 - DNA, 18 bp, synthetic construct
  source 1..18: mol_type = other DNA
taatatgaatcagaatag

SEQ ID NO: 30408 - DNA, 18 bp, synthetic construct
  source 1..18: mol_type = other DNA
taatatgacacacttaag

SEQ ID NO: 30409 - DNA, 18 bp, synthetic construct
  source 1..18: mol_type = other DNA
taatatgagtctcaatag

SEQ ID NO: 30410 - DNA, 18 bp, synthetic construct
  source 1..18: mol_type = other DNA
taatatgatccagtatag

SEQ ID NO: 30411 - DNA, 18 bp, synthetic construct
  source 1..18: mol_type = other DNA
taatatgattcccaatag

SEQ ID NO: 30412 - DNA, 18 bp, synthetic construct
  source 1..18: mol_type = other DNA
taatatgcatcactaaag

SEQ ID NO: 30413 - DNA, 18 bp, synthetic construct
  source 1..18: mol_type = other DNA
taatatgccacacaatag

SEQ ID NO: 30414 - DNA, 18 bp, synthetic construct
  source 1..18: mol_type = other DNA
taatatgttccactatag

SEQ ID NO: 30415 - DNA, 18 bp, synthetic construct
  source 1..18: mol_type = other DNA
taatatttctaactatag

SEQ ID NO: 30416 - DNA, 18 bp, synthetic construct
  source 1..18: mol_type = other DNA
taatcaaattcactatag

SEQ ID NO: 30417 - DNA, 18 bp, synthetic construct
  source 1..18: mol_type = other DNA
taatcagcctcactaaag

SEQ ID NO: 30418 - DNA, 18 bp, synthetic construct
  source 1..18: mol_type = other DNA
taatccgacgcaggatag

SEQ ID NO: 30419 - DNA, 18 bp, synthetic construct
  source 1..18: mol_type = other DNA
taatccgtcacactatcg

SEQ ID NO: 30420 - DNA, 18 bp, synthetic construct
  source 1..18: mol_type = other DNA
taatctcactctctatag

SEQ ID NO: 30421 - DNA, 18 bp, synthetic construct
  source 1..18: mol_type = other DNA
taatgcttctcaatatag

SEQ ID NO: 30422 - DNA, 18 bp, synthetic construct
  source 1..18: mol_type = other DNA
taatgtgattcaccatag

SEQ ID NO: 30423 - DNA, 18 bp, synthetic construct
  source 1..18: mol_type = other DNA
tacaacgacttactttag

SEQ ID NO: 30424 - DNA, 18 bp, synthetic construct
  source 1..18: mol_type = other DNA
tacaactacacactatag

SEQ ID NO: 30425 - DNA, 18 bp, synthetic construct
  source 1..18: mol_type = other DNA
tactacaactcaatttag

SEQ ID NO: 30426 - DNA, 18 bp, synthetic construct
  source 1..18: mol_type = other DNA
tactacaactcacattag

SEQ ID NO: 30427 - DNA, 18 bp, synthetic construct
  source 1..18: mol_type = other DNA
tactacgagacactgtag

SEQ ID NO: 30428 - DNA, 18 bp, synthetic construct
  source 1..18: mol_type = other DNA
tactacgtttcactatcg

SEQ ID NO: 30429 - DNA, 18 bp, synthetic construct
  source 1..18: mol_type = other DNA
tactaggactaactttag

SEQ ID NO: 30430 - DNA, 18 bp, synthetic construct
  source 1..18: mol_type = other DNA
tactatgactctctaaag

SEQ ID NO: 30431 - DNA, 18 bp, synthetic construct
  source 1..18: mol_type = other DNA
tagtacaacacattatag

SEQ ID NO: 30432 - DNA, 18 bp, synthetic construct
  source 1..18: mol_type = other DNA
tagtacgacacattttag

SEQ ID NO: 30433 - DNA, 18 bp, synthetic construct
  source 1..18: mol_type = other DNA
tagtacgactctaaatag

SEQ ID NO: 30434 - DNA, 18 bp, synthetic construct
  source 1..18: mol_type = other DNA
tagtatgactctcaatag

SEQ ID NO: 30435 - DNA, 18 bp, synthetic construct
  source 1..18: mol_type = other DNA
tataacgaatctctatag

SEQ ID NO: 30436 - DNA, 18 bp, synthetic construct
  source 1..18: mol_type = other DNA
tataacgacatactatag

SEQ ID NO: 30437 - DNA, 18 bp, synthetic construct
  source 1..18: mol_type = other DNA
tataacgtctcactctag

SEQ ID NO: 30438 - DNA, 18 bp, synthetic construct
  source 1..18: mol_type = other DNA
tataactacttactatag

SEQ ID NO: 30439 - DNA, 18 bp, synthetic construct
  source 1..18: mol_type = other DNA
tatcacgacacactttag

SEQ ID NO: 30440 - DNA, 18 bp, synthetic construct
  source 1..18: mol_type = other DNA
tatcacgactaactaaag

SEQ ID NO: 30441 - DNA, 18 bp, synthetic construct
  source 1..18: mol_type = other DNA
tatcacgacttactaaag

SEQ ID NO: 30442 - DNA, 18 bp, synthetic construct
  source 1..18: mol_type = other DNA
tattaagagtcactaaag

SEQ ID NO: 30443 - DNA, 18 bp, synthetic construct
  source 1..18: mol_type = other DNA
tattaagtcccactatag

SEQ ID NO: 30444 - DNA, 18 bp, synthetic construct
  source 1..18: mol_type = other DNA
tattaatactcactatcg

SEQ ID NO: 30445 - DNA, 18 bp, synthetic construct
  source 1..18: mol_type = other DNA
tattacaattcacgatag

SEQ ID NO: 30446 - DNA, 18 bp, synthetic construct
  source 1..18: mol_type = other DNA
tattaccactccctaaag

SEQ ID NO: 30447 - DNA, 18 bp, synthetic construct
  source 1..18: mol_type = other DNA
tattacgaatcactacgg

SEQ ID NO: 30448 - DNA, 18 bp, synthetic construct
  source 1..18: mol_type = other DNA
tattacgactctcttgag

SEQ ID NO: 30449 - DNA, 18 bp, synthetic construct
  source 1..18: mol_type = other DNA
tattacgatacactaaag

SEQ ID NO: 30450 - DNA, 18 bp, synthetic construct
  source 1..18: mol_type = other DNA
tattacgattcaccttag

SEQ ID NO: 30451 - DNA, 18 bp, synthetic construct
  source 1..18: mol_type = other DNA
tattacgccttattatag

SEQ ID NO: 30452 - DNA, 18 bp, synthetic construct
  source 1..18: mol_type = other DNA
tattacgtatgactatag

SEQ ID NO: 30453 - DNA, 18 bp, synthetic construct
  source 1..18: mol_type = other DNA
tattacgtctcacgctag

SEQ ID NO: 30454 - DNA, 18 bp, synthetic construct
  source 1..18: mol_type = other DNA
tattacgtcttactgtag

SEQ ID NO: 30455 - DNA, 18 bp, synthetic construct
  source 1..18: mol_type = other DNA
tattactactaactacag

SEQ ID NO: 30456 - DNA, 18 bp, synthetic construct
  source 1..18: mol_type = other DNA
tattactactcagtatcg

SEQ ID NO: 30457 - DNA, 18 bp, synthetic construct
  source 1..18: mol_type = other DNA
tattatgactctatatag

SEQ ID NO: 30458 - DNA, 18 bp, synthetic construct
  source 1..18: mol_type = other DNA
tattatgacttcctatag

SEQ ID NO: 30459 - DNA, 18 bp, synthetic construct
  source 1..18: mol_type = other DNA
tattatgtcacactatag

SEQ ID NO: 30460 - DNA, 18 bp, synthetic construct
  source 1..18: mol_type = other DNA
tattgccactcactttag

SEQ ID NO: 30461 - DNA, 18 bp, synthetic construct
  source 1..18: mol_type = other DNA
tcaaacgtctcattatag

SEQ ID NO: 30462 - DNA, 18 bp, synthetic construct
  source 1..18: mol_type = other DNA
tcataagacacacaatag

SEQ ID NO: 30463 - DNA, 18 bp, synthetic construct
  source 1..18: mol_type = other DNA
tcataagaccccctatag

SEQ ID NO: 30464 - DNA, 18 bp, synthetic construct
  source 1..18: mol_type = other DNA
tcatacgaatcacgaaag

SEQ ID NO: 30465 - DNA, 18 bp, synthetic construct
  source 1..18: mol_type = other DNA
tcatacgactaacaatcg

SEQ ID NO: 30466 - DNA, 18 bp, synthetic construct
  source 1..18: mol_type = other DNA
tcatacgtctcacaaaag

SEQ ID NO: 30467 - DNA, 18 bp, synthetic construct
  source 1..18: mol_type = other DNA
tcatactactcacactag

SEQ ID NO: 30468 - DNA, 18 bp, synthetic construct
  source 1..18: mol_type = other DNA
tcatacttctcacaatag

SEQ ID NO: 30469 - DNA, 18 bp, synthetic construct
  source 1..18: mol_type = other DNA
tgaaacgtctcactacag

SEQ ID NO: 30470 - DNA, 18 bp, synthetic construct
  source 1..18: mol_type = other DNA
tgacacgagtctctatag

SEQ ID NO: 30471 - DNA, 18 bp, synthetic construct
  source 1..18: mol_type = other DNA
tgataaaacacactatag

SEQ ID NO: 30472 - DNA, 18 bp, synthetic construct
  source 1..18: mol_type = other DNA
tgataagactcacattag

SEQ ID NO: 30473 - DNA, 18 bp, synthetic construct
  source 1..18: mol_type = other DNA
tgatgcgactcaatttag

SEQ ID NO: 30474 - DNA, 18 bp, synthetic construct
  source 1..18: mol_type = other DNA
tgctacgactcacttaag

SEQ ID NO: 30475 - DNA, 18 bp, synthetic construct
  source 1..18: mol_type = other DNA
tgttacgactcaatatgg

SEQ ID NO: 30476 - DNA, 18 bp, synthetic construct
  source 1..18: mol_type = other DNA
tgttacgactctctttag

SEQ ID NO: 30477 - DNA, 18 bp, synthetic construct
  source 1..18: mol_type = other DNA
tgttacgtttcactatag

SEQ ID NO: 30478 - DNA, 18 bp, synthetic construct
  source 1..18: mol_type = other DNA
ttaaaagactctctatag

SEQ ID NO: 30479 - DNA, 18 bp, synthetic construct
  source 1..18: mol_type = other DNA
ttaaacgtctcagtatag

SEQ ID NO: 30480 - DNA, 18 bp, synthetic construct
  source 1..18: mol_type = other DNA
ttaaacgtttcactatag

SEQ ID NO: 30481 - DNA, 18 bp, synthetic construct
  source 1..18: mol_type = other DNA
ttaaagaactcactatag

SEQ ID NO: 30482 - DNA, 18 bp, synthetic construct
  source 1..18: mol_type = other DNA
ttacacgacttactaaag

SEQ ID NO: 30483 - DNA, 18 bp, synthetic construct
  source 1..18: mol_type = other DNA
ttataagacaaactatag

SEQ ID NO: 30484 - DNA, 18 bp, synthetic construct
  source 1..18: mol_type = other DNA
ttataagacttactatgg

SEQ ID NO: 30485 - DNA, 18 bp, synthetic construct
  source 1..18: mol_type = other DNA
ttataagactttctatag

SEQ ID NO: 30486 - DNA, 18 bp, synthetic construct
  source 1..18: mol_type = other DNA
ttatacaacccattatag

SEQ ID NO: 30487 - DNA, 18 bp, synthetic construct
  source 1..18: mol_type = other DNA
ttatacaactgaccatag

SEQ ID NO: 30488 - DNA, 18 bp, synthetic construct
  source 1..18: mol_type = other DNA
ttataccactaaatatag

SEQ ID NO: 30489 - DNA, 18 bp, synthetic construct
  source 1..18: mol_type = other DNA
ttatacgaatcactccag

SEQ ID NO: 30490 - DNA, 18 bp, synthetic construct
  source 1..18: mol_type = other DNA
ttatacgaatcataatag

SEQ ID NO: 30491 - DNA, 18 bp, synthetic construct
  source 1..18: mol_type = other DNA
ttatacgaatctttatag

SEQ ID NO: 30492 - DNA, 18 bp, synthetic construct
  source 1..18: mol_type = other DNA
ttatacgaatttctatag

SEQ ID NO: 30493 - DNA, 18 bp, synthetic construct
  source 1..18: mol_type = other DNA
ttatacgacacacgttag

SEQ ID NO: 30494 - DNA, 18 bp, synthetic construct
  source 1..18: mol_type = other DNA
ttatacgactcactcagg

SEQ ID NO: 30495 - DNA, 18 bp, synthetic construct
  source 1..18: mol_type = other DNA
ttatacgactctaaatag

SEQ ID NO: 30496 - DNA, 18 bp, synthetic construct
  source 1..18: mol_type = other DNA
ttatacgactctccatgg

SEQ ID NO: 30497 - DNA, 18 bp, synthetic construct
  source 1..18: mol_type = other DNA
ttatacgacttacaatcg

SEQ ID NO: 30498 - DNA, 18 bp, synthetic construct
  source 1..18: mol_type = other DNA
ttatacgacttagaatag

SEQ ID NO: 30499 - DNA, 18 bp, synthetic construct
  source 1..18: mol_type = other DNA
ttatacgcctccctctag

SEQ ID NO: 30500 - DNA, 18 bp, synthetic construct
  source 1..18: mol_type = other DNA
ttatacgcttcacaatag

SEQ ID NO: 30501 - DNA, 18 bp, synthetic construct
  source 1..18: mol_type = other DNA
ttatacgtatcaatatag

SEQ ID NO: 30502 - DNA, 18 bp, synthetic construct
  source 1..18: mol_type = other DNA
ttatacgtgtccctatag

SEQ ID NO: 30503 - DNA, 18 bp, synthetic construct
  source 1..18: mol_type = other DNA
ttatacttctcacgatag

SEQ ID NO: 30504 - DNA, 18 bp, synthetic construct
  source 1..18: mol_type = other DNA
ttatagctctcactatag

SEQ ID NO: 30505 - DNA, 18 bp, synthetic construct
  source 1..18: mol_type = other DNA
ttatatcattcactatag

SEQ ID NO: 30506 - DNA, 18 bp, synthetic construct
  source 1..18: mol_type = other DNA
ttatatgactaaatatag

SEQ ID NO: 30507 - DNA, 18 bp, synthetic construct
  source 1..18: mol_type = other DNA
ttatatgactctctatcg

SEQ ID NO: 30508 - DNA, 18 bp, synthetic construct
  source 1..18: mol_type = other DNA
ttatatgagtcagtatag

SEQ ID NO: 30509 - DNA, 18 bp, synthetic construct
  source 1..18: mol_type = other DNA
ttatccgagtcactttag

SEQ ID NO: 30510 - DNA, 18 bp, synthetic construct
  source 1..18: mol_type = other DNA
ttatgcgtctcagtatag

SEQ ID NO: 30511 - DNA, 18 bp, synthetic construct
  source 1..18: mol_type = other DNA
ttctacaactcagtatag

SEQ ID NO: 30512 - DNA, 18 bp, synthetic construct
  source 1..18: mol_type = other DNA
ttctacgactcactcaag

SEQ ID NO: 30513 - DNA, 18 bp, synthetic construct
  source 1..18: mol_type = other DNA
ttctacgactctctttag

SEQ ID NO: 30514 - DNA, 18 bp, synthetic construct
  source 1..18: mol_type = other DNA
ttctactacacactatag

SEQ ID NO: 30515 - DNA, 18 bp, synthetic construct
  source 1..18: mol_type = other DNA
ttttaagactgactatag

SEQ ID NO: 30516 - DNA, 18 bp, synthetic construct
  source 1..18: mol_type = other DNA
ttttacgattcactacag

SEQ ID NO: 30517 - DNA, 18 bp, synthetic construct
  source 1..18: mol_type = other DNA
ttttacgcatcactatag

SEQ ID NO: 30518 - DNA, 18 bp, synthetic construct
  source 1..18: mol_type = other DNA
ttttacgtctcactctag

SEQ ID NO: 30519 - DNA, 18 bp, synthetic construct
  source 1..18: mol_type = other DNA
ttattcatctcactatag

SEQ ID NO: 30520 - DNA, 18 bp, synthetic construct
  source 1..18: mol_type = other DNA
tttaacgactcacaatag

SEQ ID NO: 30521 - DNA, 18 bp, synthetic construct
  source 1..18: mol_type = other DNA
aaatacgactcacatttg

SEQ ID NO: 30522 - DNA, 18 bp, synthetic construct
  source 1..18: mol_type = other DNA
taatacgactcacatctg

SEQ ID NO: 30523 - DNA, 18 bp, synthetic construct
  source 1..18: mol_type = other DNA
tattacgattcacaattg

SEQ ID NO: 30524 - DNA, 18 bp, synthetic construct
  source 1..18: mol_type = other DNA
ttataagactcacttttg

SEQ ID NO: 30525 - DNA, 18 bp, synthetic construct
  source 1..18: mol_type = other DNA
ttattcgactcacattag

SEQ ID NO: 30526 - DNA, 18 bp, synthetic construct
  source 1..18: mol_type = other DNA
aattacgactcacaattg

SEQ ID NO: 30527 - DNA, 18 bp, synthetic construct
  source 1..18: mol_type = other DNA
taaagcgactcacaattg

SEQ ID NO: 30528 - DNA, 18 bp, synthetic construct
  source 1..18: mol_type = other DNA
taatacgaatcaattttg

SEQ ID NO: 30529 - DNA, 18 bp, synthetic construct
  source 1..18: mol_type = other DNA
taattagattcactttag

SEQ ID NO: 30530 - DNA, 18 bp, synthetic construct
  source 1..18: mol_type = other DNA
taattcgacttaatttag

SEQ ID NO: 30531 - DNA, 18 bp, synthetic construct
  source 1..18: mol_type = other DNA
taattttactctctatag

SEQ ID NO: 30532 - DNA, 18 bp, synthetic construct
  source 1..18: mol_type = other DNA
tattacgaatcaatattg

SEQ ID NO: 30533 - DNA, 18 bp, synthetic construct
  source 1..18: mol_type = other DNA
tatttcttctcactatag

SEQ ID NO: 30534 - DNA, 18 bp, synthetic construct
  source 1..18: mol_type = other DNA
ttatactactcactcttg

SEQ ID NO: 30535 - DNA, 18 bp, synthetic construct
  source 1..18: mol_type = other DNA
aaatacgactcatttaag

SEQ ID NO: 30536 - DNA, 18 bp, synthetic construct
  source 1..18: mol_type = other DNA
atatacgattctctatag

SEQ ID NO: 30537 - DNA, 18 bp, synthetic construct
  source 1..18: mol_type = other DNA
taaaacgacacaccaaag

SEQ ID NO: 30538 - DNA, 18 bp, synthetic construct
  source 1..18: mol_type = other DNA
taaaacgactctttacag

SEQ ID NO: 30539 - DNA, 18 bp, synthetic construct
  source 1..18: mol_type = other DNA
taataagactctcaaaag

SEQ ID NO: 30540 - DNA, 18 bp, synthetic construct
  source 1..18: mol_type = other DNA
taatacaactatctaaag

SEQ ID NO: 30541 - DNA, 18 bp, synthetic construct
  source 1..18: mol_type = other DNA
taatacctctcacaaaag

SEQ ID NO: 30542 - DNA, 18 bp, synthetic construct
  source 1..18: mol_type = other DNA
taatacgtcaatctatag

SEQ ID NO: 30543 - DNA, 18 bp, synthetic construct
  source 1..18: mol_type = other DNA
taatacgtcactttatag

SEQ ID NO: 30544 - DNA, 18 bp, synthetic construct
  source 1..18: mol_type = other DNA
taatacttctctcaatag

SEQ ID NO: 30545 - DNA, 18 bp, synthetic construct
  source 1..18: mol_type = other DNA
tattacgaaacaatatag

SEQ ID NO: 30546 - DNA, 18 bp, synthetic construct
  source 1..18: mol_type = other DNA
tattacgactcactgtcc

SEQ ID NO: 30547 - DNA, 18 bp, synthetic construct
  source 1..18: mol_type = other DNA
tattatgactcacttcag

SEQ ID NO: 30548 - DNA, 18 bp, synthetic construct
  source 1..18: mol_type = other DNA
ttatacgattccctttag

SEQ ID NO: 30549 - DNA, 18 bp, synthetic construct
  source 1..18: mol_type = other DNA
ttatacgattctttatag

SEQ ID NO: 30550 - DNA, 18 bp, synthetic construct
  source 1..18: mol_type = other DNA
ttatatgactcattttag

SEQ ID NO: 30551 - DNA, 18 bp, synthetic construct
  source 1..18: mol_type = other DNA
tatatcgactctctatag

SEQ ID NO: 30552 - DNA, 18 bp, synthetic construct
  source 1..18: mol_type = other DNA
aaatacgtctcacaattg

SEQ ID NO: 30553 - DNA, 18 bp, synthetic construct
  source 1..18: mol_type = other DNA
tatttcgactaacaatag

SEQ ID NO: 30554 - DNA, 18 bp, synthetic construct
  source 1..18: mol_type = other DNA
aattacgactcacaaaag

SEQ ID NO: 30555 - DNA, 18 bp, synthetic construct
  source 1..18: mol_type = other DNA
ataaacgtctcactatag

SEQ ID NO: 30556 - DNA, 18 bp, synthetic construct
  source 1..18: mol_type = other DNA
atatacgacttactttag

SEQ ID NO: 30557 - DNA, 18 bp, synthetic construct
  source 1..18: mol_type = other DNA
taaaacgtctctctttag

SEQ ID NO: 30558 - DNA, 18 bp, synthetic construct
  source 1..18: mol_type = other DNA
taatacgtcactatatag

SEQ ID NO: 30559 - DNA, 18 bp, synthetic construct
  source 1..18: mol_type = other DNA
tataacgtctcacaatag

SEQ ID NO: 30560 - DNA, 18 bp, synthetic construct
  source 1..18: mol_type = other DNA
ttattcgtctctctatag

SEQ ID NO: 30561 - DNA, 18 bp, synthetic construct
  source 1..18: mol_type = other DNA
aaatactactcactaatg

SEQ ID NO: 30562 - DNA, 18 bp, synthetic construct
  source 1..18: mol_type = other DNA
taatacgtctcacaaatg

SEQ ID NO: 30563 - DNA, 18 bp, synthetic construct
  source 1..18: mol_type = other DNA
taattcaactcacaaaag

SEQ ID NO: 30564 - DNA, 18 bp, synthetic construct
  source 1..18: mol_type = other DNA
tataaggactcactattg

SEQ ID NO: 30565 - DNA, 18 bp, synthetic construct
  source 1..18: mol_type = other DNA
ttatactactctctattg

SEQ ID NO: 30566 - DNA, 18 bp, synthetic construct
  source 1..18: mol_type = other DNA
taatacatcacactttag

SEQ ID NO: 30567 - DNA, 18 bp, synthetic construct
  source 1..18: mol_type = other DNA
tattacgactctatttag

SEQ ID NO: 30568 - DNA, 18 bp, synthetic construct
  source 1..18: mol_type = other DNA
ttcaacgactcacaatag

SEQ ID NO: 30569 - DNA, 18 bp, synthetic construct
  source 1..18: mol_type = other DNA
aaattcgactcattattg

SEQ ID NO: 30570 - DNA, 18 bp, synthetic construct
  source 1..18: mol_type = other DNA
ccattcgactcactattg

SEQ ID NO: 30571 - DNA, 18 bp, synthetic construct
  source 1..18: mol_type = other DNA
taatgcgactcgatattg

SEQ ID NO: 30572 - DNA, 18 bp, synthetic construct
  source 1..18: mol_type = other DNA
taattccactcgcaatag

SEQ ID NO: 30573 - DNA, 18 bp, synthetic construct
  source 1..18: mol_type = other DNA
taattcgacaagctatag

SEQ ID NO: 30574 - DNA, 18 bp, synthetic construct
  source 1..18: mol_type = other DNA
taattcgactcaattttg

SEQ ID NO: 30575 - DNA, 18 bp, synthetic construct
  source 1..18: mol_type = other DNA
taattcgtctcgatatag

SEQ ID NO: 30576 - DNA, 18 bp, synthetic construct
  source 1..18: mol_type = other DNA
ttattcgactcgctagag

SEQ ID NO: 30577 - DNA, 18 bp, synthetic construct
  source 1..18: mol_type = other DNA
aaataccacacactattg

SEQ ID NO: 30578 - DNA, 18 bp, synthetic construct
  source 1..18: mol_type = other DNA
aaattagacttactatag

SEQ ID NO: 30579 - DNA, 18 bp, synthetic construct
  source 1..18: mol_type = other DNA
aaattcaactcacaatag

SEQ ID NO: 30580 - DNA, 18 bp, synthetic construct
  source 1..18: mol_type = other DNA
aaattcgagtcaccatag

SEQ ID NO: 30581 - DNA, 18 bp, synthetic construct
  source 1..18: mol_type = other DNA
aaatttgactcactttag

SEQ ID NO: 30582 - DNA, 18 bp, synthetic construct
  source 1..18: mol_type = other DNA
aatgacgactcactattg

SEQ ID NO: 30583 - DNA, 18 bp, synthetic construct
  source 1..18: mol_type = other DNA
aatttcgactgactatag

SEQ ID NO: 30584 - DNA, 18 bp, synthetic construct
  source 1..18: mol_type = other DNA
caattcgactcattttag

SEQ ID NO: 30585 - DNA, 18 bp, synthetic construct
  source 1..18: mol_type = other DNA
caattggacacactatag

SEQ ID NO: 30586 - DNA, 18 bp, synthetic construct
  source 1..18: mol_type = other DNA
ctatacgactcagtattg

SEQ ID NO: 30587 - DNA, 18 bp, synthetic construct
  source 1..18: mol_type = other DNA
ctattcgactaactatag

SEQ ID NO: 30588 - DNA, 18 bp, synthetic construct
  source 1..18: mol_type = other DNA
ctctacgactcgctatag

SEQ ID NO: 30589 - DNA, 18 bp, synthetic construct
  source 1..18: mol_type = other DNA
taaaacagctcactattg

SEQ ID NO: 30590 - DNA, 18 bp, synthetic construct
  source 1..18: mol_type = other DNA
taaaacgacaaactattg

SEQ ID NO: 30591 - DNA, 18 bp, synthetic construct
  source 1..18: mol_type = other DNA
taaaacgactcaaaattg

SEQ ID NO: 30592 - DNA, 18 bp, synthetic construct
  source 1..18: mol_type = other DNA
taaagcgacacactattg

SEQ ID NO: 30593 - DNA, 18 bp, synthetic construct
  source 1..18: mol_type = other DNA
taaatcgactaactaaag

SEQ ID NO: 30594 - DNA, 18 bp, synthetic construct
  source 1..18: mol_type = other DNA
taaatcgactcaccttag

SEQ ID NO: 30595 - DNA, 18 bp, synthetic construct
  source 1..18: mol_type = other DNA
taaatctactcattatag

SEQ ID NO: 30596 - DNA, 18 bp, synthetic construct
  source 1..18: mol_type = other DNA
taacacgacacaatattg

SEQ ID NO: 30597 - DNA, 18 bp, synthetic construct
  source 1..18: mol_type = other DNA
taacacgactcaattttg

SEQ ID NO: 30598 - DNA, 18 bp, synthetic construct
  source 1..18: mol_type = other DNA
taacacgattctctattg

SEQ ID NO: 30599 - DNA, 18 bp, synthetic construct
  source 1..18: mol_type = other DNA
taacacgcctcattattg

SEQ ID NO: 30600 - DNA, 18 bp, synthetic construct
  source 1..18: mol_type = other DNA
taactcgacttactttag

SEQ ID NO: 30601 - DNA, 18 bp, synthetic construct
  source 1..18: mol_type = other DNA
taataacactccctattg

SEQ ID NO: 30602 - DNA, 18 bp, synthetic construct
  source 1..18: mol_type = other DNA
taataagaattactattg

SEQ ID NO: 30603 - DNA, 18 bp, synthetic construct
  source 1..18: mol_type = other DNA
taataagactctatattg

SEQ ID NO: 30604 - DNA, 18 bp, synthetic construct
  source 1..18: mol_type = other DNA
taataagtctcgctaaag

SEQ ID NO: 30605 - DNA, 18 bp, synthetic construct
  source 1..18: mol_type = other DNA
taataatactaactattg

SEQ ID NO: 30606 - DNA, 18 bp, synthetic construct
  source 1..18: mol_type = other DNA
taatacaaatcactaatg

SEQ ID NO: 30607 - DNA, 18 bp, synthetic construct
  source 1..18: mol_type = other DNA
taataccaatctctattg

SEQ ID NO: 30608 - DNA, 18 bp, synthetic construct
  source 1..18: mol_type = other DNA
taatacgacacaataatg

SEQ ID NO: 30609 - DNA, 18 bp, synthetic construct
  source 1..18: mol_type = other DNA
taatacgacagacttttg

SEQ ID NO: 30610 - DNA, 18 bp, synthetic construct
  source 1..18: mol_type = other DNA
taatacgacctgctgtag

SEQ ID NO: 30611 - DNA, 18 bp, synthetic construct
  source 1..18: mol_type = other DNA
taatacgactaataattg

SEQ ID NO: 30612 - DNA, 18 bp, synthetic construct
  source 1..18: mol_type = other DNA
taatacgactcatttctg

SEQ ID NO: 30613 - DNA, 18 bp, synthetic construct
  source 1..18: mol_type = other DNA
taatacgactcgtaaaag

SEQ ID NO: 30614 - DNA, 18 bp, synthetic construct
  source 1..18: mol_type = other DNA
taatacgactctgcattg

SEQ ID NO: 30615 - DNA, 18 bp, synthetic construct
  source 1..18: mol_type = other DNA
taatacgactttctagtg

SEQ ID NO: 30616 - DNA, 18 bp, synthetic construct
  source 1..18: mol_type = other DNA
taatacgactttctcttg

SEQ ID NO: 30617 - DNA, 18 bp, synthetic construct
  source 1..18: mol_type = other DNA
taatacgagtcataattg

SEQ ID NO: 30618 - DNA, 18 bp, synthetic construct
  source 1..18: mol_type = other DNA
taatacgattcacgaatg

SEQ ID NO: 30619 - DNA, 18 bp, synthetic construct
  source 1..18: mol_type = other DNA
taatacgtcacgctgtag

SEQ ID NO: 30620 - DNA, 18 bp, synthetic construct
  source 1..18: mol_type = other DNA
taatacgtttagctatag

SEQ ID NO: 30621 - DNA, 18 bp, synthetic construct
  source 1..18: mol_type = other DNA
taatatgactcaccgttg

SEQ ID NO: 30622 - DNA, 18 bp, synthetic construct
  source 1..18: mol_type = other DNA
taatccaactcacttttg

SEQ ID NO: 30623 - DNA, 18 bp, synthetic construct
  source 1..18: mol_type = other DNA
taatcccactcacttttg

SEQ ID NO: 30624 - DNA, 18 bp, synthetic construct
  source 1..18: mol_type = other DNA
taatctgactcacttttg

SEQ ID NO: 30625 - DNA, 18 bp, synthetic construct
  source 1..18: mol_type = other DNA
taatgcgtctaactattg

SEQ ID NO: 30626 - DNA, 18 bp, synthetic construct
  source 1..18: mol_type = other DNA
taattaaactctctatag

SEQ ID NO: 30627 - DNA, 18 bp, synthetic construct
  source 1..18: mol_type = other DNA
taattagattcacaatag

SEQ ID NO: 30628 - DNA, 18 bp, synthetic construct
  source 1..18: mol_type = other DNA
taattcaactcaccatgg

SEQ ID NO: 30629 - DNA, 18 bp, synthetic construct
  source 1..18: mol_type = other DNA
taattcaactcataatag

SEQ ID NO: 30630 - DNA, 18 bp, synthetic construct
  source 1..18: mol_type = other DNA
taattcaagtcactttag

SEQ ID NO: 30631 - DNA, 18 bp, synthetic construct
  source 1..18: mol_type = other DNA
taattcaatacactatag

SEQ ID NO: 30632 - DNA, 18 bp, synthetic construct
  source 1..18: mol_type = other DNA
taattcaattcactttag

SEQ ID NO: 30633 - DNA, 18 bp, synthetic construct
  source 1..18: mol_type = other DNA
taattccaatcagtatag

SEQ ID NO: 30634 - DNA, 18 bp, synthetic construct
  source 1..18: mol_type = other DNA
taattcgacatactagag

SEQ ID NO: 30635 - DNA, 18 bp, synthetic construct
  source 1..18: mol_type = other DNA
taattcgacttactaacg

SEQ ID NO: 30636 - DNA, 18 bp, synthetic construct
  source 1..18: mol_type = other DNA
taattcggctaactttag

SEQ ID NO: 30637 - DNA, 18 bp, synthetic construct
  source 1..18: mol_type = other DNA
taattcgtctgactatcg

SEQ ID NO: 30638 - DNA, 18 bp, synthetic construct
  source 1..18: mol_type = other DNA
taattctactcaccttag

SEQ ID NO: 30639 - DNA, 18 bp, synthetic construct
  source 1..18: mol_type = other DNA
taattggactttctatag

SEQ ID NO: 30640 - DNA, 18 bp, synthetic construct
  source 1..18: mol_type = other DNA
taattggagtcactttag

SEQ ID NO: 30641 - DNA, 18 bp, synthetic construct
  source 1..18: mol_type = other DNA
taattggattcactaaag

SEQ ID NO: 30642 - DNA, 18 bp, synthetic construct
  source 1..18: mol_type = other DNA
taattggtctcacaatag

SEQ ID NO: 30643 - DNA, 18 bp, synthetic construct
  source 1..18: mol_type = other DNA
taatttgactcaccaaag

SEQ ID NO: 30644 - DNA, 18 bp, synthetic construct
  source 1..18: mol_type = other DNA
taatttgattcacaatag

SEQ ID NO: 30645 - DNA, 18 bp, synthetic construct
  source 1..18: mol_type = other DNA
tacaacgactctctattg

SEQ ID NO: 30646 - DNA, 18 bp, synthetic construct
  source 1..18: mol_type = other DNA
tactaagtctcactattg

SEQ ID NO: 30647 - DNA, 18 bp, synthetic construct
  source 1..18: mol_type = other DNA
tagaacgactcactaatg

SEQ ID NO: 30648 - DNA, 18 bp, synthetic construct
  source 1..18: mol_type = other DNA
tagttcgtctcactatgg

SEQ ID NO: 30649 - DNA, 18 bp, synthetic construct
  source 1..18: mol_type = other DNA
tagtttgactcacaatag

SEQ ID NO: 30650 - DNA, 18 bp, synthetic construct
  source 1..18: mol_type = other DNA
tataccgactcactattg

SEQ ID NO: 30651 - DNA, 18 bp, synthetic construct
  source 1..18: mol_type = other DNA
tatatcgactcagtatag

SEQ ID NO: 30652 - DNA, 18 bp, synthetic construct
  source 1..18: mol_type = other DNA
tattgcgattcactattg

SEQ ID NO: 30653 - DNA, 18 bp, synthetic construct
  source 1..18: mol_type = other DNA
tatttagactcaatatag

SEQ ID NO: 30654 - DNA, 18 bp, synthetic construct
  source 1..18: mol_type = other DNA
tatttcgactcaataaag

SEQ ID NO: 30655 - DNA, 18 bp, synthetic construct
  source 1..18: mol_type = other DNA
tcaaacaactcactattg

SEQ ID NO: 30656 - DNA, 18 bp, synthetic construct
  source 1..18: mol_type = other DNA
tcatattactcactattg

SEQ ID NO: 30657 - DNA, 18 bp, synthetic construct
  source 1..18: mol_type = other DNA
tcattcgacacactaaag

SEQ ID NO: 30658 - DNA, 18 bp, synthetic construct
  source 1..18: mol_type = other DNA
tcattcgtctcactatcg

SEQ ID NO: 30659 - DNA, 18 bp, synthetic construct
  source 1..18: mol_type = other DNA
tcatttgactcaatatag

SEQ ID NO: 30660 - DNA, 18 bp, synthetic construct
  source 1..18: mol_type = other DNA
tgatacgtcacactattg

SEQ ID NO: 30661 - DNA, 18 bp, synthetic construct
  source 1..18: mol_type = other DNA
tgatacgtctcacttttg

SEQ ID NO: 30662 - DNA, 18 bp, synthetic construct
  source 1..18: mol_type = other DNA
tgattcttctcactatag

SEQ ID NO: 30663 - DNA, 18 bp, synthetic construct
  source 1..18: mol_type = other DNA
tgtatcgactcactatag

SEQ ID NO: 30664 - DNA, 18 bp, synthetic construct
  source 1..18: mol_type = other DNA
ttaaacgactagctatag

SEQ ID NO: 30665 - DNA, 18 bp, synthetic construct
  source 1..18: mol_type = other DNA
ttactcgactcacaatag

SEQ ID NO: 30666 - DNA, 18 bp, synthetic construct
  source 1..18: mol_type = other DNA
ttagtcgaatcactatag

SEQ ID NO: 30667 - DNA, 18 bp, synthetic construct
  source 1..18: mol_type = other DNA
ttataagactctctattg

SEQ ID NO: 30668 - DNA, 18 bp, synthetic construct
  source 1..18: mol_type = other DNA
ttatacgattaactattg

SEQ ID NO: 30669 - DNA, 18 bp, synthetic construct
  source 1..18: mol_type = other DNA
ttatacgattcacaattg

SEQ ID NO: 30670 - DNA, 18 bp, synthetic construct
  source 1..18: mol_type = other DNA
ttatactactcgcaatag

SEQ ID NO: 30671 - DNA, 18 bp, synthetic construct
  source 1..18: mol_type = other DNA
ttattcaactcaatatag

SEQ ID NO: 30672 - DNA, 18 bp, synthetic construct
  source 1..18: mol_type = other DNA
ttattcgactcattctag

SEQ ID NO: 30673 - DNA, 18 bp, synthetic construct
  source 1..18: mol_type = other DNA
ttattcgactctctatgg

(The sequence listing continues in the following parts.)

What is claimed is:

1. A polynucleotide comprising a mutant T7 RNA polymerase promoter comprising a sequence of any one of SEQ ID NOs: 10-73473.

2. The polynucleotide of claim 1, wherein the promoter is operably linked to a sequence encoding an RNA molecule.

3. The polynucleotide of claim 2, wherein the RNA molecule encodes a protein.

4. The polynucleotide of claim 2, wherein the RNA molecule is a non-coding RNA molecule.

5. The polynucleotide of claim 2, wherein the RNA molecule is an mRNA, a rRNA, a tRNA, a guide RNA, or a micro RNA.

6. The polynucleotide of claim 2, wherein the promotor drives increased expression of the RNA molecule compared to a wild-type T7 RNA polymerase promoter.

7. A DNA plasmid comprising the polynucleotide of claim 2.

8. An expression cassette comprising the polynucleotide of claim 2.

9. A DNA plasmid comprising the expression cassette of claim 8.

10. A host cell comprising a polynucleotide of claim 2.

11. The host cell of claim 10, wherein the host cell is selected from an archael cell, a bacterial cell, an animal cell, a plant cell, or a fungal cell.

12. A method for producing an RNA polynucleotide of interest, comprising contacting a host cell with a polynucleotide of claim 2.

13. The method of claim 12, wherein the RNA molecule encodes a protein.

14. The method of claim 12, wherein the RNA molecule is a non-coding RNA molecule.

15. The method of claim 12, wherein the RNA molecule is selected from the group consisting of mRNA, rRNA, tRNA, guide RNA and micro RNA.

16. The method of claim 12, wherein the method is performed in vivo.

17. The method of claim 12, wherein the method is performed in vitro.

18. The method of claim 12, wherein the polynucleotide is a DNA plasmid.

* * * * *